United States Patent 8,877,916 (PROMOTER, PROMOTER CONTROL ELEMENTS, AND COMBINATIONS, AND USES THEREOF) - sequence listing, part 16

SEQ ID NO: 23667 - DNA, 3003 bp, Unknown
  misc_feature (1)..( 3003): 2750-1469P.txt file - cDNA_ID_2148429; gDNA_ID_1620475; Annot_ID_158137
acatggctctcaacatcccaaaggaacgacccgaaagtaactgcctccaagacgagcctcttcattccaccgaagctgatctttatctgttcgtccttcgatgaatcgactgtgccctccggtgttattacaatctcaggcttaccaaacaatgcctctgtgtgcttctcgatgattccaactgcttctcttgatcttatagtggcgtatctctgcagcgtctccgcatcaaatgacatcacatatgaccttaatcgggatggtttaatctcgctgccgaagcccttagcactaactccgcccgcaaatgcaccaacctctgggtgagacgatacagccgcctgatatgttgccgtcccctcggcttgctcaacgcttgttttactttcatccgacccacccggaagaatcttcatcgtcttctcaagctgaaacctttggtccaccctcttcaagaaatatccatacatcacagaagcagcgtaaacttggccaactctgagcttgcttatctgtgcaacagagttcagatcacccattctgcttccaagaatcaaggcaagatggttgtgaatcatctcgtacatctcgggcgagtgaagccgctcgagtttctccactttggtcggccaagtatcaacccgaccagacggatctgaagatgggcttactgaaggtacaagtgatacgttagcttccatgaacttttgaaccaccaatgcatacaaaatctcttccaatgttcttcttctctcgttttccttcaactccgcaattctcctaaacaccaacaaaacattactcattcagaatcaaactcatgtacaacttccaatctatcgtatatacaaacagataatgagtaatccttaaattttagttatcatttatctagacacagagaaaagttcacatcacgtctccttcacttaatatgtcaagcaagttttagtcttttagatcgaagatctatacctgtagagaacgatgtcggttccaggtacagacgctgaatctttgttctgtccctgagagtcccgatcagtttgaagctgctcaagctgctgttcaacagctgcaggcacaagatgaggatggctcaccaaaatctgagacagaaactgaccagcaggcgattgcagctggagcggagcgatcggtttgggggaagaaccagatgaagcatcattagacgctgaagaagctctaaccacaaaacttctccgagttttagcagtcgttgttaagctctgtaatgatcttgaggatctagcagacgcgttttgctgcaagtacataattttttttttagtttttgctgattacgaggaacttcctggtaaaatctgattgaacataaccggagcagaatatttggagaatgattcgattttgaattttgatcataaaagtaggttaattgaatcaagtacaagagatttgggacatacccttaaacgaagttgaagtcttgaagaaccagaacgcgtgaatccagggccactggcggtaaggaacatagatccagaaccgttgtcggaagttctcgatggtacgatgggagatcgaaccaaactcgaggtcaaggcatccatggttactctctgagggtgaaaataagagagaagtcgaagttttggtcggaggaaggagataagaagaaactttagactagcttgagagagagaaatgtcgagaatggcgatcgattgatattactggtaaacagactttggtttagttttcctgagaaataatgagagtcggatttgattatttataataataaatgaaaggactcagaaaattatatttttcgtttaaatattttgagaccatggaaattatttgaggccgtgtttatgttgtgtgttcttcgtttcgtttgtagtttgtacaataacgatattttaaaaaaaaaaagacgaattattctttttgtagcgtcattgaaatatcgaacacaataatatcactatctaattacctgaactagaaagttcgatagtaaaatccttgcagtccttaaaactctaaagtctaaaccaaatacttttctcttctgttttcttattcaatcaaaaactttttagaaattactggatgattaggtatatagtattttgccattttggtctaaaactttacatcatatttagttatttaccaatctagaatggtctctaggtttttaactttttaactttttaactttttttaactaatcttagaagcctactttacgcaaactaacgagaaaaagtagagtcaaactaacgaaggaagagaaacgttgagagccaccaactgatgttgtgtccattcccacttacacgtattatttatgaaacgttttgtttgttttgtgacgcatgggctctttaccccacttgggctcaagaatcgtatacactagaaaacaaccttaacctcacggtggatccgttacgttacgtgttcgcaatttccacgtagtcgacatataaattgagtaattctaaaactatccattttccgaaatttgttggtaaatcaagcattagttgatagagacagagaatcttaagttatatccactccgttggacaaaaaaaaattaaaaataactcaaggagataagatagagaagaaaataactgttaaatacattgattaaaactaaactaatatatttttaaatattatggattagggaagatgggtctattattatttgggtgattaatgtattattaactaattatgaactttaactaaaaacgtcaattattttcacgtggcatgaagttgaagaaccgaccaattattacaacacactcttctcttacatctctatcttcttaagttctttcctttgttcttcgatttgatcaccaactctcacatatttcgaaatcgtcacactttgttgcgtgtcgtcttctctctctcataattcttgagtttcacgtctcaagatttgatcacttctgccaattttccagattgatctctctaattatg

SEQ ID NO: 23668 - DNA, 3000 bp, Unknown; identical to SEQ ID NO: 1995
  misc_feature (1)..( 3000): 2750-1469P.txt file - cDNA_ID_2148441; gDNA_ID_1620475; Annot_ID_158141

SEQ ID NO: 23669 - DNA, 3003 bp, Unknown
  misc_feature (1)..( 3003): 2750-1469P.txt file - cDNA_ID_2148461; gDNA_ID_1620475; Annot_ID_158147
ttttagaagctattcaatgtccgctctgcctccaaacactgcaccagttactggacccataaaaacacagagctctaaaccatcatttgatattgaagattgggacagttactcaggccaaacggtacgaaacggtcagaagtctgggactgaagagctcttgtcttttcggggtgtcgcattggagcgggataggttttctgttcgttgtggactcgaaggcatctgcatccctggtagaaggtggaggaggaaactcgagatcattcaacctattgagataaactcttttgcagctgactgcaatacagatgatcttctctgcgttcagataaaggtttgtctctgcatctctgttaatttttggtgttattgtggtcaattttttttctgggatgcatcctaacttaccttttttactggcagaatgtggctcctacccatgctccagatattgtaatatacatagacgccataacaattgtttttgaagaagcagggaaaaatgcttccccttcttcagtaccaatagcatgcattgaagctggaaacgagcacagtttgccaaatttaactctcaggttagctttttttcttaaattcctcgtaattattttattttgtattgaaattctcccatcaatcttcttgataaaaattgatagatttagatatcagcattttgctttagtccagtaagtctcagaagtcttcagtgatgtccaatacaaaataacccataatattaggtaatcttgggtagtgaccaagaaaccatagaacaagttattgaatctaacaagtctctgagagtaactattctcaacaagcaccgtggtttggaggctaaaacagctagaataccctttcaggaacattatagactgcagttacccacccttaggttttcttgcaatctttcaggaaaggtgaggagcactcattcatcgtaaagcctgcgttttctgttgggagtaatctgaagccctctgctgcacgaaataaactcaaatcatcgagtttgtctcttccaactgtaaattttgaaagaaaagggagcggtttaagtggtgatcagtatgcggttatggtgtcatgtcggtgcaactacacaggtagatccacattaccgtggtttgtagccatgtttttttcttttgtccattcatatctatagctgtttcatcaatgctgttttatgttggactcagaatcaagactgtttttcaaacaacggacaaaatggagaccacgagtttcgagagacctgatgatctctgttgcgtctgaaatgtcaggagagccttgtggtccccatgggagagcctctcaactacccgttcaggtcattctctctctttatctctctctgacattccctagataataaatgggacaatgcatgaactaatggaaggagttcgcatctgcaagtgacagtgactgctagtgtttacccaaatgactgaaggtttaattagatgttgttgctaaattgtggttgcaaaagttgctaaaaactatgcaactctggcttcgtatatatgaataagaaaccatgcaacagttacaaagccacctatttgcaatgtggtcatattcttcaaaattagccaatttctaaatctgcaaataccaatcccaatggcatcttttattctacctcatactttttctctactggtttcagattttaactcttcaggcatcgaatttgacttcagaagatctatctttgaccgttctcgctcctgcatccttcacatcacctccaactgtagtgtccctaaactctacgcctacgacccctataagcccattcctaggattctctgatttcaccgagagagtacaaaacgagaaacgcaacactacagtgcgtaaacagcaatcgttacccccaattccactggagacaaggacagagaacaacacaaatggtgaatcttccaatccttcagatgttgttccaaagagcggcttaggttgcacacatctctggctacaaagtcgagttcccttagggtaaacatctgataataatatccaatgagcttctggtatgggtttaccattataaattgataacgatattcctaaatgcatcagatgcgttccttcgaaatctacggcgacaatcaagctagagctactccctttgactgatggcataatcactctggatactcttcagatccatgcaaaggagaaaggttagctaaaaaaatctctagtctctcagcaaagagactataaacactttgctgcgtcttctttctttccgtgaaaacatcagtggttccatatgaagaatgcaaatctcgaagctttaatatgttttggagtgaatcataatcataaaatgttagatgctcgtgtttaatgactgaaacaccaatgaacttgtgtgtgtgacaggtcgtagatacattccagagcagtcactgaagataaacgcaacttcaagcatttcctctgggattttctagtcttttacccaatgccacttttgcctttttctttagagccaagaagagtcatcaaacacagagcagttctatcttcagcatctccatagagactcatccaaagattgtgtgttgaaaaatcgattttggtttccatgtttcgaaggtttgaagaaaagttgttgtaataccccacttgtgctgaaccatgtgtttgcgttctttagcttgctttttgtaattgattgattctgaaattcgcatagagacagaagacgcaaccattgttatcgaatttacatttgttatttgcttataaaatcagataattaaccaaaacttttcttcaacaaatccaagtatggctaacaaatgaaggacaaaaagttaggtgcaccggagcttaatggtgcacccgaatgcaggggataacagctctacaaatctgaagccattttcacggtgaccccaaagtcgtcgtggaggcaaaaaccctttacctccgggatcaaaatcttggggagagacgaagatg

SEQ ID NO: 23670 - DNA, 3000 bp, Unknown
  misc_feature (1)..( 3000): 2750-1469P.txt file - cDNA_ID_2148469; gDNA_ID_1620475; Annot_ID_158149
acgtcggattagggagtttcttgatgagaggaaaaggaaagtgtttttgtggatggataggtgaagaagaagaaagtgacaaatgatttgctttttgaaatgattgtgcttctttaagctaaagtcctcttggccatctgttacactatttctttccatgtctcagagagctttgatatttttgataaatttgatttaattgtttctagttatgggaataatcaaaatcctttacagagacattttttttgtaaactttgggtaaaagctgagacatgttggatggtagcaaattaaaatttacgaaaagaggataaattacaacaaagtaagcttttataggtactattgattttttcataggatacctgaaaaagggtagagaaactacatctaaattcacgcgaatactctgttacgatcatgtatagagtttttttttggggtcaaactgaatatgtttagagtatattttatttattttcttgttatctgatgatatctttgtctttctcttattgtcaaaagcatataatccgacttatcaaattttttattttataactgactaatcaaatatttttttacttaaaatattattgataattagaaaattagatccaaattctacatttgttcttttctctaatctctatagttttggattttagttggtaacttttgaattcctgaaagtaaatttggtaacttttgggtagtaatttgattttcaaaaagtttagaaatgcattaaagtgtaaaaaacgaaaaacaaaaacccccaagataaatagttttttgtttggggggtaaaaatgataaatagtttgggatgtggatgacgtcaacattgatcagttacgagattacgattttataactcttttaaccaaagctaatcacttcaccctctgttttgtttctccccaatcaaaaatctcaatcccaatcacttcgcttctaatcttaaagcctttaatttagtcttcgagccctctaatggcggatcagagcaaaaacactccagagatcttcgagctcaacaatggcaccatgcaggtcaagatctcaaactacggcaccaccatcacctctttgtctgttcccgacaagaacggtttgttctcttcttcctcctttcaatgatgatctctgttttgtctccaaatcctaatcctctgattatcgtctttgtttttcttatttgaagggaaactgggggatgtagttctcggattcgactcggtggatccatatgtggtaatttctctcgaattcacctaatccttgaactgatctcgacatagattcaatcaatctgatcgaaactctaatcactgcctctggatctcatgaatagagtctgaatcataatttaagaaatgtatatggtcattcatgtaccttgttgaatgactttgtgatgaactatcaaaataagatggactttgtaacaatgttaatgaatatgtgtgttttatctatgaatatgattgttacagaaagggcttgcaccatactttgggtgcattgttggtcgtgtggcaaatcggatcaaggagggaaaattcagtctcaatggagttaactacactttgcctatcaacaagcctcctaatagtctccacggtctgtataaacaattctcttctctgtatactttctctataactttctgtgaactaaataggatttggaccgtaaaatgttactctatctgtacaggtggtaacaagggtttcgataagaagatatgggaagttgcagggcacaagagagacggcgaaaaacctttcatcactttcaaatatcacagtgccgatggagaagaaggtaatgacatatcctttctctagcatttgatttctgtgggattagattagctatataatgttttgcggttcccctccacaggttaccctggtgcggtttctgtcacggcgacatacactctcacgtcagccacgacaatgagacttgacatggaagctgttccagagaacaaagatactcccatcaacttagctcaacatacatactggaacttagcaggtcatgactcaggaaacattctagaccataagattcagatatgggggtctcatatcacgccggttgacgaatacacagttcctacaggagagatcttgcctgtaaagggaactcctttcgatttcactgaggagaagcggataggcgagtctattggagaggttggtatcggatacgatcataactacgtgttggactgtcctgatcaagagaaggaggggctgaaacacgcagcgaagctcagtgatgctgctagctcaagggtactgaacttgtggaccaatgtgccgggaatgcagttttataccgggaactatgtgaatggagtggttgggaaagggaatgcggtttacgggaaacatgcgggtgtgtgccttgagacgcagggattcccgaacgcgattaaccagtcgaatttcccgtctgttgtggttaaggctggtgagaagtacaatcacacgatgctgtttgagttttcagcttgagtttatagatggacgttttaggtgttagatgatgggaataaagggccggttcatttgattcactgggctggaaaaagagtgattttaattttatctctttgggggagaataataaaaccaaactgtttacattatattaaagttactttattttttcatatcttctaaacatttggcccatttgtgaaattgtgaattgtgcagcgaatgaatctcccattgttcacatgaacttggaaaaaaagagcaattagtgtatttgagtaattctgatggcaattatgtctacacgcatgtcttttgggcggtgagaaacacgcgccactaaagaagcaaaagcctatgggccccaaaaaatatcaaccatccatctctgtaatctcttcgtcctcccttaaatttttgtttcattatttttttcactagtaaccacggcttgtgttgtggcttaaacacagaaatg

SEQ ID NO: 23671 - DNA, 3000 bp, Unknown; identical to SEQ ID NO: 1986
  misc_feature (1)..( 3000): 2750-1469P.txt file - cDNA_ID_2148473; gDNA_ID_1620475; Annot_ID_158150

SEQ ID NO: 23672 - DNA, 3003 bp, Unknown
  misc_feature (1)..( 3003): 2750-1469P.txt file - cDNA_ID_2148477; gDNA_ID_1620475; Annot_ID_158151
aagggaggacgaagagattacagagatggatggttgatattttttggggcccataggcttttgcttctttagtggcgcgtgtttctcaccgcccaaaagacatgcgtgtagacataattgccatcagaattactcaaatacactaattgctctttttttccaagttcatgtgaacaatgggagattcattcgctgcacaattcacaatttcacaaatgggccaaatgtttagaagatatgaaaaaataaagtaactttaatataatgtaaacagtttggttttattattctcccccaaagagataaaattaaaatcactctttttccagcccagtgaatcaaatgaaccggccctttattcccatcatctaacacctaaaacgtccatctataaactcaagctgaaaactcaaacagcatcgtgtgattgtacttctcaccagccttaaccacaacagacgggaaattcgactggttaatcgcgttcgggaatccctgcgtctcaaggcacacacccgcatgtttcccgtaaaccgcattccctttcccaaccactccattcacatagttcccggtataaaactgcattcccggcacattggtccacaagttcagtacccttgagctagcagcatcactgagcttcgctgcgtgtttcagcccctccttctcttgatcaggacagtccaacacgtagttatgatcgtatccgataccaacctctccaatagactcgcctatccgcttctcctcagtgaaatcgaaaggagttccctttacaggcaagatctctcctgtaggaactgtgtattcgtcaaccggcgtgatatgagacccccatatctgaatcttatggtctagaatgtttcctgagtcatgacctgctaagttccagtatgtatgttgagctaagttgatgggagtatctttgttctctggaacagcttccatgtcaagtctcattgtcgtggctgacgtgagagtgtatgtcgccgtgacagaaaccgcaccagggtaacctgtggaggggaaccgcaaaacattatatagctaatctaatcccacagaaatcaaatgctagagaaaggatatgtcattaccttcttctccatcggcactgtgatatttgaaagtgatgaaaggtttttcgccgtctctcttgtgccctgcaacttcccatatcttcttatcgaaacccttgttaccacctgtacagatagagtaacattttacggtccaaatcctatttagttcacagaaagttatagagaaagtatacagagaagagaattgtttatacagaccgtggagactattaggaggcttgttgataggcaaagtgtagttaactccattgagactgaattttccctccttgatccgatttgccacacgaccaacaatgcacccaaagtatggtgcaagccctttctgtaacaatcatattcatagataaaacacacatattcattaacattgttacaaagtccatcttattttgatagttcatcacaaagtcattcaacaaggtacatgaatgaccatatacatttcttaaattatgattcagactctattcatgagatccagaggcagtgattagagtttcgatcagattgattgaatctatgtcgagatcagttcaaggattaggtgaattcgagagaaattaccacatatggatccaccgagtcgaatccgagaactacatcccccagtttcccttcaaataagaaaaacaaagacgataatcagaggattaggatttggagacaaaacagagatcatcattgaaaggaggaagaagagaacaaaccgttcttgtcgggaacagacaaagaggtgatggtggtgccgtagtttgagatcttgacctgcatggtgccattgttgagctcgaagatctctggagtgtttttgctctgatccgccattagagggctcgaagactaaattaaaggctttaagattagaagcgaagtgattgggattgagatttttgattggggagaaacaaaacagagggtgaagtgattagctttggttaaaagagttataaaatcgtaatctcgtaactgatcaatgttgacgtcatccacatcccaaactatttatcatttttaccccccaaacaaaaaactatttatcttgggggtttttgtttttcgttttttacactttaatgcatttctaaactttttgaaaatcaaattactacccaaaagttaccaaatttactttcaggaattcaaaagttaccaactaaaatccaaaactatagagattagagaaaagaacaaatgtagaatttggatctaattttctaattatcaataatattttaagtaaaaaaatatttgattagtcagttataaaataaaaaatttgataagtcggattatatgcttttgacaataagagaaagacaaagatatcatcagataacaagaaaataaataaaatatactctaaacatattcagtttgaccccaaaaaaaaactctatacatgatcgtaacagagtattcgcgtgaatttagatgtagtttctctaccctttttcaggtatcctatgaaaaaatcaatagtacctataaaagcttactttgttgtaatttatcctcttttcgtaaattttaatttgctaccatccaacatgtctcagcttttacccaaagtttacaaaaaaaatgtctctgtaaaggattttgattattcccataactagaaacaattaaatcaaatttatcaaaaatatcaaagctctctgagacatggaaagaaatagtgtaacagatggccaagaggactttagcttaaagaagcacaatcatttcaaaaagcaaatcatttgtcactttcttcttcttcacctatccatccacaaaaacactttccttttcctctcatcaagaaactccctaatccgacgtcgttcgttttaattcagtgacacaatctcccacatcttcaaaccctttgaaaccagcgattacagagatg

SEQ ID NO: 23673 - DNA, 3003 bp, Unknown
  misc_feature (1)..( 3003): 2750-1469P.txt file - cDNA_ID_2148485; gDNA_ID_1620475; Annot_ID_158153
tcctcctatcagtatctaaaatttcaactgtctactggttggttcggtttcaattgttttcagagtatagttttgattacttgcatctttgcaggcatcgacacagttggcggggtaagagtgcctgctggatactgtggcgttcttggattcaaatcttcttatggggctatttcaaacaccggaatcataccagtatcttcaagtcttgactctgttggtatggatatataaatctttgaattatactgtttgtggtggaatgatttggatcttatataggctaggtttcaattgttgtataatcacattgcaagatttagatgcctttgttcgtatgactaatttatatttaggaccattaaatgagcattacgttgattctgatcaatagattttggcttcaggatggtttgcccgcgatccaaacaccctacgtcgtgttggccatgtactcttgcaacttccatttgccactcaacggaatccaaggcaaatcatactagctgatgactgttttcagctgttaaagatccctgtggatcggattacccaggtggtgaccaaatcagctgaaaagctttttggaagtatgccctttactctccctgaagatcctccagtctctgttagaaattctgattataatagcattatcttgttttatatttaggacaattgctaaagcatcagaacttggagacctattttgaaactaaagttcctagcttgaaagagttcgctaggacaaaagccattgctaacacgaaggtctcaacatcgagactactggcgaatgtgatgcagctccttcaaaggtgtgcctattgtttattcacctacagaggatgaaaatatcttagttttgaacactctataacaatattggcattgtaggcacgagttccttcaaaatcatggggattggatcaacacagtgaagccagccattgatcctgtgattttatcacaagtgtgtgagaacccagaactaaccaatgaagagactgagaacctgaatgctatcagaaacgagactcgagtggctattggttcacttctcaaggtattcctgctcttccatgacatgtccacaacttgagcgagttagtttatatgtctcttgactaatctctaatggttcccaactctgtaacgttatgtatcaaggatgatggcattctggtaattccaacattgccagctgttcctccaaaacttggtagcaaggagataacatctgaagactatcaaaaccgagcttcaagtctgcttagcattgctagcatatcaggatgttgtcaggttaaatctctctctttctctctctcacctgccatgctagtaaagttcccctcacacatgttaaaagcaaccactgaccagtcagtgttagcaaaaccaatccacagtatatgtgtcttacatttatcgtgctgatgattcaggtgactgtgccactcggacatcatgagaaatgccctatttcagtttctttcataggaagacacggtggtgaccgctttttactagatacagtgcagacaatgtatccatctttgcaagagtactcgagtattgttaccgatcccaaatcttctaaaaaggctatcaccaaagaagagtcagccgagattgccaaagagaaggtcaattaatatccattgcatgtctcattttcttaatggcattatcatccataatctaatgtggttattatatctttgtgtcccgtgattatgtaaaccagggtaaccaagcgttcaaagagaaactatggcagaaagctattggtctatactcagaagctataaagctaagtgacaacaatgctacctattacagtaacagagctgctgcatatcttgaacttggagggtaaatgtttctcagatccttaaaaatactttttagtgagcaaatctttctatgtggcattgccttgacaaatcatttacatacagctttcttcaagccgaagaagactgtaccaaagccatcaccctcgacaagaaggtaactttcattaaaacacagaaacaggtttctcttgaaaaaaaaacactctttactttgtaagaacacacaacacaaagatcgtttttgatttctttcagaatgttaaagcctatttacgaagaggaaccgcaagagaaatgttaggcgattgcaagggagccatagaaggtaagctttaaagaacataatctgattgttttttcgccttgtagaatctggcagaatataacataaactctgcagatttcagatacgcacttgtgctggaaccaaacaacaaacgagcgtctctctcagcagagagactgagaaaattccagtgagcttcttttgtccgtacctcaccgatcattgagaaaacgtttgttccttagaatttgtccaagagtataggccaattttgtcaacacttgtcttttgcgtctgatatttaggcattttatctagagataccttttgcaagtccgccgagaatggaaaattataatatccgatgtttattttaaacgttctctaaaattggatatcaaaaagtaatgttaatcttaaacaccggataccggcattcccggtcgacttctagtcagcgtagcgtcaaaaataaggtcatgtctttaactatcttgtctttatcattttcttttctcgcacgttatctcctccccacgactcaaaaaaaataaacagaaaaaaagaggagtagaaaccaaagagacctgccctaatatttagcgatgatagtttgaacggaacgaaatctgacgaaagaaactaaagagacctttgaattatcttcacgggtgagttggttcgtttaaccttttttctttatctcggttgtgcttttccccgagaattaaacgtgtgttggttgcagcgttaacaaaaaaaaagggttgtagaaagtgagtaaggaagaaataatcaggaacattaataaaggaaatgacaacggcgtgtccggcgaggacaagctcactaatg

SEQ ID NO: 23674 - DNA, 3000 bp, Unknown; identical to SEQ ID NO: 2024
  misc_feature (1)..( 3000): 2750-1469P.txt file - cDNA_ID_2148532; gDNA_ID_1620479; Annot_ID_158261

SEQ ID NO: 23675 - DNA, 3003 bp, Unknown
  misc_feature (1)..( 3003): 2750-1469P.txt file - cDNA_ID_2148544; gDNA_ID_1620473; Annot_ID_158067
aaatattccacgatcgttggggaaagggggctcaaggtcagtattttgatgttatatctggaatgcatgattgagttatggggagttagtcacccgtcgtttttgtcattgtcataatcaaagtaaaacaagctaagtcaatcaggcttccaagtcaaagttcacctgttgaaaacttgatgaagaatatgatctaataaactagtttcgcaggactgtaacaatcatgaaaaataaaagatttaactgattgaggttttctatataatggcaaagagtagcattgatgagtgaccatcctgagtttgagtagagtcatatattgatggggtttttgtattgtgataaccatggagtggtgttgtgtgcagttgagtggtggagagaaacaaagagtggcacttgctcggacatttttgaaatcccctgcgattctgtaagtaactttgcacagaagcagcattgagtttacttatgtgattatgtacgtgtctagtcctcacatacatagagatggttggtgtacacaggttgtgtgatgaggcaacgagtgcgctggacagcacaacagaggcagagatactgaacgcactcaaggcactagcgagtaacaggacatctatcttcattgcccacaggctgaccactgcgatgcaatgtgacgaggtttgtagtaaatagtgtttgtcaacttagctcaaagaaacaatgtttttgcataactgaaacttttggttgcgggcagatcgtagtactggaaaacgggaaggtggtggaacaaggcccccacgacgagctattgggaaaatcagggagatatgcgcagctatggacacaacaaaacagcagcgtggatatgcttgatgcagctatcaaattggaatagtgaacctcagagccaaatgtgtaaaatttatatttatctcattgattttctatggagcttatatagttaatagagtcccaaagaacacaaaacaaagggaataataaatagtggtgaatgatataattttaacacgagtttttgttgagcaagtaaacttacgataaaaaaatgatcaattttattagttaaagcccaaataggcccaactagttattaattaattaacaagaagaagtccgtgatttcgaaattcaaacgaagcgccatttctttctcctcctaggaaactctgcaatggccatggcctatgaggaagctcgcaagctccgtcttcaagagaatcacaagcgatttcaagttacccttcatcgttaccgcgtttcttcttctcctccttctctgattcgtttatcaattttgattattgaatctcaggatttaggaatttcccagatttctaagactctgactcagattacaaagaaaacgcctcaggtttcgtgttttttccttccatttctgcttcattcctagtccaattttgtagctttaccacaatttcagcttcttcagcagcgtaatcacaaacccatcgataaagccctcttagctactgctgaaccaagacgctcttcccgtgttcgtaccgtaatttcttcctatcgcgatgatgtaattttcccagctttctcttacttctgtaatagatttttcacagcaatcaatcaacccaatcccttgtctcttttcaggtcgtcgtagacactggtcgtacttcgaatctgaggagatcgcgacatagctctacatgggcgacgtaagtgccctgctccacaattttgccctaaaaaactatcctttcatctgatcaattagttaaaattcatcagctacatttctcgacctctccatgagtgcaagtttgcatcttatgaagaaaaggttggagcattcaaggctgcagagaagttccagaggagccttaaatctccacatccttactttgtgaaatctatggttcgctcccatgtttacagttgcttttggctggtacgttcgttcacaacacttgtgtgtgtttcttcttcaaggatttcgtgttagtaccttacttgacctacatgggtttgcttgcaaatttcaaggggcttccttcaagattctgtgcagacaattttcctgaggaaactatggaaatagaactagaggatgaagaaggcgaagtgtatgaagcagtgtacattggtagaagagctggactcagtggtggttggaaaaggtttgctcttgatcataaattggatgatggtgatgctctactctttgaattggttgaaccaaagaagttcaaggtatgtatgtgtcttgaacaagagtcatgtggttggagttagttgacattctcacatgttgattataaaatgtttgcttggtgcagatctatgtgtttaaaggaaatgagaacgctaatcttacaagcgccagaaagagaggcagagcaacgacgccaagtgaagaagaagaagaagaagaagataaggatgttgaagaatcaggtgatgaggaacacagctcaagagccactaagagatcatccgtaaggttactaaggaagaggaaagcataagagagctttcttttgtctacatgccccatatatttttttggtttttgagtgggctgctaatactactaatactaatggcatatttgtaagtttatcaacccaaggtaaactttgtttttttcaatttgaaagtagaactgaaactctgatgagcggctttggttcggaaatttaaattgtttcctctcagttttggttactaggcgatgatgagctatatacttctgatgataccatttagaccaactccgtcacaaaataaacaaattaaaatggagagagtaaacgggctattaaatatcaaaactgggccttactatgacaaaaggcccatttaatctattttccttttatttagatgagtcggctcacaaattaacatttcttttcctctactccaaagatatctcggttcgcaaaagtctatttaatttcatagcaatctcacttttctcttcccccaccctcaaagatctctcaaagaatg

SEQ ID NO: 23676 - DNA, 3003 bp, Unknown
  misc_feature (1)..( 3003): 2750-1469P.txt file - cDNA_ID_2148570; gDNA_ID_1620478; Annot_ID_158227
ataaatgggatattcccataaaatacggatagatacagaaatgatacgagtcaataatatgtctaccgttttcctgaccatcacacattttcttagatttgttagtcaaacagtctaatctcacaaaattactaccaacctcgtcagaaatattttattcttatttataggaattttaggtacaaaataaatgataataaatgtaaaagggcactttataatttggttcagagttaaaaaattcatatgcaaattttgtatcgtgtgtaaaatttagcttagaaaataatatgactgatttgaccgtgccgccaaacaataagagagagtgattttctcagaaataattgaatcaagcaaagactttaccagtaaggtccattgaaatgaattggggcatgcttacgaaacctaacttataatagaaagaaataaacgctccaatttggaccagaaaagccgacttaagatggcgggtcaactctactacctctcctcgttccatttatctatctttagatattttgacattttgtattcgtcttgctcttggctttttattttatcgatatgtattctacaattatctgaatattcaacgtttgattattcgctaaaacttaaataattaattttatattcgatttattccataagaaattgattacataatgtgactgttactgttaatgtttctctcttaatatcatcaaaagtatgtaattgatgagaaatgaaaacaaaatggtagaaaatgagaagctcgaagaaacagaaatgtggatgaaaaattgtattgcttttacagtttactctttgctaaagtagtatagctgaaacatttattttgtattactttatttggctaaaaataaaataaatttggacataaattatttcaattattttagattacgctaacaaaacaatctagtcacactaactcacgatcaaatccaaaagcattagcaccatttcttattttcttaaaaaatatatattttatctaatcatatttacctattttggttttggacgtcaaaagtattccgaaaacaaactcatatttagtttctaaagacttttttaatcgttttcttgtgggatatatagaagcaacgcaagagaaatggtcaaaaatacggattatttactatacatatgcaggaatctagtttagttattttctaatggttgaataatttacactacatacagttgtcgacagttcaacgtaaccaacattttttacaacgaacaaatccaaccgcttaattaaaagattctataaatcttacccaattttttctataatattattcatatctattctatagagttggaaatagtgtcatagattatatgttaatttagagtgaagcatcgtgcgtggttgaaaatgatctagttcacatcgtgtgttataagagtgaaacatcgtgcatcaccaaaggtgatctgatttagattttgtatatctcaattatcaagttacacggattttctaagacaatttatttcatatacagcatgttcttatcaaaataaaattaaaatatatatacaccatgtttttacacacatagactgaagaatcaaataatactaaaagttgacgatcgagatacacagtggcgggcgcacaccgcttagagttgcacgcattgcgattggacagacaacctaaattggctgtacaatcagaatttttgtgcagcttttacgatttatatcttcttttttttgtcaactatcatctacatataataattatatatttctaggataagatacgaactttcgtcgtcaccttcgatgaacaaatattataggttgatcaaaagcataaacttaacgagcagccatgtttgagaagtcgtaattggaatgttgtcattaatagcttgaaagaaacatgtaagtaacgcagtgagttcatgtttattcttgtcgaattccttattgagtctttacaaaagaaatgtcatggtggacctttttggaaaacaaggtgggtacatttgcctatattttttaatcaaagcagaatatttatcgaaagacaaagtaaaaacaagtggtattgtgtgaactaatgcaagttgatcagtgactatagttaaagacaattcgaatccgattcattctgtaattatctgaaaatcaattacttttatttactttgtgtgtcggtcgcggttattgaatcgtatatatttatatattttgtcggatattgaatcgtatataataaggtggatatcacatattttcttttaccatattaatagttatgttgcatctatttatcggacgggagatgcagaaaagtatatgatttgaaatctgttgaaattcaatataaagcatttatatatccaaatttcctatttctaaatagaatagttgtaagtgatcgaaaaaaaataaaaatagaatagttgtaagcttataacaaatcaaatcagttatttacacgaaagtactattttatatatatattttagatacaatatacatattttgggatatattcaattaattatttaattttaatcagtattggtaatatttttaaacaaaaattataacaactttagtttttgttaaaaatcatctaaacctaaaatcatttacagaaactgaactaaccctataatattttagcctagtgaccaatactaacatccaccttgcatcgaagtactgtatcaaaccaaatctaatattgaaatggtcaaggagaatccatttattagtggaccttcataatacaacaaagaaagaaagaaaacgaaactcaaagagacaaattaaaagagtcaaagttcaaaatatgtactctttattttattgtgtttaataactttgtatttattataaaccaatccatatatatatacacatagaccatccaccattttcactcaaaccttctcacaaaaaccaacccaaattctttctatatattaaaaaaaaatcaacacaaaggaaaaaaaaatg

SEQ ID NO: 23677 - DNA, 3003 bp, Unknown
  misc_feature (1)..( 3003): 2750-1469P.txt file - cDNA_ID_2148580; gDNA_ID_1620478; Annot_ID_158229
taatgcaaaaaatctcttattagtgattaagaattgataagttaccttcttgagtattttgtctgttttcacctaataagcaatggtattctcttgaatctgattcatttggtatatgctcagatgggagattcaacatttctcgatagaatgcttctccagcttcgctccacttgcaagtaatgagttcgtttcgttaattctataactgtgtagaaaaccaatcatgataatgggttgatctttctgttaaaatgaaggtattacagcggttaccctaaggatctcgggccatcgcgggttctccattttacatcagaaagagagtttgtccaactccttcaccagggctatcctgtggttgtcgcattcaccataaggtaacttagcatttcccaaaacctttcaaactacactatattcaatcacgtgcgtcttcttctataaaacaggagtaactacacacaacatcttgaccggatgcttgaggaagctgctgctgagttctatcccaacataaaatttatgcgtgtgagtcgatgtaaagctgtataaaagaatacaaagaaaatagctggtaaaccatgaagtgactgttgtgtttggattgtttcaggttgagtgtcccaagtatcccggattctgcataactcgccagaaaaatgaatatcctttcattgaaatattccatagcccacaacatgtatagttctaaagtcttgtatttccggtacttaacctgtttaaatcacgaaatctcctttgttgttgtatctcgttaaatgaaaatccatctgatgcaggccggtaatgaaggaaaagtacaggatccaaatatcactcggtattcagtgaaagttgtacctgtaagttgaagcatcacacattgtcttttatacatattcatctattgcagagtctaaaagacgatatttttccttgtttgtttcgcttggcagtacaattatgatatgagtccctacggattcagagaattctttaagcgccagggggttcgtacttcggatcccaaatgaagcaacttgaaggttggttcgtattcacaagcttttatgagtgtatcaatgacttctgtgatctaccaacgactgaactattgtattactaaatttcctttttgccttcagaagaagaataaaattcttatgatatatgtctgagaatgttccaagttctactatttccatgaatcaataatcagagcggtgtaaaatttaaatgttaaagtaaaaaaaaaggcattagatatgactcttatacatggtatgtgaatttcaaacttagtcttatatccagatttcacacttttaaccattcaaacatcgaaattcagcctcgtaatcagttctagaacatcctaaacatcatttcccactcctaaataagaggcgaaccttctgaaataataattttaaaacttaatacaattagtgactatatatatagttaatgattttagttggtaacgagcgatgttaggttaaaaactttagtgcgaatcgtgcgatcagtaactatatagagttaataaatttagttgataatgggtggtgattttagttggaatggggttgatgttagattttatttgatacttttttttttgtcatcgatttaatttaatacgataaaatggttttatatagttaggaattttagttgagaacggatggtgttgtgtcgagtcatcgtctctttatttcaaccattatctctttagctctatacttctatccatgccataaatgatttacgtaggaagatccattattttcttcaggtctatagtttttgttcttatattagtatggctgacaacaacaaaaaacgaatatgcatgaatctttgagagcaattccctaacagtctaaaatttaatacagccatgttcttatcgatgggatcacattaatgatacaaagaaaatgtcaaaaaaattggatctgcctactgctttgatctaaccactactgcttcttccccataacactatttactacgtactcgaataattgaatgttcccttgacctatatgtctttttcattttcaatgttttatggatttcgtggccaatacaatagtagaaagttatataattttaattttaaataaaaaaaattgtggaaaggaaaaacaacgaaactgtttgatagagcttaaaacaatgaaacctagaacttgtaaagttttatgttctacacatatatagttcgtgactacgtgtatataacaaagcgcattaaaaatgaaattgtagaatcaggtaaaaatgatttacgtatcgtattggtgagaatgatttagctataactatgatatattggtaccattattttgtgtcattcttcttatatattaaaacatgattatcttctaaatccgtttctgatatttttctgtttggcgttttcttctttcgatagacatccgtcttttaacttgtctttcacttacaagcaacttacttttgctttgctaatggatttaagatgattaaaaccccatacttcatagttatatactagtagtattaatttattttccggtgagtattataaggttgtgagactgtcaatttgtcatgctcctttaaaagtaaaaaaaattttacaaagtaatattttgtatacgacaaatcgtcattctcatactactatatatacaacacacacatcgaggcttgagcaaaatagtctacgcgtttccttttcccttgtaatatttgctttttaaaaagattttgctttatcaggtaaacctctttggatgttttcgttctatcaatagcacccaatgcctaattttaatatacctttctagtttcttttatttgttcatcattaaggttcgatttctctctacttacaatcaacaacatcaaaaaagacttgacaaaacgctttagatcactcttcttcttattttgtttcattggttttgtttctgtgtgcaaacgcgcagaaaaaaaggagaagaaatg

SEQ ID NO: 23678 - DNA, 3003 bp, Unknown
  misc_feature (1)..( 3003): 2750-1469P.txt file - cDNA_ID_2148592; gDNA_ID_1620478; Annot_ID_158233
tttaaggaacaaagatttcattaagggacaagaatcacagtgaaagcttttaaaagagagaaagttgttataatctcctcacatgaaagaatgttggcaggtaatgttcatccgcgatgcagttcttgtttgcttctactccaggctgaggattttcaaatcagaatcagagtaagacaaaactgaaacttttctcaagtttttgaaaaccctgaggactcttgatattagcaaaagagatatgcttgagatgaaccaaagcttggtgtctttatgaacaatttcttacaacggaactcagtcatatatggtaggctgtaacatgcaaacaaaaactttggtataaaggaataccgaacttactctgcaatactcccggaatttcgagtagtagagaccatcagccatcactattacagcgtgttgacgcttcattgtgaaccactaccaccagaagagaaaagtgggaattacacatttacgtaatttcaacaataccattaccaaacagacttagagaagcaacaacttaagaacaatccacaactgagagattaagttaacagtttttcacctgtgcaccctttctgaaatcttgccttgggatctcaggtaacatgtgatccatgtgtctgccagtcccatgaggaccaagatcctcaaaacttgagagagagaaacaagtattggtgaatattaatggagaagtcaaatttagcaatagaaagaatagatacacaaagtttctgagagtcatttatttacctatcaatgaagctgacatttgcgtgcatcaaatatcgataggtgtagtcaaatgtatgcaacggtatacaactgcaacattaaaagagatacatcaagtaaacagaacgtagctggaaattaaagtaatgactttgtgcaaattcaataagtttatgaaataacctttctgaaagaagaacaaagtgctggttatcaggatcttcaagagcatttgctagaagccgtctctcagcatcaaccatagaaatccttccccaagtgacatgatcactatgaatttcacggtctgaaaagtgacggctaatgtgaactggtcgtaacctggaagggtggatgtaaatagagaatcttccttcttgacccttcacaatacagagcaaaaccgtcaaataccataacacagcaatcaaataaaatcaagaaatgtctcggaacttgttccaacctggaaaaacttatcccaaagcttctcaaatggcaaagtaccaggagtcaaaaacataaaagcgattttcgatttagcggttagagcaggaggtagtctcagtatatctttgatcacaactcgagctgctacttcttcatcagtgaatttcctgacatgaacaggaagccatccagagagcgcagcttgacagcctctactagacaaacccgcacaagcagagctcttactgttgttgtgttgtggatacatgtaagtgatcaccaaaagcacacttgtgatacagactaacaaaacaatcaacaatggcttctttagagaagatcggtgtcgtggagacaaatgcagattctctcccattgtgaaaaaaaagtttgaatctttaacttctttacattgagcaaaacctgaaaaaattccaatcaaagaacattaaagcttgaatctttgtcacttaccaacactcttgagaaacaagggagtataattcgaagtctcccacacgtttggtgaatcaaaatcaacggatttaaagaaaagaaaacctaatttaaaggagaaaagaaattcacgttgttcttgtgattgagaaagatactcacccccacgtacgagagcaattatgcttcactgcaaaaccaaaatctgaattaataagcaaaactctatcagattcgatttttttacagaaattgtaatgaagagtggaccaaatgcatttaatcagtgaagagagttattattacagttacctgagaatttggagctggggagagaataaaaaaaaaagaatctttgtctgagcccagatctcaaaatgaaagctttgatgatccttctttatatcaaagagtgaagagaaagataacgagacagtgttggattttgtttgcttttggaataagtatattaatgtgttgtaatgaagaacatacaaaacaaagtaaagtgtttgacgattcagatcctcgatttgttttctctctctttgcttagaaataaagaaatcgatgaacgagtgtgtttacaccattttcttcttaaaaaagaaaaaggtctaaaactgttttaattatcttcttctgagatgtatataaacaaacccctcaacaccagtcgatttttccaatcatggtggaatcagaagaaactagagatagaaaggtatatgcacgcataatttttattttatttttgttgataataattactatgtagtaagaaaaaacaaatcttaaaatttttttcctatcttttatgctttggaggcttttcttctccgtaatttttttgtttttcacaaaaaaataataatctaaaagttaaatttggaaatgacgatttaattactaaccggatcacttgtctctatggacataatttcactcataaagcttaaattatagtgcacaaaaaaaaaaacagcttaaattattctgggactaactaaacaaataattgaatgccaaaaataagaaattcaatttttgtgcctaccaaaaaaaagaaattcaatttttgttagttattggcccgttgctttaagaagttttggctcagtttcactgttaagctaaggcccaagacagtaaggctagagcaacaaaccaaaccgaaaaatcggaaaaattcactgatcttgttggttaaccggtggaccacaaccggttaacaaacatcgtttttatttttgttttgggctctaaaccctaaaagaaaccttcaacgccgttcgtttcttcttcttcctcctctgctacagaatcgttttgctctagacgctaattatg

SEQ ID NO: 23679 - DNA, 3003 bp, Unknown
  misc_feature (1)..( 3003): 2750-1469P.txt file - cDNA_ID_2148614; gDNA_ID_1620478; Annot_ID_158239
tcaggtaaattcatttcaacactagactaacatatactatgaatctaggttttagaatctccgaaaatatcaaccaattaatgttacagaaaaattgaagacatgaaaaagaaaatttaataattgttaaaactgctaacaagtgatatgctataagaggatctatctcattaaacttggtgtcagataaaaatgataatcatgggatattttgggaatggttggataataccagtacggatgtcgatgatggagaatatgtacgttaaaatatacaaattgataaaagaatttatagaaaagggaatcatttgaatttctaaaagtaatacagaaaacaaatcgccatttttttcttacagacacaaaagatacaagctttgtcttcaattggtagttaatataatatttatttgtttttttatatggttacatgcatatcttgatcatgtccagtgaggacttgtcttgaatatattggctaaaaataacattttctgtattattttattgttcatcatttgtccaaatcctcttgatcttctcgatttaatattatatcaacacacccaattatttcaaacccccacttatatgtataaaccaaaaattatacataatatacaaaatctacttccataagacttaggattctatattttatcagtaacacttaatatgtaaattcttgaacatattaatatatcaatcttttgagttaatactacagcatggtaagatactaagatcttttcttttactatttcatatagtggcatttatattaatgatttttttttaaaaacatcaccttctcagagaataaaggactctcaagtaagagattaaaatattacatactagtaaatccacaagaattatataaaattagctattgttttgtctgtctgttagagagagaacaattagatggacatacaaagctaatttagcatatgaaaacctctcagctttttccttgcctccttccttcacaaatatcacagcctgtcaaaattagcctttaagaactatttaacttccatcactatatattatttgtttattaatcctttttaatttaagcatttccttagctgtgaataccccattatccctctctccttctctttcctttctctctgaatatctctctatctcttcttccacacagctttagtcctatatttgattgttgacaaaacaaagcctatagtaatctctcagctattggattatgctttgaagctaaattggtaaagaagcatatagtaaggtaagtgtgcgtcttgaagaatttctcttaagtgagttttgtggcatgagtatagaacatgtgatcaatgagcttctttggagaaaatcacagcttgaccactcttcttttcaggtaatttatatagaatttctttatatgtattcgtgtatatatgtccataaacagattccggatattgctggtgctttctatttagatagatatattttctatatatgtatgtgtgtgactgcgtataaggaaaaaagtcacaaatttggcttttttcagttgattgaaattttaatacctcaagtgtatagagagagctaaaataattttttgatagcgaaatagatattttgtctagaaatatacacacatacattaggaaaaaaaaaagaacgttttcttttaaccaattttattgtccttgtcttatcctattgggtatctaatttggttctctacaattatagctaaatagacatgatcttttcatgtctttgtgtacttgtgagcgtgtgtataatagatacgtaagtacatgtgtcacatatatttatatttatttatttatatgttttagaaaaaaagataggaaacaagtataagtggaaatttaggtgatatagtcctctccgcatgaatgcgaaaacataatgaacgatgtgaccaatttatatacattatgtaattaattccaattttaatagaaaagaaacttaggtgatacagtcttcctcgcatgatcatcaatttacactaaatagttaaaattcctatttgttgactttaaattgactgctcgaccagtgtttgttgttgcttttttccatgtctctatgactctatcttattatgttaatcattctcatatctttaactttaacccacaaaaaaaaaatcattctcaaattctaaataagtcatgcttatccatagaaaaggaaacaaaatcgacaacttgttttttttccaaccttcaccacatattttatatttcttgcaattttacaactcaaatcattctattttaaactttagtagagaaaatgatattattgtactataccgcatcaattatttcactgatttgaaaataaagtattatttccgaatgcttactgcagaagatatcctatctaagtatttttacatcaatattttactataacacaagagataatttagatattttgaattggttatgaatgtggataaattcaaatagaaaagctttgtaatgttatcttactaaaacaagccgtgtctagtgttgtcatgcttggctctacttcgatttgatctgactaattagctaattgaaaataattaatcatcttccatctctatgattaataacaataataaagaaataaaatcataaatccaacaatttgtggtctaactagttctatccattgatttagtgaacataaagacatttgattcgatttaaaaaaaaaaaaaatacttggctttaagacaaaacaccatgagatagagaatctaatcaaattcaaaagtgtgtcccactagtcaaccttcttttgtctataaacccctcacttcacgaactagtggcttctgacgattactccatcaatttcatactcacatgtatacatacacatacacacaacactcactcacatatacaatttaagtagagttagggttttctaatgtgtttcatcactcatcaaatggttatgaaactatatgactacgtttcaggcatg

SEQ ID NO: 23680 - DNA, 3000 bp, Unknown; identical to SEQ ID NO: 2018
  misc_feature (1)..( 3000): 2750-1469P.txt file - cDNA_ID_2148618; gDNA_ID_1620478; Annot_ID_158240

SEQ ID NO: 23681 - DNA, 3000 bp, Unknown; identical to SEQ ID NO: 1958
  misc_feature (1)..( 3000): 2750-1469P.txt file - cDNA_ID_2148624; gDNA_ID_1620473; Annot_ID_158064

SEQ ID NO: 23682 - DNA, 3000 bp, Unknown; identical to SEQ ID NO: 1984
  misc_feature (1)..( 3000): 2750-1469P.txt file - cDNA_ID_2148671; gDNA_ID_1620475; Annot_ID_158136

SEQ ID NO: 23683 - DNA, 3000 bp, Unknown; identical to SEQ ID NO: 2026
  misc_feature (1)..( 3000): 2750-1469P.txt file - cDNA_ID_2148685; gDNA_ID_1620480; Annot_ID_158269

SEQ ID NO: 23684 - DNA, 3000 bp, Unknown
  misc_feature (1)..( 3000): 2750-1469P.txt file - cDNA_ID_2148687; gDNA_ID_1620480; Annot_ID_158270
tcttttgttaattccttttattttctactgtgcatcacgtatatttgattaactacaatgaaattcgtttaattaaaatagttgaggggacaaatttaactataatataaaaaaatctagtgtaaatcactaatattacggctaattttcgaaatctaaaatagttaaggggacaaaaccgtaaactttccataaatagtttggtaagaaaaagcaaataaatatagtttcattttttgtaaataaaaaaaaagaaaaagaaacagaatctccccgtttctcgagcactcttaagttctctctctctcacagagttagctttacgccttcaacgagaaccacacaagaacacaactacccaaaacgctcattttctttttccccggagattttagctccgtcgtcgtaacggacccataattcccggcgacggattctaatctcattttcagctaattataaactatgcttcctgtctcaaatccttccagtcctgaacatctcctcaaaaaatccagaaccccagactccaccacctccattgatcgtaagaactcatttaactcgcttcactcggtcggaaaccgctcttcctacatcgccgcttctcgtagccactgcacatggctgatcctctctcttctatctctccaactgatcctcttcctcactctccgatccatcccttttcctcaccgtcacatccccgaaaacttcccttctcccgccgccgtcgtcaccaccaccgtcacaaccaccgtcatttctgccgcctcttccaatccccctctctcatcctcctcatctgacgaacgatgcgattcaggtcgagtcttcgtctacgacatgccaaagatcttcaacgaagtgattctacaacagtgtgataatctcaatccatggagctctcgctgcgacgcactttctaacgacgggtttggtcaagaagcgacgtcgttaagcaacgtgatccctaaagatttggttcaatcatggttttggactgaccaattcgtaaccgaaattattttccataaccggattttaaaccaccggtgtcggactttggatccggaatcagctacggcgttttatataccgttctacgctggactcgcagttggtcaatatttatggtcaaattacgcagcggctgatcgtgaccgtcattgtaagatgatgacacagtgggtcaaaaatcaaccttattggaatagatccaacggttgggatcatttcattactatgggacgcatcacatgggattttcgcaggtctaaagacgaagattggggatctaactgtatttatatccctggtatgcgtaacatcacgcgcctccttattgagcgtaactcttgggatcattttgacgtcggtgtaccgtaccctaccggattccaccctagatcggactccgacgtcgtgaattggcaagattttgttcggaatcgacgtcgtgagacgttgttctgtttcgctggagctccacgcgccgggattgtgaatgattttagaggattgcttctccgtcactgtgaggaatcgcgtgggaagtgtcggacggtggattgtaccgtcgggaaatgctcgaatggttcgtcggcgattttggagacgtttctcgggtctgatttttgtctccagccacgaggagatagcttcacacgccggtcgatatttgattgtatgttggccggttcgattccggttttcttttggagacgaagcgcttacatgcagtatcagtggtttttaccggataaaccggatagttattcggtttttatagaccggaacgaggtaacaaacggcacgacgtctataaaggaagtgttggaacggtatagcaaagaagatgtgaggaagatgagagaaagagtgattgatttgataccgaatttggtttacgctaagtctccgaatgggttagagactttcaaagacgcttttgatgtggcgatagatggagtttttaggagattcaaggagcaagagaaatggtacaaatggagatgatgattggataaaattatttatttatttaataaggatttttcaagtttttagctccagtaaagttatgattacacttgtaaatttatgatttttgttttgagagatgaataagttgtgttagttgaatttttggtagtagtcaagtaagtaagttgttctatgtgttgaattctcatttatatattctcttttggagacaatttatagttttctttctgattcctacttactttacagtctcgatgttgataggctaaatagtttttgagtgttttatatatctgtaatctcttgagctaatttggtaggtgggaagtgaaaaatcaaccagaggcccgcatctttgcacgtagaagggttattttattaagtaagttgtacgatgataaaaaggtggtaggtaggagaagtagaatttgattttgggggttaggtttgatcatcgtgtaatactcgtgacacgttgattactctaggtaaaattgagatatatgctcttgttttctttgggaaagtttaaatctgttactttccaataaatccaatatctgtaacaagtaaagaagctggatcagttttgtcatgtcttttgccaatatatgtagtaagtatataacaaaattggttacaatgaacgggagataagttcacctaactaacatggccttaagaaatgatagatacttggtgtaaattgaatatattctatgcttcgaaaataatactagtactcaaagtaatagtaacacagaaaaaaaatagtacacttcaaatactcgacaatcacttttcttcatgaaagatattttcgtagtctagtgcttctatatgcttgctatatcactatatgcttgtttgtggattgtgttgtgccaagtgtaactgagtaagtatgaaggtaagttaatataacaagggtaacttctcaagttctctatttaaccctcatctcccagatctcttttcaagaagacaacaatg

SEQ ID NO: 23685 - DNA, 3000 bp, Unknown; identical to SEQ ID NO: 2039
  misc_feature (1)..( 3000): 2750-1469P.txt file - cDNA_ID_2148690; gDNA_ID_1620480; Annot_ID_158271

SEQ ID NO: 23686 - DNA, 3000 bp, Unknown; identical to SEQ ID NO: 2036
  misc_feature (1)..( 3000): 2750-1469P.txt file - cDNA_ID_2148698; gDNA_ID_1620480; Annot_ID_158273

SEQ ID NO: 23687 - DNA, 3003 bp, Unknown
  misc_feature (1)..( 3003): 2750-1469P.txt file - cDNA_ID_2148705; gDNA_ID_1620480; Annot_ID_158275
tcttagaaagcttgaagagttacatagagagctttacacacttcaagaacaaaaggttttttctaaactttaccttaaatttgatttcatttcttgatcaaaaagttaactaatactttactgtttattttggctcagaggaaccgggtgaaacagattcaagataatataagaactcttgaatcgctttgttcggttcttggtttgaattttcgagaaactgttaccaagattcacccaagtttagtagatactgaagggtcaagaagtataagtaatgaaacacttgacaagttagcttcatcagtacaacaatggcatgagacaaagattcaaagaatgcaagaagtgagttagaatgtttttaaacattttaccatcttaaaaactctgctctttgtttcttatatatatatgctatcttatggattacagcttcaagatctcgtgacaacgatgcttgagttttggaatttaatggatacaccagcagaagaacaacaaaagttcatggatgtatcatgtaatatagctgctactgtttctgaaataaccaaacccaatagtctttctatagatttgctagaagaggtaacttcacaacaactttacatcaaatctttttgtaaacttactgagactattttcgccgatggattgcttaatgttttaaataggttaaagctgagctatgtcggttggaggagttgaagtggagcaaaatgaaagaacttgttctaaagaaaaggtcagagcttgaagagatatgtagaagaacacacattgttcttgaagaagaagatatcgcggtagagaatgtaatcaaagccattgaatcaggagatgtgaaccctgaaaatatactagaacagatcgagtatcgagctgggaaagtgaaagaggaagctctaagcagaaaagagattcttgagaaagctgataaatggttgaatgcttgtgaggaagagaattggcttgaagagtataatcaggtttgtcttttttttattcattaaagattcagttctgacattttgccgttacttaatgtttttttgtataggatgaaaaccgatacaacgctggaaaaggatctcatttaatcctcaaacgcgcagagaaagctcgtgcacttgttaataaacttccaggtttgatataaatgatcccaacgtacacattgtcatattgatgaatgcttatcttactaaaaatctttttcactcttcttagctatggttgaagcattagcttccaagattacaatatgggaatcagagaaagaatatgagtttctctttgatggtgtatgatcttatcttcttctctcaaaaaaaaacccctcttcttctcttttctcctttttctcttttatatacttcatttgatctcttaatctgattttcttcattcagaatcgcctactttcaatgctcgaagagtatacggaactcagagaagagaaagaacaagaacgccgcagaaagagggtattagttttacatgcaaatcatatttttaatcaaattttctattgttccaagaatcaccaagaacaatgtttgtaggatctgaagaaacatcaaggtcaagtgacatcagagcaagacaaaggaagtgttacgaagccccaaagcgcgaaaaagggtcttaaagtgtcaactaacaagagatttgtctcatcacctcatactcctcaaactgattcgcctcactcagcaaaatcgaatcaatcgtttagtactcctctatcacgccatggctgaaaaagatagagctaagatttcaaaaacagtctttttatagatcaactagtaatagtttctttcttatatacacactgtcacacatgttatgtacaagtatagttctaatgcaaccatagaaacaagacatgctaattcaaatagagggtctcgaaactgatgattcttgatcatttgtaatctgtcaaactcaggatccaagtgtgtactatacactgattgttttgcggaaagattagtttgactttgaccaaccaatatacttgctgcaaaaaaaaatgtcaattgtttcctaacatttttttaaaaccaaggaatacttttagttggtcgattttgtaattaacatcatcggtatagattttgacgcatagttagtcttattacaattagtgaattagctgagaaataaatctaaatcttgagcttatctagaaaattaattggtcttagtaaggtattcaaagcaataatctttggtcaaccttatttcaaaagtgatttactggaaaaaagacaaaggagattgtcagaagttttggtattctttattttattttccttttcttttcgaaatttcactttaatttttcttcgtatttccgtttattttattacaaatattaaatttccaagacggacgtggatctttccctaaaccgaaatcaatactttgatttttgtaattattatatcgattttcaactaattaaatccttaatattcctattaaataatacaactgtctacatgacatttttttatatatattatcgtttcttttcctgaaattttccattttatttatttctttgcaaaaaccctaaaaattcattcgtctaagagagaaaaattatcttctttttcttgtgaatttttttttggggatattgcatgtaattttttggggatttttgaggtttaatctccattgaaagaagctctggcatttctctgctacagtgttggttttcagctgcagaattggtgaaaaagtaaatctagaaactgtaatcaaatttctctgctttgatctttggtccttttgagctactatttcatatctcttgttccttttattgttcttagttattattacaaagaagaagaagaaaaaaaagaaacctttacttcttcttcatctgaaaaagctcattttttttttttttggaatcagagtttggtgaatttcaggagcagagtatttaagtaattttggggaattagtgagaaaatg

SEQ ID NO: 23688 - DNA, 3003 bp, Unknown
  misc_feature (1)..( 3003): 2750-1469P.txt file - cDNA_ID_2148717; gDNA_ID_1620480; Annot_ID_158278
ataaatcataagacacagtgttgttttaatagaatcatgatcttgtattagaattctctgttatgtttaagaaggttccttcatcgtttgaaacgaattgaaagatgatttagagaatcttgtcctaatttgttgtggtatgttaaaagttgtggtgcgtttggcaaagctaaaataaaagtatgtttgtttttgtctaggaagcattatatcaacggaggtgatgcgttactcgcccgcgaaccagaagcggaggtcgaagcggaaacagaagcggaaggagaggcgcatagcatgtctcaaagccggtaagcaaacgtgattccaaaaatgaggtgttttggaagcgtagtgaaaccacatgactctagtttggaaacgttggtggtgtggatcggaagcgtcgatggtgacttgcaattctaattttgggtttataatttgttttgtggcccaacttaccttggtcaccataagcatttaatgtttggtattttaggttatttcatttttgctaatatattcaaacaaacatataaaataaaaagacaaatcaccacccatgatattaaaaaaaaaacactaataaaagatgatgtctcctggaatggtcgacgcagaatctgtagccactcactgttctttatcgttgtctcctcctcaacattatcccaatcccacgttcgcttaattttttaatttttaggttggattttatttttcatcaaccatataaaatcattgaatagacccattcttttatcccaacctttgaattctttacctcctcccacttacaattattcgagatttagtttgaatacatgtatacttccggtgatttgatcttggtcggaaaaaacaatcttttacgacttttctgaagtatgtcgcgacgataaagactattgaggattcatgtctacgtctacggtttcaaaatgtcttataatgtctactgtgtagtacatgcatcgaactccaattatacctacacgtacgtatttaataaagttttgtgctatttaaatttgtatacgatctaaacatttctaatgtattttgaacgtcggaccagtaaaatatatgaaatcgatcgaatgtagtagaatttagaagttctctaaatatttgttttgctattttttgttatgtttttgtcaaacttttgatatttttctttcttatctctttgttcatgatctacaattatcaaatcaaccaataggaactgtttcgagttgcacttggaccacaatatcccacactaaattaaaacttgaaccagatcaaaatctcttcggacctttgccctttggaccagttcggtccaatttaacctttcaatacccttatcttgatagagtactataaagaaataataatgacagatgcatgaaactagttcaagtggaaaaagcatcgtgcactgatatatcttcatcaattgcaagaacatgtctcaataaacccaaaactattcaaacattttttctgaatcatatctatcagcatgggacactgtggctctttgtgcctttggattcaacgcatccttcacaatcttttttttgtaactgcatctcattatcgcattagtagcaatcaccacctatatgaaatacctctttatatgtatatgatatcgatttaaaagtatttagtaaaaatcgattaatgttttctacaataagattagtcagacgcgattgccaaatccataaatccaaaaagaattatatagcaattgatatactattactataggatatattatagagtggatatgtttcaccataagcttaacattaatttctcaatcttggtttgcacaatgattaatgcataattagattaagtgtatatgaagcttcatggaaacccgtacgtgagaggacggtcactagattgtacaatcaagaacgtaatatatatatatccattaatctaaaccgtacgttgtagctaattagttttgtgaaatcgagaatctaatcttgtaagaaaaactgtaggcttgttgtcagaacaaacatggacccatgttctctatgtccctaagatgtgtaccaatctcaattcacttcttttgttgcactattttttaaaaaataacttttattttatattttgagatctccattgcccctgctgcactagacattacagctcattttttccttataattcaatccctagctatttttctttcttattagtttaaactaatcatatttgggtaattagcgttgaaactatctatcatatcaattttaatgatacatatgcaatactttatgtgagtatatgcatgtatgcatgttccaacatccagattaatgactaacgtttaagccctgattttttcagagaaattttgtgttgtacctatgtttgtattacacacaatatttaccattgtttaacatgtacacatgtgtttataaatctccgtacactataatgcatatttgaaccatatatgacagaaagttttccactagttctaattacattttgttgccctttcctactcgtctattgcctatagaaatattattttagttatgattaagaattgggatgcacattccgaaattaattattaaatgccactatgaagaacccttgaacatagtctaattcaattttaagatcataaggaacattaacagtgacaatagctaaggtctctcgacaatgagacaatccgctttttaaatatatacatataagagataccatattgtatacatatgcagatacaattacaacttgaccaaatttattcaatttctccttctctttatatcaataagaaactattcatgatactggaccagcctgtttgaatcttgtcccatccacaaatctcccaatatataaataaagaaccttcacccgtaaaaccaaaaccatcaacaacttcaaagctttctaagcaagagattgagagaaatcggattttctttctaagactcaaaatatctaaaaacaataatg

SEQ ID NO: 23689 - DNA, 3003 bp, Unknown
  misc_feature (1)..( 3003): 2750-1469P.txt file - cDNA_ID_2148748; gDNA_ID_1620480; Annot_ID_158289
gagtttattatagtatctctgtaattctatattagaatggtatgtaatatgaacaaaattaaaaatggaaccaaatggagaatttgtatgtaagtttggtgggggcaacaggaattgaaatggggccagcaccgaaggcgataaggagcttttttgccgcgatgatgttccctgtgttattacgtaaccactcatctcacgccacgttattttattactgtttttttaaaacaattatttactctgtagttcacttcttttttcctttacgatgttgttatgggttatccattaaaaaaaaaaatatttgtaaatcgtctatttaaggaaaataaaataaaacacttcatatcatgttatgtagtaccaaattaacaaagtattaacttcaaattaattcgccaaaaagatgttatgatgtgatgcattctttaatatagattaaactattggtgatttgtttttctatagttaatcactagcaagaacatttttcttttatgtttacagtttttagattataaaaaaatggtgtaataagaacatgtcaaatcaaatgtatttaatttgttaatatagatttgtgtataaacaattggtagttttgataattcaatttttcagcaatcatcataataatactttacaagaaaagctaaatcatctgaaaattttatatgaatacgtacggtttaattcccaatctacaacttttttagttggatttattataaccgtttttctaaaacaaaacacattaaaatttataagtgaagatccaatgggttcaaaccttttaattctcaataaatatacatagattctcgaagatatcctatcaacttgtaaaagttgtttaatcaatcttttgtttgatgaaatcttgttcaactgttgatttggttaagttttatagctgaaatgtgtataagtgtttctgaacctttttaattactgctaaatcaatttatgtcttacaaacttgccgatgtatcatgtatgttcattaggggtgtcaaaatgagccagctcgctcagctcagctcatgatgaacttaaatcttttatgagccagctcagctcaactcatttattatatgagcttcaaaatacaaactcggactcagatcatctagatcacgagctaaatgaggtagttcgcgagctaatgcaaataaatgaaaaaatttaaattttctaaaatttttatgtaaattatatatttttaaaaatatatttctatttttatagattatataaatatttatgttttgattgttgactttttgtgtttattactaatatttattttcagaaattattatgtaacttatatattttctaaaatatatttctattatttatagaaaaatatatatatactttgattgttagttttttgtatatattacttcaaaaaagccaaactcatgagctagctcatgttcattaaagctcgctcatataactcgtgagctaaataaagttcgatcactaaactcatttattaaatgatcctaaaaaatagaattcgcgctcatgaataactgagtcgagttgagccagctcatgagctatcagctcattttgacaccattaatgttcatataataatcgtaatccatcatgaccaattaggcaattaagacatactataacaaaacatttttttttttttcgtcaaacattgttttgttaaaggtttcaaaaagaacatgcgtatcaatttcaccaaacgaatctaataaatagcacgaccatcggatattatattgctatttgacgatcaacgtacgttcgattaaaaaaagtacggggattgtttagtttaatccaagtgtagtgttatttagacttcgagtaacatcaacgcgggagaagaaacgcatgggatgaatgtgtaaagtggttaactttcaacaatgtttcttaattgctaagatgtttaaaacgagtttacatgaattcttgtgttacttatcgaattatcttttatgagataattagtacactaccttattagggctccatttctttttctatctaggcctaggtcgatcagtactgtgtatgttacacatatgatattaaaaaaaaaattgattctataataatcttcataactaaaggcaagtatagtttatttgaaaacgtctcattcaatagttggtagagatagttctaaaagatcacattacttctctatcacacagagtgtagaaaagtgaaaacttatgcaacacttcaggtagaaagagaaaagacagtgatagcttagttataattaaagacccccaaaatccaaatagaatcttctcttaaataaactattgaaaaaatattcacaaaaaaataaaaagcacatttccttttgcttgcatcacgagagcttttgtctctctttacatttatgtgcctatatataagcctagagaatccaccatcatcggagtactcgttgtctttcatgatctcaacataaacaagacaaaacgcttttgtctcttgtctatctaaattaaatctacgaggaaacgaagagaagcaacaaaattcgatattttagaagtcttgcataaataagaagaaggtttcaagtaagtttctttcagtacatagagaaaccatgtatatgatttatgattgtcaagatgttacacagtcgtatatataattataagtatttcataaaagtaatttatgaaaccatgcacataactaacttttgtttttgattttgtaaattgagtagtttttgtttttattatcatttttatgtgtttatagttggttcagccgagatattatgagtaaccaaacgtaacctttttcataatgaaacggatcaaatatactttaatctttttcctacatatgcttagttacttgaaaacttgatttcacattacttctatgcatatcttttctatgtaccgcgcgatgataaagtatgtgttacaaattgccacattgcagaaaatataaaattaaaaagatcaaatg

SEQ ID NO: 23690 - DNA, 3000 bp, Unknown; identical to SEQ ID NO: 2030
  misc_feature (1)..( 3000): 2750-1469P.txt file - cDNA_ID_2148752; gDNA_ID_1620480; Annot_ID_158290

SEQ ID NO: 23691 - DNA, 3000 bp, Unknown; identical to SEQ ID NO: 2051
  misc_feature (1)..( 3000): 2750-1469P.txt file - cDNA_ID_2148790; gDNA_ID_1620481; Annot_ID_158309

SEQ ID NO: 23692 - DNA, 3000 bp, Unknown; identical to SEQ ID NO: 2049
  misc_feature (1)..( 3000): 2750-1469P.txt file - cDNA_ID_2148805; gDNA_ID_1620481; Annot_ID_158313

SEQ ID NO: 23693 - DNA, 3003 bp, Unknown
  misc_feature (1)..( 3003): 2750-1469P.txt file - cDNA_ID_2148840; gDNA_ID_1620481; Annot_ID_158323
atttgcaacgaattgcaaaaggcaaaacacttcccaaactattagccagagtttgccatcaccgcccaatgtgtccacacacaatttacccgatacaccgcaaaatataccgaggaaaagaacgatgaaacttatcggcattgtctgcttcgtacctgatgatcgtttgtttagaaagtaagtgaagacaatgatcattaacacaccgaaaaatatctgcacccaaactcgaacccggcagatgaaggtgttgaagcctgagttaatcgatgaaacttgtttaggaacccaccacgacgaacttttctcctcggattggtcgcatactgaggtagcatcctcgattctctttattgaaaaattgtaaacgccaagtaccatagaagccaacatgctgaagacacttacgaggagccaatccatgattcttgtgaccatctcttcttttcttgtatcttctaattcggttttgaatttctccgctctgaatgcagctttcgaaacatccaactctagcgccgctttccccaggttgtttgattcaaattttaatcctagcgccgtctctttgcaccttaactctcttatttgaagaccaatctccacggtctttaggtcgtttgctcgtgtttgctcttttaaaaacctttcgtctgtggtcaaagccattgctgaacttctaggagggacacaagagagttgtagagtctcttcgaaaagggcaagctcattcatcaaagaggttgctgttgcactgccttgcatcacttcataagcagacgtagcagatgaagtctccctctcaaatagctcggtgtctgagcatccgtctatggtagagcgatctaaattacaactcccaccatcattattgtttgactgatgtggatttgcacattcattggtcaatttaaggatctttagagtactgctgaatgtttgctcaaagttggtcgcaaaggaaccaagcttattaccataaacctgtaaccacaacattatgaatcagaaagtctataaatataaaaatgcggaaaacatagagggggattttagcttacattggctaatgattcttcgacaagagtagcaaagatctggagagcataatcaatgaagttcttgtatcactaccaaaacgatggcaaaagaaagattgaacagaaactgagaagaaatcatttgaagttcatactacttacctcaacaagatcatcaacataaacattctgacctgcggcattctttctcgcaataacctagagaacaataaaacagagtagaaacagagtaagaactacagagcatatgcaagtcaatgactttggcggctaggtaggatgaaatttggtgaaatcacaatcagaactacaaatccgagtagaaactagaaaggctcaagctttaaggcaagtgagagagaagacaatataaatttgcaatgttacattgaagctcgatcatagagacccccaagaagaacttcagcttctattgattgactctgattataatttgaggagaagatcctctcttcgattcagggtgaagaattcacgcaagtactgagagaagaaaattcagattcaatccttttgactctgattcagatcctctcctctgtccagttttgaatcaacaaagcctaaattgaaagactttgtatttaatactatctaaagatcaaaactttcaacacaaccaaaacctagtattcacgcaaggtcaactataggaacaacccgtaccagcaaagccaatttcgtatcaaaacagttatgtgatgcaataaagatcaaagtttggaaattgatcgaaccatattagcaaaagcggcaagtgaaaagcccagaggcttcgccaatttttcagcttgtcgttcaccaacgcttcgtcgagccatacctaaccgcatagggtttcgtaatctatgaaccactctcgtaacccttttagtagaatttgaattagaggtagaagatgtagaacaataggacgaagaagcttcgtcgttgtccataatctctttcttctttcccttgagttttctcttttccaaattcgatggattcgtatccttcttcttcttcatcatcatcgtctcatctttatgtacgtcaccagattgatgatttggctttgaattcgccggattggtgatttgattttggggttccggcgaaggagggaggaggagggcttccatagccttaaaatataacttatggggtaaatttgcaactttgagaaaagtatttaagttgtaagactttggtcgcttcgtgactagtgaaaagtttcgaatttccaactttttcctctgatttaatttgtatttttaaaaattcgtcataattagcttaatataggaaaaatacttgaccaaatatctgaattaacttgtaagttcaacgaattcttcaaattatacaatgtatatgttaatgtcaattaaataggtaataatatgtttactcgatttttagcgataatttgatgtttctaggtgctttctgttcaatgaataggatcggttcagtacttaattgaactaaaagtcatacatatagcttaggaccagattaacataccaagtagtcgagtttaggaccgaaccaatcagtttggtttgaagatggaccataaaagtgtttggaaaaaggaacaataaaaaaaatcgcacaatgtttgtggctccgataaataacacgatgaggtgtcttaacacaaccaatcaaaacacaagaacatctccttcactaatctcatcttatgccacgtgtccttttcatatccaccccttttattttatcataatttttttttttaacattctctgtggttcgtcatgaacctcaaaaaacctctcactgcaaagtgccaacaaacaacaagtcttcaccttcttcttcttcttcttcttcaaaatctcttgtacgcaaataatccatgagaaactagggtttaacttgagatctctcttccgaagtattaccatcaatg

SEQ ID NO: 23694 - DNA, 3003 bp, Unknown
  misc_feature (1)..( 3003): 2750-1469P.txt file - cDNA_ID_2148847; gDNA_ID_1620481; Annot_ID_158325
tttgttatccagctatgctttggaattgttgcggtttcgggaagctggagtggaagttgtagtaaaggtacttgcaaggcttatctctactatatatatgatcttatcacatagctttatattcatattcaatcaaattaactattgtaggacctgagaaagagatgggacaggcaatcacaagcattctacaatctatttagacaagcggatagagttgaaaagctagctgtagtcattgaacgacttgtaagaaactaacactctcacccaccacaaactcccattctacatgaatttctttctaatgagtttactttcatcctcaggagcaaggtgatttgaagcttagggtccgagcgctagagtctgagagggcatttcaacgcgttgcagctgttcaaaaaacagtaggaagtgtaagtagagctttccattctcatgtcttttttacatcaaaatctcttcaagtcgttctttgaaagcatttcatgttttctgttttatgtgttaaagttggtttcttttcctctttttgttaaacccattgtgtttctctacaggctgttgctgcaggaagtttagtcaatctcgcaacaattttgtatctgaattctataaaagtaagttggtactcttgttctttttttttcacctataaacctctttgtctgctcaaattcaccaacgttcttgtttctttgtgttctcagacacctgcaactatagcatatacagtatgtgctttcttcagcctccaagttctaatcggaatcataaaggttaagaagttcgatcaacgggaaaaactaatcactggaacagcttaagaacttgcttggtatgtcatgatttatcacctcttgatgtttacaagttacattatcagactcaaattctcacactcattttttggcttaatttgtacagaagaaatgtattaaagcttcttcaatctccataaacccttttgtgcatttcacaggagtgttaacaatttcactggtctgcaaataaaattatcttatggaagcttgagaggcaagagatggtcaactagtcaaaccaccaccactctctcatctctgtcttcttaaagttcgataataatttttggagaggagactctggttgttcatcaacagagtggtcatgagccacatgtattgcttgtgtatagagagatttagaaattaggaactttttcgtataaatatactcattgtactcagctactcactagactcatctctgttttagtaatattttgaatactgtatctcaaataaattaatcttatcaaatagaaaccatagttgaaaagtcatgaatgattcttaactgtacaaaataataagctttggtaaaaccctaaactttcgtttccaagatgcaatttctagcttctctcgtttccaattccagaaagtttggtcggagatgggatcgagctctctcgttgcatcatttctcttcgaatgcgacaccagcttcgatatcaaatccagcgttcgtcgagtttctcagggacaatgggttccagaaacctctagcaattgccatcgcaatgcgttaccctaacctcaaatccctagaacaacctcggtcagtgattcaaatgcttaaaagttacagtttttccgatacccagatccagaaatcgatccgggtccatcctcgaatgatgttctacaacgtggagaaaattctagaacccaaacttcgattctttaaagatattggatttactggctctggtcttggtaagttcgtctctcaaaactcatcagtcgttggtgtaagtctagtgaagaaattgattcctaccgttgagattctgaaatcgattgttgccccaaaacatgaagaccttcctgtcattcttagtagatgtggttggcttcttctcagtagagaccctaacttgtttctcttaccaaacatctcataccttgaaacctgtggaattgttgggtctcagcttgcttctttacttagaagacagccaagaatcttcaatctctctgaggaaaaactcagaggatatgtctctcgtgctttggatcttggttttactttgaactcgaggatgcttgtgcacgctgttatctcgttaagttctttgagcgagaaaacgtttgatcgaaaggttaagttgtttatggctaatggattctctgaagatgagataacagatattatacgaagatctccaggtttgatccggtgctcagaagataagcttacactggggtttgagttttacttgaagagaatggggttagagagggaagctttggcgaaacgtccttgtgtgttgtcgtataatcttgagaagagggtgattcctaggcttaaagttttgcagatcttgagggaaaaagggttgttgttaaaagaggagaagaagaagaagaacatggttggcattgttgagatgactgaggaagcttttctagagaaatatgttgtgagatttggagatgagattgctgaggaactgctggttgcttacaagtgcgtgtgtttagtcgatgaaacgctacttgatcgtatcaagatctaattgtagatttcacaagtccaaacttgaaattttgtcattgtatccaaacttcgctcatccgtaactgtgttgaacattataatttggaagtaactcttaaatcaccctttattacgagcttgaagcttctcatataataatgggattcatatgaagcgattctttttctatttcagcacttgagcaaaaactcaagattgtcaaagcgtcttaaaaatttgactcatgaatttaaccggtttgattttggttcgttgtaataaccggtttaaaccagagattgattccggataaaaaagcttaggtttttccgcgaagccgacactgtaaggtagggctaaaaccttagaatagccggagagaagaaggcgagaagaggagcgacaagggcgaagctgcagaattcttcggtaattttcagattcggttgaataatg

SEQ ID NO: 23695 - DNA, 3000 bp, Unknown; identical to SEQ ID NO: 5335
  misc_feature (1)..( 3000): 2750-1469P.txt file - cDNA_ID_2148886; gDNA_ID_1620780; Annot_ID_167890

SEQ ID NO: 23696 - DNA, 3003 bp, Unknown
  misc_feature (1)..( 3003): 2750-1469P.txt file - cDNA_ID_2149274; gDNA_ID_1620482; Annot_ID_158364
tcgattatctttctccatgaatgtgaataaagatcgtatattcagacataatcacacggaataagagaataagtttaaccaaagaagaaaaaaaacaaatcttttgcaaagtaaagatcaagactcttggacaaggctcgtggccaccacagaacagctcacttcaaactcagcttcatcttcatcaacccaactcaccaatccataaaccacgttctcttgtaaccctcttggactctccaatctcacagtgtagcttagcttctcgtttttctcgctgaacattagtttctttggctctacgacgacgtttagacccttcaagcctctcactctcacgatgtagcttctctttgcttctcccacgtttgtcaatgtcctcttaaagatcttgggactgctttgatcagacgtgaagtaggcaatgattgaagggtaattgagatatggagatggctttttacaagcgtcggagatattcgatctcgtgatgatattgatcaattttcttgattgttttgcctcgtgacaaaggaagtttatgaaatcttgtggagttgtatcatagattaggccagggtttaagactttgttcgtactcacatgccctgctccaacggctaatgggttgtctaaagtcaaagccgttgtcataattgcagattttatagccgatggactccaatttggatggacttgctttataagcgcagcgactccagctacatgaggtgcagccattgatgtcccggttaagagattgaatccgctgaataacggtagtgctcgagttccggtgatttgctcaaccgacggccaagcagagagtataagtgtcccaggagctagaatgtctggtttcaggatttgagggaagcttgtgaatggaccccttgagctgtatgtgccaacttctggcgctggttttgtcccgattaccgttttacgaaactccagctttgcggtcgcgttgtttttgttgcttgatgcgtagctttcaatagtttctcggtgttttgagccgatgaatgctactggaaactggaattttattgtgtcttgctcctcaagtaacttatctgttattaaaactactgctgcagctccggtggatctgatttgatgaagtttgctaccgatgtttatgttttcgttacagacaacaattctgtttgcgagagtcttgttttcaacgctgccagattcgatgtaagttactggaaactgaaccgaagggaactctccaggaaacagagatggaaaactgaaactaactctgtttccaaacgttagggttccttgaaattgcctaccaattgttcccgctccaaccgtcataatccacggcgctccgttaatcaaactccagtaatatggcccgtcgttaccgccggaagtaaccacgaaaacgcctttttgaatcgctgcaaaagatgcgactgcgattggatcattttctagaccgaaaccatcattgtcgtcatcatcctcaaaactcaatcctagcgacagagatatcacatggactccatctcgaatcgcttgatcaatcgctgcgattacatctgatgagtaaatcccttcttcccacgcggctttgtagattgctagatgcgcgtgtggtgcgattcctgaggcggttccttgggcgtaagagaagtaagacgcgttcttaacatgattcccagctgcaatggctgcaacatgagtgccgtgtccgattgtatcgtacggtgaagagtattggccaatcttggtttctctcaaatcagggttgttggcgaacaaacccttgttgaataccttagcaccgattagtttcttgttgcacaaggaagaagaattgaattcacatgctcctttccatttagacggaaccgaaccaaccccatcgtcgtgaaagctgggactatcgggccaaattccggtatctataataccgattactataccagctccataattcgagaccggccatgtaccggatgtcgaatttaaaccgataaactttggagagaaagtggtatgaagcttaaccggtaaatctttggtgaacgagacatacccgggtttgtgtttaagacgttggagctcagagttggtgagaaccgcgctaaacccgtgaaccgaatcggtataagcgtagataatctttggttttctattggttataactgaagtaagagttgtggaaaaccagctccgatgatcggaaaatggcaacggtttagcggataagtccatgtggatgatgtaaggagaggtctccgccgttacaatcgctacgaaaaatgagaacaccagaataattacgacggtcatccccatgtctgagcaagtttttttctctggtctcttcaaagtgaaatgaattttggtgttagtaagaaacaattatagtgttgttgttaatagatgtttagtttttattatgacaaaaaagttgcagagaatgtaacctttacttggcttttgcttttgttaaagtggttttaggtggtcggcaacacatcatctctcatcattgtttttttttcttttctctttcaattgggctttatcatagagaacaatgattttggatatgaacttattagtagtttcagcaatagtttagactttcgaatcggtaaatatcagtaacttagaactcaggctgaaactttgattcttttactgtatttagctagattctacacttggtggactccatcagcaattacttcacagaccgaggtagctcctacaactctctgatgcttgatctcgttcaaatagatgtctcataattgcttcttttttgtttttgtttttgggctttattaaagaggagtaaggcccattaagagaacccgtttgtttgttggattcggatttggcaaatggatagcgccaaaatcgtgtcgattttcccgccatctccatttcttaatctgggttcttaaacctaaatcagttactcagcttcaccaaaccaccaaattgaccggatttgtaaaaatg

SEQ ID NO: 23697 - DNA, 3003 bp, Unknown
  misc_feature (1)..( 3003): 2750-1469P.txt file - cDNA_ID_2149290; gDNA_ID_1620482; Annot_ID_158373
cagggacattactatcaacaggttctaaaacatcactaaccgaaacggatttagctgaagcgtggatgaatttgacacctgagccatcacaatcgacgtaaaacgacgccgttccagcatcttcgttctcgaccttgacaagacgaccagcgaatgggtagaagatcttcaaagcgacagagagagatgatttcaactgagagattatatgggtttccgggtcgggttgaggaaagagaagacctctttgtgggtattcggatcgaagaaagaagagatcccatggagtgagatggatcttaacccgatccgattcctcgttgtagctctctggtcgaacaatgctcttagagatcactactacttcatctgccattttcttttctcgagtagatagatgctgataaaattcactagtccactactagtggagtgtataatttctttatctttatattttctgtttttggaatcaaattcagacatgacataccaaactagtgaactacaacgtgtttcatgttatttatttggttatatagttaagcccattaattgtccctagcccctaggcccattatcaacctatcgtcgaagtttgatggaattttttacagagctcgacggaatgttgcaaccccagcggcgagtgtttccgattccgttcaggtacgttactatatatataagaatctctaaattcgttgaattatccgaatctgtttgttcatggtgatgttgtgaaccgaacacgaaagaattgcataggcttattattgtattaatttgaaaaacgagagagaattggtgtttggcttagttaaattcacattgctaaaccaaatcatctcatacaatgcttacatattcgttaaattcagcatctttgactaatttttccactacctgaggcagtaaacaagcctgaaaatcaagacttgcttctccaattcctttgaaaacaacgagtcttccattgagatacggtggtccagctcttgcagctatcggtttaccccaaccgaaatcattacagtacacatcgaaccggtgagagtttgtgacaactaaatctttgctaccaacagaaaccggaatcttgatatttttcacccaattctctgcaaatgctttggctttttcatcagtttgtgacagctccatgttgttgatttgcattgcagcccagcctagtccatggtccagcagctctccaaccgtgaccgtagctatcccggtttggcttacattcccaaaacactcttcttctagtggcggatttagccgttgcctcatgtttataggtaacctgcaatgagtctcttcctctcggctcatgccactgtgtttaaccattgaacgccatatatatgctaacaccgcttgaatagaagagatcttttgatcagcctcgtcgttggctttagcgtcaagtttcaaaacattctcttttgtaacatgaaacatcttctcttgtagattggttggtgttgttacataactagttggttttgtttcagggtctggaatatggattggataatcaatctcgtcaaagaaccaacctttaaggtgaagacgacgttggaaagtttgggatcctgaagaatctttcgagcaaatctctgaccatgcattgatgaacttccagattgaagtggcatcagccacggtagagttgtaaccaaaaccgatgaaaaccccgtccttcatctctgtcacttgaaccataagtagagatcttgagacaccgtggtagttcttgatccccgttgcagggaaaaaggaagcgaaaaacccggggacagaaccggataactcaaggacatcactgagctcgatgtttttagccactgcgtgaacaaactccacacctgaaccatcgcagctgatgaaaaacgagacagtatcgtcgtcgttctttagcttcacaagacgaccagctaaaggatagaaacgatcaagtgcaacagagagtgaagcttgtaattgtttgacttcaattttgtgaaagagaagacctctttgaagataaccaaaacgaaggcgagagagatcccatggagtcagctgaatcttcttcacagaagtcggtttcttaaggcttctgggattaactatgctcttcgagattaccaccaattcttcttccatcgttttacctttttcttaatcagtgaggttttgggttacgtgaggttttcaaatgagtacatatattgaaagcactaattaaaaaaagaccaagatccaagaaacaagttacatcacactttaataatgtttgtgactctgtgtggcctgagttgtttttcattatttgctttgtcattttgtgaaatttccacgtgtataacaacaaactttaagaatatgttaggaaagtgaataaagaatctctatgattggtcgtatttagcatgacttaatcttttttttttgttaaagtatgactatatcattaacaaaaaagaagaaaaaatgactttatctttcgttgatgtagacgtacgagtaataatgtatgtcaataaatttaacaattataaagcagtctttatttagtgtagaatacgaacagagcgatacatggatcattatcaaagtttaaagttaaactggtgttaccgacttaccgttaccatatatctcaatacatggatatatatttcttataatataaatagataagtgtgtgaaattattttcttaaaaagataaataatcataactacagtattataaatacacaaattaagaaatatgtaacgtgtttaatccttggtttgatcagaacttttaattatccgatgtgtataaattttgaagaagggcctatagttttgtttcttgatgggccaaatcaggcccaataatgtcgtacatggttgttcttcatgtaccggagattcggcggcgacgaaaccgtcctcattgcgccgccgcaactacccgacaaacaactagctttcgtattacttccttgtatctgatttgataatg

SEQ ID NO: 23698 - DNA, 3000 bp, Unknown; identical to SEQ ID NO: 2054
  misc_feature (1)..( 3000): 2750-1469P.txt file - cDNA_ID_2149310; gDNA_ID_1620482; Annot_ID_158379

SEQ ID NO: 23699 - DNA, 3000 bp, Unknown; identical to SEQ ID NO: 2063
  misc_feature (1)..( 3000): 2750-1469P.txt file - cDNA_ID_2149406; gDNA_ID_1620483; Annot_ID_158401

SEQ ID NO: 23700 - DNA, 3003 bp, Unknown
  misc_feature (1)..( 3003): 2750-1469P.txt file - cDNA_ID_2149413; gDNA_ID_1620483; Annot_ID_158403
gtagggagaccgaaaacatgtatttacctcgaagagagcttcagctagcaatactatccttgagatgctagctcttgcatttgtttcatcggttgttgctgttgtcgaaccacggttagtaactgcacggcatgtgcagcgacctgcttgatcttgacctgataagacacaagatctatcatgatggactgcgacattctcaaaccggcttcctaatctttgaagagcgcgaacctgtggaattagttatatcagttagttagatcttgagttgatcagacacatcaaggaagagagaatcaatgagtttcaaacctgagatcttattctcctccttctttcaaggaaatctgatctgtgttctaataaaccttgatacctcccttctctcacaagagcagctggtgtctcatgatcctgaatgccgaataaggtccttcgaatgctagaagcggaacgatttagtatagacgttgaagtcacaggagcatcctctgctgctgcggtttcagcagagaagagatcagtatcttcttctccctgatgtggcgagggacggaatgcgaaatcagagagtgaagatcggcgaagaactctatcacggagtcttccaacactcagagttctactaaatctaacattgcgctcaatagaaggttctcgtacaacatgtcttctatcaagaagtccagcataagtactatccataccattaactactctcggagaacgtaagctaccatcttccccaaatctcatggcatcaatatctctaactacattgtcaatcacaggaattctcggagactcaactctatcattgagcctaatagcagattctgaaggtgaagtaacaccatcttctctatgagaagaagagactggataagtcgtgttgaaggatcttgaacttgaagctctgctaagtctagagcttatgttaccaggaatgaatttgaaatgcgaaaaaactcgacctggagtagaagattcttgaatcgaaccgctaacatttctcatctgtacattgcttacactagcttcctcttcttcttcttcaacaccacactcatcatcaagctcaagctcatcacaatgtctttcgttttcagatttcttatcatctttcaattctttatcatagcaatctgatgcatctcttctcgattccattctacgccgtgtaacacttccatgactcttcctcatccatccattacacacctgaagaaatcaaaactcatgaacttgacctaatttcagatttgaccaaaataaattaaatatcaaaaccagacctgttcatcattatcatcatcactgtaatgagaagtagaagatgaagcaagacaagaagagtgaagaccacaaaaaagactctttgatcttcttctccttccaccaccactagaagacgacggaggaggttgagccacgtcagaagcttctctcgccatcgccgacgagcctagacatgatttgctccggccagatcccatcttcttctcaaaagcaaacaactttctgctaaaattacatcattgacacaagacccacaagtcttttccccatcttcttcaaatccaccaatcgaagaaacctccaagtcaaaatctaaagatcgaaactttttcctcagatctttacattgaaacccgaattcgtcattgacaatgcagaatcaaaagccctaattattgaatccccagatctgaaactcgatcgagattgcaagaatacctcgaaatctgaactttttttattgcgagaaattaatgtaggaactaagctatgtgtgttgtctttgaatcaaagagaaatgctttgaagaaaaggaaagatttttaggtgatcggagtaatcgaagaaggagacaaagcacctatctgcgatagagagagagacttttacgggaagagtgtgtcttgatgttcgaacgagagggaacaaaaaaccaaactcaccatttctttatttttctttcttttctttttcaaactattataacattcttttgttttcgttcgattttttaatcttttttgcaatcataattggacttcattgaggactataattgagaaaaaagctttgaaatggtcattgaacagtgatcacttagatgaaaaatagttgtaaccaaaccaaactagaatattcaaactatactcaaaactgaaattttgttgacaaagccttttggttttataaattgcgaagcagaaatacaaaatcgaaccaaaatcgaaccaaaatcgaatctatattctcaaaaattaaaatataattgaactacactaacttcaaagaaagaaagaaaaaagatatattaaaaatagaaaaaaaaaatgagttgaaaaaagtaaatcacaataaactaaaatatacaaatcatttttttttatgaagtgattgttttcagtattttacaatttagatatagtggcattctagcttcagaagatttttgttggaccggccctgtaaagtcgatttaaagaccaaacaaaaactaattttaacatgataaaatcgaatcaaataaacggaaattcattaacattttatttataattataatgttaattttactaaaacctacctaaaataaaaacctgagtcaaaatatgtaaactaattttaacatgattttggtttgatttactaaaccaaaatcaaatcaaaagacaaattatgtatttatgttattcagtttttcttttctaaactaataaaaccatgaaaaaaaggattggaaacaaaaccgtaaaacccatcgtgtcattcctaacaaacccatcagtaattcagtatcactttgtcaaaactggtcacattggctattgttgaacaaaaaaaaaagagaggtttttgaccaaaaaaaaaaaaaaaaaaggaggggttaatattgacgattttgataatgagagacttttaacgtaatttataataattaccgacgttgatttgtaaatccataaagttacaaaaaaatctcaaatg

SEQ ID NO: 23701 - DNA, 3000 bp, Unknown; identical to SEQ ID NO: 2064
  misc_feature (1)..( 3000): 2750-1469P.txt file - cDNA_ID_2149420; gDNA_ID_1620483; Annot_ID_158405

SEQ ID NO: 23702 - DNA, 3000 bp, Unknown
  misc_feature (1)..( 3000): 2750-1469P.txt file - cDNA_ID_2149460; gDNA_ID_1620486; Annot_ID_158482
tttactttgaaaccctttcttttttttgttaaagacatttaaaccttttcaaaagtaatacagtactattattgacgtcacgtactgttaaataatttccatgttttttcattacgttttaatgcattaacggtaacagattgcatatacattcgtgatcatcaatttccatgttttcttctggttttttgtttttgttttttgttttatgcgttaaaattcctataacgtgttttgattaatggactgacccgatttggtaagaaatgaaaaagttggcaaaaacttttttgagcctgaaaagcaaacccaagattgagaagtgatgcaactgcaaagtcatgtaaaaaatgaagagtacaattcatttgtgtacagttttttttttccccatctagatacttaccgttaaagtaaccaatagtaatatttcatttttatcccgacaccaatagtaatattatttactaattttattattactcaaaagaaaacaaatgacttttttggcatgtgatagtacagtaaagggaaactcaaatttcaacaatcacttttcttcatttgattttatcccgtctgtgtagatttttttggcccttaatatacatgagacatatgagatttatcctcgtttatcaaaaaaagaagagatttatcctcacatccatacaattttcattattgtgctcttttgtgcacactaatatacaatgttttgcttgttttggattgttgtagtttaaacaaggtgtaactaatggaaaacacatatgttttggtcacaaaccaattgttatctttgttgtctatgaagtttctatcgtctatatatatggtctctttcagttcgatcgagggagtagataatctataaagcgtaaatcatttctctcagtgcataacatcttattcgactttgtacactgtgatattgaaaaaacgtttctaacaatagtgatatcataagatgcattgaccaaatcctatagtatgtgttagaaaattgggagttatatatagatcataatctgatcccatataaaaagctactaaatatagcagaaaattaatatcaattattattttttccttagatcatttagttagcttaagaattgttacaaattgatgggccaattttaaattttgaaaaataaagatggattgtctctttgtgtgtgggggtcctcaatgatctgtataatctgatgagaaggaattgaataagtttggcaatactaaggtgggatgttttcttcctttaccattctaaacctatctcttctctctattcatctcctctctctagatctctgatctcttctccctctgcctcgcttcctatctctcaatcatggatcatttcgttctctatcctctgggaggattattgatggatcacatgcagttgaaaggatcacgagttacatatagcatatatactacgttttcaagagatcttgaatttgttatgccaattgagtaaactttgattatcaggaaataaaccaacgaatcagtgttggacttatttgaacttttaacaatccatgttatatgattgatggcttatcacaacaaagtctataattttaggtactaactaacactactcgtaggggaattttaagaagatccactgacttatctgaaagataaacactaactatttgtcatttctatttatttatttatttttgacgttttttcacgtaatgctaattgactcttttttgtttctcattttttttttttaattttttatttgtcaatagacatatttacagacgctagttagatattcattttaaataagagaagtttgtttttttttggttgagaaaataagagaatgtaatatactttctaaaatttatcaatcaatatttattctaaatttgttttgactgatacgatttaataaaatctagtaaaaattcatagagctgaaaatctaacctttttagtgattcttcatgaatacagtagatttttagtttaacggtatatatacatatgaaaagaacatgagaaatccaaattttgacttttttttttttctttttctataatagagccttgatgagatctaggaaaccctagatttgaaaagacaacaagtaaaaggatcttatttgtttcaattattatcatgatttgtgtggctctcactctccaatatttatataaattagggttttatttttaattttctgtgtctctctagtggggtaaggaaattacagatagggtttgttttgaatggggccgtccagtaccattccacatacacacagtttgtctcatgtgtttggtttgtatgggtgccatggactcacgtgaacctctaaattaattaattatatatatacatatacatatattttcaactttcttaatgtaaatattgaccatttactattactgatcatttcagttatttatttgtatccattttcttaaatcaatccaagaaaaaaacaacaagctttctttactagctcatcaaggattactggatcgcatgtccgttatagcatatgcaaataaaattatggattcgaatctcataatactttatggtcatttgagaaaactagaagtttagagcttttttttctaaattagaaaaaaacatataaaaaggacattaaaaaaattaaaatcattggtatgacatccggacttgtccgaaagtaggattttaaaacagtattttatccatgtcttctaaaattcactgtacaagttgatgtatacagagacataagtaccctaactctagactcacgtaaaccatttattaaactgatatattttatatatgaatataatagagaccatgtgtgtttggctcgtgtctcatctcattgcctttaaaaaggatcaaacatagtatagcttggactctttttgccgtctatgatctctctcaatctctcatcttagctttctttctctctctctttgtgtcttcatttgtttatctcatcaatg

SEQ ID NO: 23703 - DNA, 3003 bp, Unknown
  misc_feature (1)..( 3003): 2750-1469P.txt file - cDNA_ID_2149470; gDNA_ID_1620486; Annot_ID_158485
caccatgcaatatgcgacttaaaatttgacttattaaaaaaaatttgaatattatttttgggacaacgacattcatcactattaaatgaatccatttttatatggtatgttacattaatcagcatgtttatctcactgtcacacagtaaccttcaataaaaagagatcatcttccatcctaaaaacggatcacatggaatctcatataatttcagcaccacgcattcgatatgagctttataattcaaatgacaattatattaatcatcaattatcattatactacacaatcttatataataatctttctagtttacaaccaatatttgaaaagttgtgctaatttttataaacgtaaatgatcttcaaacaagattcgagctcattttaacaacgttaaaacaataaaaataacctttgaatttggaaagtgatatgttataaaaaaaaaaattattatttcacaaaaaaattgtgtaatactaagaaaagtaaatatatgattaagaccattgacgtatagtctagcctaagtgtctgaaaatagaagccagaaataataatttcctttcacaaaatcgtggattatattggtttcgtgatcgagttagttaggtaactatcattttataacaagaataaaaataaacttctttttgagttttgtagataaacatcgtaattcattagttatcgaatataagatttggtagttgattatgacatcaaagattgaatattcgatgacgcaaattgaagttgaaaatatatatatttcttttcacgttgaaattgaaatatagacctcgacacttggggtcgtccatttatacataattatctaatttaggtaacaaaagattagtgacccatatatttatagaaaaaaaaaagagtaaacagaaccaacttgtgacccactaggacgaaacattgttgcgtgacgtggctaactaatctacttggctggaataactgaatgaaagacagtttatccatctggataataatgaggatcgaatcagaaaggcttgtgaggttataaattaaaagtagtaaaggctttccacacacataacacgcacggaggtttggtttctgtctgaaatcaaactgtagttattgtgggttccgatttaaattatgacgtggaatgatcgtataaatgttataataacatgttatttgttaaaaaaccagcacaaaatcattgatatatatatcattattaggatcgtgtacgtaagtgcaattccacattcaaccactagaggttattttacttaattaatagaaagtgtaaggttagttagtgcatatataccttttacatcaaccaaaaataaatgtatgtatttattattatgtgatatctttgctaatggttatatatctttcaatatagtatttgattggcagtattgtacagtagaatgaaaaatctgatgaatgctatattaagcattaacccactggtaacaagatttgagacagccatctcaattatcagaaagcaacaaaaagagtcaaccaattctgattattaatttgatttagcgatagatgcatggaaaatctgagatgcatgacttacattattagccttagttactttatttgaaaagaaagatataacttatttttcaagctaccgtttgttagcaactacgacatatatttttttataattattttgttgaacatactgaaaatataaaaagaccggtttcaaattatattaaaacgaagagaatatgttttccagtaaatttctatatcaattatatggactagctagacgtaagctattcttgtatgcaccccggtttaaataaattatatgtatgttcacccaccatattttccgtacatattcaagatgtttaaacttggtaaaacaaatgttattgtaactaaaaccaaaatgaaccttaatttgattaccatatagttagcttacaatttccggagattagtgtagattttcagctcagaatatagaggcgcatatgtctttgagtctttctaatttctttaggccaagtccggtggaaggtggagctttaattacgtaatgaatgcggcaacttgactttcgttctcaagagtcaagatgaaaccaaagatgtgaactaatatatctcatcacattactacaatcttacataatgaaaaaaaattcaacttaagaaagtatatccatacacaatggcttttcgcttacaaaggaaaagaaactttgttttgtactctaaactttttttatgaatcaaactaaagttaatacattttttttgcttgcaacaaagtttacacatacaagttctatcatattcaatttgatcttctgttttttattttgggtcaacaatagcattaaaacatacttaaacacagtttttttcaaccatcatttctatgtaatactattaatttccataaatttttgttttatcacatacttattcttactcttgattattatttaattttcatcatcatttcagaatatttttatttctaactttcatttttttttttaactcactttcacataaatttttactccattgaatatcctatttacaacttctgaaaattaaatattttctagattttattttattttttcctaatattgttaacgcccctcatctcatgggtgaactacctagtcaataacagaacaaaataaaaagttataggaaaatgagaaaaaaatactcaaaaaaaaaatcaaaatagtaggttgtgacgtttcaaagtcacccgcacaaagcaaagagattagaagactctcttctatctttaaatcccttctcagaatagataacagatatacactccatcaaatctatacctacatcaacctttatatagttatatgtatcaccctctctctttctctcccttatatatataactccaaaacaatcatttaatccaaacccaacatatccttttaacagaatcttctttatctgaaaatatctaaagaaaatg

SEQ ID NO: 23704 - DNA, 3003 bp, Unknown
  misc_feature (1)..( 3003): 2750-1469P.txt file - cDNA_ID_2149497; gDNA_ID_1620488; Annot_ID_158525
agtcatctaatctataaactaatccttgatccctaaaccaaagacttaaactttgactcattgatttttagatcaccaccaagctaaaggatctagattcaaacattcaaaagacccaacaaataaaaatcaggacttttcaaaaattgaagtgcaaaatctcaccaattcattaccactgctgctggaagaaaccatctttgaagaatcatcctcagagttcaaatctctagtctttctacttccccagccagcagttagatcggtgactgtagattcctcagccgcggagacgtctttattgccggaatgttcagagcgagtaaagactcgaccggagttaacagctaaacggagaccagagcgaacggcgtcgtttacagggaaaggccaaatctcggagagagtgtaagaagaaggattagctgcagagaaggaggaatcgttcactagtggagggtccatttccgatgatcgtaaaaagggttgacccagatttaggacccggatccgagaagtgaggaacttgatagaaaaaaagaaggaaaaggtttgagctttgcgaggtcttgtcttgtttatagggttgtgtgtgaggtggacaaatagagagagagatcggagaaggtaagacagatgtgggtagtgataatgcgccactagtatgcaatggaagatgatttatcaccaatactttcagaaaatctcattaattacacagcttacatcaaatattttgccgtttctgttataaaaaaaatattacaatggtaaaattttcgtttcgtttagaaacaaaattgaatagaaaagatatattatggcgcaataacctaaataatttctatcaaaaataaaaaataaaaatctcacaattatgtcttttagttatcctttgattaaattattttttactgtgaacaactttggtaattttactgtgaacaacttaaatacaccaaaggacaatgcatctctcttagaaaaaaatacatactagcaaaaccaaatcatgttactttggtaatttcattctgacgtgtttaaggaaaaaacgtatatgtttggattaaaaatttgatcttcgtaccatatgtccatcctagtaagtactcgatcgcctatgtttacaataatattcaccaattagtgtttttttatttaacatagatctcccacttcatagtcatatgttttatgaaagttagttgtgtaaagtgaagggaaccacacaccggtacgtaggatacgatcgaggatgtgacaatgggccatatatttaaattttaaatgcttaatcacaaaagccaaaattctagctaaatatataaaacgctaatatgaaggatagatgacatgtgttttagtctttttgtttgcatgtcaacgttcttcacgttaaatttttaaaaattcagaagctatagttttattatgttcaatgtagttttagcctttttggtagatgacatgttcaaggtagttgcggaaaaatacaaggagccaagagtgtcatttttcgtttcgatgatttcaaccttcatttgttgtgtttattataaaagtttgtatttttgaatgatgaatacagagatatcaaacgtttttaagaatacagtatataacaaacaaaaaagctctaaaactattcactgagttaaaacttttaaaagtcaattctatagcattgaatgctctaaatgtgtagcaagaaaattgtttaaagaccaacaaattagaaattgatgtttttctgcaaaacttttttaattattaattttattatcgaattaagtggaatatgtttatattttgatgaaataatgaaaaggtggaaaagacaagtgtagaaagagaagacacctggatgcaaaggtgtcacacatgaagcccaattcctctctttccatttttcccataaagcttttttgctctactcatcaagatacctctaataaaaaaacaagaaacactatttttttgttatcaatttcttctgttcatttcagtttggtcatgaaattaagaaaattaatagagagaaaagtcaaaaataaaaacatgagcataggagtactatgtgacttcattggtgatggaatgacacagttggccgatttagcaccgactaagtagacattaatcaataatagtttaaatttcaaaataagaatcatatctactaaacaatcaaatacatatgattccatctactattattgtttttttttaatttataaatcatatagtactaattaactaataatttcacattctgtctcgtgtaatcaagacaaccttttcgatttgtttttttggtcgatttgcttaaccttaaaaatcttattacttcaattataagattaaaattcgacaaaaacataacgtttttcctttttattctactggtggtggaaataatcatctagaataataaaattactttaatttgaaaagataaatccaacgaatctataactttaatcgaaaactaaataaaataaggaaaaagagaagatttaaaagcgaagaaaagattcgaaaaagagagagagagagatggaccaaaacggcggtttattcagacgtcagcagcactaactaagaaagaggagagagctttaactcttccccttgctgcttccttctccaaattctcctgacgcgtttctgttcatcttacgattttacacgtctctctaaagatttaaattttcgactttacgtttctttcgggttttgaattttctcactaaagatttgtcttttccatagaaagttcttgaattttctctcttcgtgttcaaagggtttttcagaatttatagtaacccaccaatctactgattgtctccgttcatcgtaatctctcaagatttgatttttatttgttttttgaaattttgaattttgagattctgttcctctttgatcatcatcactagggttttctgtttccagttaaaaaaaagtttggatttttcttcgtataatttaggaatg

SEQ ID NO: 23705 - DNA, 3000 bp, Unknown; identical to SEQ ID NO: 2102
  misc_feature (1)..( 3000): 2750-1469P.txt file - cDNA_ID_2149513; gDNA_ID_1620488; Annot_ID_158530

SEQ ID NO: 23706 - DNA, 3000 bp, Unknown; identical to SEQ ID NO: 2104
  misc_feature (1)..( 3000): 2750-1469P.txt file - cDNA_ID_2149519; gDNA_ID_1620488; Annot_ID_158533

SEQ ID NO: 23707 - DNA, 3003 bp, Unknown
  misc_feature (1)..( 3003): 2750-1469P.txt file - cDNA_ID_2149529; gDNA_ID_1620488; Annot_ID_158536
gcacagacatcaaggaaagcatataatatgttgattttgaactcgttttctaggattgtttctttattctgtagctttgaatttgttccaactgaaattgtggtcattgttttgtcaaaaaaaaatgtggtctttttacatatatcagaaaaatgatgtttttacaaatctcgtacttgtgtgacaaaaaaaggtatatatatatatatatatatatatctacatatatatttttgcagtcattttgtgaaataaatcttggagttgtatattatttacaatggctgacattggcttttaattattgattttcttttggcaataaattgattaataaacaaaaaatattccaaatatattccaatcccatatatcacgcagatttctccaaaatttgaactaaatttcggaaattatttaaaataaaaaatatttgacaaaccaaaatacaattgcaatcccttaaaatgagcaaaactcacctaaatacattccttatcagtttactaaatcttatttctccaacatttgaattagatttcgacaactatttaaaacaaaaatttgtttgacaaactaaaatataattgcaatcccgtaaaatatttttttaaattagcggtgtaccgcagatttttttaacgggacgggtttggtagaacgggtttggaaggatgttacttaataacaattgtaaactataaaatataaatattttataaataaatataatttagataaatataatttacagacttttatatatactaattaaaaaaaaaaaaattatctacgcggtgtaccgcgggttataatctagtatgtcttatgcttgttagaagaaagtcggatgttttgttcttaaattttgaatacatgccactaccatgtgtttctaaaacaaaaacgaaaccatctttaccatctctagttttattaaatcgggttagttggttaaaattcgttattaaattaatttataacttattaaatagagataaactgttatcataaagcaaggggaaaaaaaaactaaatcgagcaaatacttgaaaatatgtgacgcacaaaacatagtatatattataatgttaataggtttgctattctggcatcaattatggttttacgtaaagttcagacgttttatttttttatttaaggattcttacatatgtttatgtttgttttttttttttttttttttttttttgagcaactacttatatatgtttgctgtttttgtccgaaggccaattagttttcctttaacacttgaagaatatatatttttctctgacataaaaattctaaaatagttcaacttgtacaagtaacggaatactaaattgcatgtcgttgttgttatcaataactttagattaacgcaaagtgtaggaacaaagaaccaaaaatagtaaataagtgtacatgtttgaaaacggataacaacgaatactaaaagatcatataacaaacgacgacggaagtagtagtggtagtagcagcggcagcaaggtccagtcaaaatcacttggcatttggctaacaaagtcatcgtaacgtactataaacaataatatcaacttctcttatgcgtaatgcatttccatttatttagattcctatattatctgcagaataaaatataacagaaaagaaaagatgacaggactacgaataagcatggtaaattctgaacccattgtttctcagtggggaatttttgagtaataataattgatatcaaatctgaactatagtacaaattttgttttttccctaaaggatatggaaatatggatttcgaaaattttggtacgaataataaagccaatcatcggactggaaaccatttttgtcggaatttttcaaaattcattcggctgatttaatgtaacaaatactcatatataaagcaaactgaaactaagaaaacaaaaaacctcaaattgaagaagaatcttagtatataataaaatagggtttggttatggtcaatttgagtccaatattcttttcagaaaaaccaagtgagaatctaaccgaattatttcccgactttattcggtacctcgaactcgtaaaccgaataaaccgattcggctacaggctctgtttcgctttcttgttggtcaattataattgaactagagtcaatcaatatcaatgtttgtggtcaaataattgaaaatgggcttttgtatcaacaactgttggcccaatttaaaaatggaaacccaaacatctttaccaaaatatccaatccataaacttggatcgttaagtagattttacatactttattgttatgatttattcacatgttgtcacggcccagtgttccctatagtttgattggattgtgtctaagctattgatttcctttaccaatttcattagccggtccatctattggaggaaaccttaagctacaatttattttctttaccaattccacatatacagtttaggataaaagcgaaattgtcttttttcaaacacgttctcttccttttgttaacaagcaaaataacatgtgctcttccaattttcattttcagcaacccttcatgaatgggcccaaagcctgccacaaacatgtgcacaatattacaaactctaaaaacaaaaacaaaataaaacattcttttttcccaatttgtattttaatatcaatttgaatcaaactcatagttttaaaactcaattttgtaatcgaaaacaatttttttttttttttttaaggaaacttacacagtagagaaagaaacggaccattttaaaattttgaatttcgtaaacaaacaaaatagtagcccttattagataattgggaaaaaaaaacaagaaacaaacacagagaggagtgagcaataataaaagctcactcactcacacttttattcatttctctgaaaacccttaaatctccggatttcgattcccgaggctcgaaaaaaccctaaatctcttctccgttcactcatccaaccgaagatg

SEQ ID NO: 23708 - DNA, 3000 bp, Unknown; identical to SEQ ID NO: 2095
  misc_feature (1)..( 3000): 2750-1469P.txt file - cDNA_ID_2149557; gDNA_ID_1620487; Annot_ID_158499

SEQ ID NO: 23709 - DNA, 3003 bp, Unknown
  misc_feature (1)..( 3003): 2750-1469P.txt file - cDNA_ID_2149576; gDNA_ID_1620487; Annot_ID_158505
tatcttcatcttcttccttgcacttttctgtttggtttacggggtaatctaaaactttgttgtgtggccattatcagcaaaccacatcatacgagctcaatgctctatctcaagaatggagacagctctgtgttaagaatatggagattcagtctgcttgtgccatgcttgagacacagatcgattcgttcaagaaagaagctgctgaaaggtgaggaaaatgttgtcttacttctttatatcactcgtaagagttgaattttaagcgtaaaactgaaactcgtggggttgtgtgtttcaggggttggaacttagaagagaaactagagaacgtcgagccacttcaaatgcaatgaggcgcctcccttgctcttaagtaacataggttcagagcaaaacaactgttggtcagtttggtttgagttgtgggttaagagaatcaaagacgagacagtttcagttatttgccagttttgtgaaatcctctgctctcctgtcaagtggtgtgtgggacaagtaattgcttttgaaagtatcgaaactctttaatttatcgagcataacgtttacgatttgaaatacaatataaatttttgtatttagaaacatatattctctctctatattaagatgttgcatcccttattctcctataatcagaatgcagaaaagctcctccgtccatttttttcttcttggatagattcaaaccaatataatatggttcttccatgatattacttcttgtggtttcgtgtggtacaaattgaattttctactcaaatttgaatatatccatgcataatgcataatgcattgtattgtaaatgatccttgagcttccctttgtttaatgttaattagacgcacaaaaaaatgtatagataaaagttaaagtgacggagccattgctcataaacattatttttcttaatcttataccaattttcacaaaacataaaaattatgcatttcctaccgactaccaatcctttaaataaatatatttgtatatacgtatttgacataattttcaatttaaatattacaattaaaccaaaaaaaaaaatcacatattggaaggtgcacacgtacgtcgtcatgcgacccaccaacgaggctataagacacggaactcgttagaatgtctctttcctacttaacaaccttcttatattgccttttaacaaagaaaaaaaatccttcctatattgctattattattatgatgcatcttattatcacctaattaattaatggaaaccccatattctttctcaacacatttcaattggatgttgaggtagtcaccgcacgtttttggatgattataaagtaaaagcttctcttaagtagatttagtccttcatccatagtaagactcaagttatagcaaaacaagcaacaacaaaactaatcattactgattgaaaatatgcaccatgcattatgcaataattaattgtaaccagtagattggtgatgatacaatttcagaattagaccagtcacgatccgcatatgacattatgatcacaattcacaaaacatatttactaacaattatctaaaaagttttgacatgtatatgtaaattgtttgtcatccattgacataagattgggtaacgattgctatgtatgtcttaactactctataagttttttcaacggagttagtcctgataagatggggatgcttaaaacttcataagaccatatatacatcaattattgaattcaaatatacaaagaaaaagaaaaaaaaagaatgtaatgagagattgttggaaaaagtccaaagtcgacaatcgaacaaccaagtttcacataagtctagaaaaacttcaccaactgttagttgattcatagctatcaggccacatttgattctgcctcattcgttaataggtctcaaggaaacaaaactaaacaattagcaatcaatcatttagattttggttgtgtctgtcataacagtcaactacaaactttctttcattttcattattttattaaagaaaagtactagttatgaacttctaatcaatttccatatgttcaatatttttatttaaatatatgtttctaactacaatctatatactctttttgtgtaagttgtagttgtgataatatgtttgcttgtttttttttgtcaaccacacattattatatataatgtatgaaaataaaaattcttcattgataatctaatttggaaaagaaaaaattgcaaataaaactaacatgtcctttaactatggctgaacaagctaagatgatttataaagcaaaataaattcgtccacggaaggtttgagaaagtggataatttctcggggttacgggacatttgatcagcttagaacaattgtctcgaagtctaaaacttttttatcctattggaataataatgatatattgaaaatttggaaatgtcacaaaccacaagaaagaaagaggttaataaaccacagagaaacacaatgctcatgaaaatcaaattcatgcttgacaattttattaatcatttgttattttattttggttgttcgttataattaatatctattaatttatttgaaatgaagctaaaaagaaaaatcgtggggagcattcattaagctgcttactaagacttgttcttcgactaatacttcatgccctccaaatccttcctctccaatgccgacactcgcctgatttataaaattaataagatcctcttcttttaataatacactaatgttcatctaatttttattttttaaaatctataacacctaaacgttctttccttgatcctgtcttaaaatccagacatttatagagacaataaacacacgaccaatgtcgtaaaagaagttcttaaatactttacacaatcctctccgtctttcacattcattcatccctctacattagcacgaagattggtttcaagagttttcttgtaacccaagaaagaaaaagtttgtgtaacttgagaaacaacataatg

SEQ ID NO: 23710 - DNA, 3000 bp, Unknown; identical to SEQ ID NO: 2088
  misc_feature (1)..( 3000): 2750-1469P.txt file - cDNA_ID_2149588; gDNA_ID_1620487; Annot_ID_158508

SEQ ID NO: 23711 - DNA, 3003 bp, Unknown
  misc_feature (1)..( 3003): 2750-1469P.txt file - cDNA_ID_2149596; gDNA_ID_1620487; Annot_ID_158510
attcttccttgtactcatatgaaagaacaaaaaaaatcggacaacaatatgactccttgtagtacacaagtgaagttgagactagattctttcatgtacatattttatcaaagagtctgagaaacgataaacagagacccatataactcaaatgatttctacataggctcagttttaagtcagcttaaaacaggagcaattcttcagggcttgatctcaagttttaatgtcatccaatatatgttattgcttatcttactaatgtttcatcaattgctcatcttgctagtgttccatcaagcttgggtttgacgtggtttaaacaatttctgcaatagcaataaagagcatagaatcatcgaccattctagtaaacagagaactatataagcttgatcaatcacaggcttacctttcttagagcatcaatcgaccgcactttctcatctctcttttcacaaaagcactctccacaccagctggagaaatccttgtgatgagttttgagctctctaaatacagaactgcaaggaacaacacgaaagacaagcttaataagaaaccaaataaaaatggaaagtcaattgcaatgtaaaaaaagatgcatggcagtctagaggcaagttttagatgctatttaccttctgcaccatagaagcatattgacccgatgcccgcatgttgtggctctggcaccatggcggtggcggccacggtgaagcacagcttgtccaggtatatgacaataatcatatgtttcctgctttcgcagaaaaaaaagagttgtttatattagctatcagccatatacagaatgttagaagacaagaaagcaacagaaaagagtggcatacatctgcctttgttgctgtgttcacatgtttttcacaccgtgtgcctctgaaaaatagctcccctcccacaaattgattacccaaacaaacattcagcgttacttctgaatcatccacatgaaagcctgaaaatttatataacatctgataattttcagccagaataacgtgagtattggaatatatctgcatttaggacaactagtcaggtcatgggaaattatacaggatatgtcaaagggtctcacctaaatcaacatccctatctttcccatattcaacaacaaaaccatggtgagagtccagagttgctccacccacatcactgaagaatactgcaaaacaaaagattcgaagtagctttttagttttaacactgtgaacatattaaacagactttccaataatagactatgtaatggatttaaaaatatattgcctttagagatgggacgtataaacccctccatgagtttgtcaagcatggtgtctagaccaaagtcgtcaagcacagcaccgtatttattcatggtgtttggtctcattatccggaatttggtctcacccacccacctttcaaaattgtctatctgcatggtcaaacaagagcaaatgaacaaaatacgaaggataagagaaaaacaaaaaatggatgcacattacctcggctagcatcatctcacaaaagctaggctggagcatgtcaaagacgaaaacaccaggagacggttcagatattatatttctgaagctttcctctgtgttttcatttatcgccttaaggaaagcaggaacgaaacatactgtgggaactagagtatacaactccttgtgaagtggctgcagtagaaaaacacttcaaactactaacaaatgactggagcagagcaatacagaacacaagaaagctcaagaaaggattcacacctgataatttgttgtaatcttcagcctatagtcactgtgcctttgagcctgtagcatcagccaaacaaaactacttaataaaactcttgagctcatattgacattttcaaaccattcatgcaatatcttctaccaaccatcatctaaccagattgaaatttccataaccacttaactaaaagtgaaaccagttcatagtagcaattagcaaaagctcaaattttcataatgaagtgtagcttctaaagcaattcacagtcatcaatacaagtaaaaacaaaattcaagagagaaaggtccaaatctagtacttactctggaacgctctccatgaggaagatgcctaagcataatatcagtcatgaatttgattttctcatcacgattcgagacgagcatattcggaggcaagtacttctccagactagaatataccgagtttgggaaatcaagctgcagatcttcataactatcgggtctatgctcgttgttagggtttagccttagtctctggcaagaaaccatcgtagaggtagctctcaatgtcgtgggagccgccgaatgagaattctgacctgcaattgttccgttaccttccaccgtcgtcgtcgtcgtctcttgcgaaccttctcgctgctcacttgacattactaaagaaggcagagaattcaagtgagaaaaaactagggtttcttcttcacactacattccaaaagcaaaaaatcttaaaggggaattgaaatcgactttttaagctctcgatctggagattctgatttttgagttcccgttgaagttagggtttctgaatgttccctcgaagatttttttatcttttatttatttgttaatattacgcacgaaaccaccagtcatacgccttataagaagagttaaatgattttctagcccatctattaggcggcccattaaataattcgaaccggttatttggtttaaactgaaattaccggtataatcgtggaattgaaatcattcgactttgagttgtctgttagtgcgttattggttaacacgtgagagatatcgatagtctcctctggagtttgttaagttcacacgtgtgaatgaaagctttcgctctcaaagcttggtgctttttcgtctcttgcctctgccaaaatcttttggccgccatcgatctttccgatcacggaacaaccgtacgaattgaaagtatctctgcggcgaagtagaaatg

SEQ ID NO: 23712 - DNA, 3000 bp, Unknown; identical to SEQ ID NO: 2109
  misc_feature (1)..( 3000): 2750-1469P.txt file - cDNA_ID_2149658; gDNA_ID_1620489; Annot_ID_158560

SEQ ID NO: 23713 - DNA, 3003 bp, Unknown
  misc_feature (1)..( 3003): 2750-1469P.txt file - cDNA_ID_2149752; gDNA_ID_1620490; Annot_ID_158584
atttatgttattttccgttaatgttgtccatgttaaacataacacctttaattttattttgtccttaaacgtgacatttatattgatggaatctctatacttttaagaggaaaaaaataaaaaaaattggaaaagagaatggggatgagtaaattgaaaatgatgtcataaataaagtttgtcgtgtcgatagatgaggtggacagattcataggaatggtcacatttatgatgaagtcgacatattggtttcgtagttaggccacctgctcttctcttcataactcttaagttgcttaaacctatttggtctttatcgtcaaccgcttgtcggagaatgtgttaatttttattagctccgaccgcatcaagttagttaaccatgttagttatgtttgtatgatcgacaatgtgtattttgtttttttaatagtgtgggaagcatctttatatatgtcttgcatatctcttttcgaactaatccctttaacaattttataacttttgatacaaatgacataaaaaaaacattcatcaactacttatggatattaactagtcactttatacatagtgttagcttcaccatttgttctacctacctaacatttaaattacatgtggttggtggcagaattgatatattgcttcattttttttttgtaaaaaatatatttcataattcctttactataaactatacactgttgcatgtaacaaaatatttatacattattcaattgtatgcgtatatttttgaaagaggtataatttaatagagaaacactaaacatatatagtcgtcaactttttggatgcatagttcgattcgtttatcagtgttgtgtgttgttacatatttattcgtttttggtcctcctagacatagaatgacactgataagaagtcattaaaattatataatattaataactattcaaaggtattttgttgttgtcaaaaacaaaaacatttgaaagatttcttaccaaaaaatatgttaattcttgaaagggtcaacattttgttttcctcactcctattaaatccaagttcaaaccaaattatatttaagtatttaactaatgtcgtaagattactatttgtttttttttaatgagtaattacggttggccgccgcatatggaaattagaaaacaaacttggtgcagttcaattcaacaaatgattcatcatcaatggcgtcacgttacgtgtccactgtccaatgattcaatttccattactaatttttaacacatataaccaaagcttgactatgaaacgtatcaaattagtaaaccaatctccgactaattaactactttatataattatagtttaacccccaaaactaatcagatattaagactaaccccatctattaattttgacagctgtcttaacagcggatttgtggaggctcgtagaggttttttttttttttttgtattaaatttaaagtagccatcaaagattgttttcatctatggtggtacacactttaagtagttttcttgtgtcacatattacacgtaacaatcaactaccaaaccccacatatataaaaatctaaaatttatccacttataatttttatttatttttaattattattttagttgaatgcatttaaaaattttctttttatgaaaccgttggttttttaatattaattttttttacagatattcgagatggacgaagattatctgactaaaatattaaggctttgagattattgggtaaactaaatttattgcttataaccaataagatgaattagttacacgttattaacttgaatttttctaatcacaaattggaagtttgctacttacttagcttagtagtttaatcaattcaaaggtaataatagagtctaatggtaacaatagattttatatttgaacatgaagattctaaaaactgacaaaatattttcattttcttaaatttcttaaattatacatatatatatatataaattttttatataatgtgagaagatatgataaccaataaaattttgctttcatatttttattgacaaaaactccaaatatgacgaaaccgcacggtacaattttaatagaaacaaatatatctatataataatatccgcagttgaatcgcatgtctccattgggagcctaataacaacccaactaataacataattattttaatacttagtttacatattaacatttttaaaaattgttggcttaaaataaaataaaagataaaataatgaaaatgaaagattctttttaaaaaaatgaaaaatctctcttatctaaaaagcaaaacaaattttttctttctaaatctggacccaaaccccatatctctcctctataaatataaacgtctcgtctcttaaaaaaatcgtataaactcttatatactttctctagccgccacattttaatagaaataaaaatatttctataataatatttgtagttgaatcgcacgtctccattcgaaacttaataacaacccaattaataacagaattattttaatacttagtttacatattatttcttttttaaaattactgattcaaaataaaaaaaataaaaaaaaaaatttaaaagaaggaaaaatctctcttatctaaaaaagcgaaacaaaattttctctctcttataaagctggaccaaactccatctctctcctctataaatataaacgtctcgcctcctgagaaaaacgtataaactctcacactctccctagccgccacctaccctccgccgcctccttttcgccgcctgcttcgctccgccgcgcgcagcgcttttagtctttttctgagactgtttccgaagaatctctctgttaggattttgtttgattctggtcgttatccagatcagagaaatccgtgatccttttttctctctcactttcttctctgaaataggaaaaacaaaaaacaaatctgataatcgaaactgatcactcactgctgattccgtaacctaaaaaatg

SEQ ID NO: 23714 - DNA, 3003 bp, Unknown
  misc_feature (1)..( 3003): 2750-1469P.txt file - cDNA_ID_2150159; gDNA_ID_1620686; Annot_ID_164604
atatacacattcatgtacagttatggtgttatcacacaaccgaactgagtagtttattgacttgtaatagtgtcgctactttacctttttccaaaaataatgcatgtgtgaggagttgtcgacgatgatgaaaaaatgacttatgatattcttacgaaataaatctcactaaaatttgaggtttttttttttttttttgtcgtaaaatttgaggtattaacccaacatatttggatgatgcaaataaaaactttgaaagtaacaacgttaaatagcataagacattcgttttttcactaagcaaaacagtcgtgttgtacaatttaaggtaacaaaaccgtaaaaactgaaacacatatcaagagattatttgacattttcgaactgtgttacgttcttgactccagtattcacatctagacgagacgttactgtttattgtaaccaataatgtatatatgtttggtattcttatataagtttcttattgtttttttgcattgccaaagtgttttatgtgtctcagtgatcaacatcataatttgtatcaaagtcactgatatctttcttctcaaatctagtactgcataatataattttttcttagtaaatgtgctacaattttataattgttaaacttagcgtcactcatgagtcatgaaagctgatgaccaaaatcatacaggatataatatatgttgggaagaaaagagatctggagcaacacctactaagttcgctgattagttttctaatagttacttttaagtattactaataaactattacttcctctgtagtcaacgaaataagtgtagttaactttcatttgatttcttaaaatataaactttcattatttgatttaattcttttggcctaccacaagcttttgggtgtgtacatgtgggtgcatgtatttaaatatgtaacacttgtttttttatattcataaaatgggaaatgctgtacttgcttattaattactcactatttacatattccaactttgaaatattgttgattggtgaaaaaggtacttcataataatttaactaaattgtaccatcatatattcgtctaagaaaaactcaatcttttatcattgttgatttcacacacaattccaaatttgacacgagttatataacatgatacccatattcaacaaaccactagactctatatttatctttagttttaaaaatttgtcctcaatattaaaattaaggggttggttatatatatcaagaaaaataaaaagattccatgaggtggctttaatagttctgattaaaggtgttaattaattaacaagatgaataaaaggttccatttaagagtaaagtatatgataacagtgtgggggatgatattggttcaccttaataaagcgattgcaataattttatgtataactaacgaaaagtttataccgtttgattaagaaaatgagaaggtcatgtccctctctctctctctttctcttgtatttaaatcaaaagcaatctctaaccatatccaaaatcccccctaattccgggttttctttttataacaagtattaatttggacttggttcccacttatgtttcttctttttttttgccaaccacttatgtctcttttttataatcctaaacttttcatatgttttttgaaatgtcccatctagattcagttagtggattttactcaacttgtaatacgattctactacataagatgagtgaaagagttaacatgcgcttatttttaaggttgaaaatcgcaatgtacactctctagaattatagtataaaaataaaaaaaaatctaattcagatttttgattgttacaggctaacagcaaaattaatatggatttaaaagattaatactggaaaataataataattaaaagagttttaattaaaacttcccccccccccccccctcaatcccacgattaattaaaaaaggaaaccaccgaataaccgtaattactataatgacgtggcacttagatttcgaatagccgctgtaataaatattaaaaacgttttgtcattttcctttttctcttctcaaagaaaaaaataatcactctctctttttttttttttaattcacagacagaatcaaaacttgtgtagaccgagaatccatctctcacaaaccccaaaccaaaaaaaaatcaaaaaaaaaaatcaagaacaaatcgaaatctcaactctgtgaaaacctcgtccttgttcttcttctgcttctcccattccttcgatttttgcttcaatggatgtttgatttgctctctgactgcgtttggtgagcaacaagtccgtcttagtgtttatgttttgttttcttgcctgatttttcttctttcttctctatttggttgctgtctcaaatggcggatgttcttatgaatctgtggaacttatctacttgtctgttttcatttcatggttttgagtgtcggtagatcgaaactacaactgtcacttaccgattcactagtgagctcactaccactagatttagttttttgtctgcattagatttgcttccactcccaggtttgatttgcgtttctccgatttgtttacttagatcgattcagtaatcacaagttaggttttttctttctgttttttttttttcctgtgtggatatttgctctcgttgatcctgtggtgtaggcagaaaatgttgattagatgatttgaaaaaacctgacttatagggattatcttcggatccatatacaccattatgagtagactatgtatatgtattggataaacaagtgcttctatgttcaacactataaaaatgtagcttcaatattcgtcactgacaatgctgattgatgtatagctcatttcagaaacactagaaaaagctctgatttaagtgaatgctattttaggtatactctacaatacggttttattagtggtgtgctaattccttttctgtctcttctatattttgttgatttgtagtttactatactatg

SEQ ID NO: 23715 - DNA, 3000 bp, Unknown; identical to SEQ ID NO: 3039
  misc_feature (1)..( 3000): 2750-1469P.txt file - cDNA_ID_2150159; gDNA_ID_1620621; Annot_ID_162303

SEQ ID NO: 23716 - DNA, 3003 bp, Unknown; identical to SEQ ID NO: 23714
  misc_feature (1)..( 3003): 2750-1469P.txt file - cDNA_ID_2150159; gDNA_ID_2926202; Annot_ID_201909

SEQ ID NO: 23717 - DNA, 3000 bp, Unknown
  misc_feature (1)..( 3000): 2750-1469P.txt file - cDNA_ID_2150189; gDNA_ID_1620692; Annot_ID_164830
aatggggggttaatgttcagccgttatctggttcacctgcaaactttgctgtctacactgcgatacttagccctcatgatcggatcatggtaaagaacttttgcactcttcatctccgctttacttgtgtgcttgatatagattgaatataatggcttgttttatacgattagggtttggatttacctcacggtggtcatctgtcgcatgggttcatgaccgctaaaaggcgtgtatctggaacttcaatatactttgagtccatgccttatcgacttgatgaatcaacaggtaatgcatttcttatgagaagggtctctgaaactacttttgtatgaggctatttcctgatgtctgaatatttgaacaggcattgttgactacgatatgctcgagaaaactgctacacttttcagaccaaagcttattatcgcaggagctagtgcatacagccgagattttgactatcctcgcatgaggaaggtagaaacacaacctgatccttgaaaacacctttcatgtttctgtctacttttggctttcaaatataaatctgttatttcattttcctcacaatttgtatgaatttctgaagatcgcagactcagttggtgcttttctgatgatggatatggctcatatcagtgggcttgtggctgcttctgtggtagctgacccttttgagtattgtgatattgttacaacaacaactcacaaggtatgtatgttccgaaatatgaaacatgatttccatttgtatttagacaaaaagcgtttccagattatctgttagtaacacacttttaccttactagtctttgagaggtccgagaggtggcatgatcttcttcaggaaggatccaattaatggggttgatcttgaatctgccgtgaacaatgctgtcttccctggtttgcaggttgagatattcaccattatttttagctctcttagataattcttctcccaacgtgattaaaagttgtctgaattgtatatttgaagggtggccctcataaccacacaattggaggattagcagtctgcttgaaacacgcacaatcaccggaattcaaggcgtaccagaaaagagtacccacccttttacttgatcattaagttcttctgcaccggataaagtttgtaaattttgcttctaacaagaatcttttgctgcttgtttaggttgtgtctaactgtagagctctagctaaccgattggttgaactcgggtttaagctagtttctggtggcagcgataaccacttggttctcgtcgatcttagacccatggtaagtttacaaactgtattaatggcttgaataaatcaacttttttcttaaaccagaaaatcacttatgataatgcggtgtcagtctaacatttttgttgtggttagggtatggatggtgcgcgggttgagaaaatcttagacatggcatctattactctcaacaagaactctgtccctggtgagttcgtcctcctactctcggtcttcttcttcccatttgaaaagtcaattctgagagaagccctcttactcttttacaaaacagaaatgaagtcgataagtagaacttgtagaacacaactgttaaagaaatgcttaattgttgttatagcaaaatcatcaattgctatatttatatgtttgattcccctagagtagtgaaattgagacagtgttgttgtgtatgtgaaatggtgaaacaggggacaaaagtgcgttggtaccagggggaataaggataggatcccccgcgatgacgacaagaggactgtcagagaaagactttgtagtagtggctgacttcatcaaggaaggtgtggagataacaatggaagccaagaaagccgcgccgggttcaaagcttcaagatttcaacaagttcgtgacatctcctgagtttccattgaaagagagagtgaagagtctaaaggagagagtggaaaccttcacatctcgttttcccattcctggcgtttaagctataaacacacacagatatgctcttgttgtaccttaattattcacctttttcatctgtcttttagggtttttacttgcttgtgtcccaagtttaaagttacagttgaatcgagagaaattattttcaaaaataaatttatttgtggaacaatgattcgtctatgttcccaaatctcaatcaatatttagtataatcagttgttgtgaaagaaaaaaataataataatttgaaaaattgtttttagcgaagagagcaaatatttcgcgggatgtggcgaatatatctcacccaatctttctctttcatgcgttttttttgttgccttctccaaatattcatctctgcctcctctcagggatagactctctctctctctctctttctttctaaaactaaaacaaaagaaagagagagatcccaaattcaacgataacagattttatctgctttttttttttgtttcgtttcttctccctcgctccccaccggattatatatctcaccggaaatcggatctctcacgttggtcgatttttctattacggcggcggccatcgctttcttcttctcctccaggtgcgtgcgatcttactttcttccttgagactttggtttacgcatgcacctctgtgtctctgtctgtacgtacgtcattgatttcatttcggattttctcctttgtttgatcgatttgtatagttaaacaacattaatatggaaactcaagtgtttttaggctttgattcttctacctttccattataatcatctctgttgttaatttcattgcatggatccacacacaggaggccttcattggtattgctatggagggagttaaattcccatttggtgggattattaacgatttcaatggaagaagaaagtgttacaaacaagactggcttgctgccttcaattctggtgttaggtattatactttgttcatgcttttttcgttaacttctttcagaatttttttgcaaacttatcattgaacaatg

SEQ ID NO: 23718 - DNA, 3000 bp, Unknown; identical to SEQ ID NO: 18695
  misc_feature (1)..( 3000): 2750-1469P.txt file - cDNA_ID_2150218; gDNA_ID_2926212; Annot_ID_202687

SEQ ID NO: 23719 - DNA, 3003 bp, Unknown; identical to SEQ ID NO: 17033
  misc_feature (1)..( 3003): 2750-1469P.txt file - cDNA_ID_2150231; gDNA_ID_1620618; Annot_ID_162102

SEQ ID NO: 23720 - DNA, 3000 bp, Unknown; identical to SEQ ID NO: 17034
  misc_feature (1)..( 3000): 2750-1469P.txt file - cDNA_ID_2150231; gDNA_ID_2926212; Annot_ID_202679

SEQ ID NO: 23721 - DNA, 3000 bp, Unknown; identical to SEQ ID NO: 18669
  misc_feature (1)..( 3000): 2750-1469P.txt file - cDNA_ID_2150259; gDNA_ID_1620618; Annot_ID_162128

SEQ ID NO: 23722 - DNA, 3003 bp, Unknown; identical to SEQ ID NO: 18670
  misc_feature (1)..( 3003): 2750-1469P.txt file - cDNA_ID_2150259; gDNA_ID_2926211; Annot_ID_202643

SEQ ID NO: 23723 - DNA, 3003 bp, Unknown
  misc_feature (1)..( 3003): 2750-1469P.txt file - cDNA_ID_2150263; gDNA_ID_1620618; Annot_ID_162130
tgatcattaacttgtcatgggccttgtagctgccactagtttaaaaagaactattttcccccttaaatgtgcctttttcttgataatatacaggtagttacgttatggtttttagtactacgttatcatatagtataaaaataagaagatgcttaatattgttctataaaactataaaaggcatctaacaaacaggtttagcgtaagatgtactttcatctaacctatacatctactgaatctaaacaggtctaccacctactctaaacgcgtgccttaccaaaacttggaaaattttcaattttgattatcatgtgggtgaaaaacatcaaaaaattatgttgatgtattatctaaagtcattcacaattaatcaagaagtgtacttgttgtgagactgagagtagctttcacttgtcaatgagtaggtacctattcatttggccaataacaaaatgacaacaaaaatttacctaaaacttaaataatttagtgatttggtcagtaagcctaattaaaccctcaagcagtttacatcacaatcaagcttgaagcttttatttgatttggccaatgaaggagtttataaccctaaaacagttcacatcacaacaaaaccatttgactcgttttctgattaatttggccaatgacgagtcatcttgggcttcacatatggacattgatgttgtgtccatattacgacacacctttatcattttccatttcaaaaaaagaaaacaaaaacacccatgctattttttaaaacacacttaagaaacaaaaatcaaattaaatctttaacccatgatatctactaccaacaactaacaatattttacatcaagtgtgtcgtcaatagtagcactattatctaatttagatctagataaagccagataacactcttttgaactttccatgcttgaatatttcttctataatatcatcattaagaaatcttctcccattctttggcttcttttagaaaagatactctattagattttttagcgagtgaaagaagaataaaagatggaccagtcaacaaatggagacgaacaagtctttatacattgttgataatttgcgtttgcgaaggatgtggtcacaagaaaagaaagtattccgtccctctctctagctaatggcgtgtgatgtgactactacactctctcttctatacatgtttattttttccagaaatgtctgtttgaatataaactttttaagtgaaattgttgggcacaacagaaaactttaacaccaaaaaaaacgcgacataacatgttgcattgttgattagtttctttctactagagattagcattctcagactccgaacggtgactgcgttttacagtgcggaaaaaatgcggtacggtttaaatattaacgaaaatacataaatacatatgtataaatagagattttaatactgttatagcactgttgcggtacggttttgggtgcggttttgatcaccatttacagttttttttattcagattagatttctgtaggtaattttgattaaaatcttttggtgataacgcagtcttttcgtctggactggacccacgcgaggacccaaaatttgaccaatatgcgatccaataaacaaaaaaatggtaatttaaaatgaaataatccacatgtatgatgtcaaatgtattattttacattcacaattaaatacaggtcagcgaagtaattgttttgacaataaaaatggtaagaattacttggaacgtcatctaacatcattttaattaatactaacatcatcattttaagtaaacaatttttttagaataatagacagaaattaaggtggagttcatctttttgataattagcattaatccctactctaccatgtttataattgaaatcattatttcatattttgataattagaattaatccctactctaccatgtgtataattaaaatcacaatttcatgaaaaagatcaactaacttaaccaaaactatagtcaatgtcttttactgaaaaattcaagaataaaacaatcttagttacgtcactatcaatctccattagaaagaatggtttaaaatcattagtttttaacaaactctaatcatgattattaaaaaaaccaaagaagcaaggaagacttttattcaaaagattaaattttcttccatttaaaaaaggaataaaaagagatgtcaaaataattactacaaaaaacattagaatttgttggatatgtaattgacctaagaccataacgagcactcagacctcgtcctttcaatttagtctgcgcttgacacggcactcttaaaaataaacacggtgacgtagacgccgtcaccgtccaatctcatcgtcccttttttaattagcagctcaacgatttaaaatcgactgtcatttacaaaggctgtcatttcaacactcttcagtccttcttccttataatcctctcatcttctttttctccaggtttttaccaaccagttttttttttttcaaccctcgagatctttctttgcacgaacaaacctcgaaaaactcattctttatcttgacccatctgaaaaagtttctctttttttgtcggaataccatagagtttcattattttcgttttagggttctttttttgtaataaataattggaagcagaggagctatgctcaagttctcagatgaaattctcgcttttgatcatcagttcttgtttctctttctgatttacgctggatttgcaagggaaacactctgactttgtcaggactcttctgtgaaattctgcaagtttatgacttttctagtgctttttaactgtttgtgagtttgaagaaaacaaatttcaattgagttgctttggaatccgttgacataatagggtaagtcaattttcttactactaatatttatcccattaatgcttgagaattgttcctaatagaactctttttgctgtttgttaaatttgcagaatttagaaacttctcgtttagatg

SEQ ID NO: 23724 - DNA, 3000 bp, Unknown
  misc_feature (1)..( 3000): 2750-1469P.txt file - cDNA_ID_2150263; gDNA_ID_2926211; Annot_ID_202641
tcattaacttgtcatgggccttgtagctgccactagtttaaaaagaactattttcccccttaaatgtgcctttttcttgataatatacaggtagttacgttatggtttttagtactacgttatcatatagtataaaaataagaagatgcttaatattgttctataaaactataaaaggcatctaacaaacaggtttagcgtaagatgtactttcatctaacctatacatctactgaatctaaacaggtctaccacctactctaaacgcgtgccttaccaaaacttggaaaattttcaattttgattatcatgtgggtgaaaaacatcaaaaaattatgttgatgtattatctaaagtcattcacaattaatcaagaagtgtacttgttgtgagactgagagtagctttcacttgtcaatgagtaggtacctattcatttggccaataacaaaatgacaacaaaaatttacctaaaacttaaataatttagtgatttggtcagtaagcctaattaaaccctcaagcagtttacatcacaatcaagcttgaagcttttatttgatttggccaatgaaggagtttataaccctaaaacagttcacatcacaacaaaaccatttgactcgttttctgattaatttggccaatgacgagtcatcttgggcttcacatatggacattgatgttgtgtccatattacgacacacctttatcattttccatttcaaaaaaagaaaacaaaaacacccatgctattttttaaaacacacttaagaaacaaaaatcaaattaaatctttaacccatgatatctactaccaacaactaacaatattttacatcaagtgtgtcgtcaatagtagcactattatctaatttagatctagataaagccagataacactcttttgaactttccatgcttgaatatttcttctataatatcatcattaagaaatcttctcccattctttggcttcttttagaaaagatactctattagattttttagcgagtgaaagaagaataaaagatggaccagtcaacaaatggagacgaacaagtctttatacattgttgataatttgcgtttgcgaaggatgtggtcacaagaaaagaaagtattccgtccctctctctagctaatggcgtgtgatgtgactactacactctctcttctatacatgtttattttttccagaaatgtctgtttgaatataaactttttaagtgaaattgttgggcacaacagaaaactttaacaccaaaaaaaacgcgacataacatgttgcattgttgattagtttctttctactagagattagcattctcagactccgaacggtgactgcgttttacagtgcggaaaaaatgcggtacggtttaaatattaacgaaaatacataaatacatatgtataaatagagattttaatactgttatagcactgttgcggtacggttttgggtgcggttttgatcaccatttacagttttttttattcagattagatttctgtaggtaattttgattaaaatcttttggtgataacgcagtcttttcgtctggactggacccacgcgaggacccaaaatttgaccaatatgcgatccaataaacaaaaaaatggtaatttaaaatgaaataatccacatgtatgatgtcaaatgtattattttacattcacaattaaatacaggtcagcgaagtaattgttttgacaataaaaatggtaagaattacttggaacgtcatctaacatcattttaattaatactaacatcatcattttaagtaaacaatttttttagaataatagacagaaattaaggtggagttcatctttttgataattagcattaatccctactctaccatgtttataattgaaatcattatttcatattttgataattagaattaatccctactctaccatgtgtataattaaaatcacaatttcatgaaaaagatcaactaacttaaccaaaactatagtcaatgtcttttactgaaaaattcaagaataaaacaatcttagttacgtcactatcaatctccattagaaagaatggtttaaaatcattagtttttaacaaactctaatcatgattattaaaaaaaccaaagaagcaaggaagacttttattcaaaagattaaattttcttccatttaaaaaaggaataaaaagagatgtcaaaataattactacaaaaaacattagaatttgttggatatgtaattgacctaagaccataacgagcactcagacctcgtcctttcaatttagtctgcgcttgacacggcactcttaaaaataaacacggtgacgtagacgccgtcaccgtccaatctcatcgtcccttttttaattagcagctcaacgatttaaaatcgactgtcatttacaaaggctgtcatttcaacactcttcagtccttcttccttataatcctctcatcttctttttctccaggtttttaccaaccagttttttttttttcaaccctcgagatctttctttgcacgaacaaacctcgaaaaactcattctttatcttgacccatctgaaaaagtttctctttttttgtcggaataccatagagtttcattattttcgttttagggttctttttttgtaataaataattggaagcagaggagctatgctcaagttctcagatgaaattctcgcttttgatcatcagttcttgtttctctttctgatttacgctggatttgcaagggaaacactctgactttgtcaggactcttctgtgaaattctgcaagtttatgacttttctagtgctttttaactgtttgtgagtttgaagaaaacaaatttcaattgagttgctttggaatccgttgacataatagggtaagtcaattttcttactactaatatttatcccattaatgcttgagaattgttcctaatagaactctttttgctgtttgttaaatttgcagaatttagaaacttctcgtttagatg

SEQ ID NO: 23725 - DNA, 3000 bp, Unknown; identical to SEQ ID NO: 18665
  misc_feature (1)..( 3000): 2750-1469P.txt file - cDNA_ID_2150267; gDNA_ID_1620618; Annot_ID_162131

SEQ ID NO: 23726 - DNA, 3003 bp, Unknown; identical to SEQ ID NO: 18666
  misc_feature (1)..( 3003): 2750-1469P.txt file - cDNA_ID_2150267; gDNA_ID_2926211; Annot_ID_202640

SEQ ID NO: 23727 - DNA, 3003 bp, Unknown
  misc_feature (1)..( 3003): 2750-1469P.txt file - cDNA_ID_2150275; gDNA_ID_1620618; Annot_ID_162135
ctcagatcgtagcttattggtcaagattgatattattcaattgcagaactacccaaatttgggacaacatccaaaaaattatagttgaaaacaacccaatagagatatcgtccagtaaacttatctctagttactcaaaatataaagatatatttctgtttaatacgcatagtttttctagacaatgtgcttatgaattatgatctagaaaatcagatataatagctagtagtaactatttaaatacaccgatgatggaaacgaataagtgaatacaccgatgacggaataagtgaatcttgtaagtagggcaagcatggttatcaccgccatcattatgttcgaagcataatatttaatcatgtttttatttgcgaagttatttttactaatatagctattcaaactataagagactatagtattgatcaaagtgtgaattcgtcttttatatatttttttatcatctagggttcatgcatgctttacaaggcacggagttttaagcaagcacgcgtatacacacccacacgtttacatatctatatacatgtttgaagcgcgaataaatccagctaattttatttgaatgaaattttactaaacagaaaacgaatttgaatttatatttggctctaaaccaaaaaggtaagggtacacaattgaaattcattttaaaactaaaattaactgattaaattccgaatctaacttgtagaaaaagttggtgttgtcattaactaatgatttaatatgcttgcactcgttcatatcacaatgaattattttgtcgtaatagccctagtgcaggtaaattttcactatcataattaacaaaatagatatatatcaattgatttcatagttaatgagtaccaaaaaaaaatcgaatacatacatgtacattaattgatgctatacaacttaatatgggaagccaactacccatatatgaacaaatattaattatcttctaaatttcaatttcgactttaagaggggcaacgtagagtgataatcatatgagttgtcaacaaattaataaatggttcaaatcattaatcatgcatgccacgatatatctcgttatcgattgtggacaccaaatcgttacactagcgaatcggtatttattctattttattagggtgataataatacgtataaggaataaatatgttgtatatgcaccatacttgcgtcgtacttaattataagtgtaatgaaattataaatttcgacttgcaatggactatatatgcttgtgagaagaaaaaaacaaaaaaaaaggatactcaatatgatctggaacggtttaggctgtcctattcgtgacttaattagtgtccctttttaatttgattttttcttataaaaatgatctggaggaatggtgccaaatttggattaatacttatatgctcaaatcttgattaaactacaccaacagtgtcattttcaggctattattggaaacgtcagaacagttttacaaaatgccaatgattcacctgtttttactaggagtttttgtagattacatatgtttaatcaagttatttggataatcaaatatattgtcaatattgtaatttatgatttaaattactagtttcaagcaaggactacttttttttttgtcaaagagcgaggactacttttgtcaaataatactgttggcttttagctaaagttttacaatcatagcttaatacacatgtaaatgtattcataactagtggttaaaaactgctagcgaatttataattactcgttttgtcaccaaatatctttcattggatacatatatacacatcaattagaaaatgctaatgctagaatttgaacaaaaaggaaagaaatgggaaatagtagtacaagtaagagtgcgttacacttgtaactgattcattggccgaggcaactccacagtttcttactcttaccattttcactacatttgtttccctcttgggaacctttattttcttcttcttacatttattatcactcttttattattctttttgtttttgtccgtatattttagtttggttttttatagccttgcaaaaaacgacactggtatatctatactttttatctagatgactagaccaggtccgaataatccaagttttgtactactatagtataatattaaaactatgagattcctgcgtatctgtaatttaatttttataaattcattctaacgttataattatcaaagagagaattattttcctattttttcatggaaagtgatgaagatagtgtgctgcaatagtcggacccaccggagacgaagaagtgacaacaacgagtattgtgtatttcctattttaccctttccttttcgtttcgcgcgtcttcaccggcttaccggctacacctgtcctcctatatatcggtttcatcatttcattataaaattaatagcacaaataaaataaaacaagtcttattaaaatactaaaaattgttactgtatttaattagttgccgccgcgccggccgttacgattgcagcagcacgactgttttcagaactctttttttttattaacaatcaatcaaaattttttatttgttttagtattatatggagacaacaagcaataagttaaacagaaaaatcctaacgttcttatttttttactattaaataataattttgacatattacaaaattatgaattaacctaaaataaatagaattaattctctttttgtacgatgtagagagatgggaatattatatacccttttgaaataaagacgactcgaattagatttcaaattaaagctgaagaggtcctttttcgtcattttggagtttctttttgagacatttttcctcttttgattttcgctttttccgtccgcttgacttctgctgtttcagactctcaacaacggagagagccggagagattgaagaagaaaggagaaatatttgcgaacccccaagaatcgtttttgttgattgactctctcatg

SEQ ID NO: 23728 - DNA, 3000 bp, Unknown
  misc_feature (1)..( 3000): 2750-1469P.txt file - cDNA_ID_2150275; gDNA_ID_2926211; Annot_ID_202637
agatcgtagcttattggtcaagattgatattattcaattgcagaactacccaaatttgggacaacatccaaaaaattatagttgaaaacaacccaatagagatatcgtccagtaaacttatctctagttactcaaaatataaagatatatttctgtttaatacgcatagtttttctagacaatgtgcttatgaattatgatctagaaaatcagatataatagctagtagtaactatttaaatacaccgatgatggaaacgaataagtgaatacaccgatgacggaataagtgaatcttgtaagtagggcaagcatggttatcaccgccatcattatgttcgaagcataatatttaatcatgtttttatttgcgaagttatttttactaatatagctattcaaactataagagactatagtattgatcaaagtgtgaattcgtcttttatatatttttttatcatctagggttcatgcatgctttacaaggcacggagttttaagcaagcacgcgtatacacacccacacgtttacatatctatatacatgtttgaagcgcgaataaatccagctaattttatttgaatgaaattttactaaacagaaaacgaatttgaatttatatttggctctaaaccaaaaaggtaagggtacacaattgaaattcattttaaaactaaaattaactgattaaattccgaatctaacttgtagaaaaagttggtgttgtcattaactaatgatttaatatgcttgcactcgttcatatcacaatgaattattttgtcgtaatagccctagtgcaggtaaattttcactatcataattaacaaaatagatatatatcaattgatttcatagttaatgagtaccaaaaaaaaatcgaatacatacatgtacattaattgatgctatacaacttaatatgggaagccaactacccatatatgaacaaatattaattatcttctaaatttcaatttcgactttaagaggggcaacgtagagtgataatcatatgagttgtcaacaaattaataaatggttcaaatcattaatcatgcatgccacgatatatctcgttatcgattgtggacaccaaatcgttacactagcgaatcggtatttattctattttattagggtgataataatacgtataaggaataaatatgttgtatatgcaccatacttgcgtcgtacttaattataagtgtaatgaaattataaatttcgacttgcaatggactatatatgcttgtgagaagaaaaaaacaaaaaaaaaggatactcaatatgatctggaacggtttaggctgtcctattcgtgacttaattagtgtccctttttaatttgattttttcttataaaaatgatctggaggaatggtgccaaatttggattaatacttatatgctcaaatcttgattaaactacaccaacagtgtcattttcaggctattattggaaacgtcagaacagttttacaaaatgccaatgattcacctgtttttactaggagtttttgtagattacatatgtttaatcaagttatttggataatcaaatatattgtcaatattgtaatttatgatttaaattactagtttcaagcaaggactacttttttttttgtcaaagagcgaggactacttttgtcaaataatactgttggcttttagctaaagttttacaatcatagcttaatacacatgtaaatgtattcataactagtggttaaaaactgctagcgaatttataattactcgttttgtcaccaaatatctttcattggatacatatatacacatcaattagaaaatgctaatgctagaatttgaacaaaaaggaaagaaatgggaaatagtagtacaagtaagagtgcgttacacttgtaactgattcattggccgaggcaactccacagtttcttactcttaccattttcactacatttgtttccctcttgggaacctttattttcttcttcttacatttattatcactcttttattattctttttgtttttgtccgtatattttagtttggttttttatagccttgcaaaaaacgacactggtatatctatactttttatctagatgactagaccaggtccgaataatccaagttttgtactactatagtataatattaaaactatgagattcctgcgtatctgtaatttaatttttataaattcattctaacgttataattatcaaagagagaattattttcctattttttcatggaaagtgatgaagatagtgtgctgcaatagtcggacccaccggagacgaagaagtgacaacaacgagtattgtgtatttcctattttaccctttccttttcgtttcgcgcgtcttcaccggcttaccggctacacctgtcctcctatatatcggtttcatcatttcattataaaattaatagcacaaataaaataaaacaagtcttattaaaatactaaaaattgttactgtatttaattagttgccgccgcgccggccgttacgattgcagcagcacgactgttttcagaactctttttttttattaacaatcaatcaaaattttttatttgttttagtattatatggagacaacaagcaataagttaaacagaaaaatcctaacgttcttatttttttactattaaataataattttgacatattacaaaattatgaattaacctaaaataaatagaattaattctctttttgtacgatgtagagagatgggaatattatatacccttttgaaataaagacgactcgaattagatttcaaattaaagctgaagaggtcctttttcgtcattttggagtttctttttgagacatttttcctcttttgattttcgctttttccgtccgcttgacttctgctgtttcagactctcaacaacggagagagccggagagattgaagaagaaaggagaaatatttgcgaacccccaagaatcgtttttgttgattgactctctcatg

SEQ ID NO: 23729 - DNA, 3000 bp, Unknown
  misc_feature (1)..( 3000): 2750-1469P.txt file - cDNA_ID_2150283; gDNA_ID_1620618; Annot_ID_162138
tatccaagtttgttggttatttgagattactaaagatttcaacttttttgtttttgttttcgttttccagggcacttctttgtggaagggttgttgggtgttgtcattatcattctcctcactcggaagagttataaacctcccaagcgaccattgaccgagcaggttctgtctcagatcctttcttgatattggtttgatagatcacataggatttggttcgtggtgacatctttgatgtgtggtatagttgaaatgtattgagttttcggggttttttattactcaggaaatagatgagttgtgtgatgagtgggttcctgaacctcttataccgccaattactgaagacatgaagcatgagccaccagttcttgaaaggtaacgtagaagacttctatgtagttcgttgtatagccttattctgtgttatgcttaaagattttgttgggtccatacagtgctgctggaccgcatacaacagttaatggaaaagatgtggtgaattttgcctcagctaattatcttgggctcattggccacgagaagttgctggtaacgtgaagctactttgttttcaatacaatctctcttctgtttgaatagttttatttaagatttgtcttatgccaggaatcatgtacttctgcattagaaaaatatggggtcggttcttgtgggcctcgtggattctatggtacaattggtaagaagacaataattttctaaatagatactttggttcatccattggctcgcttggaaagggttcttactgtttgattacttctcttgactagatgtccaccttgactgcgaaaccagaatatccaaatttttgggtactcctgattcaatcctttactcttatggactttccacaatgttcagcacaattccttgtttctgtaagaaaggcgatgtcattgttgcgtaagtacacaatttcttataacatcgttctacttattagattacgttagtagaaatcccaggattacattgaacatctttgtttgaaacttttttatctcgatattaaactcattcttgtcttttctattttcttagtgatgagggtgttcactggggaatacaaaatggacttcagctttcaagaagtacaattgtgtacttcaagcacaatgacatggaatcccttcgaattacccttgagaaaatcatgacaaagtacaagcgctcaaagaacttgaggcgttatattgtagctgaagctgtatatcaagtacctggcagttttctttcttctcctgcttccatattttgaaaattctccctgaactgtgatgcttacccatttgcctttgggtatgttaaaatctacagaattcaggtcaaattgcgcctctggatgagattgtaaaactaaaagagaagtatcggtttcgtgttatattggatgaaagcaactcttttggtgtgcttggccgttctgggagaggtcttgcagagcatcatagtgtccctgtaagtatgattgacacacattttagtagtgttctcatttgccaaacctgatgctaaaaatttcacggcggtttatctttaaacagattgagaagatagatgttgtgactgctgcaatgggccatgcattagccacagaaggtggattttgcactgggaatgcccgcatcatcgattaccaggtaaacatcgatcatgctgattaactaattacaaacaaaattaaaaaactaccgataatagaaacttttctctgggacgctcaaatgcacagagacttagcagttcaggatatgtgttctctgcttctttaccaccataccttgcaagtgctgctatcaccgccattgatgtcattgatcaaaaccctgatatgttagttaagctgaagcaaaatgttgctctgttatggaaaggtttgatcttcaagttttaatctaatctagcaacaattagagtttgatttagtttgttatcttcctctaattgaaaaagaaatgctgggaacaacgcaggattgtcagatatcaaggggatgtcattaacaagcaaccgggaatcacctattgttttcttaaaattagagaaatctagcggttcagctaaagatgatttgcttctacttgagaaaatggctgaccgtgtaagttcattgtttctttgcaaaaccaaatctagaccctgtccccgtttcttgacatgactagatgcatgcaggctctgaaggaagactcattgttggttgtgagttctaaaagatcatttcttgataaatgccggttacctgtgggaatcaaactctacgtctcagcgggacattcggaatccgatcttcttaaagcgtcggagtcactgaagagacttgcttcagagcttctactcaagtcctgaaacaccgaaactcttttttcttcaagaacaacaacactgaagggaactctttgaacacatccgtgtgagatagtagacaacagaatccgcagagtcagtagcttgaagatgttcatagcagattcctaaactggttctccactttcagtgatgggcttgtggttgatctgaagctcaattgacgaaggaggattatcgaagacaatggcttcttgttcttacatttatttcatttgatcatctgagttctttttttttttttcctactcatacccttcaatgatcaagtagcttagtgttgttgccgaaattcaaaaactttcaatttatgggaaacaaaaaagttcatgtgctgacatcagcctcttaaggctttctgagtttcttgcggtaaaagaaagtgtttttgcctctctcaaatctcaatagtattgacacgtgtcagtataacactcgtgcataattgacacgtgtcagtataacactcgtgggcggtataatgtgaacgaaagagcgagggacaggtaatctctcttcctctgtttctaagtttgtataattagaactgcataacgaaaaacaaaaacaaaacagtgaccaaaaaaagaagaagaatcaatg

SEQ ID NO: 23730 - DNA, 3003 bp, Unknown
  misc_feature (1)..( 3003): 2750-1469P.txt file - cDNA_ID_2150283; gDNA_ID_2926211; Annot_ID_202634
gtctatccaagtttgttggttatttgagattactaaagatttcaacttttttgtttttgttttcgttttccagggcacttctttgtggaagggttgttgggtgttgtcattatcattctcctcactcggaagagttataaacctcccaagcgaccattgaccgagcaggttctgtctcagatcctttcttgatattggtttgatagatcacataggatttggttcgtggtgacatctttgatgtgtggtatagttgaaatgtattgagttttcggggttttttattactcaggaaatagatgagttgtgtgatgagtgggttcctgaacctcttataccgccaattactgaagacatgaagcatgagccaccagttcttgaaaggtaacgtagaagacttctatgtagttcgttgtatagccttattctgtgttatgcttaaagattttgttgggtccatacagtgctgctggaccgcatacaacagttaatggaaaagatgtggtgaattttgcctcagctaattatcttgggctcattggccacgagaagttgctggtaacgtgaagctactttgttttcaatacaatctctcttctgtttgaatagttttatttaagatttgtcttatgccaggaatcatgtacttctgcattagaaaaatatggggtcggttcttgtgggcctcgtggattctatggtacaattggtaagaagacaataattttctaaatagatactttggttcatccattggctcgcttggaaagggttcttactgtttgattacttctcttgactagatgtccaccttgactgcgaaaccagaatatccaaatttttgggtactcctgattcaatcctttactcttatggactttccacaatgttcagcacaattccttgtttctgtaagaaaggcgatgtcattgttgcgtaagtacacaatttcttataacatcgttctacttattagattacgttagtagaaatcccaggattacattgaacatctttgtttgaaacttttttatctcgatattaaactcattcttgtcttttctattttcttagtgatgagggtgttcactggggaatacaaaatggacttcagctttcaagaagtacaattgtgtacttcaagcacaatgacatggaatcccttcgaattacccttgagaaaatcatgacaaagtacaagcgctcaaagaacttgaggcgttatattgtagctgaagctgtatatcaagtacctggcagttttctttcttctcctgcttccatattttgaaaattctccctgaactgtgatgcttacccatttgcctttgggtatgttaaaatctacagaattcaggtcaaattgcgcctctggatgagattgtaaaactaaaagagaagtatcggtttcgtgttatattggatgaaagcaactcttttggtgtgcttggccgttctgggagaggtcttgcagagcatcatagtgtccctgtaagtatgattgacacacattttagtagtgttctcatttgccaaacctgatgctaaaaatttcacggcggtttatctttaaacagattgagaagatagatgttgtgactgctgcaatgggccatgcattagccacagaaggtggattttgcactgggaatgcccgcatcatcgattaccaggtaaacatcgatcatgctgattaactaattacaaacaaaattaaaaaactaccgataatagaaacttttctctgggacgctcaaatgcacagagacttagcagttcaggatatgtgttctctgcttctttaccaccataccttgcaagtgctgctatcaccgccattgatgtcattgatcaaaaccctgatatgttagttaagctgaagcaaaatgttgctctgttatggaaaggtttgatcttcaagttttaatctaatctagcaacaattagagtttgatttagtttgttatcttcctctaattgaaaaagaaatgctgggaacaacgcaggattgtcagatatcaaggggatgtcattaacaagcaaccgggaatcacctattgttttcttaaaattagagaaatctagcggttcagctaaagatgatttgcttctacttgagaaaatggctgaccgtgtaagttcattgtttctttgcaaaaccaaatctagaccctgtccccgtttcttgacatgactagatgcatgcaggctctgaaggaagactcattgttggttgtgagttctaaaagatcatttcttgataaatgccggttacctgtgggaatcaaactctacgtctcagcgggacattcggaatccgatcttcttaaagcgtcggagtcactgaagagacttgcttcagagcttctactcaagtcctgaaacaccgaaactcttttttcttcaagaacaacaacactgaagggaactctttgaacacatccgtgtgagatagtagacaacagaatccgcagagtcagtagcttgaagatgttcatagcagattcctaaactggttctccactttcagtgatgggcttgtggttgatctgaagctcaattgacgaaggaggattatcgaagacaatggcttcttgttcttacatttatttcatttgatcatctgagttctttttttttttttcctactcatacccttcaatgatcaagtagcttagtgttgttgccgaaattcaaaaactttcaatttatgggaaacaaaaaagttcatgtgctgacatcagcctcttaaggctttctgagtttcttgcggtaaaagaaagtgtttttgcctctctcaaatctcaatagtattgacacgtgtcagtataacactcgtgcataattgacacgtgtcagtataacactcgtgggcggtataatgtgaacgaaagagcgagggacaggtaatctctcttcctctgtttctaagtttgtataattagaactgcataacgaaaaacaaaaacaaaacagtgaccaaaaaaagaagaagaatcaatg

SEQ ID NO: 23731 - DNA, 3003 bp, Unknown
  misc_feature (1)..( 3003): 2750-1469P.txt file - cDNA_ID_2150393; gDNA_ID_1620832; Annot_ID_169712
cagagtgctatggagggtataagctttttgtcattaacatacaaatatagtcggattaactaatttcggaacttctaatgcgttatttgcatttgtgttgatctatatggctaatcttggatatgtataatgatgtgtaggtttggccatttcaagattttggaccacttggaccaaccccaacttagcatatgagttagcttggtcattaggccgatgagatcaccgaggcatattggtagtgtggttaatcgctgttgccgagtgagtctggctcttgattgactatgagatgcaggatcatcataccatccacaaagatgggagaatctaaacgctcaggaaaagtgagtatatggtttagactttagagcaagtaacattatgtattttggtctgtcactctatctgagagtggcctctgtatcaaaaagttaaaacaaagatctattgtggacctggacatggaatcggtatatcatcaaattcctagataatatccttttcaaaccaaattataattctctttttgcaaaatctttggaatgatcgcagcattgaaagtcttgggaaggataacacgacaggcattgtaacacaagttgtcttggacactgcgttgttgagagagacaactaatggactcagaatcaaaacataccaggtaaacaactaaaagcttgatcaaatctttaataaaacttcgatttggtttgatccgcatcaattttttctcttacgagcagggaggttctggttacgttcagggtattcgattcacaaacgtagagatgcaagatgttgcaaaccctatactcatcgatcagttctactgtgattcttcaactacatgttaaaaccaggtttccttataatatacaatacaaacttgtaattgtgattcttatatcgaaccaatactcagttatgttctcttcccttttttggtataaatgcagacctccgcggttaaaatcagccatataatgtaccggaacataaccaaaagtgcgaaagccatcaaatttgcgtgcagcgacacagtcccttgcagccacattgtcctcaacaatgtgaatcttgaaggcaaagacggtcaagtcgaagcgtactgtaattcagctgaaggatttgggtatggagtctactcgcacaacgacaaaggcttggaccagactcacaagtcagaggaagccgagactggccacgatgagctttgatggtgatgttcaaagtgttgttgtagtgagggatgataggtaaaatagtttaatgaagcatatggtacagtaaaatgatcttatgtttgtgttcataatcaaccataactaaggttgttgttaacagcatttgtccaccttttgtatcaaatatttttctttccccatacaaattcatgtgcaagtattttttcaacataaatttttgaacttggaagtttattgtttatgaaactgaaatacgtattgatatcggaaactaagttatatagtagatgtttagataagttagttaattgtcttagactttgggattagaggaacaagaacaacacatcacatggggactccaaaggtcgcaattgatatgaattgtttgatatgtctgtcacgtgtgaaaaactcttcctttcttcacaattatcattttctatatatatatatatatatatttgtcaaacaattattttctaattaatattcccaatttgtgtgtagctgtaaacatcaatgaccaatgccaacccattttatttactctttcaataacaactcaacaactacatcacctaagaataagatatagtcttggcttgcaatttgcctgtaatgtgaaatcaaatgatcgattatatggtataataatataatgataacatattaattccctcatatggtatgaatagtgaattggttttgtctatatccataagaatgaaaataaagaaataatttccttaaaacaaagaaataaccaaactatatgctataatggacccggagaatctaagtcgtgcgagaataatgattttgtttaccattaaaaacaaataattgttcatgctcattccatttccaaattattctgaacaaacaagatagagagagtgcaagttgtaagaagcagattttttttggtttttctctaaaaccaaactaaggagatctctaagttgtggcagagaagaaagcttctaaggtaaaatcacaaactctccactttttccaatatcttattgactcatattgcatttgctttcaagttctgataaatctctaaaaggtttatgacttttagaattactctttttgatatttaaacacattgttcatatgactatgcagatccagatcattgttttttttccagcttttgaaactaaacattcacaaatccaaccctacatcatattccttgtgacaacattgttgtttttttgttgtctatatgtttttcaagtaatacaagtatagaaaaagctttatctacaatattttcatcctgaaaagaagccaaaagcaaatttgttacaacattcttgataaaataacacgtcattagagaattaacaaagttttgaagcagagggaggaatgttcaatactagaaaattaagaccaaaaagtcaacatcacttttataagagaaaaaaacgagtacaactgtaacatttacttcgactttatctacgagagtattgaacaagtgggatgcaattgacaacctaaatcatggctcatagttacaaattatatatgactaatcattttccttttctcttaaagttgtttatagtttagacaataataataggagatgaagagaatgtgatgctactaactcttatttaaatgaggaatataaacaagatctggtcctgacattgttatgaatcttcaaactcaggacacaaaccaagatctcgtgtagaggaaaaaaaacctttcctccatgtttaagttttgagcttctggttggtttcaagtcctgtggagaaaaatg

SEQ ID NO: 23732 - DNA, 3000 bp, Unknown; identical to SEQ ID NO: 7438
  misc_feature (1)..( 3000): 2750-1469P.txt file - cDNA_ID_2150435; gDNA_ID_1621146; Annot_ID_173054

SEQ ID NO: 23733 - DNA, 3003 bp, Unknown
  misc_feature (1)..( 3003): 2750-1469P.txt file - cDNA_ID_2150519; gDNA_ID_1620793; Annot_ID_168383
ctttacgagcagcttttgtcggcgcacgttgcttgtttgagaatcgcgactccggttgatcagcttccgagaatcgatgctcagcttgctcagtctcaacacgtcgtcgctaaatactcagctttaggcgccgccgctcaaggtctcgtcggcgacgataaagaacttgaccagttcatggtatataaatttcagatttttttgttctataattttataattaacgatttcataattatacttagcacaaattttaataatacacaccgacttaggtttcttgatttttgaaatcttaaaatattaaaatcaagatttgtgtttttagggataaacaagactaaaatcccaaaaaaagagcttatgatataataatggtcatgatgatgaagaaaatacaaattttgttctttgtgtttattgtgtgtttgattaatgttttttttatggtgtagacacattatgtgttgctactgtgttcatttaaagagcaattgcaacaacatgtgcgtgttcatgcaatggaagctgtgatggcttgttgggagattgagcagtctcttcaaagcttaacaggtgagaaaatgaatcctgtgattagctcatgaatccaatagttagttttatgacattgacaagttttgtgttttattggtgagattaggagtgtctcctggagaagggatgggagcaacaatgtctgacgatgaagatgaacaagtagagagtgatgctaatatgttcgatgggggattagatgtgttgggttttggtcctttgattcctactgagagtgagaggtcgttgatggaaagagttagacaagaacttaaacatgaactcaaacaggtaataatcaacaaacttgttctttgaactagttcatgaactaacaatgtagagggctttgtcttgttgatgaaaagggttacaaggagaagatagtagacataagagaggagatattaaggaagagaagagctgggaagttaccaggagataccacctctgttctcaaagcttggtggcaatctcattccaaatggccttaccctactgtgagttcactcatctaacatctctttataacttcttcaagttcattcattgagccataaccaaatattggtttgtaggaggaagataaggcgaggttggtgcaagagacaggtttgcagctaaaacagataaacaattggttcatcaatcagagaaagaggaactggcatagcaatccatcttcttccactgtattgaagaacaaacgcaaaaggtattattatactttaatatagtcttgtaacataaccgaaaaacttatggatcggactcaaagaagactgaaacttttgtttgtctgatgaaagcaatgcaggtgacaatagcggaagagagcggttcgcgtagaaacaacaaacatatgatgtgaattggggaggtggaagatgggatttgaaagcagggttttagggatttaaagttgagaattttatggaggagtttggattatacagagagaggggacagtattagaaagtaactttttgtgcaattacatagtaacgtagtttggttatgtgattatgcccatatattttattaagtagcacacaaaccaaaaagaaaatatgaaaactgaagatgcaggcttttgtttaatgttttttgtttgtttgtctgcatgagttttttttttatgaaccatcagataatcatcatcatcatccataatatatcttgtgaataaagatagtgagagaggagaacattgggatgcacaagttttcttaatctactagtatatgttacgcattgaccaggtgcatatgttaatttgtatcgcaccacttggttagcttaatctatgtgactattatacagtatatgtttcgcattaaccgtacttaacccatcttatgattcttatccgcttagttcgtagtatttattgcgatgtcacattccaactcgtgatattggcttgataagtaaaagacattatacatggtagatgacgacaaaaaataaaacataccccatcttacataacgtagcttgctgcgtacttttgtaattgtaataatttgaaacgtgttcttttttctagtcaaaattgtttgtttatcctcatcttgttgtttcgtttgtcacgtttgtgatagccacaagttactgtaagttttcggcgagatttttctatcgatcacggagagattctgcacacattaacaaagataattagagtgtccttaagtattttggtcgcctctctattagaggaccatacaaagttcaaagactagtctcatgagaagcccattagtacattagattaaatctaggaaagtagattcatataagtagttttgtaatgaacatcaaagttgttaacttagagaattgtcatttggattgtataaatggtttgataaacgaagtctaacattagtatgtgttagtcttctaaattcaaataataatcggagttttggtctcttggacgatgcttcacagtgatattcaaaagtttaccgttatcacccaccaactagagaagccaaattaggtcttttaccaactgtagggtaaagaactgtcttcatgtaatcattataaccaccaccatcttgttatgctttgtttcttcttcaaattgcagctttcaatatacaacccggtttacgttctggtttacactttagacgtttcaatttacaaaattgggccgattgacagatattggacctggcccatcaatctaaaaatgcgctattttgaatcaaagacctatttaaatcttccgacgacgactccgttcacatagcagaaacagtggcgacaaaccctatcacggagccaacccgcattttcctctagctttcgcaccgcctctcgctctctcgccccaccggttcgtctctgacattttgtgcttgatttggccgttacaaaattctgattgctagttcatgagattcctttttgacaggtgacataaagatg

SEQ ID NO: 23734 - DNA, 3003 bp, Unknown
  misc_feature (1)..( 3003): 2750-1469P.txt file - cDNA_ID_2150527; gDNA_ID_1620793; Annot_ID_168385
aaaaattaaactttgatgacaaccggagctacaaacctctccggtgaagaatctttgccgtcgccgccgtcatcgaaattaagactatagtttttcagatcataagtgaaatcaacatctctcctcatcttcttcctgccactactaaaacttcttataaagtttttccactttggtcccgcgattttctcagaaatctcttttagccccttaagtttctcacttccccaattccctcttctttcttcctgcaaacaaccactccagccaccgcgactgcgagactcgtcgtctcctctccgccaccgggtgaaactgaaactacgaaagtacccacatccacaaaacgcagccgtttcttcataatcatcggagagcagattctctctatcagtggccatgataataaaaaacaaaacagcgagtttttgattaaaggaagagactcgatactatatataggtgaatgagtttaggacacgtggcgtgtcgaccgttgggtgatagtagtgatggggtatgttgttggactgttatgagaagagtgtgacagtgatgtgagaggagcgggattaggattcgctggctaatgatgaaagacagctgtgaaggcgggagcgaaacggttgctttcttttctcttttgtctttaaggataattatgaaacgatttattgatatgactaaatattaaaactttaaacaaattagaggatatctgaaaaagtgaaaagtgattacaattattattttaagaactggttgttgatgatgatgatgataataactgatagatatttttattttgatactatatatatatatatatatatattggtttcattttcatatatataagagagaaattttgaccaaaaaaatatgattctaaaaacgttgaattaccaaatatttgtactagtttggaatgaaattccatatttttagaattttgatatcaatttgcatcttcttgtttaggtgaattcttgtagtattgatttacatataaaatcccatataaaattccctacataacatttgaatctcgttaggtaatttttagattttcatcaatattgactactattaaataacacattattttcttgacaaaaaaaaaatgaaattactaagacaataacaccctgcatttggccatttactatcaaatatcgaatatttctagattataagttgattgaaattctatagaaatttatcatctaataactaactacatcatattggtttataaggttttattagctgaaaattatagttaaaaacaacgaataaagtagtactttcaatgatgaaaaaaaaaaagtagtactttcaatattgcaataagtaagattaaaaagtgtttaagtaagacaaaaaaagaaaaaggtaaccactaaccagcctggaaactgatgattagccgtggattaaaaagcaaaactggtgtttagagatttgctaaaccaaaccaaaccaactcacaatattataaaaaggctgtcccatgttgcctaaactaatctcattattataacgatgactcactgatcacccaataatcattatgtttttgtcctaatcatcataacaaagattgcattatgaaaagtttttgtttaattaattactcgatccaatctagagtacgcagttctatctctgatgtagcatgagatagattcaaacaagacttgactaagctgatcattagtccaaccatttcaagtgatatcttcagtttttgaggcttttagatgggcctaactagtccaacaatttcagtgatacctgcaatttgggttttgatatctttcacttatagatgtttcataaaaaatccaaatcttttttactaattacaattattatatattcaataaaatcatgcagttctatttcatgaatatttaagcatagagactcatgtatttttcttagaaaatattggcaaaatgagaaaagttaggatttaaatggtatgagaagatttgtaactaaatataaaataaaatattttagtacgtatgacctctagaaagaaaaaaagtcaacaaaattaaattcataaaccgcgtggagagaaaataaaggaagatcataacaaaacaaatcaaaaaatttgctaaatataatatccgacacatctatatatacatttttgcagccactttgtaaaataaatcatggagttgagatttatttacagcggctgccactagcatttaataattgtttttgataattagaaagaaaatcttctaattaaatatttgacatttaacaatcttcccaaaatctctctaccttacctacacgattaattactaaaataaaacttccaaaatatttaatattatttaattacttcaaaattatcatttttgatattgcttttctacatgattataatcatcaatccgtatagatatttgatagcatttaattactacaaaattacaaaatatttagacaataattcataaacatatcataaataagatcaacattaataaaataaatgagttttttttagaggacaggttggcagggtttggcaggacgttacttaataacaattgtaaactataaaataaaaacattttataatatacacaatttacaaacttttatatatattattttaaaaaataaattgttctcgcggtgtaccgcgggttaaaatttagtatgattgtaaattacaaaacttaccaatttaaccacttaaaccaaaaaccaaaaagagaaaaaaaaaatcattaaaaaagagtaatttaaggattccatatttaacttcaaaataaacctaaagtacctcgccgccaataggcgatggcttcaaatatgtagtttcttggaaatgcgttgattttttctgtaagactaagtcttcgtacataacgcacgactatatatatataataagtccttaagaactcaaaacaaagtcttctaaatcatttgggcgaaaagtccaaattaaatcaaaagatg

SEQ ID NO: 23735 - DNA, 3003 bp, Unknown
  misc_feature (1)..( 3003): 2750-1469P.txt file - cDNA_ID_2150531; gDNA_ID_1620793; Annot_ID_168386
aaaagtccaaattaaatcaaaagatgttcaaagttgcaagagcgtcacagtatttggcgatcaccggtgctggtatcgaagacatcaagctttccaagaagtcatgggtgtttccatggcaatcttgcaccgtcttcgacgtttctccggtgaactatactttcaaagtccaagccatgagcgcagagaagcttccttttgttcttcccgctgtttttacgattggtcctcgcgttgatgacgatgacgcgctgattttgtatgctaggttgatttctcctcatgataaagattcaaatcatgtccatgagcttgttgaaggtgttattgaaggagagactcgtgttcttgctgcttccatgactatggaagagatctttaaaggtaaaccccaaatttagggttttagatgttaagtttattggtgaatatgaggatgttaaggtagatttaatttatgtagatatttttcggatttgattggtgacataaagttgtagtaagactagggttttgtataatgatttggctaagtctctttaaataaatgtcagtttgattggttataactaagacatattttgtgaaagttttggttaaaagagtttttgattttatgtatttgaagggacaaaggagtttaagaaggaggtgtttgataaggttcaactagaattaaaccagtttggtcttgtgatatacaatgccaatgtgaagcagctcgttgatgtgcctggacatgaatacttctcttacttgggtcagaagactcaaatggaagcagcaaatcaggctaggatcgatgtctctgaggccaagatgaagggagagatcggtgccaaggaacggactggtcttactctccagaacgcagccaaaattgacgctgagtcaaagatcatatcgatgcagaggcaaggagaaggaacaaaagaagaaatcaaagtgaggactgaggttaaagtgtttgagaatcagaaggaggctgatgtagctaaggccaatgccgagcttgcgatgaaaaaagctgcttggactaaggatgctcaggtggctgaggttgaagcaaccaaggccgtggctttgagagaagctgagcttcagactcaggtcgagaaaatgaacgctttgactcgaacagagaagctcaaggctgagttccttagcaaagctagtgttgagtatgaaaccaaggttcaagaagcaaattgggaactatacaacaagcagaaacaagcagaggcggttctatacgagaaacaaaagcaagccgaggcacagaaagcgcaagcggatgcggctttctactcaaagcagaaagaagcagagggacttgttgccttagctagtgcgcaagggacttatctaagaaccctcttagacgctgttcagaatgactattcttgtcttagagacttcttgatgattaacaatggtatttatcaagagatcgctaagactaatgcgatggcggttagagacttgcagcccaagattagtgtttggaaccatggtggagaacagggtggtggtagtgggaatgctatgaaggatatagctggactttacaagatgttgcctccggttcttgatacggtttatgagcagactgggatgcagccacctgcttggatcggtactctacgtggtgcggaaccgaagcaagtgactcgcagctaagagaatagtggcatggtttggtcgtttacttgtggttgaagatacatccatgcgaatgtaattttttattattttaatcctgttggaggacttggcttattcttgtgtgtgttttgaagtgtgttattgatattcttaattgaatcgtattcgtatatgttgaaaataaattaaaatgaggaataaccaaaaccagagaattatttcatttttatatattggagtcttgaactatttcaaattcaaagaacgatagctcgtcctttcgggaacaaccaaaatcaacgccctccgatatgtgggctaaataggagaaaactggttcggatggtggctagaaaataaaattttgcggttttggcggaaaaacacatcatgagaatggaaggtgttatgcgcatagtctgatgggaggtgatctagccactgactgactgactaagaattgtgttatgcgtgtagtctagcggaaggtgaaaggtaggaatagtcatttggagaattaggacgcgcttgggtcatcgaccaggacaggagcagctagctactagctgactatctgaagtcttcttcatgtgtagtttcttggaagtgggttgaagttttatcttattaggaatttgcaaaaagtctccgatcctattttattctaaaatatcatatgtcatagtcaaacaagtttgaagagattttggcaaactcaacgtcttattatcaaaatgaaaattgtaatgtatataagcttggtcatggtcaacatttaatataagatgtaactatatgctatacgtaaacatccgagattaggatctacatctattggtttaatgaattatgatttattttgtttggtttatatatggtgtacttatatactatagtttaccctaccaaaaagaaaaatatactatagtttaaaagattttgaattttatgtatttgctgtatcgtgtacatacatttttatttttttttgctaaaccgtgttcatacatataaatcttgaattttatcaaagacaatttcatcaaattttaacaaatatgattttttttgcaatacaattcagcttgacaaaatctaaatagaaagtcaagaatgaaacattcttcacaatcatcctttttttttgtgatatatacaagtttgtgaaatttctttaacatttctctaacagtgacagacaaagtcttgtaacatgtcaacgactatatgtaatatataaacacttctcacgaaacaaaaaaacaagtacagctactcattcttcgtctccaaaatcattttggcgaaaagcaatcaaatccttagatcctagacatg

SEQ ID NO: 23736 - DNA, 3000 bp, Unknown; identical to SEQ ID NO: 5473
  misc_feature (1)..( 3000): 2750-1469P.txt file - cDNA_ID_2150625; gDNA_ID_1620792; Annot_ID_168329

SEQ ID NO: 23737 - DNA, 3003 bp, Unknown
  misc_feature (1)..( 3003): 2750-1469P.txt file - cDNA_ID_2150649; gDNA_ID_1620792; Annot_ID_168335
aggtgatcatcaatcctagtttcagacatcagttttggtctctacagttatggaatagttttccttgtaagttgtctgtctatcttttacctgtaactgttgttagtgtcaggtgcttccaaagaagtgccatctcatggaaaattgtatcaaccaaaacacaattttgactcattgagatttgtccttcacagtaaaaaaatgttatagatttttgtagactcattaataaaagcaagtgttcatgcgccattgtatatttatttagttttggttaccaagtgatgttccagtggtaattacattccattgggcccaaataaacttcacaataaacaaatatgaaaaaccttttgtttcttgttcaagaaactcgacctaagcaataccagattctctaaaacaatacaaactgggttttctctcttatgccaaccttttcctgtcttgagtgaaaagcctagttgatacccatttaaacaaagatctataaagacaaaatttgttgaaaacttggctttccattaacaagtaattatttctttcacaatatcatactaaagatgaattatacgtatatttgtcgtaaataaacggagcgatatatcatagagaaatatcctaaaatagcactcaaacaagtttaatggacaattaaaataacattgtccacaaatttgtaaaattagctttagtgaatttactcagtaactattttataattatataaattaacaaaattaattacaatttgaaatcacgattaatttacaaacaatcgtgtgaaacgtcaatcgaatgttaataactttatattagttttttactatgaatttgtgtttttttagagttttagagattgtgtgttaaatttagtaacaaacttactttcatgctatttatgagaattgcatatttctagaccaattttttattattataattcatataattattcttgaattatttatgtgctatttgtgagaattaccaatttctagaccaatattttattattattcatataattaaacgtttattgaattattttagctctaaaaaatataatgaaatttagaattgttatagaaactttaaatgactcaaaactgatctttgtttttttgtcaaccacacattaattaaaaactgatctttgttaaacatctaaatattgaaaaacaaaaggattaccaccgcacctatcctgcatcgtcttgtaccatttgcattcatcagagccattatatattcatgtggctgtcacatccttatatacatttcaacttataaatttaattttgtacgtttagcagatgttggtgaattcatttattcaagcttaaggtttaactcgttcttgtctcctttaggttcataacatttaatggacaacaactactccaaatatccgtggactttaccacgcgacgcaccgacaattctctagccttttcattaattgatcagtaaaaacacttctataattttaattattctcagaaattttaaccggtagtaacataaacgtagatgatcgaaaaagatgaaatcgaggtctctgttttgtgtcgaattaatagatctataagaaatcaaacaatgaaaattaaatagatgaatgaaatatgttttgacgacgttttcacgtcactgtttaagttatctgttagtaaaatttgatagcatttaatttgaattgctatgtaactcggaataaattcgacggcaagaggtgtgggatgtgatcagtcttctaattaagtgtaatctttacaaaaaatcagtatgagttaatacaggtttataaatagaaagacatctacagtaaaacctctataaattaataatgttgggactgcaaaattttattaatttagaaagattttaatttatcgataaattaatatttattaatttatagagagattttcgtaatttagtaacttttcaaaaatttctataaaatttttttcattatagaaaatatctttcaaaaatcaattacaagtaaataataatatcatgtttagaaaacaacaccaaaagtttttgataaagtaaaatactataactaaatttaaataagaataaatacaaattttaagcaaaaaaatattagaattatatttcaaaataatttcttacatataatgtatatatagttgatatatttataaaattattaatttatgatattgatgggaccatatatttacataagattttttaaaaagttattatcttattaatttatcgatttgtgtcactttttacactgatcccaactcgggactggaagaatttattaatttatagaggttattaatttatcgagtattaatttatagaggtttaactgtatatgaataattgaatacacatgggacatcattatagttaccttagtacgattttatgcatttggttaccaaaatccactaggcttcgtaattggttgtgggtcagtgtccattcgatagtttgcattagcgataaacacttaaaacagtaaaacgtgatctatttttaaacaataacatttcttcttatcaaatattcacataattaatgaagaaaagagacgaattgataggcaataagaaatatgatcacttggtaccattgtatgcatggtatgaactgacatcaagtatttgtacgttgtagggtaattattaacattgtagaatgacaagtatgatcaaatggaaaaggattagttatatgtagcaaaactagtatttgtacttggactatcttgtcatgtagttttcctaacgctatatataatccaataaccccatgacacggaagagataggggacatacaataaatatcagtagagaggacgtgggaaaagcagagagttaagtgagtagttggagatagaaagatcagagacgaggaatctctctcccactctcactttctctcctattcttagttcgtgtcagaaacacacagagaaattaagaaccctaatttaaaacagaagaatg

SEQ ID NO: 23738 - DNA, 3003 bp, Unknown
  misc_feature (1)..( 3003): 2750-1469P.txt file - cDNA_ID_2150883; gDNA_ID_1620758; Annot_ID_167084
agatgcttgaatctacaaaacaagaacaatgatgcacagatcacttagtcaccgtagaagcattctgatctacttaagtgagttagtcttatatgcgtcgggtttctgacctgcttattacgagcttcatcatcttgacgaaaattcaattcctgaacaaaaatgaaaggcatttatcatcagtaatctctgttaagtaacccttctctaaaactgtcgaagaggaaaaagaaaagttgatgcttcacctcctcctcaaatttatcaatatttttgaataaagctgctattaaggcatcaaagtttgggtcgtctcttaaagaacgtcggcttgcacaatgttttctgcaagtaggacactcattgttcctgaaaatgcatttgccagttaatataatacagaacaagctttacattagactccctaaagaatgctgaacatgcaaatggaatgcataccccaatctcattgacttatcaatgcactctcggcaaaaccggtggagacattccatcacagtccttgttttccttataatccctaggaaatgaaaaccagtgctggcatcagtcgaatttagtaaagatagagtgaatgactatgtaaaaacagggtaatgagaaaagttggcaagcctgaacagtctacaatgactaccagctttatgttggttgatgaaagtagctgaagcctgatttttcttattaggtagttaaacattcacaataatggtgactgagaggcaactgaagctgattgactttgtaatataaatgtggagaagagtacctaaacatatcgagcattgcacgtccttacagatatccgctagatcaacaaccatatatctgcaagggaagtcaagactttatcaaataacaaagatcaccaactactgtgttgcctactataagaagtctgtctcagtcaaaaacttatgttaagctaaaaagagactaatcaacacagatcaatcctcggcatttaaacacaacagtatcaataacatgcaagcaagaaccaaacaatgcatcggatcaatgaaaacaaaacactgaggacatcagagaccacatgttccgcttaaaacctatcaaacacaacagtgaaaccaatcatcagaaaatgtcgaaagggaaaagaattgttactctgattctgataactctcctgctgaagaagattgacttctttccttagaatctgaaactgttaataccaattaaagactttcatgttgtacatactaacgcattgattgattcatgtatctcacatcacatacgtatataaatatatccacgactataaacaagagcaaaaaacgaaactttcaccttcttcttctcctaacgcttcctcatcctctgcttctacttggtcacgtttcacgtcgtcttcctcatctccactttcgtccttctcatccattttgtctggatcttcttctttctccacagcttcaggattgaatctttcagcttctgagttccgacccagttggtcatcttcttcctcggcggcggagaagctcttcaaggaaggcattgttgattgtttgataacagtgatctctgcttctaggaagagagaggaaaaagaataaagctttgacctttatctctccatctacgtctctctcttgtgggcttatttgtatttcctcgttctttgttgtttcggttcggtgccgatggaaagagagaaaggagaacaaaggaggacgaagaagaaagagagaaacttctttaccttttagcatacttatattattttataatattttttttttgttaattatattaagatccttgggaaaaaaaagtaaaaattatactaagatcccttatactaaaatcttattatacatgttgtgaattcttaagctaaacctcttattttctcacaaatccttaatcatatttttgtttttttggttcatactgacgcgtctaaaaagtttggactttcaccataatttttctaattttacgagataaaagatacaatatacgtttttgaagagacgtatattatccgattaccaaacaaaatcaaaattagaggatgtaattcacttccaaaagtgtaccacgcgtataattgacccgtctctacttctgcttggatatcacatacttagtttagattttttttttcgtaaaaggcaaaatatcaaaacttatttaggagaatttgaccacaaaatatttcatatgtatttctaaactaatataatttcttcttattttattgttactatattttttcttttttttgtaagttagaaacctattaaaaacactatttgggtgataagttattgaaatttagtgataacttttttcattatggtagattgtattagttaaagtaactttgatgatagatcttagttcaaattttttttttgtttctcatagtgtttgtagtaaatgatgtgttattgacttattgttaaacatatattggatatataaataatatatcatttaatatgtattgtcaatagctagctcaaaactacgaaatattggaattgaatacaaatgatattgaattgaagtaacacaacattgtcggccttcttctcgtgtgttagcctacttgccaacccaattccattatctccacactttgcattacatgtgacacatgtgtgaagtgtaaataatatatcaactatcaggcatcataattctttaaataaatcaagattggtaaaaaatattacaataatttaaacttttaacatttgttactaaaaatatcaacgataacacaatttacaaacgttaataaatttgttacagacaaggcaatttttattttcgaaaacataataaaatacattgggccatattaaatcggcccattaagttcactataacttagaacttagaagcctttattgcttccctctcaatttccattttttttttggttctttttttctttctgcaatcggtcgtcgtcgttgtgcttaaacccttaccggaatg

SEQ ID NO: 23739 - DNA, 3000 bp, Unknown; identical to SEQ ID NO: 5501
  misc_feature (1)..( 3000): 2750-1469P.txt file - cDNA_ID_2150917; gDNA_ID_1620796; Annot_ID_168474

SEQ ID NO: 23740 - DNA, 3003 bp, Unknown
  misc_feature (1)..( 3003): 2750-1469P.txt file - cDNA_ID_2150962; gDNA_ID_1620796; Annot_ID_168499
tttggaaaccctgtttcagacttgttcaccattcgagaagcagacatggtcttctaccgttagaaatactcggttgacatctacgagcacggaaagcgcgaggcgggttctgtgtattttgctataatcatccaagaacaataatctgaatctttgcaactaattattttgaacaaacctatcgaagatatttgattgcaactacatttaagtttggagattgtaagaagttaatttagttttcgttatcactctcttctcaaacaaaatgtaatgtgtatgtacacgttaaaacatatgtcccccatatatatctatatttctcgtacactgcaaatttactttctaacataactcaggtgataaattgatttgacagctaacgcttaccaacacatgtatgacattcaatacaactgtaattgccccaactaaatccacaatagtggttattaaagtgaagaacttactgactcttcccgacgattgactctcgaagataactaagaacatggctgactaatgttggtctgaccttggtccattgatacgatcaagcactcgtggaagagacattgtctacttataagtgtgcattttacatgttttgagcatccatttgttatcattattgcatcatatcaccactgttttataccatttctcatcatttgtcatcactttgcatgtttaggatagttttgcatgcatattgtatatttgtgttgatttcaggtgatttggagctgttaacgagctaattggaagaagcggacctgatcatgtcaaaccactcgacccccaggtcgagcagatgctccacgacatcaaaggaccacttgaccccctggtcgagtagaagacttcaccactcgactacctggccgagtaccaccatgagagtcactcgatcacttcactcgatcacaccactctaccatgaagtcgagtatcaccatcaccatcactcgattacatactcgattgccagctaatcactcgacctctcactcgaccacctgggtcgagtactgttcttaatccgtcccaatactgcgtcgttttgagtattagggtttcagaatatctcgctataagtagcatgtactttacattttcgtagggctaagttttattttccgcagacactgtgttcttgacattttgtaatctggatttctcttaatcaattcagtattcagcattttgttcttgatttcgtttactgttgttcatcatgttatcaccttgctattactctgttgttatcatgttttcattctattcaacgtgtatgttctctgcaatgatgtctgagtagtgaataagtttctgaggatgggttagagtagtttagaattctcagtatgctaggtggttgagtttgattgatatatcccttctggattagttgttcttaatgcatattgctttctgatcaactggaattggagcccagacatttctgcgcccaaaaggtgttcgatgaaatgtttgaaccactaattctagagattcgtggctctgtaccaaggtattggttgcagggagcgttttggctttaacttgttgattcgtaagcctgttaggttagctctcgtcaatggtgattaagtctgggactaagttaacttgagagtctctgttgcggtgacacttagatttggtttttgttgtctagggataatttattgagcatgtcaatcacctgtaaactgaggaaacaaacctactcaattaccccatcctcgtgaattctttatgtgattgatttctttgttacgctactgttgtttactgcatcttgtcatctgttgcttagtttctacaattctttcctgttactcgacctgatactcgaccacccagttgtctagcaacagactgtgcagtcgagtatctttgtttcggttactgcatgttactcgaccagtcactcgaccaccccagtgctctgcaacgagttgtgttggtcgagtgttttactgtatccgcttgattttctgttttctgcatgttcacttaggactgctagaacacaccaaaacctgttattgcttggcttgacttagtgacttctgatcacatcttgattgttagcatcacatccatttggattgacaacctaaaatactacaatgacatgattgatgttttaggataattgagtaaaaacctattatcaatttggcgctgttgccgattaggtgtttgtttgttacatttaagatttcaaacttgcttagatcaagttctttttcaattttcagttcagttactgactgtgtatttttgttgttgtctttttgatccaggtacacctctgctgtatgcaaactcgatcaccagagaaccagaacctctttttcaacaataacatcgaccacatggcttgcgaattcagagaaagaagaaacacagtccaccttttaccccaacaaccactcgaaatggctgacgaacagaatcaacagaatggtcctgccaacattggtgatgtagatgcaccatcgtcagaggaaaggaattgcacctcctgctatccagaacaataacttcgagattaagagtggtctcatctcgatgattcagggaaacaaattccatggtctaccaatggaggatccactcgaccaccttgatgaattcgataggctctgcaacctaacaaaaatcaatggtgtaagtgaagacggattcaagctctgtttatttccattctcgttgggcgacaaagcacacatctgagagaagaatctgccccatgactccatcaccacctgggatgattgcaagaaggcttttctagcaaagtttttctccaatgtcagaactgcaagactcagaaatgagatctctggcttttcacagaagactggtgaaagcttctgtgaagcatgagagcgtttcaagggttacaccaaccaatgccctcatcatggcttcaagaaagcctctctgctcagtactttatatacatgcgttttaccacgcatcagaatg

SEQ ID NO: 23741 - DNA, 3003 bp, Unknown; identical to SEQ ID NO: 20690
  misc_feature (1)..( 3003): 2750-1469P.txt file - cDNA_ID_2151223; gDNA_ID_1620774; Annot_ID_167624

SEQ ID NO: 23742 - DNA, 3000 bp, Unknown
  misc_feature (1)..( 3000): 2750-1469P.txt file - cDNA_ID_2151232; gDNA_ID_1620774; Annot_ID_167631
cgtacttgccggttgcagcattgtaaccgaatttcacgttatcgttggaaagcacctgccaatgaatagagacatctcttcaagcatctgacttgaaatctagagataaaaaagtgggaattatgttatctgttgttattaccttctcgctaactacacttccattaacaccagcattcttggcgattagttttagggggtaacttagtgctcttttaactatatccgctccaacctaaagggaatcatcagcaaagttagagaaaccgaaggttcatgagttaaaatctgaagacttgattgatttaccttttcttcatcattatcaagcgtggctttaatggcatcaaccttggaagcaagacgaagcagagtgcaaccaccaccaacaacaataccttcctcgacagcggcctgaagaattaaaatcctgattagttatagttcacgagtatgcaaataacacgcttctcaagcctcagaaatacaaaatcacctttgttgcattaagagcatcttcaactctcaacttcttctctttgagttctgtctcagtttgtgctccaacctttaaccaatacataacgagcttaacttaatatctctgaaacacatcttaatcagacaaaggaaacttaaatagtttttagtttacctgaatcacagcaactccaccagagagctttgcaattctctcattgagtttctccttctcgtaatcttgctccgcttgctgcacaaaccaattaccattgcaatgtaactacactatccacaaaaagtaaaagaggtcccatatatgctatactcttttactatacctcaataagatttttaatctgtgtaacacgctttttcactgcatcctgtgtgcttccatcacccactatggtcgaggtctcctttgtgaggacaacctttgaagcattaccaagaacctcttttccagctttgtcaagtgaaagaccaacttcctcacggatcacagttgctgcaagcgaagatagaaaattaggacaagataaaaactacaaatatatgcgtaaacatagggctcatcaatgcagacagaacttacctccagttagaatggcaatatcatcaaggtattggctcttgcgctctccaaaccctggagctctgagagctgctatcttcagtgtacctctaagcttgtttacaacaagagtcgctaaagcttcttgttcaatgtcttcagcaataattaatattgggtatccgcctctaattgcatcctccaaaacaccaacaagatcccttgcattggtaattttcttgtcaacgagaagtaactgcaatcataccaaaacattaaagatcgttgttatactcatatataaatatctttagtggctaaatagtctgccaacaaaattcatcttctactcagattcaagaaacatctaccttgcaattgtcgaactcgacggacattttctcgctgtctgtcacaaagtaaggagagatataaccacggtcaaattgcattccttctacgacgtagaggttgttctcggcacttttaccctcctcaagggtcaccacacctttcctgcccactttgctcattgcttcagcaatcatatttccaatttcgtcgttgttacccgcactaacagctgcaacatctgcaagttcactgtcttcaacctacatcgacatgacttacattcagaaccttttgaaaaagactcttaacatattaaaagaaagagagttctataaatttgaaacctccttagacattttcttgagctcggtaaccaaagcctttgctgtcttctcaatacctctggtgatcaaaacagggtttgcaccagcagctaccacctgaataagataatcttaaaattagtacaaaagtttttgaagtttcacatagagaaagctgaaagaagaatgttacacagaccttgacaccctcagcgataaaaccttgtgcaagaacaacagatgttgttgtaccgtcaccagccaagtcattggttttggcagccgcttgcctcacaagcttagcgccaatgttctcaaccgggtcttccaactcaacctacaggagaaagtttgaaactctaagactcagttgaatgagaacaaaaatcattatcagaggggtaataattccatacctctcttgcaacagtcacaccatcattaacaattcgtggtgatccatacttgctctcaagaacaacatttcgtcctttgggtccaagtgtaacaccaacaagatctgcgagcttgttgacaccagcctagtacaacacaaaattagaaaccacagaaaatgtaaacctttagctccggtttgggaatgaagtttccattaactttttttaaaaaagatacttacttgaagtctcctaatggtagtcccatctttgttgaaatgtaattcctttgctgcgcacacaattgcagaactggatcttctgggtctaggacacacactttgtctccttccaaatgagcttgaagacaacttgctgataagtttcttatcagatttgtgaccattcggagcaaccattgaaccaatagaagatgtggcagtgaaagttgacgccattttatccacttcaaagacagacaaaattcagcacttagataagatttcaaagatataaaaaagactcttcttttcatctatatacggttaacacaatcaatataacagaaagaaacaacaacccagtaagctaaagtaataaattttcacaacaaaccagaagaaaggcgacaccttcgaaagcagagctcaataagaacacaattgacaatctgaagaaacactaatccataaattttattacaaaacacccaaaatcatggaagtaatgaactaatacaagttttcaaaagcttacaacaaattcttatccaaacaaaacatacacacataaactgtggcactaaaaaatgcagaggataaactattccaagagtaaggattaagaaactaacagaagtagagagatg

SEQ ID NO: 23743 - DNA, 3000 bp, Unknown; identical to SEQ ID NO: 2136
  misc_feature (1)..( 3000): 2750-1469P.txt file - cDNA_ID_2151342; gDNA_ID_1620492; Annot_ID_158646

SEQ ID NO: 23744 - DNA, 3000 bp, Unknown; identical to SEQ ID NO: 7347
  misc_feature (1)..( 3000): 2750-1469P.txt file - cDNA_ID_2151370; gDNA_ID_1621141; Annot_ID_172819

SEQ ID NO: 23745 - DNA, 3003 bp, Unknown; identical to SEQ ID NO: 15925
  misc_feature (1)..( 3003): 2750-1469P.txt file - cDNA_ID_2151380; gDNA_ID_2926149; Annot_ID_197953

SEQ ID NO: 23746 - DNA, 3000 bp, Unknown; identical to SEQ ID NO: 7345
  misc_feature (1)..( 3000): 2750-1469P.txt file - cDNA_ID_2151380; gDNA_ID_1621141; Annot_ID_172824

SEQ ID NO: 23747 - DNA, 3003 bp, Unknown
  misc_feature (1)..( 3003): 2750-1469P.txt file - cDNA_ID_2151380; gDNA_ID_1620725; Annot_ID_165936
tgattttcaactcatagaaacagcataaaacataggggtaattagaagaagaaaaattatggtaatgtaaatttaaaataatgtagacaaaatcaattaagatgttgtatttgtttaattcttgaccgccactatatgtaaagcctattcttgttcgacgagcagtttgctatttttgaaggctttaaagatttgtttgtcggtcttcaaaaattatatatgattcttttttgtgttttgttctcattcaaacactaccgaaaatcactttccggtagatcatctatcatgaaattgctccagcacaaacatgcttaactgtaaagttttttcgatatgtttaatcgaaaagataagtgcatttcgtggatatagatgatctaattaatttttaaaactcttttcattcactactatatatcctgaaatcgggatgttacaatttatttctgaatttttttaagtgtctcctacataactagatatgttacaaccactatggatcttatttctaaaaagtattgaatacatcatgtctaaattgattaattctcaaatatactacattttatgctattttctgtaacttccatcagaatccaaaatttttttttaacataccataaattttaattttatgatttatgaaatatttatagattttattattttaatatttttaaaaaaatccaaaataatagtatctttttagctaaaatttcttttactgtattttaggatatttctctatctaattgtacaccatacatataaccataatttggtgtaattcagatttaaattaggatgacatcaaaattagtcaaaatcaaaatagcatctctattttattcttatacttccaaggaaaaaaaataaaagagctttaaacgtgtcgttatagctgtaaagctggtgatggaactggtaagttggtaactgcttcgaccaccgtacgaatatggtggttactggttaggctacacggtaatttcttttatttacctgcagtgagaaaggtaaataataatgagtgagagagtaatggataattctgaatttgtaatgtcattgtcattgttttgtcagtaagtgatgctttagttaactcatgtttatccatatgggccattctatgtttcatatatatatatatatatatatatatatatatataatatgttattttactttttataattttgattcttagtctttatcagaaaagaaaaagaattgattcttagttcttggatttatgaaaagtaaataattatgtgcaaagagattctttgataatttttcaatataataaaatattaagaatattatttaaaaaaaaaaaattgagggaagagattcatttgattttacgaaaacgctaaaacgagatggattaaatgttagcctttttcatgacaaatatgttgtaaagcataatcatgtacaaggtaaaataattttgggtttttagtgtttatgtcgtaattctataatttttctcaactacttttttctttgtataatttagcatttttaatatcaaacacttttgattccaaatacagtttatttttattttcttaagactacttaccaaacacacataaacggtttttaatatctaaagttaccaaatgtatgtatttcaaaaaacaatcatcagcaaatttagatgttttgaatttttattagaagaaatgcattgcatggttataattagaaaattaaaataaaatataaatcaggattatatgaccaaaaattgttttaacttttacttagcatttacacataaattaacagaaatataatattttttaaaaaataattttcttataataaaaattgttatattgaaattcgaatattaagatttggcaagtcgccaaaatataatcacactcaacaaatttatattgtctcactaattatctgttcataatacatatatcaaatgtataaatcttaatataataaattttaaactaatttcaactgtcatactaaacaagagtttatacaagtctttacctagtgttatactccctctggaaatgttaaagcttattgtttaagaaaacatattatacacctaaagaaaactatgcattcgttttgtgccatgtgttgttttactagtcgtgactcgtgattctccatatcattacgttaatcccaactctcaactattattatgttattttttactatagaatggaaacttgtagattacttatatgaaggttgattaaaatgtaattaaaatctgtatcttttttataaaaaaagtctcttcatatatgttttagttgatgagtgatggacaagtaaaaataaataaaataagtacatacgttttgttttagtgatataaatatatgatgccaaaaatgtacatatattttctggataaatattagagttgtagatccaggtttgctatgatctagctctgtccgaaaattgcagagcgtgatcttttctctgtagtacgaccgatttgttttactttatccaatcgttttaactttttcaccacggttaaaaaagttaaaatcagatctctaaccattttctcaacgaacctcgctaatatttctcatttaatcaaaatttaatcaccattaatcctttggttgattactcttttgtcctcttcttcttctctcttctctttcttggtggctctcttcttatagccactgttccctttttcattgtattcctcaaatctctttacttgatcgttggttctctcaaaaatcagatttttatttctgggttttgttcgattttgtgatcatggcggtcattgagagcgtcggagctaatactactgtggaagctggtggtttgatctcgccgtcgccgccgtcttccgtcaccagtcaagaatcaggagcttcttctaacaacgatcacggtggaaatggaatccatgatgagatcggagtccacgtggcgagatccgacggtggtgagagttttaagcgtgatatg

SEQ ID NO: 23748 - DNA, 3000 bp, Unknown; identical to SEQ ID NO: 2147
  misc_feature (1)..( 3000): 2750-1469P.txt file - cDNA_ID_2151453; gDNA_ID_1620494; Annot_ID_158683

SEQ ID NO: 23749 - DNA, 3000 bp, Unknown; identical to SEQ ID NO: 2143
  misc_feature (1)..( 3000): 2750-1469P.txt file - cDNA_ID_2151461; gDNA_ID_1620494; Annot_ID_158685

SEQ ID NO: 23750 - DNA, 3000 bp, Unknown; identical to SEQ ID NO: 2151
  misc_feature (1)..( 3000): 2750-1469P.txt file - cDNA_ID_2151501; gDNA_ID_1620496; Annot_ID_158702

SEQ ID NO: 23751 - DNA, 3003 bp, Unknown
  misc_feature (1)..( 3003): 2750-1469P.txt file - cDNA_ID_2151548; gDNA_ID_1620495; Annot_ID_158697
gaataaggtgttgttaccttcaaatgtgcgttgtggcgcttgccttctttccagcgacggatggtaccatcatttagtggtttaaacctgtctttgaatgacctgagatatagattcaacacaaaaaaaaattgttgagagagacgcccaaactattactaacaagatttgttgataatctgggaatcagaagtttcagcacgtacgaataaaacttaatcttgactttcttgacttttgatgtgattggagtcctaggtctccacttcttcttccattttgccattttttccttagaagtgatatttcgtacttgaacaaactgaaggcagagagaatcaaacgtacataagataagcaatcagatataaatcaatgttggtacttcgtagtgatgatactcaagcacaccgcctttatcatctggcttaacgaacatgatatcaaaatgcaagagctactatgaacaaataattctattttcggaaaacacgcaatcaaagccatgacgattcttctttcctatgatcaaacaaggggcacaaaattcaagaaccgtacacaataaatccgaatgttaagattccaaagaaaacatgtatgtatcttatgagattgagtaagctctttttttttttttaacaaaagagatttagtaggttaaaacttgcaacgtagtgatatatgcaagcactgacttgtatcagttggattcaaaacaaagtgcaagtaagcttattaacattctttgaattagtatttagtaatccatgttgttgattttgtttcaacagaacatatagaaaattcagaagaagctaaaactatataccaattcaaactatctagctcgtcactcgtcagatcttgtcctcctaagatttgtctcaatcagcagatatatataaagcaattgaagctaaattctggaaacttacgtgatgaggaacaaaggtagtgcccatggagctaacattcgacggaaaaactccggcggcgggaacgaagctccatttggtggaattggcaaaacctagggttgttgttgttaagtgacgactcggagaaggagaatggtgaatgagacggtgaggagaagcaccgtaaaaagagagattccgattagattggagagaaatggaacgtagcttagtgcaaaacctctgcattgtcgtctccaaggggaagaacaattttctgattgaaatgcgaattttataaaagagaagaagtgtgtgtgacaaagctttggggtttttgggaaatgattttgagtgtttggttattaggataactctattcttttttactctttttttttcttgtcatcattctcttttactttgataatggtaaaatgtctttgggaaaaaagccaaaaaaataccaaactaatttgttttttttttgtaggcgaaggggacaacgagtccccttcaaaatattattataaaattaaaccaaattacaaacaaatacgccgtgaatacgagatcccacgatagtcttcatcaaaaaaagatgagatacaatccgaacaagaatctagtaaatgcaaccctaaaaggcataaaaatgcataattagccaaaccatccgcaaagtgattcgcctccctatacacatgagacaattggaccaaccaatcctttgataaaaagccatagcacaagcgtgctaggaacgacaagggatgagtatcgcatatccccgtcttaagaaaccccgcaaccatcttcgaatcaacttccaactttaaccgagtaatcttgttctcccatgcataataaagcccatagtagaacccccaaagttctgctaaaggagccgtacatacccctatattaaaagcaaaaccttggacccagttccccaccgcatctctaatgaccccaccagccgtggctaaacccgggttacctcttgaggctccatccgtgttaagtttgaaccatccttcatccggtcttgaccaagcaatctgacgctccactctaaccctcttaatctgacctccattcgcaagacaatgtgcttgatacacatcttttgatatctctttcacaaactgggtacgatcacggcacttcctattctcaccaaaaacgttcccgcatctccactttcacgcccatcacattgccatactgaacactgtcccccacggtatcccctctctaaccacctgacttcccacgtttccataaatccactctagtaatgtttgagtgtaaaaaggtctctggagagtaggtggaacaatacggttccatatccccatcatcgccggacaatccctgagaatatggagaatagtttcatctccactcttgcaaacttggcaaatagctgtatcacataagtgtcttctctgtctctcagtgttagtcataataacctgatgaacaactagccaaagaaaaactcgcactctttccggtgtccgttaacagctgggtttgacaccgttaaaatttgacaccgttagatgattccgtaaaatttaacgccgttaaatgattctgtaacgtccgttaacggttgagtttgattccactaataatttatatctgagatattttgtgattacaaataattaaatgaggtatttttactctaatttaaaaatattgggtattaaacttttaaattaaaattagtttttttttttttttttccaaatgtttttatattctagtgtttatgcttattagctacgtagacaaattttgatacatttgggcctgtgtagctaaataaattgggcctttcacatgagtagataaaactaataaacctaaaagaaatcgtcttgttgaattcgccgtttggatctggctccattggaaaaaaaaactagaagcagatctgttgaagttaagccgagattcatcaattcgtgttatttgtctctcttgataagcaaaaaacatcgtacgaagaagaagaagatgaccttaattttttctgaatgaaatcttaaaattcccagaaagaagaatg

SEQ ID NO: 23752 - DNA, 3003 bp, Unknown
  misc_feature (1)..( 3003): 2750-1469P.txt file - cDNA_ID_2151611; gDNA_ID_1620493; Annot_ID_158672
atttcagttgtttcagaatatcaaactacagacaaagtaaaaaactgaagatagttcatggatttttccaaaaggatatggagagttgactaataagaagaggggcactatagtcatttcctagtggaaatacccactgttgtgtaaaagagagaatacatttaatgaaagtgaggttgtaaaaaatacatgtatttatgaaatggatgaaagttattgttgacataaacaatcagcaaaatcatctatccaacctcttcaccgtattgtaaacaatgttaatgtgtatctatgaaatagagtataaaagacaactttaaatttgatctagaagctgtaaatttcagaaatcaatttggatgttttaatggttttcttgttatgacaatcttaatgtatgtgagggtttgtactttgttgaatgcaaaaattatgagtgactgaaatagaggagaagaaaattggggatagagttcgatgaatatatgcaatcatttaggaccgagaaattaagagagggagtgggcaaaagggacagtgacattctctcggattttattcttgtatataactaaattacaaatccataaattccaaatgtattggtaacatcgattatctttgcaaatagcaacaaactcgcataatgaaagactcaccatgagccaaaactattaaatttcttttattttggagtttgaatcttgaaattagtacaaatagaatagtcttttttttccaaaagaaaaggtttaaagtatcttctcgagcactgtgttcttcttttctttaagttttcagtgtcataatttatacaaatttaggtaaagttactaacattttcttaactatttaaccttccatttcatgtcctagcaatttttctaaaaacgttgaaattgtttccactaccttttctgccaaatatctgcacttcaaacgcatctagtcatctaccattctacttgaccccggtaccatcttttggagatttagaatgtatgttatgcccattatcaataagaaaacatggaaatgtggaaagaactttataaactagagaataaagaaaagtaagtttggagcatagtgtttgttggcttctaaatatcacttgtacacaattacacattattaccaataaagagaaaatcacttcttaatatatatttttcttacataggcagaaagagaagagtgtttactacaaaagaagcacgcactgatttgtttttttcactttcacccattcattgctcttctacactcttttaaatctctccttttctcttcaactttgaaactgaaaaaggacataaaagatttggtgggttatgtttcttttctttggagccaataacggagcttagagattcttgcaacttttttcccccttgcatcctcctttactcaatagtaatttatgtgtattctgtatctcttcacaaaataataaacaaagactgtctttcaccacaaaatctcttgagaagctgcaaagttgggtaaaacttaaatgaaatgtacacttttttatatactacatatccgttttcagaaatagatttcataaactatgtgttccatatggatcccatttcaccttcaaaggccccctttacatttatgtatattaatgattatatgtttctcattgctcaagagaagattgcatcattgaataaaggaagaaagaaaaaacatagagagtgatttggttcatgtgggtcccaaggaagtggagtcatggttcctccaaatgccatgctcatgctcatgctcatgcacatgcagagacgcgtatagtctttctaagctgatatatcaactgagttattagatgcgacaaaatctacttatataatccactcgacttactttaacccaaaatttcactaaaacaaacgtgaatcacataacaaactcgcaaaactcaaccaaaacagttttgctgttgtatgttgaaaaatggcaagatataactaagttgatagatcgggtgctcatgggttattgaaaatcccccacactagaaacgaagggtggtatcaaagttatagtatagaggctgctgtaaaaaaagtggaccactatttttcacgcctaattttcttaattactctattattgttaattccgaagttacaaaccctaaattataaggctagcctttatatttatagcatgttcttctgaagctgatacagttttcaacacatgtatccatcataggagaaataaaaacaccaaaagaaactgaatcgaattgtgacgctttttcatgtgataatacacattattttgttttttgtgtgtgtttattttgcttaattttaacattttcatatgagtaccatagggaattaatcaagaaaagagtggtgtgtgactgaggtgatataatgtaaagtagagagtgttgacagatgtcatgataatgaaaaaatcaactgaaagatatatatgtttacacaataaatcaaaatttggatggaagggacaaaaggaagcatatataccgtccgatcatgtagaaaagagatagcaattacaccgacgagaatagtaacttggcaacgtcatgctttcttttcaagattatatgaattttcaaactttatgttcttccaaataattagacgacttcatggctctcacgttaccatttgagtacgtagtccactagcgtggtccaaaattctatatccatcattttttgttctttttcttttattttacaatcaatcaatctatggatgtacatataagtaaaagtctacgccaattggatgattaagaattaagataagcgtcgtgaagaaataaaaaataattgggccttgggctaaaggaatatttgagaagcatataaacaattggcccacaaggccacaaggatctccttcaaacgctcggaagtttccgctttggattcctgtcaccggcgatttcgtgggatgataacgacgccgagctatatttcgtgactgaagcaaagtgatg

SEQ ID NO: 23753 - DNA, 3003 bp, Unknown
  misc_feature (1)..( 3003): 2750-1469P.txt file - cDNA_ID_2151663; gDNA_ID_1620499; Annot_ID_158796
acattgattggtttattatatatgtagtataactaataatataaccttggtgggttgatcagttatgtgcattttcagattttagctactttatggtatttaaggatgttgttttggaccatctatggtaatagagatgaaatttgaaattgtccgaggaagatgacatgagtttttctcgacatgaaatccacaacttttggaattttagtacatgacaatgatctaatcttatatattcttatgtttgtttaaatttttatacggtttcaaattttgaattgtttagatgtgcgaatataagtgagtgtatatcaaaagtaccaatcttgtgtatgtatgtgtactgtttaaaccccaaaaaaaagtgttaatccaataaaatatacgaacgagaatatgcaaaagtagcgaagtggggctaatacagcttgtgggttcctttcttttgaatcaaaaagcttttgctttagcctaaagcattccgatctaaaggattcctgattttaagtaatcactatataaaccagtatgaaaggagcttttcctttatttatccttcctaaaaacattggtctctctagttttgtgtaagtttagatgatctacctcctttgtatggctacgtcaatatagtcatatagatagaagttgatactacttgttacataagaaatgtttaaatagtgtaggctaaaagcctaaaacgaaaggaacaacaaagtttgaagaaataatgacgataaatacataagatacaagagagttggagcaacgtcaaaccgaccaagaccaaatcacgtttccttttacgtgagacacaaatacgtaccaacgcattttggttgccctctcatccatacggacaccacacatacataaataaatagttcgaataataaaaccaacaaactaaaagaatagtaaagcataggataggttgtgttgtttgtcaaagtaaaagaatacacataatacattattattacggccacattgtgatttgtctcacaactaaaaccaagatgacagaactctagttagtatcgattccgcacgtgagatagaaatccttgataaggagcagaacatgcctatgatgatgtctcaagacatcatgtctgtacgaaactttttctttttaaagggataaaacaccattagactaaagtcaaaagaatcattctacagcatattccatgatttaaagttactaacagttagagtaacccactcgtttattcacgtccataagatctgaatccaaaattattagacatctactataaacatgcctcgagattcgggagtttaatttagaaaagcaaagctgaagagatatcacaccaaataacacaaaaagtaacgaccaaaattcaactaattgtaaatgataaaccgttttttgcggaataaataacttgagaatcttccaacacagaaaacaagaagagagaaaagtaaactggcaggtaattttaataggggacgacgacgaaacacaggacaatataaagaaacataaacttagagagtcgctgcgaccgaccacagtaacccaacgagagcttctctctcagcacttgacctccttcaaaccatgagcgaagtacaaaaatgttgggttagttgaaccctccttgtagtaagcaaagaccaaagtgctgtcatcatgcataccctccccaacaaagctgtaaaatcagacaacacaagcattgatgagatttcagatgaaatatatgtcatgtataacaagcaagatacgatagattggggtaacttacaattggaagtcactgagcctggggagcaaaaacttggtagctccctcaatacccttcttgaagacagcttgatcttcttcgctgagcttgggtgtcaaaagcttaatgtatttcttaatgtaagcgatgaatcccttcttgtcataagttggttgctcctgaagtctgaaggtgtcgacaatgtcaacaaccttttgagtagagtcatcaacaccttcatcctcaccaccttcttcagcagatggattggcaccaatgttaacatctacagctcccacagtaacccactggataacaaaatcaaaacccaattcagaacaggaaaacaaaaatttaacaaaatcaaaacaaaacttgaagtagaatcgatgacactgacctttccttctacttcccagaggattccattctcaatctccttgtaagggaaagagtcagacagaagctcatcacctgtaaatcaatagcccagactctttagtcattactcataagatcccaaacattaatcgatacaagcgaataaaccctaaaatccaatctacaacgaatcggtaagctcaattaaaggacgtttatatactaatgaatcacagatctaaccaaatcacataaactaatcccctaagatttgaattatcaatgcaaagagcagcaaatcaacgaaaaacctatgatgcgatgacagatctaacaattcgataacatgatttattccgatcggaagaaaaagatcgatagctacacagttcataccgagattaaggaattattgagcttaccggtgagaagatcttggtacaccaacatggtcgcttattgattgttttctctctccgatggatgcgaataaacgaaaatcgaaggttgcgggagagagacgcagcgacgaggggattctgaagtgaggtcctaagtttggtatttatagtcgaaactatagcgtagggttttcaggtaaatttacaattctcggtaaattacaattttgggctttaactgtttccaattttctattttttaccctttccttttttttaaataaaggaaataaatctgaaccgacgcttaatgagccgggtttggtccaacgggtggggattcgagtgttgggctacgtataaatagtgttcgggtcggataaaatcctatttccctctcttctcttccgtctttctcgttctgtttctgattgttcgtgtaaaaccctagaatg

SEQ ID NO: 23754 - DNA, 3000 bp, Unknown; identical to SEQ ID NO: 2173
  misc_feature (1)..( 3000): 2750-1469P.txt file - cDNA_ID_2151674; gDNA_ID_1620499; Annot_ID_158800

SEQ ID NO: 23755 - DNA, 2300 bp, Unknown; identical to SEQ ID NO: 2155
  misc_feature (1)..( 2300): 2750-1469P.txt file - cDNA_ID_2151725; gDNA_ID_1620497; Annot_ID_158713

SEQ ID NO: 23756 - DNA, 3003 bp, Unknown
  misc_feature (1)..( 3003): 2750-1469P.txt file - cDNA_ID_2151729; gDNA_ID_1620497; Annot_ID_158714
cttcattgataccctagtttttctatgtcaatatgactgactcgtaggtttttttttttctcattttgtttactataaattatcgtaatcaaattggaatttgtatcattttttttttgtagatgtcagtggacttaaagcgtggagaaactcttccaattcatgtaaatatgacgtttccatctttaccttgtgatggtaagagaaatccattgatcacttataagtcaagtctatattacttttcttccgccataccttctggaatacttgtcattgtagacgtaatcatttgattttttttctttttgtagtactgagcgtagatgctatcgacatgtcagggaagcatgaagtggatcttgatacaaacatttggaaggtaagatgaatccagatgctaatgcaaatcacaaatttcttcagatgttttcgtttccacctttttgaaattaccaaagttcattttgtttgattgcgcctaagacattatagctggtcatactgttcatatataggttaaacattatatttgaagggaactatttgaatatttctcttcgcatctttatctcacttcgtatggcattttgctctagttgtactgttttatactcatgttaattgctcactaattgtgaatatctgcagctccgtctcaacagtcatggtcatatcataggcacagaatatatatctgatcttgttgaaaaggggcatgagcatggccactcacctcacaagcatggtaacattctcaactttatgagcctttaccgagtttgtaccttttctgagagcttcttttcccttaactgttgttgaatgtaatttgtcttgaatcttttggaagaacagatagtcatgtgcactttgaaactaggttcatgtcaaaacttgtagtaacaatactcagatataactgataatatgatgtacgataatcaagtatgttgtatctggagaaccgaattactctaaattttgtgcttccaagcaaatattaataggaatcttacaagtctaattgaggcttcttagtaaggtgagtggtagatatgtaagagagccccagcgatagttttcatggtagctaaatgtttttgggtataagaagaaagacttaatcatgtatacactttatcttttctgcttgctgaagatggcaaagaagaacacaagaatgagactgaaaccgaagcattgaatattcttggctttgaccaagctgctgagactatgattaaaaaagtgaagcaagcattggcagatggagaaggatgtcgggtattaaccgtttctcttgtcattacacaaactagagattttgtgttcccggcgtttaagaaaacagagactaatatttggctattttccaggtttatggtgtcctagatgtacaacgggttgccggaaacttccatatttcagttcatgggctgaacatctatgttgctcagatggttggtatcctcatctcgctttattaaccatccccttactaagaacatgctttaaattcagattcgttaaagtagtttaatttagtaccgtatgatcattattgacgtttgtttccattgatttgtcaacagagaaagtataaagccagaatttaacttatcaataaccgataaattactctcataatttgtgtttgcacctcattcactgacttactacttgatattccttgttagtatataactagtctctttactctctgaacagatatttggcgggtccaaaaacgtaaacgtgagccatatgattcacgatctatcatttgggccgaaataccccggaattcacaacccacttgatgacaccaaccgaatactccatgacaccagtggaacattcaaatactatattaaggtgtttatccaaattcgttactcttcttgtactcgtatctctccgctggctgtatattttatatacttcattatttgtttactttgaagtttgaaatcatttacctgtatgatccattttgtttcacacaaatccgtatttgtaaggtaaggtcactaaattctttctaatatggcgcagattgttcccacagaatatagatatctttcaaaagacgtactgtcaacaaatcagtactctgtaactgaatatttcacgccaatgactgaattcgaccgtacatggccaggttagtcgatcaaacttcatttccagtatgcacctggttcttattactctctttctgttttctgatgtatctttttttcttccagctgtttacttcttatatgatctttcacctatcactgtgaccatcaaggaagaacgccgtagttttctccacttaatcactcgtctttgcgctgtattaggcggtacatttgctttgacaggttagtcccatctcagtcttgcctccaatactcaatctttcaaaatcttttgcctaatatagtttatctcataccttaaaacaggaatgttagatcgttggatgttccgctttattgaatctttcaacaagaagccgagtactagagcgtaaactagctgaaacagagacaaaacaatgagaaacaaaaaaaaccaaaggaaggaagaagaatctctcaaatcccaaaacttgtatctgccttcttcagacaacaacacccaccagagattccaggattgatgattacattactcagaaactctagaatccatggatatagtttttttttgagtctctcttatgtattactctgattatctctggttaaactagtagagttaatttgtaatttttattcaccttgcttcctgggattttaacatttttgcatcttttcacttgtctcagtaaaaaaacaaaattatactgtagctcaccgtaagataacgtacactcgtcacaggtgatcctgtcctcacaattctctctgatttcgcttactctttcactgaaaccctaatttggggtttttcagatttccttcaatctctcgtcgtcatttcttcgtctcaccgttgaatctgaaaatg

SEQ ID NO: 23757 - DNA, 3003 bp, Unknown
  misc_feature (1)..( 3003): 2750-1469P.txt file - cDNA_ID_2151733; gDNA_ID_1620497; Annot_ID_158715
cataatttgtgtttgcacctcattcactgacttactacttgatattccttgttagtatataactagtctctttactctctgaacagatatttggcgggtccaaaaacgtaaacgtgagccatatgattcacgatctatcatttgggccgaaataccccggaattcacaacccacttgatgacaccaaccgaatactccatgacaccagtggaacattcaaatactatattaaggtgtttatccaaattcgttactcttcttgtactcgtatctctccgctggctgtatattttatatacttcattatttgtttactttgaagtttgaaatcatttacctgtatgatccattttgtttcacacaaatccgtatttgtaaggtaaggtcactaaattctttctaatatggcgcagattgttcccacagaatatagatatctttcaaaagacgtactgtcaacaaatcagtactctgtaactgaatatttcacgccaatgactgaattcgaccgtacatggccaggttagtcgatcaaacttcatttccagtatgcacctggttcttattactctctttctgttttctgatgtatctttttttcttccagctgtttacttcttatatgatctttcacctatcactgtgaccatcaaggaagaacgccgtagttttctccacttaatcactcgtctttgcgctgtattaggcggtacatttgctttgacaggttagtcccatctcagtcttgcctccaatactcaatctttcaaaatcttttgcctaatatagtttatctcataccttaaaacaggaatgttagatcgttggatgttccgctttattgaatctttcaacaagaagccgagtactagagcgtaaactagctgaaacagagacaaaacaatgagaaacaaaaaaaaccaaaggaaggaagaagaatctctcaaatcccaaaacttgtatctgccttcttcagacaacaacacccaccagagattccaggattgatgattacattactcagaaactctagaatccatggatatagtttttttttgagtctctcttatgtattactctgattatctctggttaaactagtagagttaatttgtaatttttattcaccttgcttcctgggattttaacatttttgcatcttttcacttgtctcagtaaaaaaacaaaattatactgtagctcaccgtaagataacgtacactcgtcacaggtgatcctgtcctcacaattctctctgatttcgcttactctttcactgaaaccctaatttggggtttttcagatttccttcaatctctcgtcgtcatttcttcgtctcaccgttgaatctgaaaatgatcgccggagtattgcgccgatcttcactcccgtcgaggcagactctctccgccgcgttagcctccttcaattcgtgtatttcgcacaatctcactccagccaccaccggagcttccgtcagctctcgattcactctcgcgtcgtctcctaactcgtttggcatcagagcgaggaacatccacattagatctgagccgtcgatgattgttcccgcaggaatcgcgtcacaaggttacgccactgtcacaaaggatcgcaaaaacgagattaagaaagctaagattaaaatttctccagacaatgtcagaccattgagtaggaaggagatcgctctccaggtatatgcatttttgttcaaattcatagaatattattcaaagtgcttcatcagattcaaattcgaataggaatcggaatgtgaaattcattgaaatgatttagaactgttgtttatgttgttgttgttgtgtgtttggggttgaattgtagaaagaggcagcagaagaaagcacatcaaagataaaaggaacaaagatttgtatagcgattcggtcttttgttaacccggaaaagcaagcttggtgtcttcctcctcacactcgtaaagtcgcaatgcccgatacacgaactctgtacacggtgctaagatcgcctcacgtcgataagaagtctagagaacagtttgagatgaggttcaagaaacggtttcttgtcatcaaagctcagagtcatgagttgagcaagaagctgttttggttaaaacgttatcgtattcttggagctcaatatgaactccagttccattgcaagacccgtttggatatgactcaagtgttaggcaacatcaatggctccaccaccaatgcttactgagatggctaaagacatcattttgtagaagtttcaagacccaaccgggtactatgcaataatttcgaaccttacggatccatgaaaccagctttgcttcacatcagatcaagtagttattttcttgcttagtataaacatgtgtttttggacgattttgaaagatacaattgagtttcagttacagtgctttccatttattcattagccaatcaaagtctttatacatcaccaaggattgagacacatttagactgctaaaggtgtcattttgagaagttatagaaacctttgacccgaccatggaatgatgtcgaactttaaggatccaagagctcacattttaggtgtattcattcattaggcaattctaagacttttacattgtacataatcactaatgatttgagacatatggtataggttaatttgatagatctgattccgaacctgagctattgccaatttgccacactacacaaagttacaaaaaacagaactcattaactctttgcttcacattcaagaacacctttgggctcaagcaaaaaataataatcaactctgtttccttacacaagcttgcacgtgtaggaacataccatacactcacccgcaggtgattataacaaagttccctttatacccgcctttgattcttcttcttaaatctctaaacccttttgccgtctccctaaaaccctaattctcatttctggggtttcacatttcatcttcaccagaatccatcacactctctgaaatctgaaaatg

SEQ ID NO: 23758 - DNA, 3003 bp, Unknown
  misc_feature (1)..( 3003): 2750-1469P.txt file - cDNA_ID_2151741; gDNA_ID_1620497; Annot_ID_158717
gggatcaagcagccgttactctggtggttcagaccgctcatctggtttcggaagctttggttcaggcggttcttcaggaggatttggttcagaccgttcttctcagtcaagtggaaggagcagctttggtgggtttggatcaaacgatggtaaaagatcttactgagagaagtgttgtgttggttttgacccgactcagcaataatggagttgacttaggagagaactcggtatctcgagttgagtagtttacaaggagtcgagctatatataaattctgtagctacttcttgtctcataaaccaacataagttatatcattatttcatatcctctaattcatttttatttctcaatttgagtgaaatgtgtttcccttacttcgccacttccatttatgaatcttgttagattgtgagaaaaggaaataatgtggttgatcaaagattcaaatcatccctagttttgatttcttgttagatcttgcaagtttttggtagaaccatacacaagaaaaattgttttaagctttaattctcatatctgaccaacaaaaataaaacacagtcgacaattattgttcactacaaaaagcattactcttatgtttcacaactaattagccttcatttcgcaaaacttgatgcactgcatagcaagagcatgcaactagctgctgaacgaaaaggcttggctctgcatagctagcataataataccaagctccttgggtgtgatcccctttgcagtgaatccagatttagtttcatccagtcttataggcccaagaacgggttcttgtacacatacttggtgattctgagggttacaaagctgagatcccataaacgttgaaaggcgttcaggtggtggtataagaatcattgagatgagtaaaacagtcaacaccacccacaagggcatgcaaatcaatggtagccatctcaacaccatcccccagcttctccatttggagacattttgaaaaaaactcaagaacggcgcctgtacaaccgtcaacactcatccacagctgatctgaagtcagtaatactctggaagaagtatcagttttgaacattttaaaaattgatatttacgatttttttctttttagggtgttaaggaatggggattatcgacaaacaagtgatgaatcagattattaacaaaatatggcatttgttgggatgaacaaatacaaacaagtcggaatcggatcttgcaagtttttggatagaaaactaatacaaataagttgtttcaagctttaatttctcctatcggacaaacaaaaataaaacacagtcatcagtttggtttagtacaaaagcattactcttatgtttcacaactctcagcgttcaattcgcattacaatccacaaaagccttttgctttggcttatacaacataacgataggtaacataacgaccagccgtttcactcggacgaatgatcttcacgacttgcccacgttttagtccaaagtatcttgcgattggatcagtcacttggatccttggaagctaacaacacccacaaagttccaaacatttaataacacaacaaaaatttcatcaccaagaattcaaacaaagtttctatatactactaacctgtgtctccttcactgtgtatctctccagtaaagttttcttctcttcagtggtaagaacttgatgctcaggaacaagaacatgttctttaatgttcactagcatttccgcctcctgcagcatccaccaccaaatcatggtttagtaggattgtgatgtggatacatcatcatcaagagtcaagacacaaagtgatttgttttacctggaaaacttccagatgaaacttagaagagatctcactaatgcaagttcgagcaaacggggtcaagttctgttgcacaaccaaaatagctctgaacacattctctgatttcatcctgttcgtgtacattttcatcgtcttcacaccaactttcgcctcatcagggaagaatatatagagctacaacaagagcacatgaatcagcgactaaatcaaacacacataaacaatctttctaccatatccacagcttcttagagattaaagagatgacatttatctatacttttgtcaaaatctagctctctgtaacattccatgtctacttactattcacattcaacaactagataaataatgatagtctccagctaaagaacactaaagagaagctgataatcacattgaaggagagacatacaactacaaacctgatcactattatcatttcgcttagccttaagagtaacaagatcctctcttttcatgttatcaccatgtttcctaataaactgttgtttagtcatcgtaagttcagaatccgcgataaaatatccacgatcccttaacatctgcatcaacgtcttctggattctgtacaatcttttgagctcctcttccgtcaacatcttcttcaccaagttatctgcagctttaccaaaaccatatcaaaattagggtttttcaaaaattgacagaaacaattaagagtttatcaatctctttgagaatatatacacagatacgaaaacttacgaatagagacaaatccacagagatgattgaagaagcgatttacagagagaacgacagtggaagaagaagaagaagaagcggcgtttcaagctttctccttttacctcgaacccttttctcaattctattatattgaagcttttattgcatttgaaactcccaatttataccgactttatgttttaaccctcaactttattttcgatatttaaactccaatccttaatagcctgataaaggcccaatgggcttgtacgacccaacatacttaaaccctttagttgatttttctcaacttattacactgttcttgttggaactaaaaccctttgccttctttcttcatctctctaaatccctaattctccaaattttggggttttacattttccttatcaagagaacacctgaatctgaaaatg

SEQ ID NO: 23759 - DNA, 3003 bp, Unknown
  misc_feature (1)..( 3003): 2750-1469P.txt file - cDNA_ID_2151775; gDNA_ID_1620497; Annot_ID_158725
tcaatactaaaaattaggcatctacttattctggtttatttacacttgcaccaatattgacttaaacgataagatgccaaatcaagaaaaactttggcctctctagacttgttcagaacttgactatgtagtttgatctttaaaataaaataaaattcaaaatataaatattttatttatagtactatttgcatatggtttagctagttttcatagtattgtccttaaaattttaattcacttaaccaagtgtcgttagctcaattggtaaagattctaggcgaaccttagaggtcgtcggtttgagtgacgcttgggacgaaactaatattacatgatatggtttcgggcctgaaagattatgggtttcgatccagatcctcctagatttttttttttaaaaaaaaaaaaaaacataatccacttaacgtcaacgttgtggcggatatttggggtaaatcatcagcctctgataaatgtctttatccataaaggttatggtttttgcaataaaatctagtcgttgaccacaagaaaacttggataatatatatataacgactgaatttattcgataattttgaaagattatggagatggacgaagattaagttatggatggaaacaaggatactttataaaatttgacacaaatttgagtatacttacttattctttttggtcctataaaaagaaatgttaagtttaaatcctttagtaaggcatctctcgatcgattctttcttgtaattttcttcacatgcttttgtaatagacacgagttttgtcagcggtgtctcttttcttttactatttactgatttgttattataattatcacgtttggatttctctttccataaggttaggttttgcttatatatatgaataattaatggttgtttaatttcctactatgattataaaaaggaaaagtattcggtcattgttttctctttgacgataactttctcatatcagaagccatccaacaatttgaagcagttgcttttggtttttcctccacggcttgatgatatgaagtgattgaagatttgtcaacgaaactttggcaaaatggttttgcttaccaaaatgcaaaatcctatacgagaaacatcaccaaagatgttctctgtttctgtatttctttcgttttattcgtttatgtaaatgttacagcttgactttcttagtgtgctttgggtttagatgttgcattatttgtttgcgatgttgcatgcatctttggttagtgaattatttagataaaagcaaaaacataacaaaacaagacaaacgtagacataaaagcaatagaaacagatagacaaatatagtctatactctatatgaatagttgaccatcctacatatgtggaactaaaatagaatggcagtttaaagttgatttatgatggctggctacaagtaggatggtcaactattgatgtgtcaatctcataactctgtactatttccagttgtgcctattgccaatacataagagaatatgaactatttcattagcttataacatacaagttttacaaaaaaaaaaaaatgatctctcatatatggaattcatataatgacttatattagtatcattatcttctcactaattaaattcatatttgacgaaatgtacgtagtatgtttttaacaataaaagtccatttcatttggctagctatttcattttctgccaaatattaaagtctatcatcagatagtttcacgtaggtaggtacagaagagaatgtgaagaaaatacttttcaaaaagaccttgacttaggaaaaagtcattcaatttccacagatacttactatagaaactttttcgatcaaaaaaaggagaggaaattgctaagttatttcgcaccgtacgactcatattattccaaattatgtatgttaataagttacaacattattatatacacacattcactcatgtattcaataattgattctcaaaccattagctatgtacgatacatatgcttgtttcttcatacgacattattgtttatataggtttcactaaaaaaaaacatgcagacggaccagatattaaaatattgcaacaaaatttttcatactctaaatttacaattttgctcatcttatctaaagctataacacataacttaaagcaatatgatgaattcattgatatgtataccgtaaatggctaaaccgcgtgaaatatcttagcaggtaaaaaataaagggaatttaaatcatatttatatctttatattttaatcaaatctaaaacatcttctaagactattagaattgataaacaaaaaatatagttttattaatatatcccaaaactatacatgaaattgttattcatgtatagactgactcaaaacaaaatttagtaatgtttttttttttgtaaaactctacgttttaatttaaagactaaattcaactttgcaaaaatatatttgttactatttttatttatttttcgttgttaacgtatgacaactagttgtaatcaatttactaggtacagtggacaaaatattacattaacatccatatttcagattcatctccttttctccaaaataaaacaagattcaactccttttctttttctgaataaacacggttgatatatatttcagtacataccacttggtgtatagttttgggaaagaaaaaattactagagttggagaaagaatttattgtagcaaaaatgtaaaaccattgtgactgttcagctctagctagattcaatataaatatagtatcagatttgtgttatatgcataaaaagaacattcttataatcacacatctctctctcttcattccccaagcatagaatctctccctctctatctatctctctttcaccttttcttgattcttactcagagaaaattctgcaatatatatcgccatgatccacaccgacatcgcagagatcttatgcgtcaaacccaagacaacgaagaagacaaaaacaatg

SEQ ID NO: 23760 - DNA, 3003 bp, Unknown
  misc_feature (1)..( 3003): 2750-1469P.txt file - cDNA_ID_2151793; gDNA_ID_1620497; Annot_ID_158730
ctaacactattttatgatactgagagctttcattttcttttccatcttaaatcagacttgaagacatgttaataacattatattaatctataagggtataggaagcttagaatgcgacttgatcaacaagtattgccggaaagaaatcaaatatggtcttctatggcgaaatttcaaggcctcatctgttttctcatacatgatcatcagagagtcatgaattcatatatatggactaagaggtaagaaaaaccaaaaatgttaggaaactcatataaatgaagatgaaaggaaataagaagaggaggcggcagaagcggtgtaaggtggtgaaggtcagaaggtggtttcggcaagaagctagagctagagaacgatcgaggaggaaggaaagtctagaaagagagatggaaattttttgtaatgatggagaaaggtttatgtgttttggtttaaaccgcttccatgcatgtacttggcttcattcagttttcgatttaacgctaaacacacacaattaacttgcaaaattgtgaaacttggccaaaataagttgatagattttaaaaccagccacatatcccaaatcagcgctagcttagctaaggcttaaaccaccatcttacattgtcttggaatttataaaattatccgaaaatactacctttcaaaacgttagtaaattcacatatttactaagttataccaaactttaaaatttaacactttactactatttataattacatttcatgtcattcttataatttcttatggatcttatactctcataagatgtctaagttttccgaagggacaacacatcttggtagcgagggagattgtggagctctcacatgaggaagcagcatagcacgaagtatactaataacttgatacttataatggccttcatttggcttagacgcagctataacgcaataaatgacaatgtttcttttgttgacatttgtattggtgggatggtggccaccgactacttcaaccaatggattgaggcagatttggtttctgagacttggaatgatgcggttctttgtttgtttatcctaaaggacgattttccaagaatcctatgtatcaaacaatttactacaagaaacactattatttattaacatttaggatgtatacagtgatgccaacagagatatacaacaaaatctaccaagatggagctttctctcagccggaagatatagagaaaaacactaaatgcgtaccatctaaaatgtgtatctaaaatgtgtactatcagacgaacatcttccataacctgatttacaatcactagcagagtggtacatatatttctcttttaggcatatctatgtacctaatcttgatttcacgatattaagacaattattttaaaaccaactcaacaatcaataatacatgcataagattacaacattttaaaagtttgaactatctacaagctaaagctacaattaataattcacatgctagtcactccctttcaatccgtctagtttcatagctatggatttttgtattttaacttttacaaaatctatggatttgtgatgcgtacaaagagtagtgtgatatttgataagaaaatgaattgaagatgcgtgatcatacagagagtactgtccagttatatagagaagtgaatgcaaatttcaagagttacatgaatgcaacaattagatcttgataaaaaaatcaataatttagattgattcatatttttttttgataatgtaaaaaaaatataagacatgaaatgactaattaatgcaacgattagatcttggtaaaaaaaattcattactttagattgattcatatttttctaataatgtgataactgatataagacatgaaatgactaatcaatgcaacggttagatcttgaaaagaaaaagaactataacttagattgattcaaattaaattatttcttatgtcattaatagaacatctttctaaaaactttatgcttgattgaatatacatttcttgttgcacaaaaaaaaacaaaaacattatatacaagttcaattgctggtattcttttttttggtcatgtataaaccataacacatagaagaggaaaacaatttcacctttaaagcaacaatacagagtacatgatttagctatttcaaatacaacatttccacttagaagtttaggaacattttcgtgaatctgaaagataacaaagttaaacttaaagtaagagttatggttggtccaaatgtgtctctaacaccatcaccaaaaaagagactgtgttgctgccgtgactcagttccatgtgcctcctctttcactttctcacaacccgtgacacttaacaactatcactacacgacaaaaaaccaatccacaagtgtttcgataaacctacgactttttttgttttcgccttttggcatttccttcggttatctccgtaccggttttggaataacccggttcttggaatttagcttatccaaaaacaatcacagcttcataacaacgcatagcttatttatgtggtcttaaatccactctttagattctttgttcacacctgtcaagttgtataatatgcacaatttttcaaacattctttcttcaaaattccacaaatattagttgaccacaaaaattcaatagaagaattttggtatagttcgtacagatggaagttgaaattagttgaattgccgttttctatacgtacgaattttggtatttattgattagataaaccggaacaaaaccggtttagtaaaccgacgcatggtgttggtaaagtgtgattgggtaagaagcctaactagttgtctgttgataattgtcactaggtgggcacttaaagaaaaaaacacttgtttccttatatattcttctccctttaaacatttaatcttttcctcttctaccatctccacaaattccaaacatctctctctctttctctctcacacacaaaattgcagaagaagaagagtcatg

SEQ ID NO: 23761 - DNA, 851 bp, Unknown; identical to SEQ ID NO: 2193
  misc_feature (1)..( 851): 2750-1469P.txt file - cDNA_ID_2151809; gDNA_ID_1620501; Annot_ID_158883

SEQ ID NO: 23762 - DNA, 3003 bp, Unknown
  misc_feature (1)..( 3003): 2750-1469P.txt file - cDNA_ID_2151889; gDNA_ID_1620501; Annot_ID_158901
gaaggattgtgaatgaagctttgttgaatcattcattgcattagcttatgaatagcagagttagtggtcgtgtttttcgatctgtttcttcaatttgtcttctcttttgttgttgaagatttggttctacgtgaactggtcctttgattagattgctgaaagtagcgagtgattcagataatatagtatcttcacaccaaacttacagtttcacagactttcgattttaacaaaattttatcctatttcaaaccaaattttgttgaaagaagaagatcacaaagcaagatataaatgttaatcagtaatcaatttcccttttttcttccttttgcctccttgcttgatttgcgctgagcttggaacatacgagcacacaagtggatctcgaattttatcagtagtttttccgagatccacttctttgtaatatccatcctctccaatgatgtaagctgtgttgtgagtgggatacattacatctttgtctttagcaaagactacaacaactttcttctcttcgtcaatgatgaaactcgcatctgcaattccaaacttaaaatcagtgagtggttgcatatccactgctaagaacaacttgctccacatcacctcttcaggttcaatcttagtcgtaacccaaatctccatatgtaagttgtccttacgctgaaataacacagcaagttgctcttctctaacactagaaagactcacagtatctacatccatagggtaacacggcaaatgaagacgcggcccaaatctctccgatgtaaaattaaaacagagcaagaaataaacactatgtataagattactgctgatttctggaaacttgtctgtagcaaaccaataagtatttcccttgagagagacacctcgtgcataaaactctacttcccagtcggaagtgacatcgagaaccctccatgaattagactttaactcgtatatttcgtactcaacaaattcttcttcggcaaaatcaacgaatcgcaaaactttgtagcgtaggcttgatttacgcttctcgtatcctatagcacagatataccagtccattctatggtcaggactactgggtttgagccacaaagtttggctcctatacggattccaaaccacgaccctagtgtagtctttcgagatacataacagtaaaccgtcgcagtgatatacttcagatatatcgatctgatctgtaccgtttaggctaacaagtttagcttgacggtttatagacgggtcaaagccgttgtgaattccacggaggttgatgctcgttagataaaccttacaatgcaagaccatgacaaccttaaactcactttcccttgatgttgcttcctgagcaaggtgcttctttgtaaagctccgctttttggataatgttttccaatttttgcaggtaaatcgcgcttctctcaatgatttcaccggaaccctagagagtctctcctccaacaaatctcttggaagatcggacatcatcttcaaatctttcaaatttgaacaaggatcgatgtaacacaaattagttaggtttgaaacttcagtaaaaagctctcatgtttccccacaggaaccctaactcaagctgggccgaaacacaactctgccctctaaaaatttcccggaattattcatctttttgaactcttatttatatgactgtgatgtcgtttcatttatgggctttattattgggcttttagcccaactgtagttaaaaactttttagtgattctcatttgtatatggcgggggagatgatcgacggtcgcttcttgcggtggagatggaggaggaagactctcctctccgactgcggcgattgaaccgagagagccaccgaagattcgaaacctacaaaatatagagggtgatgtaatccagcgtctgagctcgctgagaacagcctcgacgccgattccaattcagtacggtggcttaaagctccttcaattctcagaccatggccaaggctctgtatcttttgctcactggttctaccattgtgagttcttcactaccacctgctttgaattcaactacaatctatctacaaaattctctagccgaaacctttcaagttttagcatgagacccttagcttcaattgtttttctcttggacactgtctaactttgattcttcttggaattgattaggaaatggctaagaaagttggagaagttatagaaaaatcctgcgtagagaatgggatcacaaaggtggcctttgaccgtgcaatttacacttaccatggctttagctgcttcagcaaatagaacacggtctccaattttaagtctttttttgttttgtccttctcagaaatttgcttgtatagaacccatgattgaaatttagattagtcggcttggaacagtgttaacttcttcctttttaatgtgttcatttgttcttactacttatgcatctcaagaatgtttatatcgtctatacgatgataatatatttgaaaatggttgatgtttacaaagcttcagaaggtaagacatcaaatgtgctgcttagttaagagacaggtacaagtgcttgcaaatttaggacagaaggacaaagacagagacgaaaacttcggcgcagtgaaggcagttcatatctgcgaagtatagatgcgatatggttggaagttaagtaactgatagtctataaatagaaaagtgcgaggtatatgcccaccctggagttggtatgtccgcttctatctcatctacctattattagcaaactatagacgttattagttttctgttttttccttttatatactcacttctttaatgtagattctgtttaataaaaacagtaacagaacagaataaaatcttgatttcttttttttcctcccattcaggtctcatacttcgtttggcaatgcaatgagggagcagccaaggcagtattgaagggtgaagcagtatctcgtttcttgaccaatcatcaacctgtaagtagatctccactaggatg

SEQ ID NO: 23763 - DNA, 3003 bp, Unknown
  misc_feature (1)..( 3003): 2750-1469P.txt file - cDNA_ID_2151897; gDNA_ID_1620501; Annot_ID_158903
tggtggaacatccaggaatcacactaactgtttacaaatttgtagctgcgagaggaacattgaagagattcgagaagagtgaacacgacgaaaaggagaaaaaagagaaagagactgacgaagagtttgtgagggagttgatgaatgatccaagaggaaatgagtcattggcttacgaggaaagagtcgttgagagcaaagacgatatcatcgcgacacttaaatcgatgagtaaatgcaatctcttcgtcgttggaagaaatgcagctgttgcatcgttggttaagagtacagactgtccagagttaggaccagttggacgcttgttgtcgtcatcagagttttccaccaccgcgtcggtgctcgtcgttcagggatatgatccagcagcagatacacgaccgctcgttgaggaagatgcagagtacgatcagtcttccagagatatttcagacttaactgcctgaacggattttattataaaaacaaaatttctctgtttttttttttgtctcatgaaatattttgatattctttttggttgggacttggagtgtctccattgttctttttctattttccttaaattgatggttgacattagatttgtgggcatgaaaatcgacctgtaatttcttaatattttgccttgaatgatcaaaggaataatatttttaagatccaacatttctagtcatcaccatggaatgtatccttgcccatgatggtgtcacctacatacctttttagggtgtaatgtgttcattgttattcagaaaaaatgtaacaaacggaaaaatgtctaatcttaaattacctcctgaagagatatgaatgcaaaaagggaccacaaccgccaatgacaccgacaagagtcaaaagagacgtcactaataaataaactaacacattttcgaacaagaatccataacgttaacattcactcactgtctatcacacacacacatgctgtgtacttcattattactctctctcacgctctctcttctcttctcttctcttctttaaaaatctcacaccaacttcattgacaaagagaagaaaacaactctcaaaaacaaaaacatgagctacactttctttctccttttgctctctcttgtccactccactttctcttcattagctcctacggatcgagccgcgctccaatccatcagagactctttaaccgacatgcccggttcagccttcttctcctcttgggacttcacagttcctgacccttgttcctccttctctggccttacctgctcttctcgcggccgtgtcaccggcttaactcttggccctaatctctcaggctctctctccccttccatctccattctaacccacttaacccaactcattctctaccccggttcagtcaccggtcctctccctcctcggttcgattccctccctctccttcgagtcatttccttaacaagaaaccgtttaaccggtcctatacccgtatctttctcatctctctcaaatctccacactcttgaccttagctataaccaactctctggctctctccctccttttctcaccactcttcctcgactcaaagtccttgttttagcctcaaaccatttctccaacaaccttaagcctgtctctagcccattgttccatttagacctaaagatgaaccaaatctccggccaactcccacccgctttcccgactactctccggtacttatctctatccggaaactcaatgcagggcacaatcaatgccatggagccattaacagagctaatatacatcgatctaagcatgaaccaatttaccggcgcaatccctagctcactctttagtcccacaatctcaacaatgttcctacaacgaaacaacttcacatccattgccacctcaaacgccacgtcattgttacctgagggctccattgttgatctgagccataactcaatctccggagagctaactcccgcgcttgtcggagcagaggctttgttcttgaacaacaaccgtctcactggagacattccagaggaatacgtcaagagcttaatcaacggtacaacaaaacagctcttcttgcaacataactacttcacgagattcccttggaactctggtctccaactaccagactctgtttcgctctgtttgtcatataactgtatggagacagatccagtcgttggtttgtccacgtgtccgatcgaagttgcacctctgctctcaagacctgcttcacaatgttcaagattctataatcacagctccactggttaaagatcagtttttctttgttatttttctcaaagaaatttgcaaaaaatgacaaagtttttcataagcgttatcgacaaaacaaaagtatgacattttaagaaattgaaccgttatgtctcctagtgttttcttaaaaaaatcaaaagttcataaaaaagatctgtaaaactgtggtcctcacgtgtaaatgagattgtagtgtttatggaatatataatttatagattggtccttttctctatttttcttcattgacatatatgccattttgatatgaaagaaataaacaacacaccattggttttctatatctcttctccttatcttcaaattgtcattatcttttaataaaaaaaggtacaaacttttattcagtttgtggtctggagagcactcaaaatactgtttacataaaatgattgaagataattagatccaagcatgatggatatggatatgagttaatggtgttgattaagaacttataaagtctaatggtgttgatttagtaaaacattaaatgccagataattagctgttaacagacataccgacaaagaattttaagtaataaagttagcataaagctatctgatttgtcagaatgtaaaaacgagtccaagttgactccttcgagctttgattctcgttccaataatacttcctccaccatctctcctcctctcgttagatctaagaaacagagaaaacaagagagatagaatg

SEQ ID NO: 23764 - DNA, 3000 bp, Unknown; identical to SEQ ID NO: 2214
  misc_feature (1)..( 3000): 2750-1469P.txt file - cDNA_ID_2151976; gDNA_ID_1620503; Annot_ID_158960

SEQ ID NO: 23765 - DNA, 3003 bp, Unknown
  misc_feature (1)..( 3003): 2750-1469P.txt file - cDNA_ID_2152010; gDNA_ID_1620499; Annot_ID_158809
atcattcaaaaacacaaacatatagttttttctaacctttttagcaaaaaggtaaaataatatttctggaacttacggaagatgataaaaaaaaaatatttgtggttttggtaatgtaatttatcaggattatttaattatctgtgtggggttaaaattgtaaattttgaactttggggaatccggtgaaaattttgaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaaaagaaaaaaaataagtttaaaaaaagttaaataaagtctgtaatatatatgtaaccgccgttacttttaaaaggtttttaccgtcgcattggactgctgatgatgtctgttgtgtaatgtgtagaatgtgaccaaatggacgttatattacggtttgtggtattattagtttcttagatggaaaaacttacatgtgtaaataagatttgtaatgtaagacgaagtacttataacttcttaactgttttgtggtagtcctgattcctgaaactaatgggaattagtttgtatatcaaacaggggttcctaacttgttattattaggttaggtggaataattctagggtttttattgacaaaaattaacaaatagtggtttttatggaaaaaggtgatggtaccagtatagtgggaatacacagaagaatttgcagcctttctcaattcttatacgtataattctcgtatgtctatgaaaagggttatacgtatgatgatttatgagtagtgagtacatacatctttttcactactttacatgtaatatttatggaaaaggtctgatccgtttgctctatcgagaattggaattgtgagatatcttgattttaacagtttcaagattaatgaagaacaaaaacaatggcaacaacttacaaattaacattcggaagaaagaaaaaaacttacaagtgagatcaaatttggatttagtattttagatgtaagttacaaatatttcataaactaataatctattaaaaaaaaattattcattgtattttactttataccgtaacctaaacaataaaatacaaatttataattgaaggattttaattgtttaaattactctttctaccatatttgtttttatttctttaaacttactctttctaccatgccatttaattatttttgattgcaaatattgtacgtacctttcaactgtgaactagtattatccttatccctatcgtttcccaaatttcgtcttacgtatagtattaatacatgcatgtgattaaatagaagataagaagatgttgatgtgttgagacttaagactttgatgcatgaacctctaaagcctagttggtaacttggtataataagatttgaagtgggtccataaaatgttttgaagattgacagaatctatttgtttcgcgatattgtctatttctttgacgttttagagaatcattagtaatttaattagtaataaactaataactaagcggcatcttttcgatgtgataaccaaaatcatataatgatgcgtgtcttagactcttcgatacatatgtagataagatagcctaataaatctcgattggtttctaaaatttgtgtttacttcatgttataaatagtaaacacaatactaatcgaatcatgatattcacggttacgacaatgagttgacaatcagatatacttcaaaagaattgtggttaatactaactaatataacttgttcgctcaatctatatatataaatatataatcaaccttcaatattatgaaaccagatgcttatatatatctacttcgtaacatttaatcatttatcatgcattcaggctgatcgtttacggtttacccaaattcaatatatggaaaaggtgatggcatagtgacgttattcaaatagagtaagtgaacttaagttagttctcttgcatagaaattcgagcatgacattatgtttgaattttaattaaaacaaactcttatgcaagaaattcgttgtgttatgttatgtcgtcaagaaatcgtagccgacagtataccatctctgtgtggttacttttctcaagcatccccaaactttattcttttcgatcccccacttggaattatccaaaatgattcgcatttatttgacttgcaatcaaataatgtaatccgtgtgcgtattgtatatatattttttcattgtcaatgcaaacgttattgttattcatcagttttcataaatgaaacaataatgggccaaagtaggcccatttataaagcgaacgggtcgaattatcaaaacatttctgtgtaagtgggtcttaacgaaattggagtggaactgaaattagacccaaaaaccctaaagaattgatatgtcttcgatttataagtaggtcatttttttttgccttaacaaaaaagccctaaacggagagaggcggagaggagaaggaagacggcgtgaagcaatg

SEQ ID NO: 23766 - DNA, 3003 bp, Unknown
  misc_feature (1)..( 3003): 2750-1469P.txt file - cDNA_ID_2152054; gDNA_ID_1620504; Annot_ID_158981
atgatgatcatcaattgagttaaagtagttagctttgccaccaaaagaatctgatatcgtaaggcatgaaaactaaactgataatagctctgccttaggttgcatattatctaattcaaaaccaagaacaacaacattcaatcaccaactaactaaacaagtgttagataaaaatggattgcagcatgacaagtgaaaaccaaaccaattgttgcagtttcagtgaacctttccttgtaagtagttttgccacaactgagttaaagttgttagctttccactcaaagaatctatcttaaattcctaacacttggttcaaacaaccaataacacaagattgcaattatcaactaaactaaaacaagtgttaaatagaaatgaactgattctcaaaattaggaaccttttctcgtgtggaaaccagtaggtttgcagtttttgcccttgtagaagtctctaggagctcgttttggggagaggatatcaagagaagaagctctctttcttctgaatgatcttccaatccccattaacaatcctcctatcgtcgtcattctccaacaatgtattagactgatatcagtcgttgatcttaaaaaaaaaaaggacctgatagaagagtgcaaatctcagagaggtcaaattaggggtttttgttcaagtgaggttgtaggttgaagacactgtaaacgatgtcgtatagggggtaaaattcggaaaattgttgttttcaggaaactatctgactctaaacaaatgaaactgaaaatataggggtcatatttacaaattagttatcttcgatttacgcacgtattatatgtttgttgtagatgtttattttctaagtattgcataacgcataatgttttcttgtatgattgtatcaagctattctactatgtgaacatccaattatcaagtgaatatatattccaccgcataaacatgttatcaattattttgtatatcgtttcgtgaaaatatcaaaccaaatctaccatttttagaatagcacaaaaaaggattaaggataatagaagaacagagtcctaacttaaagcttagtgaggaagcttcacactcgtattatcgtcaataaaacaaagacgagatacaaatgactcttcacactactattattgtttatcttgtgatgattcctttcctatcaaaatgtctgcagcaacttcactctcttgttgacttttatcttgtgatgattccttcctttccactatatcggctgcagtttcccactcctctaggcctttatcgtctgttgcttccataagtttccacacttccattatatgtccaccttgctttgccttgagtttgagcagtgcagctacccactcctctcgacctttaccagctaaaaacgaccctaacagtctaaggcccaaaggaagaaagcctgcgagatggacagcacgaactgcgagctcttcgaaatcagaaggtggataaggctgcttgaaagcaaaatgagagaagacttgaagagcttcatcatatcttaaagatctgacttcgtacacatccatcactccggcgtcaacaagcaaattcttgttctggctaataagaatgactctgcttcctggagcaaaccagttagcatattcaatgatccacttcccttgttccatgttgttcacatcatcagcgataaggagaattttccggtgtttacgccttgcttcggtaatttcatgtccatcgtgatatgagcttattattaccgttggatcttcttctccttcaaactttagaagcttgtctttcatgttttcaacattatctaggaaaacatgtgtctgaaagtttacaaagatctctgcataaatgtaccttgcaagtgttgtcttcccaacaccagcactaccccaaatgccaattgtacgaacctctttgttaacttctaaagccaacaagtcataaaccactttcatgtgacgatccattgcaacaagggcattcgaatcgtttgatccggagtagaacacgacaagagatatgtcacgagcaatttggttgagtagatctgactgatccattcctgcaagattttgagataatggatactcagcggcaaggttggtcaatttggtaagtgcagttctccaacttggcgccttctccggatgttgtctgcatatttcttccacattaaaagataaatctgtaagaaaaatgggtatgaccatgagtgaacctttttcctgaaactcgagtatcactaagagctcttctaggaagccaacggagcaaggtttcgtcgtagaggtcataacaaccgcgactctcgactcttccaaagccttgagtgtccgttgaccaattggtccgaatctcttctccaagcatctgtaggataaaaaagttctaatgccatttcgaatcaaaatattttgaaaatatccatggctagtctggcagcagaaactcaggaagacatccacctcccttccaagcaacaaagaagcagcagaagatgaagaagcagaagacattgctttggttaaaaacactaattctgcagctggactcgaacaacgaaaagctacacatgtgaaacagctttacaacaaacacaccacttataaaaaaaacactagtagctaatgtgaaaacaaacaagacaaaaaagacaaaaactttacgtagaaatatataaataaacagagcaatgatagatttcaaagtatttaaaagttcttaatagatatctatcaaaatgacagcatacaaagtagcatttggtttattctttatatttttttgccgaacaaaatcaaagattcactgctccaagacatgatccacttgcttgatagattaatttcttatattttccttgtttatgcatcaaaccaacattaaagaaacgacatctctcttatcttttgatctttcaggattcaaatgatcatcttgaaacagagcgttgaaacagagtatctttgagcctcttctaagccaaggtctttgacaatg

SEQ ID NO: 23767 - DNA, 3003 bp, Unknown; identical to SEQ ID NO: 20751
  misc_feature (1)..( 3003): 2750-1469P.txt file - cDNA_ID_2152105; gDNA_ID_1620788; Annot_ID_168210

SEQ ID NO: 23768 - DNA, 3000 bp, Unknown
  misc_feature (1)..( 3000): 2750-1469P.txt file - cDNA_ID_2152180; gDNA_ID_1620505; Annot_ID_158995
acttgattggggagaagatggttacgcgacaacggctgagacatctgctctacgtgcttcatttcgtcaagaagttgcggtttggcataagcttgaccatcctaatgtcacaagggtaataataataacctctttagtggtctatctttgtgtgtgtgtatgtaatgaatgagactctatggataaaaccagtttgtgggagcatcaatgggaacagcgaatttgaagataccttcatcagctgagacggagaactcgttgcctcaacgagcttgttgtgtcgttgtggagtatatccctggaggaactcttaagcagtatttgttccgaaacaggcgaaagaaactcgcttttaaagtcgtggttcaactcgctctcgatctctcccgagggtaatttacaaaactcattctttaatctccaagaaagaaacttatgatacaatcatgatgatggtgatttcatctatgtaggttaagttatttgcattcagagaggattgttcatcgcgatgtgaaaacagagaatatgcttttggattatcagaggaatctaaagattgctgattttggggttgctagagttgaagctcagaatccaaaagacatgactggagaaactggaactcttggatacatggctccagaggtacacaaaaacagagataacatttaagacaaaatgcggtttctttgtttggtttcaaaatctaatttatagtaatctgattaggttcttgatggcaagccatacaacagaagatgtgatgtttacagctttgggatatgcttgtgggagatttattgttgtgatatgccttatcctgatctcagctttgctgatgtttcttctgctgttgttcgtcaggtcagtggaacttataatataatcccaagttctgaatctttcaaagttatgaaatatgtaaaatttgtgaaacttaagtttgtctctcttggcttttggaatttcatagggttagttaatccggtttaggctagtttttagtctgatcggttaaacagaacagaatccaaattttggctcaatttcggtttggtttttccggtttcgtttattttggtcactactgtacaatgagagaatctgagattgttggtttgttgtcttaaacagaatctgagaccggatattccaagatgttgtccaacagcattggcgaccataatgaagagatgttgggaagctaatccggagaaacgaccagagatggaggaagttgtgagtttgcttgaagctgtcgacaccaccaaaggcggtggaatgatcccggaagatcagagacctggctgtttctgctttgtctctggtcgtggtccctaattttaccccctctctctttttacctttatttatttacttacttaccttcacattgaattttggagcaatgctctgttttttttcttcttctttaatctgtcaagataaaaaaagattttcattattaatatatatacacattattattatttctgtcactgtgaatatgaatattgtcgtttggtccaatatacattggaaaatcatataacatattttttgaaacgactgtgataagttaaggcctctgttttaatatacatagcatagtgtgtgcaaattttctctatttagtaagatgcatctttctttctatttgtaaagggtttactattagaatgcatgaaaaatgacaaggctatgacttgtttagtcacataaattgaaagagtagttatgagagaaagaagattaaggttacacttaatactgtttttaaagacaatcataagtcagagaaagggagtattaagagaggagatatatcactagatgtcactagttgggtgaatcttcgtccgcctccgctttctcaaccccggttttcacgtctcttaaatgtagtccattgcattttttggatctttttggttggtttgaatgtttgaccgacctttcttcgcggttcctctgtgtttttcataacttgcttattcccctgaactcttccctacatttcatgatcctcatttatagacacaattgcacatgtcaagtgtcaggactcaggaaaagatgcatctttcacttacaaatccaaccatttacattgaatagaatggaagatgttagattgaatgcaataaacatgttacaaattagtctcaataccacacatctagaattataacataagaagcatgacttatattcatattttatttctggatccgaagatgcacgtggtcaattggaattaggtcgaaagtccaaatgaaaatttggtggacaagatgttttggccgttttgatcactctggaatttagtcggatatgcccggatcacacatgcttgaaaagaagttcactcatttccctatcaaaaaacaaacccacataattagatgactaattagaaagataaaatattgtaaaataacgcattcaataaacctaataaataagataccaagtattttaacagagaaataagtctatttacatttacgcaaattgggagagacgtaatattgaggtgtatataaactacttataacgtggcacatagttggatagctgatttcccacacggcaggcaaaggaatcacatgtaacgttgctgtctgatccaaagtttactcattaaatatccacttactttttgttaacacaatctcacaattatccacttttggttagtactattttaatttctcttcaagataattcgctcgttttcctcgttacaaagcttataggtcggtacataatttattggtcgagccacagctatatttagttatttaccaacattaccataagggacatatatgtctttttcacatttcccgtatctcctcctatatataaagcttagtgatgtcgtggaaaaccaaccatatgaatctcacgatcaaagataatatctcatcatctatatagtatttgtctcgatattagagacgtacacactttgtttatactcaaatcaatatg

SEQ ID NO: 23769 - DNA, 3000 bp, Unknown; identical to SEQ ID NO: 2223
  misc_feature (1)..( 3000): 2750-1469P.txt file - cDNA_ID_2152183; gDNA_ID_1620505; Annot_ID_158996

SEQ ID NO: 23770 - DNA, 3003 bp, Unknown
  misc_feature (1)..( 3003): 2750-1469P.txt file - cDNA_ID_2152187; gDNA_ID_1620505; Annot_ID_158997
tgtgaagagaaatagacagacaaataatgtatatacaataagatgaaagaaatgcatttgtcgtctcatacttgtcccaagtccgattattatggttcaaaaaaagccaaataacaagagtgcaaatttattttgaaaatccaaacaatcgtcgtttgttctgtcttttgttttttaacgtttgttctgagttgtacactttctccttgaaatattcggtgttgacatccaacaaaatgcttagattcgaatatgaattatatatggagatggagaataattataaactaaaactatcctaccaaataaacattttggatcaattagttatcccaaacattttatcccatgggatcacacattttagatttctacatcattccctaaaaaatgtttaacaaattcaaaaattagaaagcaacaatcatttaaagtgcttgtatataatttagttgattttactaaagtcgtgcaattgattctcattacaaacaagttataagctagtcttgattttgacacaaagagaaagtgattattcagaaaaaatatatattatgtgggtagatgtgactgaaggatcctacattggatgattaatttacataaaatctagatataactctatggacttaaaaataataatggattctatgtataatggatgacaaagaacaaaaacgaaggagattctatagtacaaatacaaaggccaaatgatgactttggtaagatggcttttcttgtggccatttgtagtaagcaagatgatttttaatttacttaattaaaaatgtaacagcaattattttcttaatattccgttaataaacaacctgacatgcacaaacagttcatggaacagcttttgaatatcccaatacattaacacctgatttagtacattatacactgaaaattatatttaaagactgaccaaatatataatacatagatatcaatcaaaatgttatagaagatgcttctttttcttattttttgaagaaaaaaaaatgcattgttgtatgttttttatgtcacgtgatgtgtcatgtggcacgtgacagtgaagtagcagcatgaatgaagaatggtcgacattatgattatcgcatggagccacttttgccagaagaaatgttttcagctctatccatatcaatactcgaagacatatttactctatactttaataagtttttatttgttacaatcacttgactagtagttttagttaagttaagctccaaaaacttcttgaaaagctccggtagaaggatcatgccttcggtttcttaagccgtgatttgatggctaattgtatacatatcgtcacacataattcgtattttctttagccgaaaatcccccgcaacattactagaaaataaaatgtttaagtagatataatttcatttttcatcattcaaaagagaattttcgttccatatttccctttctatatctcacgattcacgtaccgatgaaaaggaccgttgctacgaacatttggagcattcgctttatggcgtcacgggaaatacattttttggctaggagaaataaatagctaaatttattttatttcagaaggtagctaatatattaaaacaacaacatatgtcacaaaaaaatattcatgcaattttttttcacagttcaccatgggtgcgtaataactgtattcacaatccatcatcatgtacagttatctttagaggtgacattaacttttcaacaactatttaacaagtagacgtacatacgtacgtgaaaacaatttcgttgcgagttgttagttacaacatacttggacgttgagaccattcacagtaactatatttcacatttccacttttacatgtgagtgtgtaacattgaggccattcacggtgactgtatttcttcaagttaaataaagttttgtttttgagctaaaccggttaaaaaatacacataccatattcaaatctttataaacttatataatccaactatttgcaaccatgtacacactattgtaacattctttggtaatgtcgatatactttaacgattcttataatatgggagatattttatgataatgccataaaattatcataaaaggcttgaatatctctgaacgttacatttaaaaagaaatattggaattatgattatgactataacttcgaataattgaccaattaatttcaatttaagtgtcatgatgattacacataagtgctttctcgtgattagcaatattcagccagcaatatattttattaattccaaatctccatgttaaacaaaagccttgtaagttgtaatctcataacgtgtgtttctttttcattccgttctagaatcttctttaatccaacacttaatactagtacttaattatcatgtattctcacgagataattacatttatcgagcacaaaaataagtttaatttatcttaacgaatcactgttaatacggtcaaataattataggtatatcaacaatgacaagtagtagtcaacagagtcagtaaaaaccacagagaaaagataggaatttatttctcttttttgttgttcatcatctttatatatacaaaacaaaacagaaggtgcagcgaaaaggaactgttgattattgcagttacttaaattttattttgcataaccaaagcaagaaaaaaaaggagcaaagattaaggtgatgtccgttactttattaaaagcaaaatcgatacgatatttatttttgtacagagagacaacagcgagtgaattgattctcaaagagacgtgtacgtagaggtgtatatatagacaacataaaagagaaagagagagacaaagacaagtgttggggtcaccttttgtggtctctgttggatttggtttggactatcttcacgagattatcctcatcttcccgcttcttctctcctttgaatctttcttcgttgttctttcactttcttaaagaggatgtgagattgtttttggtagttagaaaatg

SEQ ID NO: 23771 - DNA, 3003 bp, Unknown
  misc_feature (1)..( 3003): 2750-1469P.txt file - cDNA_ID_2152195; gDNA_ID_1620505; Annot_ID_158999
attcaggacaaattatagaagtggttccaaagtctttagcttcagtagacttgactccaataagccccaagaagaaaaggcaagtttgtcccgaaacttgcagaaacagatttatggtaaatcttttttctaacaatctgttggcatttgaaacatgcaggcgtaagtccgaacaatcaggagaaggcgactcgtcatgtaaacggtgcaactgcaaaaaatccaagtgtttgaagctgtaagttgaatacaccaatctttggcttgctttgaagtagttttttgttgagtctcttgtactgtgtttccctctgcagttactgtgaatgctttgctgctggattttattgcatagagccatgttcatgtataaattgcttcaacaaacctatccataaagatgttgtcctggctactcgcaaacagattgaatcccgcaatccacttgcatttgctcctaaagtcatcagaaactcagattccatcattgaagttggtgtaagtgttctcaatatttccttttacttatcatcctcaatacatttatctcattgaaaaggctataaaattctgcattggttcacaggaggatgcaagtaaaactccagcttcagcgcgacacaaacgaggctgtaactgcaagaaatcaaactgtctgaagaaatactgtgaatgctatcaggtatttccattaaactccatacacatcagtgtaagattcccttctgtggattggttctgattcattgatcgtgtagggcggagttggttgttctataaactgtagatgtgaaggatgtaaaaatgcatttggcagaaaagatggttagcttttacttctccactttatcataaacacacaagtctcttgatcttttatttgacaagagtacacaatttcttgcagggtctttgttcgaacaagatgaggagaatgaaacatctggcacacccggaacaaagaaaacacaacagaatgtcgagttgttcaaacctgcagctccaccttcaacaccaattccatttaggtaaagaaataatctcaaatacaatcaaatatgtgtccatttacacttctcctgattaactttattaacctttgttttcagacaaccactggcgcaacttccaatctcatccaacaacagactgctacctccacagtctcattttcatcatggagctattggatcatcttcctcagggatatacaacatcagaaaaccagacatgagtttgttgtctcattcaagaatcgagacaatcacagaggatattgatgatatgtctgagaatctaatccattctccaataactactctatctcccaacagcaaaagggtttcgttgtctcatcttgattcaccagagtcgactccatggagaagaaatggtggggggaggaatctgatacgttcgttcccaacgtttccttctctcactccacaccattaaaattctttgaatgtcaacttctagttggtagttttaacttacacagacaacatacgcaaacatttacaagtttagtagcagtattgcgttagtttttacaatggttgtgtaataaaaatgttaagtcatttatcaatatcttgacaacattcctcgtctaatatcacaaatgtaaccttatttattcaacaattttcatgtaaaaacaatcttcacaattaataatttattgactaactaataataatcttgttcaaagaggatgacaaaagagaaagaaaaccaaaaaacaagctggtcgactaattaagttgcactagacttggaacataagaccacacaattgggtaacaccttctgtctgattctccaagatccacttctttcatggatccatccactccaatgatgtaagctatgtagcgctgtattctgtagcctttatcaaaaacaacagcgactttcttctcctcgtcaatgaagaaactccccaaacaaaactgaaactgagggccaatgagttttcttatactcactgataagaacaccttgctgttccaagacaccgcgttgggctcaatcttagacgtgacccagatctccatcattaatgtatcccacggctgatataaaacagcaagctgctcgtctctaacattggatacactcaaagcatcttcagattcaacaaactgaaacggaagaggcaaaagtggtccaaatgtctctcttgtgaaatcaaaagagagtaagaaaaactcttcgtttgtttcacttgtttcgtaatacttctcttcagcaacccagaaggcatttcccttgagagacacgccactattaatagtccctaattgccagtctggagtgacatgaaaaaccctccatgaattagagttaaaatcgtagattatgaactcatgaaaatggggtctcaaacaagtaatacacctcaagattttgtgggatttgctgctcttgtcgtatccgagagcataagaatagctgtcgaatttgttgaactgatgtgtgggctcgattgaccgggtatgcccccaatacgggttccaaaccacgagcctagtcttggcttgggtgatgctgatgcataacaataaaccgtcgcagtgaaagacttgagatatatcatcaacttcgtcgcctaagctaataactttagcttcacgttttatacatgatgatgatgatgatgatgatgattcaacgacgttgttatcaagattgactctcatcaaataaaccctaaaattcatcatcatgaccaccataaagtaaagagtaaagcattaattgggccaaaaatgtaacgaatgggcctgagtgttataggtccaggtaagggaaagatgacgtcacttagtggatggactaaaagagtgatatgatttggacttcatagttcacactgtttcgcaccggcgcggacaaagttttttttttgttcgaaatccgacaacaaccctagattataaacaaaataaaccagtgtctgcatagaggcaatgtagatgtgatttttgctggaaaatg

SEQ ID NO: 23772 - DNA, 3000 bp, Unknown; identical to SEQ ID NO: 7394
  misc_feature (1)..( 3000): 2750-1469P.txt file - cDNA_ID_2152269; gDNA_ID_1621143; Annot_ID_172911

SEQ ID NO: 23773 - DNA, 3000 bp, Unknown; identical to SEQ ID NO: 7392
  misc_feature (1)..( 3000): 2750-1469P.txt file - cDNA_ID_2152288; gDNA_ID_1621143; Annot_ID_172919

SEQ ID NO: 23774 - DNA, 3000 bp, Unknown
  misc_feature (1)..( 3000): 2750-1469P.txt file - cDNA_ID_2152311; gDNA_ID_1621143; Annot_ID_56695
tttttatatattcgatataaattagctaaaactattttctaaaatggggatggtggagaccatagagtaccaatagagaagagctatcagaagttagtattgaccggaactaatctagaattgtgaaaattatacacacacacacacacatactaattcgagtacagctgaaacatttcaatagaaaaaatacccaatgatttaagagagagctgcattttaaattgttacttggaggactacgatgaagttataagttatttggataatctagctcatgtagcagcttttatgctggcagggcctttttagggtttggttgaacatgtgtgagagacatactttcaaatgatttctgagattcttattggataaggacactcttcttcctattattgtttgtgttaatcatcttatattgagttacctttatgtaatagtttttgataatgtttataatatgagtatgaaaagagtggttctaatctcatatgggtttccaacttatttccaacaaaaaaaacaaaaccagaaaatggattaaaaattagtaatgggccggcacagcccattaggtatattcacctacccaacatgttgaaccaagttaacgacttatagtaagattaactaacatgaaataaaacaagggtgagttaaaaatctataaatgcaccagcaaataattaaaaatttatatatgaaaactatttatttaggtaacatttttaattaaaatctatatgacaaatatactctttcaaggagatatgataaaaatcaggatagttagcatataaacgcattatcgagataatattgttagcgaaatatagatagagtttgatggatggatgaaatgacattgagtacaaaccaacttaatatgttaataatatatttgacgatataaaaaaattctcagttattgaaccaatgtttagatttcaaagactgatatatatgcgaagcgataacattattatttaaaggtaacaaaatatttagcatgaaaagcaaaaaagttgacttgcgactgaataatcatgtagaaaaaatacatgcatcagaatagttagcatataacgtattatcaggataatattgttagcgaaatatggatacttggataaagttttgatgtatggatgaaaagacttaggatacaaacctacttaacatgttaataatacagttgacgatataattaaattatcagctattgaaccaacgatttgatttcaaagattgtataattatgggaagatgataacattattattaaaaggtaacaaaatatttaacgtcaaaagcaaatatgatataagagtataaaggtattttcatgatggaaagagaaaactcaacagtaattttttcttggacttaattttgtaatattctgtgtatatagagtgataatacccttgaaatccacatatcaccaataaaatgtatatatatagcccctactagactactaatcttgtgtaacttatatgatttgtctattacaactttagaagtatttgaaaatacaattttgctaaatatgatttatatgatttatatgatttatcgcttttttagtggaatcgaactccaacaataaaaaaagcagaatcaaatagatttaatcactcgactaaatacacatctccacgtaatttatcgtttacatatagcaaacgaacattatatctgacgaccaaacctaaaataaatacagatggacatattcggaaacataatataccaaagcaaatagtattctaatcgtacagtattaagatgactctaatacacattgacttctttaaataataatataattttatattaatattttaaatcatatgtaatgtataatattaagatggtcttatatcttattatataaagtatggttttcaaagttactaatttataggatcgtgccacgtgtcaagtcaaacgatcggatttttacatgtgtcattaaaaatttaacttatgattacacccgcctaaataatttatttttgtatcttacactcgcctatttaggcgggcattatctagtttctaatatacattaactaactagtaactagtggtgagagtcataaataatttgaaaagtgccaattgagacacatgcatcaaaggggagtcatgtaaaatacttcgaagattcatctcaacataaaataaaataaaatcaattgattcgtcttcttatcctccaaaacattttatttttcttcgtcaattaattttgtggaaacaatttcctattctaatattttcacatttaaccgagactaaactctttttctctctctcttcctcaaataaactacttctaatttttgtcttcaacttaagaattataacaattatgaaagacctagtcagtttaccggcgaagctcgggtcgtatattatattttagcaaagaccttaattcttacattttttaaagacccaaaacaaatatttttaaccaaaaaaaagtctctctccatattcgtatacaaataaatacctttcatccatcagcttatagagaccaacatacaacaatactctctgttcttcatcttctctatcctgcaacaccaaaggttagagctctctctcctccctctctctatacagatttgctttaacttttatcaatgttttgagcactatattcttatataaactattgtaaacgtaaagagcatagtctggaaaactatagagttctattgtcttctaagttctaattagataattgtttttttgggtaaacaatagataatagtggtaacggcttctttattcacccatgaaatttgatcgtttaaatggccttcttgcttcactctagatcttgtttgatcatcggtttgaaaatggttttatcttttaataattcccaacgtaatgaaacacatattgcttttgatgcgaattactgactaagtaacacaatatgcctttatgtctcaagatacaaatctatccgatatg

SEQ ID NO: 23775 - DNA, 3000 bp, Unknown
  misc_feature (1)..( 3000): 2750-1469P.txt file - cDNA_ID_2152311; gDNA_ID_1621143; Annot_ID_172933
gtcctaatcgtttatgtatattatacctttttatatattcgatataaattagctaaaactattttctaaaatggggatggtggagaccatagagtaccaatagagaagagctatcagaagttagtattgaccggaactaatctagaattgtgaaaattatacacacacacacacacatactaattcgagtacagctgaaacatttcaatagaaaaaatacccaatgatttaagagagagctgcattttaaattgttacttggaggactacgatgaagttataagttatttggataatctagctcatgtagcagcttttatgctggcagggcctttttagggtttggttgaacatgtgtgagagacatactttcaaatgatttctgagattcttattggataaggacactcttcttcctattattgtttgtgttaatcatcttatattgagttacctttatgtaatagtttttgataatgtttataatatgagtatgaaaagagtggttctaatctcatatgggtttccaacttatttccaacaaaaaaaacaaaaccagaaaatggattaaaaattagtaatgggccggcacagcccattaggtatattcacctacccaacatgttgaaccaagttaacgacttatagtaagattaactaacatgaaataaaacaagggtgagttaaaaatctataaatgcaccagcaaataattaaaaatttatatatgaaaactatttatttaggtaacatttttaattaaaatctatatgacaaatatactctttcaaggagatatgataaaaatcaggatagttagcatataaacgcattatcgagataatattgttagcgaaatatagatagagtttgatggatggatgaaatgacattgagtacaaaccaacttaatatgttaataatatatttgacgatataaaaaaattctcagttattgaaccaatgtttagatttcaaagactgatatatatgcgaagcgataacattattatttaaaggtaacaaaatatttagcatgaaaagcaaaaaagttgacttgcgactgaataatcatgtagaaaaaatacatgcatcagaatagttagcatataacgtattatcaggataatattgttagcgaaatatggatacttggataaagttttgatgtatggatgaaaagacttaggatacaaacctacttaacatgttaataatacagttgacgatataattaaattatcagctattgaaccaacgatttgatttcaaagattgtataattatgggaagatgataacattattattaaaaggtaacaaaatatttaacgtcaaaagcaaatatgatataagagtataaaggtattttcatgatggaaagagaaaactcaacagtaattttttcttggacttaattttgtaatattctgtgtatatagagtgataatacccttgaaatccacatatcaccaataaaatgtatatatatagcccctactagactactaatcttgtgtaacttatatgatttgtctattacaactttagaagtatttgaaaatacaattttgctaaatatgatttatatgatttatatgatttatcgcttttttagtggaatcgaactccaacaataaaaaaagcagaatcaaatagatttaatcactcgactaaatacacatctccacgtaatttatcgtttacatatagcaaacgaacattatatctgacgaccaaacctaaaataaatacagatggacatattcggaaacataatataccaaagcaaatagtattctaatcgtacagtattaagatgactctaatacacattgacttctttaaataataatataattttatattaatattttaaatcatatgtaatgtataatattaagatggtcttatatcttattatataaagtatggttttcaaagttactaatttataggatcgtgccacgtgtcaagtcaaacgatcggatttttacatgtgtcattaaaaatttaacttatgattacacccgcctaaataatttatttttgtatcttacactcgcctatttaggcgggcattatctagtttctaatatacattaactaactagtaactagtggtgagagtcataaataatttgaaaagtgccaattgagacacatgcatcaaaggggagtcatgtaaaatacttcgaagattcatctcaacataaaataaaataaaatcaattgattcgtcttcttatcctccaaaacattttatttttcttcgtcaattaattttgtggaaacaatttcctattctaatattttcacatttaaccgagactaaactctttttctctctctcttcctcaaataaactacttctaatttttgtcttcaacttaagaattataacaattatgaaagacctagtcagtttaccggcgaagctcgggtcgtatattatattttagcaaagaccttaattcttacattttttaaagacccaaaacaaatatttttaaccaaaaaaaagtctctctccatattcgtatacaaataaatacctttcatccatcagcttatagagaccaacatacaacaatactctctgttcttcatcttctctatcctgcaacaccaaaggttagagctctctctcctccctctctctatacagatttgctttaacttttatcaatgttttgagcactatattcttatataaactattgtaaacgtaaagagcatagtctggaaaactatagagttctattgtcttctaagttctaattagataattgtttttttgggtaaacaatagataatagtggtaacggcttctttattcacccatgaaatttgatcgtttaaatggccttcttgcttcactctagatcttgtttgatcatcggtttgaaaatggttttatcttttaataattcccaacgtaatgaaacacatattgcttttgatgcgaattactgactaagtaacacaatatgcctttatg

SEQ ID NO: 23776 - DNA, 3000 bp, Unknown
  misc_feature (1)..( 3000): 2750-1469P.txt file - cDNA_ID_2152441; gDNA_ID_1621183; Annot_ID_174329
aagaatcaattttcactcgaataattaaagtaattagtttaaagattttactctatttctttccccaaattaatataaaattatgaaaattaatgggtttgtgtttttctttgtataggaaacgaaagatgagaagcaacgttcagtgttaacgaattcagcttcatcgagatcaaaaacatggaggccatcattgcagagcatctctgaagctacgagttgatgtttgggttttacgtgagggacaagaaacgtagtctctgtgtgtgaatcattcagaagatggaatctgaagaagaaagagatataaacattattgaataaactcttctcttatgttcctttctggttataatttacataggagatgaaaattttatagattaagatgtaaaaagaactatgcagagattaagaactaagtcccttttttgtcctgttaatgtatatatgtgctccatgtgaagaaatcaatcaaaaaatagattgtaaaaacatacgtttttgttggtgtttactggtttacacaaattcttggaataaagttcaaaaaactttagttaaatgagtccaaaaacatttgatttagatggttatgtgaggtataaatggttgtaagaattgcattgagttggattgatcattggtaggtacacatcctttcatgcatttatgggatggttttttaagaaaataaccaattttatttgagattattagttatttttcttcagagaagtagtagactttctcaaaatttatatttctttgaatggaaaatcaaattgaatttacattgtcttttttttttataactacttttttcatttttttagcaaatagtataacatagatgagctaagtaaaccaacaaggatgggcatttgcatcaaacccataccaaaccaaaaaattgaaccgatattatgaatcaagaatttaagatatccttgaaataaaaaatctgaaaatccaactgaagccagccaatgtttttagactctataaaaagatatctgattaataaattgttacttttaattttaatttttttttaatccagaaaacaaaaaatcaatggtcaaaacatacatagaaatctcaataccaatctcaatttattctgaaatattcttctgaaaccagaaaccaaagaaatccagaccaaaccgaaataactaaaccggaataaaccccctatccagtcatagaaacacttgattctaaagattgcgatagccgccgataggccaatcactcttttggccttatccgaaatctttttgtgggcagaaacgtttgtgtcttaggccaatctctgtgtctctctgtccagagagaaatggcagcatcatcagtactactctcgtgcttcaaatcccatcatcaaccaaaccttctccatggctgcaactactcatctaaccaaacactcctcagattcaacttttcaaccccaaaacctctcctgatctcctcacggagctgctcacgacgattcagagtcttgtcagagaccatcaccgtcaaattggaagaggaggagaaggatgatggtgcaagtgctgttcttgatcctcctgccgccgttaacactaagctctacttcggtaacttgccttacaatgttgacagtgcaactctggctcaaatcattcaagatttcgctaaccctgagctcgttgaggttctttacaacagagataccggacagagtcgtggattcgccttcgttaccatgagcaatgtcgaagattgcaacatcatcatcgataacctcgatggaactgtaagtctcttgcagccttattacaaaacacataaaaaaaaggaaaaaacacattttagttgatctttgttattggtctttctcaggagtatcttggtcgtgctttgaaagtgaactttgcagacaaaccaaagcctaacaaagaacctctgtatccagaaacagagcacaagctctttgttggtaacttatcatggactgttacttccgagtcattagctggagcgtttcgagaatgtggagatgtggttggggctagagttgtgtttgatggagatacaggaagatcacggggttatggctttgtatgttactcttccaaagcagaaatggaaaccgctcttgaatcgcttgacggatttgagctggagggtcgggcgattcgagtaaaccttgctcaagggaagaaattttgatatcatacaacaacattgtgtaatcatttagagttttatacattagagttatgtttatattgattgaactaattaactcaaaagatcaataaaactttttatgctagaaggtgttggtccaaattgttcacttgtgtgtctttgccagaaaatacaacattagaatcaatcaaaagcattagttttgttccttctctcgataacaattaacaattaacaagaaacctagtgacttctctttatacacatgtaagaaaaatcacacagagactcttcgttcattagtggtgtgcttcactgaaccaaaacactatagaactctaacttcacaagtgaagagaccgtaaagacccaccccagagaggaagagctaaacggtggcgacctcatccgttaagaaattctatagacactcagatcgcacggtcttagttgatcaaccagggttacagaggtacgagcctatgacagttcaggttaggtcgtgaccagtccaacttatcttcactttagacgatgtgagacaaagaaaagactaaagtcacttaacaaagcctatacgtcgtcgtttccttcctcaacgtactaattgctaatatgtcgtcgtttcttacatcagtgagctaatgaagagagagactgaaacagaggtttcttactttcttctctgtatctctcatattttgcttaaaccctaaaaccctttttggattaggttttctccaaatcttatccgccgtgataaaatctgattgctttttttcttcatgaaagtttgatttgtgaaactcgatg

SEQ ID NO: 23777 - DNA, 3000 bp, Unknown; identical to SEQ ID NO: 8018
  misc_feature (1)..( 3000): 2750-1469P.txt file - cDNA_ID_2152445; gDNA_ID_1621183; Annot_ID_174332

SEQ ID NO: 23778 - DNA, 3000 bp, Unknown; identical to SEQ ID NO: 3176
  misc_feature (1)..( 3000): 2750-1469P.txt file - cDNA_ID_2152530; gDNA_ID_1620630; Annot_ID_162639

SEQ ID NO: 23779 - DNA, 3003 bp, Unknown; identical to SEQ ID NO: 18894
  misc_feature (1)..( 3003): 2750-1469P.txt file - cDNA_ID_2152530; gDNA_ID_2926193; Annot_ID_201249

SEQ ID NO: 23780 - DNA, 3000 bp, Unknown
  misc_feature (1)..( 3000): 2750-1469P.txt file - cDNA_ID_2152556; gDNA_ID_1620630; Annot_ID_162651
aaaccagtatcgtgaacccgaaccggagggaagatgataatgagagtatagatggacttaaccacgtggaatgctatggcttgtcagtgattttggttatgctaagggtcccgtcactataaactagctatattcgaaggtacacaagggcctcaaagttagatttctaatcataagatatgaagttattagtactctttataaatcttcatgaaaagacatccgtatttcatccttcttttcataactatctttgtcaaatcttatttattttataaaacccaaaaactgtaaatctttataaaatattgtaattttcaaagatttagttgtgtcaaatttatttcttcagtaaatggaaatacaggttggcaaaaaagaacattaaccactctatgttgagcggcaatatccgttaggtgcattaattcttcttaaaaaggtaattacgcatttccttggttcgattcgtctagggacttaatagtgtgcgaaatattagaggatccaaatgatgcgtaagataagtcttatgagaagtccattagccctcgtaactatgattttaggtactagtagaaattcaattgggtatatttggtgaattctagagctttataattttgttatcgtttaaggctgataatgatgaagacataatgtcatggctctatgtttttattgctctttcctgttattttttttatcaactgatattaaagaatatatacattatattggctggtccatttcagtttttcttttatttggtcccgatttgattttatgtacataaaacatgtagaaccaatagtagtgtggtcgttatctttctaataatcgaaggctcgaaaccatatattgattcttggttagcgtatcgtctcttttatgactgcataatttacatggcttgcctatgtgttacacattatctcgatttcgatttcacgttcttggtaacatattaaagaatttagtatacgaaacaataaattgcatggggaaaccgatattcataaccaacgataatttgacaacacaaaaatggatcatcattcgccattgcccactcggccatacattagaaggacaagttatatttatttgctctctgtgaatctaattaagttttttactcgtcagtgggaaacatatagtaattgttttgtttgcattaaaatgaaaatgtatatatataaataaaaatgtactgatatatctactatagtagacttagtagtaattgttgtgaaagtagcagaaacaaaggatatggttgttgtaacataccaaattttcatgaaagcattcattgtgaatgtgaagttgagcgtatctatccgtgcaaccaaaaatagaaagagatgaagtatatgatcataatctgatttcttttgcttttagcacactaatcattgaagtttaagcatcacatctcttttctattttcctttccttgacaaaacttgcgaatcgttttgatgttccatacgtcttttgccatcattcatacataagtaccaaccaactattattaaacttttatttgttaattatacacaatattgactatatatattattatttttaccacaaaaaaaatttaaaatttagactatatagtaccaaccaatatagtattaatttttttttattttttacaaaaaccaatgaataaatttgattttccgaatgtggtttcttaattaaatttatattatttcagttccaatatttatatatatagataataaaaacaaaagagataaaagaagagatattggaaacaaaagaaaatgaataattgagagaacacaaaagaggaagaaagagagtggagaagagaagagaagagaagagagcaacttcctccattttcttttggcttcctctctccttctcggtttgttttgtctgtacctgagagagtttcccctaacaaaaaaagactcttttttcctcaaaatccatttcgcttccgacgccattctcagtcggtgtgaacgcgtgagagaaagagagagatttggcttactttatctccggcgggcatctttttccggcggagtttccgatgtatctactctagctaagctcagctcttaactgttacaggtctctctctctctctctctctctcttcccccgagtaaaaaagccacaaaatgtctgaatcatttagctctgatctcactttccgatgctttttacctattttctcgtttcgatttctttgtttgcttttcactgttcttacttcaattagattctgatccctctttttaccctttctctctctctctttctctgcttttgcttttactgtttccttacaattgtgattgtattgagctaattttggtcggattcatttactcttctctttgtcaatttgcttgtttttgttaaagatgtgacatttattactaaaggtttcttctttttgggggaaacaaatttgagttcatagatagacttactagaggagtgttgtatcactgatgctggaatctggttaatgtaggcagatccacagtgcctgttgattgtttcttcctatcatcaatctcggaatttgagggggtcttattattaagggtgagtcaattttgatttgtaattttcacaaggagtttgtgttcagacttcagagcataaaaagtgactggcttgattgtgataggtcatgtgaaaaaatggtaactggttcatcttatcttttgttcagtcactataaagtgtccctctgattacagaatcttattctcctttctttttttccttacaaagttcttgttttgttatgcttgtcctgttcctctttgctgctagaaatattctcttcttctactctctcttcacttttcctggatcttttaggtttaaattttgaagcttgcagagctggaaagtttcttcattaggaatctttgcttgttagtttcgtgtcacctcagataataactaaatagctgtgaaactgcagggaccataatg

SEQ ID NO: 23781 - DNA, 3003 bp, Unknown
  misc_feature (1)..( 3003): 2750-1469P.txt file - cDNA_ID_2152556; gDNA_ID_2926193; Annot_ID_201238
gctaaaccagtatcgtgaacccgaaccggagggaagatgataatgagagtatagatggacttaaccacgtggaatgctatggcttgtcagtgattttggttatgctaagggtcccgtcactataaactagctatattcgaaggtacacaagggcctcaaagttagatttctaatcataagatatgaagttattagtactctttataaatcttcatgaaaagacatccgtatttcatccttcttttcataactatctttgtcaaatcttatttattttataaaacccaaaaactgtaaatctttataaaatattgtaattttcaaagatttagttgtgtcaaatttatttcttcagtaaatggaaatacaggttggcaaaaaagaacattaaccactctatgttgagcggcaatatccgttaggtgcattaattcttcttaaaaaggtaattacgcatttccttggttcgattcgtctagggacttaatagtgtgcgaaatattagaggatccaaatgatgcgtaagataagtcttatgagaagtccattagccctcgtaactatgattttaggtactagtagaaattcaattgggtatatttggtgaattctagagctttataattttgttatcgtttaaggctgataatgatgaagacataatgtcatggctctatgtttttattgctctttcctgttattttttttatcaactgatattaaagaatatatacattatattggctggtccatttcagtttttcttttatttggtcccgatttgattttatgtacataaaacatgtagaaccaatagtagtgtggtcgttatctttctaataatcgaaggctcgaaaccatatattgattcttggttagcgtatcgtctcttttatgactgcataatttacatggcttgcctatgtgttacacattatctcgatttcgatttcacgttcttggtaacatattaaagaatttagtatacgaaacaataaattgcatggggaaaccgatattcataaccaacgataatttgacaacacaaaaatggatcatcattcgccattgcccactcggccatacattagaaggacaagttatatttatttgctctctgtgaatctaattaagttttttactcgtcagtgggaaacatatagtaattgttttgtttgcattaaaatgaaaatgtatatatataaataaaaatgtactgatatatctactatagtagacttagtagtaattgttgtgaaagtagcagaaacaaaggatatggttgttgtaacataccaaattttcatgaaagcattcattgtgaatgtgaagttgagcgtatctatccgtgcaaccaaaaatagaaagagatgaagtatatgatcataatctgatttcttttgcttttagcacactaatcattgaagtttaagcatcacatctcttttctattttcctttccttgacaaaacttgcgaatcgttttgatgttccatacgtcttttgccatcattcatacataagtaccaaccaactattattaaacttttatttgttaattatacacaatattgactatatatattattatttttaccacaaaaaaaatttaaaatttagactatatagtaccaaccaatatagtattaatttttttttattttttacaaaaaccaatgaataaatttgattttccgaatgtggtttcttaattaaatttatattatttcagttccaatatttatatatatagataataaaaacaaaagagataaaagaagagatattggaaacaaaagaaaatgaataattgagagaacacaaaagaggaagaaagagagtggagaagagaagagaagagaagagagcaacttcctccattttcttttggcttcctctctccttctcggtttgttttgtctgtacctgagagagtttcccctaacaaaaaaagactcttttttcctcaaaatccatttcgcttccgacgccattctcagtcggtgtgaacgcgtgagagaaagagagagatttggcttactttatctccggcgggcatctttttccggcggagtttccgatgtatctactctagctaagctcagctcttaactgttacaggtctctctctctctctctctctctcttcccccgagtaaaaaagccacaaaatgtctgaatcatttagctctgatctcactttccgatgctttttacctattttctcgtttcgatttctttgtttgcttttcactgttcttacttcaattagattctgatccctctttttaccctttctctctctctctttctctgcttttgcttttactgtttccttacaattgtgattgtattgagctaattttggtcggattcatttactcttctctttgtcaatttgcttgtttttgttaaagatgtgacatttattactaaaggtttcttctttttgggggaaacaaatttgagttcatagatagacttactagaggagtgttgtatcactgatgctggaatctggttaatgtaggcagatccacagtgcctgttgattgtttcttcctatcatcaatctcggaatttgagggggtcttattattaagggtgagtcaattttgatttgtaattttcacaaggagtttgtgttcagacttcagagcataaaaagtgactggcttgattgtgataggtcatgtgaaaaaatggtaactggttcatcttatcttttgttcagtcactataaagtgtccctctgattacagaatcttattctcctttctttttttccttacaaagttcttgttttgttatgcttgtcctgttcctctttgctgctagaaatattctcttcttctactctctcttcacttttcctggatcttttaggtttaaattttgaagcttgcagagctggaaagtttcttcattaggaatctttgcttgttagtttcgtgtcacctcagataataactaaatagctgtgaaactgcagggaccataatg

SEQ ID NO: 23782 - DNA, 3003 bp, Unknown
  misc_feature (1)..( 3003): 2750-1469P.txt file - cDNA_ID_2152681; gDNA_ID_1620506; Annot_ID_159025
attttaaaacaaatttttttgttaaaacaaatattattcttactaaacgttttttgtttaaataaataaatcatgtatttgaacttatttacaatgtaatgacactgacattaattatttaggaatgaaaatattaaatcttctaaatccttgcttttagaattattatgtcattacttaaaaggctcaaaatataaaaaaattaaatattattatttatatatctagactttataaaacattattaatatttaaacttataaaaagtttaatatatcataattttttaatattattatataatatatagagttttaaaaaatcttaattctttccgtcatattttgtgactcgaaattttaaaaataaacatatattaatcaattggcaaaaaatgtgtgagttatacgtcccacatgaactaaaatatttagacaatgattcataaatatatcataaataagattaacattaataaaataatgatttttttacaggatgggtttggcgggacgcgatttagcaggacgttacttaataacaaatataaagtataaaataaaaatattttatagcaaaattttatatatactaattttaaaatataaattgtctccacggtgtaccacgggttaaaatctagttatttagtaattatgcatctcgtataaaccagctacaaaaatatcagtggaaggatctttatcagcaagcatattagaaaacattaaaaaatgaatagtaaactatgagtggggaagcaaaagaagagcgacggcttgctattggagacaaagttcataccacacgaactagacgatgcatagtatagatataggttaggcatatgtccatgcatatgttacgtgtagattgaaagggcatcgagatcaacggtggagatggaagcaagtaaaaatagccacgtgtggaaaaagcaaaagaagagaagaagaagatataagcgacgaaaggagagaggatatgtttcctttgtgatgggaacatcacaactctgtctctattggtacttctagttcactacttgtctatgttttttctttcagtacttagtttcccccacgatttacacaactttcttctgctcgtatttacagattttgaagattatttatacatctttatatagaactacacatgaaatcgtatgaaagcatgcatgaatcatgattcatgtgtgtgaaaattgacggtatgaagatgtgtataaattttatacatctgcgaaaatcatatcttgtggccaaatatcgaccaattggaacggcttgcaaattctatgaaaacgatcgatatgaaaatctgatttacatatataatagtattttcaattaaaaatcattttcctcaatttctatatatgtgtatttagcatatatatatatatatatatatcaaataaaccaaataacttcaataataatttaaatatatgaaaattaaaaaaattcactactcatatgatataattcatcactatagaacttataaaataagatcctggtaaaaaaagcatcaatcttgtatttcagtagtttataatgttaaaatatatgtaatcaaacttctcatatttttattaaaaccacacatgggctatctagctaattcacacacacatatatatatatattgttttcgattgtcatgatgatcatttatccacgtaagcagagacaagatgtaaaatgtcactagtttatagggagtggagtgggaataagtaggaaaagggaaaaaattaaaggaaaggtatacataattttcaagtcgattttgggttgataattacagtgagagggagacaacacattgcgctatacctaattctaactagtttcatttctagactgatggaccaatcatatcactttctactaatatcgttagtttgagcttcataaatatcttttatcacattttattttagaaaggttgttgttagttctatgcatctttttaaaccacacgaagtttcaaaaatattcataataatatttacgcctttataactaacatattcaatttcttacattttatcatggacaaaaaaagagagtagttcctcaggagaaatacaaattcgatatctaaaatcaagtgttagtaatctattggttaatattttttcaacacaaagattatttcatggtaaatgcattttttaagataacaattgtatgttcgaacactagtttagattctctatatgattttccgatactcaaagaaactatacactcactttcttaacaaatttattaggccaaatatatactgtttcaccggagatgcattcatatttactatggattagataacaattgtatgttccgaacactattttagtttaatttagattgcctatatgcatgatttttttataaccaaagaaaatatacactcactttcttaacaaagattaaataaagagataatcataaatggaactttgtactaacagaatcttgagaagaaatttgatttgagttttgttcttttttttttgttgttttaaatttccacatgcctatactttcgtttgtttatgtgacgcttttgtacgacaaaatcaggtttggattcgtacttcttttaggtcaatacattcttttgtttaattctgaccaaaaataaagaaatatgttgtttaataaaaatgtaggatattgagagtcgtactataataaaaaaataaaaaaatctcgaactttgatagtataagagatatacgattaaatcttgaacttaatatcctatatttttctcaaactatacttagtttgtatttatacttgtatatattagagtccacacaaagaaaaatggataacaaataatgacatcaatattttgggaacccccaccatgccaaacccaactccatgttacaaaacaaaacaaataaaatttctttataaaatggcatcttctcttcatattttttaaatctctcatctcaataaacaaacactaacaatg

SEQ ID NO: 23783 - DNA, 3000 bp, Unknown; identical to SEQ ID NO: 3604
  misc_feature (1)..( 3000): 2750-1469P.txt file - cDNA_ID_2152761; gDNA_ID_1620653; Annot_ID_163540

SEQ ID NO: 23784 - DNA, 3003 bp, Unknown; identical to SEQ ID NO: 19295
  misc_feature (1)..( 3003): 2750-1469P.txt file - cDNA_ID_2152761; gDNA_ID_2926186; Annot_ID_200611

SEQ ID NO: 23785 - DNA, 3003 bp, Unknown; identical to SEQ ID NO: 19288
  misc_feature (1)..( 3003): 2750-1469P.txt file - cDNA_ID_2152794; gDNA_ID_1620653; Annot_ID_163553

SEQ ID NO: 23786 - DNA, 3000 bp, Unknown; identical to SEQ ID NO: 19289
  misc_feature (1)..( 3000): 2750-1469P.txt file - cDNA_ID_2152794; gDNA_ID_2926185; Annot_ID_200572

SEQ ID NO: 23787 - DNA, 3003 bp, Unknown
  misc_feature (1)..( 3003): 2750-1469P.txt file - cDNA_ID_2152800; gDNA_ID_1620653; Annot_ID_47797
agacttacaataacttcatcaagcaactcatacacgagcacaaagtttttcctgaatgaatcttcattcagaacaccaagataatccttaataacacgagcaatcctttgtagaagctccaaaacaagagagggtgacacgttaactctcgttgtcgcaacaaaatatagaccaacaaccttgacatggaagtagttcacgccatcgacattctataagcacaaaaaataagttagatgaaatcattacagctcacaaccaaacagaaagtataatacctacaaagataggtggcgcctctgcattgccatcctccttccagaacttgactttacggaagaatgtctctgtacttcctttgggtacctcagcccggtctgtagcaataaaacgttacacatcttgaaacttgtattggatccaaccaaatcgtataatctcaaaacaaatagctttcttctactacattacatacagatactctgcccaaactaattgaatagttttgctatatttgtacaatctgatttggaaattcagctcaacataatttgtcatcggataagaaatgttggtagatcaaacagatcaatgagcttagagaagatttcaatggaaaattctcatgaaacagtgacataagactcgactctgaagagaaaaagcaaaacaggaagaagcagagaggatcagatcgagaaagagagcttacagtcacggaagacgatgttatctcctcgctgagataagacgaagaattgggagatcatcatcgttccttatagcggtggattccgactgtttcaccgcgagtttggttaagtctactgatcgccgatcggtctcgtctttttgtgtgtctggtggtgaggtggttcacgttttaccatttgccgtcgttatcgtgaagcttcttcatgagacggagggttctgtgtttttgtgaattatgatttcttgttcttatatgggcctatttttaagacatcaatatggcccaaatttcgaacttgttatgagtttaaggaaataagtagtaagtactataaatgatggttcgatctcggaggagaaaaaaaaaaacattgtttacgaggaagcaaaatgtgagttgatataaagggtacaacacataatttatttttggaagtcaaaactttgaggattaagctgacaacgaaggttagtgaagactttcgggatcgagcaatcgggagatatacatgagcctagagggctgacaagatgaccaagcattccaaatgaaaggcttaagatttttctttttctaaactcaagtaagaaacacaagatatatgaaagggtaacaagggtcaacaacaagtctaagctttttaaacgtgttagatgattcttcttgaacactattacaattactgtttagtttcacatttatatgaccttgggagtcttctagctcgtcccaaatatattttcaacatattactataagatcctaaagaccaataacattgatctacaccaaaaactctcactttctgattttgcactcgctttttttcctcccataaacaaaaccaaaggcttacaatactaaatctgtctcacattcttagtgcttatttgttttagtcataaagaacttaatcttatacagattgaagtcttaaagtcatctatattacttttcacatgtatcattatgagatggtacgtttcccacgaattttatcagtttagtttaattttcagttgtactttgggagaaaaaatttacaagatacttgtcggccatgatatcaccctagagttaccggagtccggtgatatatcatttctaattagggttaaaacttaaaagggtataaatggctgatcaaacccaaaaataaaagataatgatgacggtgggagacgagtgatcttatcaggtgtcgcatctagcatatataggtgaaagactataaaaaagacatgaaatatttaatagacacaacttttgtaataaaccaaaaccaaaaaggtagatgaactgatgaacagcatcttctaattacgaataaaaaaagtaaccaaactttctttccattagaattggtacgtagttccttgtgtattgtgatttctttcattttccaattatgtttttttattttatcatgttacatttttgatagtgggtaacttttgtatcattttatttgacctagccatatataaatctattaacttatacggagtagtatttcacgtcatttatttttattttgtttttagatgggaagttattcaaaactagactaaaacagtaaaactaggaaacccgctactgaataaagttacaattccacattattccatgacagactaattgaattagaaggttaggtaaattattaaatcataactgtagcagtctcttcgtctggcagctcagtcagacaaaacacaaagtgtgtttatgtgttatttttaatgattatagtttgggaaaaagacataatcaaaagggatacaaaacatatggcccattgataagtatagatcactgtttagctaaaaaaagcagactcttttttccaatcttgaacacaaacacagtcaccatctctctctctctttctctctcactcacacattagggagtaaacagctaccagaaaaaccttttttatcttctcacaaatttaataaagtgggtgctgagattgaataacgtaatccaagatcctccaactcacagaaaggtaaaagctgtgaatctgtgttctttcttcttaagcaaagtgtttgatgaattcatctagtcctgtccattcttttgcttctcatggtttatggatctgatctctctttctctctctctctagccattagggtttcctaagaatattatataaactctctttagctaacaccgttccaattggtttctttctttgttcttggtctaaaatctaaatggtgttatgggtataggcagattcaagaacagtagtgaaggagagatctggtaaaatg

SEQ ID NO: 23788 - DNA, 3003 bp, Unknown; identical to SEQ ID NO: 23787
  misc_feature (1)..( 3003): 2750-1469P.txt file - cDNA_ID_2152800; gDNA_ID_1620653; Annot_ID_163557

SEQ ID NO: 23789 - DNA, 3000 bp, Unknown
  misc_feature (1)..( 3000): 2750-1469P.txt file - cDNA_ID_2152800; gDNA_ID_2926185; Annot_ID_140763
cttacaataacttcatcaagcaactcatacacgagcacaaagtttttcctgaatgaatcttcattcagaacaccaagataatccttaataacacgagcaatcctttgtagaagctccaaaacaagagagggtgacacgttaactctcgttgtcgcaacaaaatatagaccaacaaccttgacatggaagtagttcacgccatcgacattctataagcacaaaaaataagttagatgaaatcattacagctcacaaccaaacagaaagtataatacctacaaagataggtggcgcctctgcattgccatcctccttccagaacttgactttacggaagaatgtctctgtacttcctttgggtacctcagcccggtctgtagcaataaaacgttacacatcttgaaacttgtattggatccaaccaaatcgtataatctcaaaacaaatagctttcttctactacattacatacagatactctgcccaaactaattgaatagttttgctatatttgtacaatctgatttggaaattcagctcaacataatttgtcatcggataagaaatgttggtagatcaaacagatcaatgagcttagagaagatttcaatggaaaattctcatgaaacagtgacataagactcgactctgaagagaaaaagcaaaacaggaagaagcagagaggatcagatcgagaaagagagcttacagtcacggaagacgatgttatctcctcgctgagataagacgaagaattgggagatcatcatcgttccttatagcggtggattccgactgtttcaccgcgagtttggttaagtctactgatcgccgatcggtctcgtctttttgtgtgtctggtggtgaggtggttcacgttttaccatttgccgtcgttatcgtgaagcttcttcatgagacggagggttctgtgtttttgtgaattatgatttcttgttcttatatgggcctatttttaagacatcaatatggcccaaatttcgaacttgttatgagtttaaggaaataagtagtaagtactataaatgatggttcgatctcggaggagaaaaaaaaaaacattgtttacgaggaagcaaaatgtgagttgatataaagggtacaacacataatttatttttggaagtcaaaactttgaggattaagctgacaacgaaggttagtgaagactttcgggatcgagcaatcgggagatatacatgagcctagagggctgacaagatgaccaagcattccaaatgaaaggcttaagatttttctttttctaaactcaagtaagaaacacaagatatatgaaagggtaacaagggtcaacaacaagtctaagctttttaaacgtgttagatgattcttcttgaacactattacaattactgtttagtttcacatttatatgaccttgggagtcttctagctcgtcccaaatatattttcaacatattactataagatcctaaagaccaataacattgatctacaccaaaaactctcactttctgattttgcactcgctttttttcctcccataaacaaaaccaaaggcttacaatactaaatctgtctcacattcttagtgcttatttgttttagtcataaagaacttaatcttatacagattgaagtcttaaagtcatctatattacttttcacatgtatcattatgagatggtacgtttcccacgaattttatcagtttagtttaattttcagttgtactttgggagaaaaaatttacaagatacttgtcggccatgatatcaccctagagttaccggagtccggtgatatatcatttctaattagggttaaaacttaaaagggtataaatggctgatcaaacccaaaaataaaagataatgatgacggtgggagacgagtgatcttatcaggtgtcgcatctagcatatataggtgaaagactataaaaaagacatgaaatatttaatagacacaacttttgtaataaaccaaaaccaaaaaggtagatgaactgatgaacagcatcttctaattacgaataaaaaaagtaaccaaactttctttccattagaattggtacgtagttccttgtgtattgtgatttctttcattttccaattatgtttttttattttatcatgttacatttttgatagtgggtaacttttgtatcattttatttgacctagccatatataaatctattaacttatacggagtagtatttcacgtcatttatttttattttgtttttagatgggaagttattcaaaactagactaaaacagtaaaactaggaaacccgctactgaataaagttacaattccacattattccatgacagactaattgaattagaaggttaggtaaattattaaatcataactgtagcagtctcttcgtctggcagctcagtcagacaaaacacaaagtgtgtttatgtgttatttttaatgattatagtttgggaaaaagacataatcaaaagggatacaaaacatatggcccattgataagtatagatcactgtttagctaaaaaaagcagactcttttttccaatcttgaacacaaacacagtcaccatctctctctctctttctctctcactcacacattagggagtaaacagctaccagaaaaaccttttttatcttctcacaaatttaataaagtgggtgctgagattgaataacgtaatccaagatcctccaactcacagaaaggtaaaagctgtgaatctgtgttctttcttcttaagcaaagtgtttgatgaattcatctagtcctgtccattcttttgcttctcatggtttatggatctgatctctctttctctctctctctagccattagggtttcctaagaatattatataaactctctttagctaacaccgttccaattggtttctttctttgttcttggtctaaaatctaaatggtgttatgggtataggcagattcaagaacagtagtgaaggagagatctggtaaaatg

SEQ ID NO: 23790 - DNA, 3000 bp, Unknown; identical to SEQ ID NO: 23789
  misc_feature (1)..( 3000): 2750-1469P.txt file - cDNA_ID_2152800; gDNA_ID_2926185; Annot_ID_200568

SEQ ID NO: 23791 - DNA, 3003 bp, Unknown
  misc_feature (1)..( 3003): 2750-1469P.txt file - cDNA_ID_2152804; gDNA_ID_1620653; Annot_ID_163558
agccgatgaactttcagttctttgcgatgctgatgttgctctcatcatcttctctgccaccggaaagctcttcgagttctccagctcaaggtatattctatctttttgttagtagttgtcttatttttttcaatccatgtttgtgtttttgagaatatggttggataaatatattaagatatgtatttaaatgagatttttattttctcgtttactctctaaagttaattatcagtaggctcggagatctcatgtacggcataatttgatgacctaaattattatactttaaagtataggattgatgttttattacttttatgtataacacatcatgtatttaattccgtttaacataatatgggtttttaacgtgtaatttttcaatcattttcatttagactcatggttaagatttctgtactgggaaataagagagcagaatattatagtgtgatttttgttaattaggaaagcatatgtatatatggatacatagtacttaccacaattagaatgaatttcttttcccttttttcatttgactttgtgtattacaaaagtctttgacactgtcacttggtatgattggggattaattcttaaccactcgtttagtttatcttgggaagcattaccataattgggaaacgagtcatctgtctgtatcgtgatggctacttctgattacttttcttttattataaccaaaaaggcttctaatgtacttaattaattttacaaatgtaatatggacgaaggaaatgtttataagaaagatggattgtttgttgaaacgtgtagaatgagagacatattgggaaggtatagtcttcatgcaagtaacatcaacaaattgatggatccaccttctactcatctccgggtattttcgatatcacttactcttttttttttttgtggattttaaactctctgctctttttaccaaacccttctctttttatcaaacccttctctctataatattatccgatgttcactttgttacacgtgtttgttataatttttagctgtaagtctaaatatagaaacattgagtggcatataatcattaatcttgaagcatctaattaattggttttacatattaatagcagaatcctgaaactgttgactttgcatctagcagcttgagaattgtaacctctccagactaagtaaggaagtcgaagacaaaaccaagcagctacggtatggctccattgatatgttatgcagataaacctattttcatataggctatagctgtaagagatcatctatttcatgtgtgtggtttttttttttatgttttttcaatgatgtgtgcatgctatttttaggttttagaatctatttcatggaaattgaagatatttcatttcacgtgtaagttcgtcaagttgtggcgtgtgtcttggaaattgatgttttgtttgtagattttaagagctacttctaaaatttacaagagttttgtaattttcaattatggcccattattctcattaattcattaaaaaaattatatacattactatctatatctagcataggtagttttttttttctttttctttggtagacctactgaacaaatatctgatatatcactgactggataaatatctatagagatatttttgatagaaatgagtgttaatttaacgtaaaacaggaaactgagaggagaggatcttgatggattgaacttagaagagttgcagcggctggagaaactacttgaatccggacttagccgtgtgtctgaaaagaaggtttactactatacataaactaatagcatgcatattttccttaacgtggcatataaataataagctgtacatatataaaagtttgactttgttgttgttattggtaaatagggcgagtgtgtgatgagccaaattttctcacttgagaaacgggttagtagttagtacatacaattcgtataactaatggatcataagcctatctatagctagtgactttcttaataagtgaaacagggatcggaattggtggatgagaataagagactgagggataaagtacggctctaaacccttatagatatcatggaataaccttaatctatttttttatgtataagaaaatatgatgagggaacgtatattatatatcggcagctagagacgttggaaagggcaaaactgacgacgcttaaagaggctttggagacagagtcggtgaccacaaatgtgtcaagctacgacagtggaactccccttgaggatgactccgacacttccctgaagcttgggtataatttgtttaactgaacatatttcaaactttttgttgacattttgtatgtggatgtttactaactgtttgttggttaggcttccatcttgggaatgaatctgagagagagaaagatccagcagagttgacttcgatggaagcccacaaatattaagtctaccttttccctttcttttctttgaataagtgttgaaaaagaattgagatgggaaggatgaattctcattgcattgcagagaagcaagtttcagatattgtacgtgttattggtctttataactattttgcaccaaagggattcttcacatcacggacaaataataattttaacactaatgaaacaagtaaatatagtgaaacgataggttttctatagtgattctttacattaacaacaatgaaacaataaatataatattggagaggggtgtgaaagaacaaatatgttaattaatttctacaaatgttttcacctcctttctcgattcatataaaacaaaggtaagtctttgttccttaccttcactctctagaaaagatttttttggccaaaaatatgtattcacgcaatcagcagaacaaaaacctcggaagatcacgtccaacgaaggacctttaggcttaggggtaacgtcatgtcttccacttttgagcaaccttgcaaaccatcaacgaagtctttcatgtgcattttattcaacaatg

SEQ ID NO: 23792 - DNA, 3000 bp, Unknown
  misc_feature (1)..( 3000): 2750-1469P.txt file - cDNA_ID_2152804; gDNA_ID_2926185; Annot_ID_200567
cgatgaactttcagttctttgcgatgctgatgttgctctcatcatcttctctgccaccggaaagctcttcgagttctccagctcaaggtatattctatctttttgttagtagttgtcttatttttttcaatccatgtttgtgtttttgagaatatggttggataaatatattaagatatgtatttaaatgagatttttattttctcgtttactctctaaagttaattatcagtaggctcggagatctcatgtacggcataatttgatgacctaaattattatactttaaagtataggattgatgttttattacttttatgtataacacatcatgtatttaattccgtttaacataatatgggtttttaacgtgtaatttttcaatcattttcatttagactcatggttaagatttctgtactgggaaataagagagcagaatattatagtgtgatttttgttaattaggaaagcatatgtatatatggatacatagtacttaccacaattagaatgaatttcttttcccttttttcatttgactttgtgtattacaaaagtctttgacactgtcacttggtatgattggggattaattcttaaccactcgtttagtttatcttgggaagcattaccataattgggaaacgagtcatctgtctgtatcgtgatggctacttctgattacttttcttttattataaccaaaaaggcttctaatgtacttaattaattttacaaatgtaatatggacgaaggaaatgtttataagaaagatggattgtttgttgaaacgtgtagaatgagagacatattgggaaggtatagtcttcatgcaagtaacatcaacaaattgatggatccaccttctactcatctccgggtattttcgatatcacttactcttttttttttttgtggattttaaactctctgctctttttaccaaacccttctctttttatcaaacccttctctctataatattatccgatgttcactttgttacacgtgtttgttataatttttagctgtaagtctaaatatagaaacattgagtggcatataatcattaatcttgaagcatctaattaattggttttacatattaatagcagaatcctgaaactgttgactttgcatctagcagcttgagaattgtaacctctccagactaagtaaggaagtcgaagacaaaaccaagcagctacggtatggctccattgatatgttatgcagataaacctattttcatataggctatagctgtaagagatcatctatttcatgtgtgtggtttttttttttatgttttttcaatgatgtgtgcatgctatttttaggttttagaatctatttcatggaaattgaagatatttcatttcacgtgtaagttcgtcaagttgtggcgtgtgtcttggaaattgatgttttgtttgtagattttaagagctacttctaaaatttacaagagttttgtaattttcaattatggcccattattctcattaattcattaaaaaaattatatacattactatctatatctagcataggtagttttttttttctttttctttggtagacctactgaacaaatatctgatatatcactgactggataaatatctatagagatatttttgatagaaatgagtgttaatttaacgtaaaacaggaaactgagaggagaggatcttgatggattgaacttagaagagttgcagcggctggagaaactacttgaatccggacttagccgtgtgtctgaaaagaaggtttactactatacataaactaatagcatgcatattttccttaacgtggcatataaataataagctgtacatatataaaagtttgactttgttgttgttattggtaaatagggcgagtgtgtgatgagccaaattttctcacttgagaaacgggttagtagttagtacatacaattcgtataactaatggatcataagcctatctatagctagtgactttcttaataagtgaaacagggatcggaattggtggatgagaataagagactgagggataaagtacggctctaaacccttatagatatcatggaataaccttaatctatttttttatgtataagaaaatatgatgagggaacgtatattatatatcggcagctagagacgttggaaagggcaaaactgacgacgcttaaagaggctttggagacagagtcggtgaccacaaatgtgtcaagctacgacagtggaactccccttgaggatgactccgacacttccctgaagcttgggtataatttgtttaactgaacatatttcaaactttttgttgacattttgtatgtggatgtttactaactgtttgttggttaggcttccatcttgggaatgaatctgagagagagaaagatccagcagagttgacttcgatggaagcccacaaatattaagtctaccttttccctttcttttctttgaataagtgttgaaaaagaattgagatgggaaggatgaattctcattgcattgcagagaagcaagtttcagatattgtacgtgttattggtctttataactattttgcaccaaagggattcttcacatcacggacaaataataattttaacactaatgaaacaagtaaatatagtgaaacgataggttttctatagtgattctttacattaacaacaatgaaacaataaatataatattggagaggggtgtgaaagaacaaatatgttaattaatttctacaaatgttttcacctcctttctcgattcatataaaacaaaggtaagtctttgttccttaccttcactctctagaaaagatttttttggccaaaaatatgtattcacgcaatcagcagaacaaaaacctcggaagatcacgtccaacgaaggacctttaggcttaggggtaacgtcatgtcttccacttttgagcaaccttgcaaaccatcaacgaagtctttcatgtgcattttattcaacaatg

SEQ ID NO: 23793 - DNA, 3000 bp, Unknown; identical to SEQ ID NO: 2230
  misc_feature (1)..( 3000): 2750-1469P.txt file - cDNA_ID_2152817; gDNA_ID_1620508; Annot_ID_159043

SEQ ID NO: 23794 - DNA, 3000 bp, Unknown; identical to SEQ ID NO: 2233
  misc_feature (1)..( 3000): 2750-1469P.txt file - cDNA_ID_2152837; gDNA_ID_1620508; Annot_ID_159046

SEQ ID NO: 23795 - DNA, 3003 bp, Unknown
  misc_feature (1)..( 3003): 2750-1469P.txt file - cDNA_ID_2152915; gDNA_ID_1620509; Annot_ID_159068
aaaaggcggtcgcttacctacatttactgcaaaacaatctaaaatgttgaagggatcatatgatttcattggcagaaattattactcatcttcttacgctaaggatgttccttgctcaagcgaaaacgttacattattctctgatccttgtgctagcgtcacaggtgaaagagaaggagtgcctatcggtccaaaggcagcatcagattggcttttgatatatccaaaaggaattcgtgatctccttctctatgcaaaatacaagttcaaggatcctgtcatgtacataaccgaaaatggtagagatgaagctagtaccggtaaaatcgaccttaaagatagtgagaggatcgattactacgctcaacatttgaagatggttcaagacgctatatcaattggagccaatgttaagggattctttgcatggtctttgctagataactttgaatgggcaacgggctacgcagtccgatttggactagtttacgtagatttcaacggtggacgtaagagatatcccaaaaaatcggcaaaatggtttaaaaagttattaaatgaaaagaaaaagaattgatgagacacgcatcattacattgcaacaaacatatgatgtccactaatggttttgtatgaacgttaagcgtgactaacttttttataacacatccaatagagtaaaaatatatccgttaaattagaataatgacatttcttatgctactttcaaagagatgcatgaaatgttttatcgattgttaatttttttttccaaagtaatgtaggtgttagtttcttaaaccaaacctgaaaaattgaatttaaaatacttcaaattatctaaaatttcccacaaaattccatactatcaaagaatacaaattagcttaactcatttacgaattacgatcgtaacattacttagtgaaattctagtagtaaattactttactagcttagtgaaaattctatatccaataccaactcgctattcaaattcaatataaatattgtatcatgttaattgctaataaaatgtcatatattataagatttctatattattgagaaatatacacatttctaaaaactaaatcaaattcaaggaacagtttgtgcatcgaagtactaaaccaagatgcgatttcttatcaacatctatgtactagaatctagtctactaaagaaaaaattcatacaattaaattgtctaaaccaaatgggtaagaactcattattaactgggactgtaatgaagcaaaactttttaataacgaaattaaagatggccaagctcgatccattaactgtgtaacttccaaagtaaagattgttattgacacaaacactaactgacttatggataccccaccataatcaacctccttccattgatgttgccccatttttaacatctcatagaaaaatcgtcatgttcttcttcttggcaaacaattcatattttatagcttaaagagtaatcaaatcctaagaaaaaaatagaaagattatttgatttaatttctttgcaggggctatgtttcactaacctttaataaaaatgaccaaaaataatgaaccaagataaacgaatgtaggtgagaatttaatcaaacgattatagtaaattagattagttctccatatttaaactgttgacttccaaagaatatacaagctttactctgcactcacaattggttacaatgttttacagattatgaaagtaatattatttaactattacatatttatgtggtagttggtagaatataaaattaagccatatggtagtaaaaaaattagataaaaaaattaaattatagataatatgaattttacttttgtgcaaaaaataaacaaaaagtattcttcaataaaacaaacataaaataaaataaagtagtgatgctcattattcctctattttcttggaatgggcaagcaaagatcttctacttggcaaggagagagatgtattcccccaaataccaatgaactccaaatccacacatctctagatgcatgtattaagagaatggaatcaaaatccttgggttatgccaataatatgttgaacaatctacacttgagttgatgcaatggatatgaatagtcctgatctccgtagacaagcacaatgttgcatcgtggttgttgattgttattcattccgaagcaaaacatatgattaatattgatacaatggtttacaaaattatgaccaaaatatttttatgtaccgactccttcttacctagaaaaaaagaatgataccaatataaattgaacaaaaagtatatgaataaatccaataaaaaaaatacagaataaaccaattgggacatgaagagtataaactctactcgcataagcattaatattgtatcatgatcgagtttaaatattaaatattatgtatatgatcaaaaattaaatattatgtattatagcaataaaagattaattacacagtttatgaatcgagtttgacttagtgaaaagtttagctttattactatcccagttaataattcgtaccaattcgatttaggcaatttaattgtatgaattctatagagaccatattttattgttacttttacacaaattaagatttaaactttttttttttttatatatctttcatcgaatggaagtctctcttccgtaggtaatgtggacattggggtttatttttctggcaatacaaaacacacaacactaaagcccacagtgtttgaagcaggcccaataagaagctctcttcaaatttttagactcttgcgtgtccgctagtatcacgactggatatgtgataacacacgtagacgaacctgaagcaatcactcaaactcaagacttctctttaatcctcctcccaaaaatctcagagaatcctccttcaattccaattcaaagctccttccttttttcacatctctcttcttcaaattcaatcatcataaaaatcgaatctttattcttcagagagcttcaatg

SEQ ID NO: 23796 - DNA, 3003 bp, Unknown
  misc_feature (1)..( 3003): 2750-1469P.txt file - cDNA_ID_2152928; gDNA_ID_1620509; Annot_ID_159072
gttatcaatcatgttccaatagagacaagggggtgtctcaatgggaggaagcaaaggttccatgtctttctaagaccttctcattacacaaacgattaggaaagatcaaaacacatttcagtggaagaagaatgataatagagaatctttttaaccaaccaatctatttcattacgagcaatcatatcttctttgtactaaaggagcctcaacatatctatctatgcttaggatactgtggaacaaaatcaaaatccttaaaagcttcaattttgtataacaatggattttgatgggtccaactaaagctttagagttctacttttcacaggtctgcaactaactacaacctctgaatttgctaaagtttctgaaaaaccaaaaactttaaggaaacacattggtcagctattcacttatggcgtctcttaaggtttagcaactaggctattccaaaacattataattaaaggtttggattctccttaagggtttacttactacaaaatcaaacaataacaagcttcagtttttaataacaatggcttttcaaggttccaaaattccaattaaatctccaaattctgcaatcacagggtccacaactaacaacaacatctcaattccgcaaaatcttcagaaaaatcaaaatcttaagccaaaaataaagctccatactcaaacaaatcacataccacaaaaaccgaaagataatcaatcgtaatcgcaaacaataagaaagatgtaaaacctagttgtagtaaagctcaagacccatgccgtcatggatctcatagtccttgagagtgatgtgatccttgtagatgttgtaccacttctgaattctgatcttctcggctcgtgttccggtttgtgccgcgacaagcttcttcagatcaccgatcgtgtcatcatcgttacacttcaccctaacttttttccctaaacgatcgttgagaaccacctcgatcatcttcttcgctcgaaaactacaattgcgaaccctagcccccaattttctattcctccggaaaagtaaagtacgggaagattctacgcgttaaggctcgttgtgacttttatttataaacttttttttggtcgtacttatgtcggtttgagaattggtaatagatttatttaatttctagaaccttatctatattttaatagattttacctttttttttgtcggctaatagattttactttaattttgtgaattatcaattttggcttcctattttctccatatatagactttgtattaaaattatttttttgtttatatttgaaagtttgtgcaaaaaaaaaaaagtttatatttgaaaccttattattaaaaccttgtgattgtgatttttttaatttttttatcatcttgaattctctcagcaaacttaaaaataacaacaattttatcctatcaaagaaagagccgacctctcaaaataagatacatcttaattgtgattattgatgctagcaaactcaaaaataacaacaattttatcctatcaagaaaagagccgacctctcaaaagtaacaaaagcaaaaaccaaaaatttacatagtgtctgattggtaaccaaaagctgtacaagttttttagctgttagctttatttgaatagtgcaaagctgttagaaagagttgtacaaaaaagctgagagtaaactttttataacacttttaataaagtttttgttattggtaactgtgaaagttgtacaaaattatataaagctgtattgtgttaccattcaaactcataatctgatatgtaaaattacaataaatatgccaccaatttacgtctaaataaaattctacaaaacgctatcaaatcactaccaaatatgcaaatcaaagacaaggagcgaagcttaactactcgaaaaaaatctgtctcacgaacaagaacaccatcaaatcgaaccaactatcattcaccgccatatcaactccggataggaaaacatgtaaactttaacatcgacttgagacaaatcaaaacaactagaacaatctagaggaaaattgaagttgaaccaagaaaaaaagtgctaacataaagatgaaagcttgacggatactaacgagagatcacctcgaaaaatatggtctattttttcaagaaagatggtgttgttgtatgaaaatacgggagctatttgacttcttgtgtatatccacttactttgaaccgtatcacaggtttaaaagtaataattcgtaagtttgaaaaaaaaaatctcatttagctaacattaaagaaaatttaaacgttgatttaaaacgctttaacatgtttccataaattggattaacaaaaattgcaacgttttcaaaacagatcgacgacgttttaaaaaaaaacaagattttatttaaacctttcaatttttgtataaattaagtataacatcaatataaattataggattaacttttcatcgttaattttttttttaaaaacataaatatcataatgtcattaaaaagtaaaaatatctaaaaattcattggtttaaaattataaaaaaatatttcatatataaaatgaaaattattaaataattaaacaagaattatttttaaatatatgtaataactctataaaatcaagaaaaaagaaaagaaaacaaaaaaactataaaatcaattttctcggaacaaaagatgtagttacataggatcagaacaagggaaagatattgatcaacccgtgtagaatatacaatatggttaactcttacaatcacttaatcggttttaccattacaaattttaaacacataaattattatcctctgagaagttggcgtgtgtgctcaaaaaggaaataaacaaaaattgcagaaattactgaactagagatagaatgaaacaataacaacaaccacaaacgaaacagctaaagaaaacgataattaaaaaaaaaaaaaaaaagcttacgaacgccattggagaagagcacgaaaaagaagaagaagactatg

SEQ ID NO: 23797 - DNA, 3003 bp, Unknown
  misc_feature (1)..( 3003): 2750-1469P.txt file - cDNA_ID_2152950; gDNA_ID_1620509; Annot_ID_159063
tggggtcatgatttgggccatgacttacatgatctcacacacaacaaagaaaaaaggtagtattcgcaaatcgcaacaaactgcacaaaaatggtaaagatggtgtctacaacagcgaattggccaactttctctacatatataaagtaatttgtcataattcaacatttgttttgttttttctctttctttcatatctcgtaattacaatcataaaacaagtaagttagcagagtgtgctagggttatcttgatgatggtatttatgatatttttgttcataaccttttaacttttttgtagctaaagaaagaattaagtttcaagattgaaaatgttaaattaacactaatttgcataccataactttgtaatttcatgattggatgtcagattcaaaattttaaaattaatatagtttaaatttttgattaccaaaataaataaatataatagtaaatccttaaaaagttaaagcagatgaatcattttaacttacaactatttaaatcttctaattcatttcaaattttctttagttatcttggaaaaaagatttactaggtatagaaaagaaatattttttcacaaatgttcaaaagttatcaatacattttataatcaaaggtaaccaaatcaatacatttaattactgtatttaaatccgtaaaataatgaatcatttcaacttaaaactattaaattcttcttctttttttcatgggcttttaatttgtgctcaaaattacaactattaggttcttcaaaatttaattcaaattttcattattaatcttggaaaatcaatttactatgtagaaaataataaatattttctcacaaatattcaaatttatcaatacatttagtaatcaaaggtaacaaaatcaatacttttttactattaattataagaaaattaattgaaagattcttatgttttcaacctatgacagatttttgaattatttttttacatgtgttgtgtagttaagagtattgggaggttgtaaaacaatatgaatgttaaaataaatattggaagatatttgcatatttgtatttctcttctttacattacatttcttagtagaatcttgtgaaattactagtttctgctttcagggtaagtccaaatccgtaatttggctaatcgtgtgtatatatatatcggccactgatggccaagtaatactactaacaaaaagaaaaatcttatacaaagttatcaaaaagataatcatagaaatggctatcaccaaaaatatgcttgtcgtattacttctcactattatttttgtcacatcgtcggttcattgttctgatagcgctcttggtacaatcttattatactctcattttatatttttattttttgttataaacatagtttaatcctttagatgattataatgatctgtttaaataggaattggaatcaaggaagattgggaagtatgcttcagcatagacccgtgtttgactggagaagggaccctaggatgcacgaagtggtgtagaaaccacataaatctttcattagttggttattgtcgtactgatcctgaacactgttgctgtgtggctgaaaaataatctaaacgaaagattaaaattttctataaaataataatatcactagtttcatctccaaagatttgtgaatttattagtttttcttctccttaatttgatttatctccaaagattaatcgtttctcactggtctagtgtctagtgtctacatatatcgaagtcataatacaccaatcgtaccaaatcaaagttttgaaaaaaagaaactcgagcgaattttgcatgcaaaataagtatagtgtataatcttgtttttttgttaacgtatacagtaaaaatctgtttaatgaaaaactgaattgtacatgtatcaatttgatcactaaaaagtaaaaacatacaacaaaagaaaaattggtaataacattagagagagtaaggaaaaaacacaatcgttgcatccatctaaccagattgaaacccaaaagtttaggaaatttggttttgtaccggtttgggaaagaacggttaccgcccagtttatcaggttgccatgacgatatctgacgctgtcgatgtgcttagttggggcgactaactttctaggagacttgtggtagattgatttgaagacggaaatcggtctttttcgtcgaaatttctaaattatcggttgcggccacgaaacggtaggtcttgagcccgccgaatctaatgtccggtcactcagccagcatctatgaacaagcagcgatcttcttatatttatcggcatgtttttctgattttcttattttgtaattggatctgattttgatgttggttacggccaaactccttaaattgaattttaataaaaattatgaaaaagagacacattagagtaaattgaaccgaaccgatttgaaccgaagcggacttaaccaagaagaagcaggcgcgtcacttgttttcactcccaatatcgaattgaagaagataagagtagactagagtcttcttggttgtgatattcttttccaatttcgtaattttaggtaccttttgctcttgttgctcttgtagattttgtttaatgggtatctcaaagattcatgctttacttgttaaatttctgggtttgggttcttataaccaattagctgatttttgaactgttttagaacttagatcttactcttagaggatagagacataaagaatctccattgtttgatatatcacttacgttgtcttcttgtctcattgattcgagcattgtagtcttttagttgccaaatgcaattgtgaaaatgtacaaaactgttcttgtttcatatctgcagtaaaattgtttttggtatttggtgttctgtagatttctcttgtttatgtctttcatgtttgtttaaattgggtttataaatgttttgtggataattcatttgacataataatgggtatgtttcagaaaagctgtagaagatg

SEQ ID NO: 23798 - DNA, 1845 bp, Unknown; identical to SEQ ID NO: 2255
  misc_feature (1)..( 1845): 2750-1469P.txt file - cDNA_ID_2153039; gDNA_ID_1620512; Annot_ID_159132

SEQ ID NO: 23799 - DNA, 3003 bp, Unknown
  misc_feature (1)..( 3003): 2750-1469P.txt file - cDNA_ID_2153043; gDNA_ID_1620512; Annot_ID_159133
cttgagtttttcgtcttttcgagtttgtttaattaatgaaactttctgcagattctcattgctaacagagatacaaaatcaaatcttagtaagaaaaggtaaaagctttgaatttttctgcattaaggattggcatgcaagctttgtctcctaagcttttcaattctcgcaggggatggtggacaccgatgtttttaactgcgggtttagcatctgcaaagtattttctaaagcatgtctctaggcagaacactctaacacaagctcgtagaaacatttctcgtcactatgaccttgtatgtagcttgaggccctgagcctccatctctcttatatctctgtttcctttttgtttgagttcataatcaaattctctgtttggttaattcacagagcaacgagcttttcggtttcttcttggatgataccatgacttactcctctgcagtattcaaggtgaccatgaaatgtttttagggaatttttttttttttttttggtttctctgacttgactatgattctgacttcaaccattcacaatgatcatagtcggatgatgaggatctgagaactgcacagatgagaaaaatctcgcttctgattgataaggtaaagcattttcttgatttagaacaacaacttgtggttttttatctcttcttgaataaccgaagagggacatttcaggcgagaatagagaaggaccacgaggttttagagataggatgtggatggggaactttggccatagaagttgtgagaagaactggatgcaaatacaccgggattacgctatctattgaacagcttaaatatgctgaagaaaaagtgaaagaagctggacttcaggtttacataatccatttcttgatctgctttcttatctccaaggctatgtatgactaactatataacttctgaatgataggactggattacttttgagctccgcgattatcgccaactatctgatgctcagaaatatgacagaattatatcttggtaaagaaaactctcattttccctctgttaatatggctctgtagttaatctatcttataagatgacatttttgaacattttagcgagatgctagaagcggtcggacatgagttcatggagatgtttttcagtcgatgtgaagccgcacttgcagaaaatggcctaatagtcttgcaggtaatatatagctcttccttatttctcttccgagacattatcaaaacatttcataatcatttgagcctttttatgatgttttgactgtaacagttcatatcgatacccgaagagcgttacaatgagtacagactaagttcagatttcattaaagaatacatattccctggtggatgccttccttctttagccagagtcactacagccatgtcctcttcttctaggctatggtaaaaatgtttgtgtataaccttttccgcaatctctttgttaaatcaatctaacacttaagttaatacagcatcgaacatgttgagaacattgggattcattactaccaaacattgagattgtggaggaagaacttcttggcgagacagaagtaagataaaaaaaatatttaaagcatttcctctgtttttgttctgtttactcatattttcaacataactattattggtgcagacaaatcatggctcttggatttgatgacaaattcgtaaggacgtgggaatattattttgattattgcgcagctggattcaagactcttactcttggaaactaccaggtaataacattgacatagaccattaaaaataacgcatgattctttagtttcatgcaatcaaatgtgaggttttgacaactttgagtacaatacattgcagttggtgttctcgcgtccagggaacgtagctgcatttgcggattcatacagaggattcccttctgcttattgtgtcacctgagaggcatccacaacgtttgattgcttatatttttcgatctatacaatgtttgattgacctgaaatactagtattgattattgatttgtttggtgtgccaatttgtgaaagtttgttgaataaaagagagatttactttggaaaaaaataagcagtactcgtggagctttatgaccaattcatacactccatgcacaatcttgtatgcgaaacctttttgatattctatctgccaaaggattcactgtcaagtatttatctactccaatctttacaatagtagcattagttaactataaaattgccaaaagctatagctcacctaaagtatacagataatatatttgtgacttgatatttgttgacagcagtgatcaacaacaaaccatatatatagtagtaattaataatgaggagaagctcctctattaatttttgatgttctttaaaatactccttgatgaccaaaaaagagaatcaagggtattttatgattttcaaaagatttgtttttgcaaaaaattattgaccggagtaattattctgaaacaaaaaaaaatatatattttttctgccaaaagaaaaatattttaaaatattttttttgagattttctaattaaaaattcttcatagtagagaacatataataaaataaagttttgtttaaaaaaaaatagattttaagaatatagactcaaataaatgcgtcaataaatgtcaagaagtggcaaaaatgtaggtaacttacaaattttaaatcactaacagaaatctcaaaaaaataaaaacaataaacaaacaaaatccgttctaaaactttcttcttcttctctctttcccttcgtatcttcttcttcttcttcaacctctcgatctcactgatttttctcttcaacaactcgatcttcccttcctatttttcaattggggtcttgcaaacgaatatctgctttgaaattgaacgaaattatttagttttggtggtttttcttcgacttcaccaatctgttgaactcaaggagaatatatgagataacatcagtcttcatttctgtgagtttctataatg

SEQ ID NO: 23800 - DNA, 3003 bp, Unknown
  misc_feature (1)..( 3003): 2750-1469P.txt file - cDNA_ID_2153058; gDNA_ID_1620512; Annot_ID_159139
aaatgatttgttttgtgaatagttgattccagctaatgtggtgaaagacaatcatcttacgtttggtgattgtatcaactacattgatgaagaagggaacttagtaggacaaagagggaataagcagatgataggatttgcttcaaaggatgcatggcgacataatttgcagaaggattagacataataacatgaagatactgtcaagtatgagctccttcatgaacttaagtacgttcataattccacttgatccacaactttgggctattggtataaaaagctaactttatctagattacatgctacatctcaattcaagatgtccatttattaaagcaaaggcatgactttatcttcgactagaaactggtgatggaccatcctcaacctccactagcatcatctccacctactcctaaccactaacccaattatccttttcaccttttcctctcaacactatcctatttttaggtgatttagggaaaagagaaatactacactttgatgtaattttttttttaattgaattgagctttgaatactatggttaatatggatgaaagaaaacacacgttcctactaatttctttttctaaatgatgacgttttctcaagttacttatcgtagtctaatcggttattgacaaaaatgatctagacgtttgaaaatcattggccaacctcttcactagatagaatttttatttctaaccattacctacctgatacacacaccaagttctgaatctagagatgatcttgtctcatttgtttatagactaaagagtatataaaagctggattcatgtgggtcatccatcattaatcgtgttcttcaattcaccaacttcgtaggttccgcatcttttgtactttctttctatttttaatcttgcaatatcaaaaataaatatatacaccttttaaaaaaattctgaatatgcatatggtaatggtatcatcagaaaacattgaatattgaatcgtctatctaccaatctcttcaagttgtgaattttatttatcaaaaaaaaaaaaaaaatcaactgaaacgtcaatgttatgttttgcttcaatctaaagaaagttgtaccaaaaataaagtacttttttaccaagaaatttcggattgtagccaaaatatgtcttgttttattttttttgttcaccaaaaatatgttaaactagttttttgactttttcccccatgcgttgttgttgttattcggacgaccaatatttaatacagtattcaagtgtagctaagctactgattccagataaagtaaaaaaatgtctttgataccaacttcactttgaccaattatcgaactctttaatttcataatatatagctttgacaaatatcccatcagaattcataaatcgccacatgaatcttataattgtcaactatgtgcagtccaatattaatatcatggaaaactagattactagcatttaatttcttaattgtatttaggttatagacttaacatggtttttcttctagagcattttcactacatttttttctttctatgttattattttatgttttacttattgttacatccatttacaacgatgttggataaaatatttttaactgttcagtccgtaaatgactagctaaatttttacggatatatttttacataaaaaaagaaattatttttacgatttaccaatttaactcttctttctctctaagttttcatttattaaaaatgatagtttttttaagaaagttatttgtatttatttatttaaaattggatgcaaaaaattacaaaacttggaagaaatattgttaacccatctttatcagtatagaatttctgattactccctgcgttgaaaataagaagatccatagaacgtggtaatgtttttttttttttttttctggcaagaaatggtaatgttaatcaattagactcatgactaaagctggaaaatttgactaaaatggtattatcttgcattattacctaaaagctcttcttgcattactctttcatgcaaaattgcctccaaaagtcatacttcgaaatcatggctttgtaactcacccttgccaccatctatctaaacttattattgtttaaaacaaaattgattttcaaagaaaaaaaaaatataaactcccaccggtcaataacttttaattttcacttcaattattcataaaataaatatatacaccttgattctttcttaataactggagttattttgaatttaaattacttttgaaatacaaaagaaagtaagataattttgccatttaaaatgtctacaacaattatgttaacacttaacatacatttttagaaccaaatggtaatggtccactagttaaaagatttcttatgaatgtctttttatgcagagttcgaattttctcacaacgattttaaccattttcgtcactcgcaaaatttttagtggataacaaaaaaaaaaaaaagttgaaatttaatggaaatttaggagatttgtccaatttttaattttcccgattaatttaaaaaatctactttacgccttttattgacaaagatgcatattaactatatatatatatatatatatatatatatatatatatatatattataaactaaattttgtagaacccatcagaagaaatttgtacttttaactttaaaatcaattaaaaaatttcaattcaaataaaaaaaaatccaaaattgtttataaattcaagaaatataacacacaagttgacataaacagtggagagatttgtgaaatgtgaactcttttgacgtctttctcatatttcgtctcgggacaattcacacgcactgaatcatctctctcacgaggactattcagccatttgcaaacgcacacacaaacgcacacgcgtttatttttttttcgccaaatcaaatctgaagagttcctgtatcttttaaccgctcttcttcttcttcagagagcttcgttgattgaacggaaaaaatg

SEQ ID NO: 23801 - DNA, 3003 bp, Unknown
  misc_feature (1)..( 3003): 2750-1469P.txt file - cDNA_ID_2153093; gDNA_ID_1620512; Annot_ID_159154
tggtcaacatattagcagtacaaaaaattttgatctgaccagagtcgcaagatattttagataataattgaagttcgagactaaaccgagttggactgtcccaattaacacccctagataatgaacacatctcaactaattgtcgggtctttggatcatgcgtttgtttaatcactttcacaagtaaagatgtgtaggacatagaaagaacttaaactaaacagttgtgtatctgttccttctacttcatttggttgatgtttcataatgcgacgcataaactaatataataatatatggatatgtaatcctcatgcagctgttacgcattggtgccggtagtggtcgggctattgagtaccattattttttaatattatgacagttttagcatttgagttgtactaatagtcttatataggtttaaaaaaaaaaagagtatattgtttttctaatctttgataatatttacttatacacaataaagttaatgccttgtaatccaataattgtagtcattcaataaagttataagtgcatccgtatactctatcaatcaatcacaagtcacacacgtacgtgtcacgtttaaaagtgtcaaacccaaattatagatacacaaaatactacatacataataataaatttcgtagacttttagggcaagtttagactttagcgggtaatagactatgagatcttaaggatattatgtcgttgaaatttgcaaagaaataataacacatttgtataattcaagtttaagagatttttacaaggccaactccaatgattacacagtacactattctccaatctttaaaaaatggcgaagattggtaaaaaaaactgagtaaacaaaaaaagtaagatcaaaactaacaagattaaaaaacgattaaaaaaagattaagagttatgagtaatcatcggaagaaagaagcatagtgatgcaaattctgatgatatgaagctttgctctttgttgcctcactgtcctcttcatcttctccaacctctctttcatcttttccatcaactgactcatcaattttccagatatgttggataccaacatggcaacacatcattatacacacgcatacctttatatacatgcaaacacttacacgtacgaacaaaggaagaagcgacaatcccacacctatacacttgagttcaacctccaacactacatatacaaagtgtccaccatgaaactctgtcggaatcctacgtgataaagatacttatgtgtgtgcttatgggttatatatgatttacaccatacagttttgtgtttgtgggtggatgtacaattatacatagaaaaagctagctaggtagttactaatcttatttatatatataaaagatgacgaaatgttttgcaatctttgacatcatcacttctttaaatgatatatcaataaataatcatactgtatattcttttatttttcttgttaataaggaagttctaggtcttgatcccactttttttttttgttaataagaaagttctaggtcttgatcccacttttttttttttttgttaatgagaaagttctaggtgtattttatcccaaaatctcattcgatttgggaccaacttttgctaatatcattagagcgaaaccattactttcaagtgagactcgaacttgggacaactttcctcctaaggcagttcttgaatccaagttaactatccctatttattttatttaataataaatgtgggatatgaaaataatatggattggcgcatggatggagagggtccacttgtaggttggagagtgaagcaagttcacgtgctgatcatcgtcatgcaactctttgaatatttgcataaatacacgttcttaaactcatcctccatgttctctcactctacttttgtcctcctccactaacttgtcatttcttaactttttcaattttggtttgattatctcaattaattaacattatctattgtaaatgtcttatcatctttttttcttcatgtaatgctatataatcagtattgtctacaatctacgttacaccttccatttttgtatgctattcacgttaatttgtaaactgaattagtatatcgattgagatacatataggtaaaatatggccaaggaaaataagaaatcatttaaccaaaaataatacaattatacgaataataaattaaataaatcataacaatgataacaaagagacaaaaaacaaaaactaaatagtgatagcaaaggacaactaccttttctgtttatgacttatcttcaacaattagcttcaatattggttttattagccctacaagctgtccgtttcatatcaaacatataatcttcttgtcttccaaaatctgcttttaaacagcactgcctctctaattaattaatctagcttcaccacaaatttcttttagttctggtaaagttttcatcaatataattattctatgtatatcacataatttatatttgattaattaaaagcatgtatttgcgtttaaattggggatattgtaatggactacaagtatgtgctaatttttaacattaaaacctaagaaaaaagaagatatactaattgatatgtatgagatcatataataatatatgatgggtcgtatcttgagaccaactagtaaatcaggaccattttagaattagaattatcttgctccgccattatatgcgaataatcacagtcgaaccatatgcattatatcctcagctaaaatttagtactaaaaggttcatgatttgcgaagctttgttcacttggagagctggagtatattatcataattctctttaacttagcttattggtgtttattacagtcgcattatctctaaccacatatgataatagagaacaacataacttctagtagtaattaagcactttttatcaaattaaaagttaacactacaaataaaataaaccattgaaaataaaatagagctaaagtgtcaacagttaatcaatg

SEQ ID NO: 23802 - DNA, 3000 bp, Unknown; identical to SEQ ID NO: 2258
  misc_feature (1)..( 3000): 2750-1469P.txt file - cDNA_ID_2153103; gDNA_ID_1620512; Annot_ID_159157

SEQ ID NO: 23803 - DNA, 3003 bp, Unknown
  misc_feature (1)..( 3003): 2750-1469P.txt file - cDNA_ID_2153107; gDNA_ID_1620512; Annot_ID_159158
ttagtaaatcccattgcatatcaaggccacacttcagagacaacaataaaagatgcattcattttatagacaaaaaagtactacacaaaagatttagaatccaggcgttgcaactaatgcaaattgaactgcacaaccaaacttgaagaactaattcagagccttgcgcaccaacgatttataattacgtcgcagtaatacctgatcaagtgcagaagcaaaaaggtctagaacatgaccctgagtgactagttgctttgcgatgctatcataaaacttgacagccttcttatagtacggagcggcatctttatctaaatctttgtgagaacgcacaggatccgacaaatcctttgagacaatctgtacaaaagagattacaaatatgcttcatacacatggtgtgatcaaagctcacaatgccaacaatcatcaacatatacttaccgttccagggccttccgtacatggacctccgatcaaagctacaattctagccccagttccaggcaagcaagctccaagcaatcctgcagctacactcaatgccacgcctgtacatcgttgggaccgatgacctggcttaacaggccactgatcactttgtagctcatccaaaagctacataccaaacatcattcacacaaagatagaagaatcagatgaaaattttccgacttgacaatcaaaagcaaagtcactcaccgagttgagtgtgaattcgcactcggaagcaggcaacaagaatctattcaaaccagaactcgggaagccattttgaggtcctttagaacctcctctcctagaagaaccaccaagccccaactgatccaaaatctgatctttcgaaatctctttatctcctttaaaaacaaaaactttagacatctcagagaatcccaattcatgtacatgagcctgagtaccaaacgacacaaatccaaccaaagcattctccggaagcaacccaatcgcttgtttaagcgccgatttagcaaaatccaattcttcttcaatcatacaagtatcaagaacaaacacaaacaccggcggatccaccagaccttccccgttggctacaggcggaggaagagtgtattcaacagtagtgtactgaggataaagctcaccaggaagattagtctcagagatcacatgataatgaggcgggaaatgattacgctgataacaaaacggacagatccaaagctttgcggtgaaatcgacttgtgcgtaagcgtttaacgcagcggaacaagtccggcatcggagcggtgcgtaaggaagagtagggatatcggcatgtcgccggatcggagaaatgcaagcggcgagtgggatcacgcatttgctagcttcagctttggaatgaggccagacgttccatgtcatacgaactccatcgattccttctagatctgtattcgcagtctccgccattcgttggaagcttttagatcagatcagagaatttgagttttttttttttttttccttaatgaagaaattgaaaaatctcaaaattctttggcgttattttttaggaactctaacgttgactgagtatcaaatatttctatttttgtgtgtctatactcatttcattttagttaggatcgaactgagatcgtagaaattgaaatggtaagtctaattactgatttgtattcctaagctcaaacttgagttttttttttctaaaataatttttcaaaactttgctcccatgatcatctttagccagtttcaccaacttatcttcatcacacttcacaatctccttcgagaagatccccaaagccaccaccgacttaccgtcaccgagaagcttctccacaacgtttctcccatgtttatgatacgaaagctcgatgcaatgccattgaagcatacatgcgatggtgtccgtaatacgctcgttggaccaatgtgtttcccacttcccagtgtttcctttgaaagggagagagatttagtttttggatttcatacttcacttgagaataaggtcttcttttcttgaaaacttgtatgaaatataacacgatgagataaccgaatttatcggttctaatatcggtgagcctttgcttaattgcttccaagaatgttgtgtcgacttcttctgattttcctaggattatttgaatcatgcatgagtgagcctcgcatggttttggtaaagtcgataaaaagatcagaatctgatgccaacttggaggcaatcctatggagctctactatgttggaacgcgagagaatgtcatcaaacttagccattatctcgtgcaagtgtggtcatgtgtgatttttcgtgtaaaatcgagcttaagcacatgttggatcaatgaacttcctaataagagagcgttctttgcgattaggtcaaggaagtaacctttgaagcgatcttcagctattgatatgactcttttgagtacacagcaaccgaatacgtcacccgctaagtcaaggattatttgaatcatgagcgagcctcgcatgatttcaacataataaccatgatttcaatacaattatgaattaaagtgatatatttttgtagtctacaaaattatggttattattgtaatacaacacaataaccatgatttgaatcgactgtttaaatttggagtttaccttcattgggcttcgtttataagcccaacccaacacaatctaaaacctcacgtgccacgtgggataaaaatatcctaagaataaataactcaaacggtcgaacaaaatcatgggccctaatttgatcttatccgttagatctatcatctcacgatcaacggagaatagatgaataaacatgtgaatgcgttctcgatctagaaattcaaaattctcgccattaacggctctctctcaaactctcaaactctctctctctcttcccttcttcttcgttactttgcccgaaacactgactgttgcagaagcagatttaattcttctttagggaatcttcgaattggttagcgcagagagatg

SEQ ID NO: 23804 - DNA, 3000 bp, Unknown; identical to SEQ ID NO: 2282
  misc_feature (1)..( 3000): 2750-1469P.txt file - cDNA_ID_2153146; gDNA_ID_1620515; Annot_ID_159242

SEQ ID NO: 23805 - DNA, 3003 bp, Unknown
  misc_feature (1)..( 3003): 2750-1469P.txt file - cDNA_ID_2153183; gDNA_ID_1620515; Annot_ID_159253
caggagcttattcttcttcccattcaacatcttcttcttcttcttcctgactcatctgtcctctcagttcccctactacatcagccactccttccctgatcatccatagagggaggttttccactctaggatcttcatcttccctggtcggattcaatcttgcccgattcaatcttgtccgattcaatcttgtctttctaaaacgtgcttcggctgaagcgaaaaaactagcagacgatattgaagaagatgaagatgatgcaggagcgcttgtagcagctactgttgtgtttgtactcgagatactcgaatcgggttccttcggtccagaacaactatgatcaggtccaaaccgatgtttcaagcaatgatcgacattttatagagaatgtcaagacttctttgcacctagaaacaggacattgtttcttcttcttcttaacatcgttttcgtagtttgagggatcacaatctgtatcattaacatgtttatcccaagttatgtttgaatcttcgtcagggtttaacctaaatcctatagcacaaaacggacaaataatcactgtgacatctcctctgtttccttttggacaatcgtgttacatatagctacaatgatccaaacaaagcacctgcaaatagagttttaaaagttagataaactttaccacagccattgttcctctctatttagaaaatcatgcaacattgtagatcgtagaaactagcattggaataaaaagacaaggagaaagagacctgaaggcagcgatcacatgtgaagggcaagaaatcgatctgcgtgcaaacatcgacggagcagtgtttccctagatctggaaattccggagtccccatcgaaataagggtttcgacgttcagaacaattcaaactcgaagaagtaacaattcgaacccgaaagatctaggtccgaggaaccgagcgaactatgtaaatcaaaatctctatactttgagaacacggtacgaagaacggagagaactaggtcaaacaaaatctctatcccttgagaactaggttcttctccttttataacacgcaacagtcggatgggcctccttaatgattaatatcttgatgggccttctctatactaatatatgacccaaagagaacccattccactatatcccccttctgccttgtgctaagtttttagtacttttccaagttacctaatcctacaagaaattctggaaagtgaaatttctcataaaatatatcatttacttatttcacttataatacaatagaataaaacaacgtgtagaaaacaatattaatctagcttatcttgtaattcatcaaaaaaaaaaaaacttaacaaactgtcacctttatttggggtcatcccaaaagtgcctccataattcctcacaatgaaaaatttcacaatacgcaacttaaaatattaacattttttcatcttatataaatccaatcactgactactattatattcatatcaagataaaactcaataaatcattccaattctctaatcaaaatgtggagcaacaagttcttcttccttcttccagttgtatgcatcgtagtgttcgctacttctcaaccattgccatcaccacaaccttcccaactagattgttggtcatcactagaagttattcccgactgtgtcccggaaattttccgatcgataacaaatggacagttcgggaatgtaggtccttcttgctgccatgcttttataggtctcgatactgaatgcatccctcagatgtttatcttcgctcccctcatcccgccttctcgcagactcagggatcattgttcccacaaaataattgtgccataaacattttgagactttgttagttgttacaaagagtttgttattctacatgttttagactataaatgtgcttatagtgttatgtttctgcttaattaactacgtacgttctctactataagatatcaataattaacttccatgtgaacatgtgtcatttagctataataagtgaatacgtactaggatacgttggtttatttatcaaaattgtacacattgcatttgcttcacaattgtttggatgactttacaaagcgcttgtttacttatggccttatgggttgtgaattttaatcgagcattgttcatattgtagtccttcaaattttgagttttttctcgtatatacacatatgtaaactccaatactcaatagctgaccaacatcgagttacaagtacgactaccaataaaaagattttaccgaaaataagaaacatcttcgatatatattttttgattatctcttaatcattagtttgcgatgtttatagtgcgggaattgagtttgagatcgactcaaaaattataattggttttctcaaaacatggattagacgactcatatattcattgtctttcctaacatgattatagtatggctctatcgtgaaggactggatagtctgtattttatatatctatagaaaaactaacagttttataaatgagttagcaaaatatacttttttttgttgctttaaaactttttttttctaattctatcccatattatattaattcgattttgttgaatgattctagaggatcgatatacccgaaacatgtttaaaattgtaatttatttttagttttttcagtgaagtaggaggacatttgtccccctcaaatcaccaaatttttaaaaaaaaaaaacttatacatgatttaaggattatgcaattgtattgtctgtccgtcatttgactcattttcccactggtaagagctcaacttcagggattaatgggcttaggcctgatccgtttaaaaaaaaaaatatatatcttcataagagagtttggccgtttggaaataacgtgtaagtaggacccacttttgtgattatccgccgcacagaagtctctcctccactccacaaatagcattcccggcgagagacagagagcgaagaagaagactcaaaccaaaaaaaaaaatg

SEQ ID NO: 23806 - DNA, 3003 bp, Unknown
  misc_feature (1)..( 3003): 2750-1469P.txt file - cDNA_ID_2153193; gDNA_ID_1620515; Annot_ID_159256
ctggtctcatacaaagcaaaaaaagaagaagagagagttaacacaagaagcaactcctaaagataacttcccttcttctcattatacaaatctatataaatctattttaatgacaaccctaaacatatgggctaataagttatttctatgacaatgagtttttattttggacaaacttctatgacaatgattaagtgttccaataactgcagtttgtttgaccaagattttgattccaatttttaatttttattcgatatgcaattattaaaatccgactcaaccccaaattacgacccaaattcaactaacaaacacgaatgggatggagattgatttttttttttagtgaattaggatggggattgattttctgtctggaaatggaataggttgttgggaacgaaaaagcaatctactaaatactctctattgtaccttcccttgatacaaaagttaaactctaagttaatgaaattgtagttaggccaaagttttttttctgtttaagggcaaattataattatttattaattgtttatcaaaaataaaatatcggtcaacgcataattctgacaaccgaagtagaatggttatggtattggcaacataacttatatttatttgtgtatgtcggtatgttataacaatatatagtgtagctaacaagacatttttaaagtatgcatgtgtgactagatgatgacatctctttcgtataagtagcaaacatttatccatttttgtgctcatataaacttattaacataaaaatctaaaattgaaaataagatagttagttaagttttattgtgcaagaaatagaaaagaataaaatattgggattgtcatcaagattaaagtggttccttgattgatctcaccaaaaaaaaaaaaaaaagagacttctacgagaggcaactcctaaaaatacttctcttcttcttatcacacaaattatgaatctgttttgatggaaacctaaacacatgggttaatgagctatttctataacaatgattgggttgctctactaattgtagtttgtttgacaaagatttttattccacttttattttttgttcgataattccttatccaaacttgatttaaaccccaattttgacctgagttcaacaaataaacgcaaacttagcgaacaggatgagacaaattttctatctcgaaatagattaaatagttattaaaaacttattctttttatcaggattcttttgttctattcctttcacaactttgaattctttgaagcacttttgtataaaatcacaatcattttgttcagattttgggagctggaactgaagtgttgtttctaaaatcttatcaaagggatgcatgttgtattgcttttgtgtcgcttattaaactttcaatttgcacccaaacgagaaataagatcaaatcctcttgttttcatttagatttgtgttgacatttgtgttagtttcttagtgtaaaggaacaagtttgtgttgacatacattctttcttcgttttttcagtggcaattgacagttccttacttgctacttcctctaagattgtcacttacttgataagatgaacaacgatgatgtaagtttcttttttttttctaatgttatagaattgtatgattgagaattggatgttttttcctgaatttagaattggtcggacgaagagtgttgatattttcttcaactttgtactgctgaggaaaaagggaatagaagaaagacgagattaaatataactggaaaagagtccatcatgagatagtttgaagaaaaatttgggaagagatattcatgggataaacaattcaagaacaagtatgatgtgcgtagaagaacatacacaaaggttaaaaacttgcttcataacagaactgaaattacatatgattctgtgtaaagaataaatataatttttcttttcattacgtttacctaagtatttaagaaagcaagtaaacatacttttaataactaaaggtcgctgaaaattctaaaaattgtaacgtgaattctcaaaactgtaaaaactgattctttttattgtaccctatatgttaacgttaattctcataactctaaattcttatttttccatcaaaatcatgacgtcaatcaaactgttaaaaggcgagatacaaatataaatattgtactaatattgttaatctgaaatatctactattcaaacatatttgtttgaagtatatcatattacatgatacattttttggtgatgaatcaaattgatgaataaacatttcaatatgaaatttacttgtttttgaataattatgtaatacttttttttattagttatattttgtaaaaaaatataatattttattataaatttcatcaattgacacatattcattcatgacaatttttttatcaagcttgagatcctcaaaatggttttatcattagttatatttaaaattttaacattaaatcataataatataaaaatttggtgtttttcagttttctaaaattataaattatattattttggtattttgtatttaccgttatcgcacatgctagttaaccaactataaaacttcaacaaacgtaaaatttaaccgctaaatcaatcatttaaaatatatgataactcttaaaaccgcaactctccgtttccataaatttcagcagtctgcatttgaaccattcaagcctcgtagtttggtcaagaaccgattacgcggccaaatcttatatccgacgctaagtcgctaaccatgtggaaaccattatttatcaatagaaatcaaaacgacaaaacccgacctaaaccgaaatctcaaattcgaacccaaatccaacttacaaacctgaccttaaccggaaatcagaatccgaaaacattttcccttatagcaaggtttaaagaaagcaataacaaaaccctatctctcgtctcttctcccccaaactctcgccgccgtgataacccaaagttctcgacgaagccatg

SEQ ID NO: 23807 - DNA, 3000 bp, Unknown; identical to SEQ ID NO: 2284
  misc_feature (1)..( 3000): 2750-1469P.txt file - cDNA_ID_2153197; gDNA_ID_1620515; Annot_ID_159257

SEQ ID NO: 23808 - DNA, 3000 bp, Unknown; identical to SEQ ID NO: 2274
  misc_feature (1)..( 3000): 2750-1469P.txt file - cDNA_ID_2153231; gDNA_ID_1620514; Annot_ID_159208

SEQ ID NO: 23809 - DNA, 3003 bp, Unknown
  misc_feature (1)..( 3003): 2750-1469P.txt file - cDNA_ID_2153235; gDNA_ID_1620514; Annot_ID_159209
caaagaaggtactcatatggactgattggatgaaggtttaagaagtttgaggaaccaataaaaagaagtacaagatagaagtcatggattgtgagcatctcctgcaatagttacctcctgactctgggctaacaaatttctccatatcaactaccagcatatttggctgcaaaattagacacaagcttcatgtagctagagtaattgtaatgcagtgtttgcttaactacagaggggattaatccagagcatccgaagagaaaggcgacaaacaacaagaatcttacctcaacaagagtctgctcaaatgcaacagacaaaagtttgtcctgattgagaaagaaagatattggttggagtgttagaagaggaaaaactcaaaaaatccagagaaagctcatcaggcgtcagtacttactagccatcctgcaatccctggaagcacagcaacatcaagtccatgagtggtaattggtttaacagtcatttggaaataaggtggctctgcaaaacacactcgtaaacgcccgagaaaaggccatcgacgaaggaacttcactccaatcaacaccttcaatagttaaagataccgatatgaagtaagatacttcattgaaggaagcgtgtaagtgaagctgcagaaaagaaaatgcactacctttccttcaacatgcattcctgtcaaatgcaactttgtccacattccaaacccaagtctttttcttaacttcacagcgagtattgcgctcatatcatctgctgtgaggaaattcattccaagttccagtacctgtacacactccaatataagttatactttctctatagaacttagagcttatagaactgaaattgtgcaactataccaagtgatcatcacccgtagattgccgtagaaccctaatatctgtcaacaaaggagggtttcttcccaaataaaggtgttgtatcacaacttttttctgcacaaattatcattccatcaatactaagtcggtttttcgactgtaaactgagctacagttagtggcctagctagtactactacaaagggctaactagacacaaaacgaaactggaaagactcaaaatttgaaagagttaccgcagtccaaggtctatacttgtccaagaaccaaggtatgatcggacgaagaatcttctgagaagcaatctgttccatacaaataggccatatcctctccacggcatgattcaaccaccgcaccgattcagaatcagatagaacctacaaagttgtatttaaaaaataaaaataaaaaaagattaccatttcatgcaaacaaaggtaaagtcagtatcttccaatacaagattgagaagaaccctagaacttgaacaaatgtatacacaaagcaacttaaagtcttaaacaacaaagtagaaaattacacgtctctggttagcttgcttcctctcttcaaactgcaatttcttcctcaatctcatcacatagcgttcatgaacctaaaagaaacccaccaaaacaatatttttcaccaaatccaataaaaattgaagctttaacatctaaaagaaacatttctccagagaaggaacaacacaccaggtaaagataaacgagagagaggacatagaaaaccgcgtgtgatcgattcaagtaagatagaacccaaagtaacagtaacacaatcaccacatgatggattaccgaacactccattattattatacttcctttggttacaaaacccagaagtgaacaacaaactagtccaaagattcttgcttttttttcttaaatccaaaggatcaaacaacaatctcatgaaacaaaaccatccgaaacgagtcgcacttcatgtgtgttggttaggaaaggacaaagaaacaagtaataagatgatttcagtttttgtttgttctcgtggattttgattagttagttcagagaaaaagacacagagacagaaccaaagaaaaaaaaaacatttcgatctaaatttactctgttttcttccgcgaagccaaagaaaaacgctgtcgttttttgaaaagcgaaacgcgtcaaccgcctgaaagagtgcaaacgtgtcagacacgtgtgaggagacaaggataaaggtcccactccaatgtcattgttcaattaatcgtgaattagacgatcctatccgttcatttttaaaagcattgatctgatggacggcttacaatttgacttgtttcatataatctcatctccatagaatatctacttttattagataacaatagctatctattctacattttatattaaaaataatgaaataattccactaaatggtcaacaaataatttaatattaaatgttattctaatctattgttatgtagaagaacaagtgggatatttttctatattcatctctctctttatctcttttattatataatcaaatatttttttgaacttgcataatcaaatattatgcatctcttatttgaacccaaaataaaaatgaaaatatgcaaattagaggtgcatgtcacttgttttaatagagaagaaaattgtcttttttaaaagtgaaaaattgaactaaaaagagtataatttataaggtgaataatagtggaaggtgcagtgtcaattgagaaagccattgcgactgtgacataaacattaaagccaatatgattaaacgatatatagttagagaatatagatacaagaaagaaattgaacaaaaaatttcatttccgtcggtgtttgtttttatatttaggaaaaaaaaagagaagcgaatgtttcccctgggattacgcaaatatcaaagattattataggaaaatctggttgaggaaagctgactaaccaccacataaaaagccacgtggcacatgcacttcccctagaaatacgaaactttaataagaagcatccagcaaaaccgaaatcttggttcaccaccgtctccagatcaaagaaaacagagaaacatctgtttttttgtttagtttgatctgttgagagatg

SEQ ID NO: 23810 - DNA, 3003 bp, Unknown
  misc_feature (1)..( 3003): 2750-1469P.txt file - cDNA_ID_2153256; gDNA_ID_1620514; Annot_ID_159215
aaccaggtctgcttcttgcctttcgggtggggaccgaggatttgcatcggtcagaacttcgctctgttggaagcaaagatggctctggctttgattcttcagagattctccttcgagctttcaccttcctatgttcattcaccttacagagtcttcactatacatccacagtgtggggctcatcttatcctgcacaagctttgatactatactccacgtgatgttatcaaaacttatacatatgagaaacaaaatttcatagaggaatttattcaagataatagtcatattaaccatgttttgaattgagaatgcttccctaataacaactaatccatctatttttgagtattattttataccaaatagaaatgccttagtggaagagatgatatttaaataagaatctacaaatttggggaaaaaatctataaagtttaaaatctctcaacttttgaaatacacagttgtaactccccaataaaagcaaaattgatcaattagtgactcaagtaaagcaaaatatcaatgagtcaaaataaaacaattttgtccaaaacacaaactatacagtattttaaaacatgaggggtggtaatatccatatccataccttcttcgaaactatctctcttctctgggagagaaaaatggagatatcagttgcatgcgtaacagtttctgtagttgtagttgttgtgtcatggtgggtatggagaactttacagtgggtttggtttaaaccaaagatgcttgaaagttacttgagaagacaaggtcttgccggaactccttacacacctcttatcggtgatttgaagaggaacgtcaacatgttgacggaggcaacatccaaacccatcaaactaaccgaagatatcacacctcgtgtcctgcctcatcccttccaaatgctcaagactcacggtatgtgtcctggttggccttttgcttcctctctgttttaaactgttgatcaagagaaaaagagtttcaaattttgtatatctatgtggtttgaaacaggaaggactttctttacatggcttggacccaaaccaaccatcaccataatggatccagagctaatcaaagaagtgttcaacaaagtttatgattatccgaaggcgcaaacgtttcttttgggcagactaatagccactggaatcattaattacgatggtgataaatgggcgaaacaccgaagaatcatcaaccctgcttttcatatagagaagatcaaggtttaaggctttatttttcagtcatgaatcaagttgtatgctcattttattctgaactaatttgtgcattctaacttctatgtatagaatatggtacctgcgttccaccagagctgcagcgatgttgttggcgaatggagcaagttagtgtcggataaagggtcgtcgtcctgtgaggtagacgtttggccttggcttgtgagtatgactggagatgtgatctctcgtactgcttttggcagcagctacaaagaagggcagaggatctttgagctacaagcagaactagtacatctcatcttacaagctttttggaaagtttacatccctggatatcggtaataaaagatctcaacctgcctggttttagaacttcactagtgctgcaaactattacagattgtgaaccatgatgtgtcatatactcatattctctctgtcttctgtttgtgtagttatctccctacgaagagtaatagaaggatgaaagcagcagctagagaaatccaagttatactgaaagggatcgttaacaaaaggttaagggcgagagaagctgggaaagcagcaccaaacgacgatttgttgggaatacttcttgaatcaaatttggggcaagccaaaggaaatggaatgagtactgaggatgtgatggaggagtgcaagttgttctatttcgccgggcaagagacaacttcggtacttctggtctgggcaatggtgctgttaagccaccaccaagattggcaggctcgtgcacgagaggaagtgaagcaagtttttggcgataaagaacctgatacagaatgtcttagccagctcaaagttgtaagtataaaccaaatcataaaccttcaggtgactttagtacttttattgtgtttagatggttttgctgaatgtttccaacagatgacaatgatattatatgaggttctcaggctatatcctcctgtaactcacctgacccgagcgattgacaaagagatgaagctaggtgacttgacactaccagccggtgttcatatcagtctacctataatgctagtccaacgcgaccccatgctgtggggtactgatgcagcagaatttaagcctgagagattcaaagacggtctttcaaaggcaacaaagagccaagtctccttctttccatttgcatggggaccgaggatatgcatcggccagaattttgccatgttagaggcaaagatggcaatggcgttgattctacagacattcaccttcgagctttctccttcctatgttcatgcgcctcaaacagtcgttaccattcacccgcagttcggtgcacatcttattctgcgcaagctataattctataaccacatgtgctgttgtcaaataaacataggaaaataatccagatcataatataaaactcaaatctttttcttatttgaagtcagaactttgtcctcacatatgtcttgagaaaccaaaatatttccaataaaaagagtgaaacgcatggaccaatagatttcttcctcttttcgtcgcttttcacacaaagtccaaatatgcttctgcgctttggtggcatgtgactgtgagggtccaagtaaagcaaaagatcaattaagcacaacaaaataattgtccaaaccaccaaaatataaaatataaaataatttgtgaccatcatcaccacatccatatcttctccgatattctaaaccctgagaatggtcacaaattctctaactctctctctctctctctagtagaaaacatg

SEQ ID NO: 23811 - DNA, 1129 bp, Unknown; identical to SEQ ID NO: 2268
  misc_feature (1)..( 1129): 2750-1469P.txt file - cDNA_ID_2153283; gDNA_ID_1620514; Annot_ID_159229

SEQ ID NO: 23812 - DNA, 3003 bp, Unknown
  misc_feature (1)..( 3003): 2750-1469P.txt file - cDNA_ID_2153338; gDNA_ID_1620518; Annot_ID_159360
actcttgttgtacaacatacctcggatagtcctgaagtagtgatttccaaagaaaggaaagagcgagtatggtcatcattcacaaagacttcccacttattgaaatctatcaagtatctgtcaaaaacagaacggaaaacaattcacaaaccccatcgtaatttgggtagtatggtaggcaagaaatgatcttacctcttctgcaactgaagcttttgccgaagcatagaaatcaccgagttaatctgatgaacacgtagtggaacgtttcttcctaagcttatgtggaactctctccccaaggcacgctcaaacttctgatcatccttgcatagaatgctgagtggcacatcagcctctaccaaatgaagatgaggaacaactgatgcaaccttctttaaaaaacatacaatctccttctttggcagtggaggtatacaaactagaatcccaaaaacaaaataaacaatgagtgaaagagaaagacaagtgatacacttcatcaggcctgcacttcatcaatacattctcaaacacatacgtatcctcttatactaaacaaccacttcagaattcaaaaacctcgaaactctcagaaattttaagctacgaaatgaacaaataccaggtacgtaaacgtgcaaagcgtaatttccatcgacatgaggaaagtttcttacacgaactccaggctctgttgagaagaaatccagtgaaccttcaagttcagacgaaataaaaaataagtgatgagtgaaatctctaagaatttgattgaggaacaatcacagagacaattgatgagcatcttcacctgtggatacaatggaatcgagaagcgcaagcggtggaggaggcaaggaaatcgaatctttctctccagaatttgcagtaacgggactcgccggagaaagatcatcggtatcggaatccgatgaagagtcgccgtaggacgctctcaatgcttccattgcccgtaaattaattaaaacagaaaaaccaaacagagaaactatttaaaccagatttcattttcaagcataaaccagattaaaccaaaatgattctaatataaccaaattaaagcgaaccgaatataaaccgaaccatccgcgaagacaaagcagcacaattcggaaaccattaacgggccgagaatgggccttcaccgaagatcaaagcaaaaccctaattacgttccctataaattagacaccaatcgccggaggtttcatcattatcagtattcaatagcatctagggttctcttcttctgttattcaatcgtcgtttttatgggtctttttggatgattgatagtttttaagtttctttataattctctaatcgagagagggagattggcagtgatgactcggaaatttcaagctcaacagaccggaattaggcgtttcttccaatttattggttgagtcgtttctgtgtcgataaccccgctgatctgagccttcctctcttttcatttgattctgatttgtttgcgttttcgaatttgaaattctctggtaatcgatttatacgtttttatcgattttgaaatcggtgtttgcgcttttttaatgatgatggggattttggagattacgatgaggatgtacagctccctcttctgattaagctgaagagaattgctggcagaatcgaacctaaatcactagccactactgagttatccccttaatccccataaatagtttataagagtttgttttttggttttctattcagtaaaaacgaatttagatggtagataatgatgaagcaaaattaatctaatccaacacttgatctgagagatactatgtgcatctccaagtgaagttacaactgttagcttctgaatctaactttgttcaattgtgatttgcttcagtttaatgacaaactacgagtaaagtttaatcggaagaattgactaatacattcaaaatagttgtctgattaaatgtctattgaacacgacacaaaatagttatctatttgttcgaatatgattaggacatccatattcgaacaaatagataatttagtctgccaattctgaaaacattgttttgacactgagaatatcaaattaatgtatgaaattatctattttatctagtgcccgtacctagttgaatccgaagtaatcgatccctgtgtattgatttgaaagcatttggtcataaacattggcgtgttcttgttaaagagcagtcgtcagatatcttagaaactaatggcagttaccaacgatgttccaacgagcacccaatttgcctacaatgacgaaggctggggacttaaaattgattcgaaaaaacctgtaaaaaatatattatacaaaagtattggtcacaaactttgttatcaccgttagtgattcaaaggtagtcagattgtatgaactttttagtcttaatcaaaaattggtatagttgaagaaaaagaaaaatccaaagaccggcaatccaaaacgtttagttactatggtaatttgtaacttccgtataattaacagtttaatacagttcagtacttagcagagttccgttgtaacggaataacgggatccagttgattacgttttgaaaccagtaaagtcaaagatattattttgttgttaagaagaggaaaaaagtcaaagttatcctgtttgtttgttttccccaaattaagaaaaaagcaaaggcgtagagggagagagtttgttctcaggaagtcggtatctctatcgaagccgacttcacgtcacgattacttacttccacgttacattttgtcgtgttttcttccttccgtttccttctctggcaagtctgcttcgtacgtactctctcttcattcccacttcacactttctactttttaccaaatcctatcctcaactctaattcccaccatttctgatccacgatttcaaattgggtggttggaagcagtgtttgtgctgtaattggatctgatctgatcggattcgattgaaatttggatcccatg

SEQ ID NO: 23813 - DNA, 3003 bp, Unknown
  misc_feature (1)..( 3003): 2750-1469P.txt file - cDNA_ID_2153349; gDNA_ID_1620518; Annot_ID_159363
tttattcaatttaagttacttcatttttgtttctttgttgtttatatagaccaacttgcctattttgaacaatgaaagtttgaatttcctgcatgcaagttatatagaacaacttgccaaataaatcagattagaagatgttcaataaattcatggtcaagctttgaaaaactccggcccccacaagagtataaacaaaatgctggaaataaaagttttacgaggagcatttcacgaatgttggttaatcacaaaagtcttaattacttacttcaaaaattcttgttgacgaacaacaatgaaaagaaaaaagatacaagattttttgtcaccatgcataggcccgaataatatacagaaacgcaagatggatacaaatgccaaggacaccgggtaagtcggagaagtgctggtcgagaggacctacaaacataggcggagaagagctaagggtagaattaacttcattaaaacaattaccaccaaaataagaaacattggatgagaatctaactcctacactaggtgctcgacatttggatacgcatgtcggatttggtttttttaagtaaagaaatttaggatccaataagatatatataaaaaacgggtttggtatcgattcggatttgggtcgaatttaagatttcataacctataaactcggtacttttcagttcaaatgtttttctatctgattgtacctgattactcgaagttttacttgattaactgatattatatccgattatccgaaatttttacctagttatccgaaatattatcagattttccaaaatattgtccgattttccgatgtaagtaaagcttctatccatataagtgtagctaattttgggtaatcgggttactcgttcgggtatcgggtaatacccgaagcgacctgatacccaagattacaattacataggatccaataggtaaattagttatatcctacttgacccaaaccggttttttgggttggtttcgattcgggttttcagtttcattcatccacttctgttaatttgttaaatctttgaagttcagaaaacacaaggagtaagattagtgttggaaaactagaccagattcattcgcattcaactcacgccgtcgatcaaaggtatctggcgactccaattttgcctccacatagtctcaaaccgataaatgatcacttctccaaataacctaaaatagctgcccagtaaaaaaaatccctaaacccaacaaccaaatcaccacgatcacaccaccatccagacttgctagacgcaaaaaagtcatcgtgagtttcatcatcgatctaaaatctaaaacctttcacttctataaggcggaaccaccatcttttaagcttaacaaccataacaaacctcttacattatcggcaaaaaaatgctagtgaccgatccaaattaaatatattttttttttttttcacaaaaagtgatactttttatatagatcaagtgttgcaaaagatacaactgtggaaacttccacttacaaacttaactaacaagttaaagcatacattgttaaaacatggatcttctaaagtgaatgaagactccattgaacataacccaaaaggttgcagctacatcttcagattccatttctgcttgaatctccagtctattcaaacggaattgctgcacactaaccattaggtatgcaaatactccaataaaatcctgagcataccaattattcaaacccttgcttcactgagctaacataccattgccaaaaggtgtttaacgccaaaaagtgatgacagaataattagagtggttaccgcttctttggaggtttcagaatccctccttctttaagctctgttactttctgcttttgattccttcgaactgcctctggctgttcaacttgtgtggtcttgcgtttagatgagtcaccttcttcagttggcctggaaccttccccaatctcagctcttcttgatgattcaccaatctctaaaattcttgaaaatctagaagtgacttcatctgcaattggtggagagagatgagattctgacctgaaacgtggtgtaagagttgccatttgaggtttttcaaccatcaagttctgaggagtagctgttcttgaagggaacaggtaaagtcttgcagctgcaagctctgcagaattcaaaggaggggtagcagtccttggaggtggagttataggagcaggaaaggagtcatctgacagttgtgattgagaattcatatccgacctgcaaagctcctcatgtaaagccgctcttgtcctttctgccatgtcttgacctctaccatcatttcttggtgcaggaagaggaaccatgtaaggacaatgattccgttgatgagtgaaacgaagacaccgactacaaattcttctaagacgttcatattggaaacgtatgattgcagtctctccagaatcaaaccggattcgttggaagaaccttagtctatcagttataccaaacctgactcttactctgatgtatgcaatttgattagaagtagcttcctggaagtctatgaggacaatatgacccaattcctgtgcaatctcactaacagtttccacacaaacatatggcataggaattcccctaatctgaacccatagatcaatattggctagaaaatccaagtcaggaaagaactcccacctttgattgatgataaaccaattattaaaaagccaaggctctcttctttgaactgagatcaaatcaaatccaaattaaatatagaagattaaaaactaaattaaaattgaaaattaaaaaaaccgcgtttcactttaaaaaaaaccctaagtgctcgtctccttcgctttcctctgttctctcggatttaaaactcaaaaaaatcgtatttctccataagagtaacatatcactggacgtttcccaattatctcctcctacgctcccgactagcgtttatcctattccggtcgccgccggagaccttgtatctccatataatg

SEQ ID NO: 23814 - DNA, 3000 bp, Unknown; identical to SEQ ID NO: 2307
  misc_feature (1)..( 3000): 2750-1469P.txt file - cDNA_ID_2153372; gDNA_ID_1620518; Annot_ID_159369

SEQ ID NO: 23815 - DNA, 3000 bp, Unknown; identical to SEQ ID NO: 2309
  misc_feature (1)..( 3000): 2750-1469P.txt file - cDNA_ID_2153376; gDNA_ID_1620518; Annot_ID_159370

SEQ ID NO: 23816 - DNA, 3003 bp, Unknown
  misc_feature (1)..( 3003): 2750-1469P.txt file - cDNA_ID_2153383; gDNA_ID_1620518; Annot_ID_159371
ccaaggaaccatagagaaatcgatatcacattgctgaataaaaatgtaaggttttgacaagatcctgatttcaaacagagaatgcatcgatcaagagatgctttgatacgatcagaattcaatatctagatagaacaaaaggtcaaaagccacattccaaagtctatttagatatagacagctagacaatgcaattgcagaggaattttgtaactctgaacctgaattttgagatttaagcacataaagtttcgaaatttactagaacaaaagcttggaaacaagaaacccatcaagccaagcatgatcggaatctctaataaacaagaaaaagtcacaactttgacctacctgatatttaaaggatgcaactttaagctgtggcataagaagaaaagaaggtatctttctcactttgccatcttgaagttgaagaagcgatggagtcttctattctcacacggagacattgacacaaagaagagccaaagacccaagttcgtggcttcgttcgtgctcccaatttcagagacagtcaattccttttgaataaccacataatcttatatttatagaaacaagaaaaaaaatgaagataacttggtcatgcatatgactcatgattcattgttgaagattcttctttcactcttttttattttgtttttgataatagattctttcactctcgttatttactagctcacacaaggattttcttcattatcagagagctacaaagaagagggaggggcttatattatttctcattttttttttatgtttgaaagtttctgccaattctcaacaatcttatgaagggatttgctaactagtatttttttttagatttggaaaatgtctgttttggaaactaatattatttttgtgcacggctggatatactttttcaaaaacatgaatattattaattcatcaagaaattaaaattaaagatgaagtatatattgttcttacttcggaaaaattgcatcacatgatgttagtcactttatatgatatcttgaggatttaacgtttttaaatatttttgtagtccatgttacatagtgtaaaactgtaaagtaacaaaatgcgtattcttcttaaatctcacatagttctgccatgtatatataatccctctgcatggcacttcaaatgagaatattgaatggagagtcggagaccatatgaaatcatggatcacgttcatgatagagatctatatatcccaattcacatatatactatatatattctataatatatcatctaggaatacagatgaaactgttacagagaataacaaaatttcgtgataattaaatctaatattcatttattattcttaatactttgaatatatatggaaaaaacatttatctaaaataattcttctatttaaataggggacttcagatttttaaaatttgagtattttgcttgaagaaatgagtatttttttataaaactttccttatgttttaagatgaatttttcatcttgtaactagacatatgatgtaattccaatttcttttacttttattttttattatatatgtaattccaatttcatttggtttttgcggttagtttacgaatgaattctacatattacaaaaatatcataaaatacatataatgatctatattttaatggggttttcctcccttggttgctcgcatgatctatcttgccatcacgtctttttgtctcccgatccctataatataggtatgtgacaatgtgtgtctatctttttctttctcttttaagtttttaaccaatccaatttttgtcaacaacacaatccaatgaattctaactaatatactatgaaagtggcatattaatataagtttatatgaatgaacgagaaaatgcacttagacataaaagagggaaagagagatacatatgcaatgtcaacgttgctcagcttcacaaacccatgttatgaatctttttcttaggtacatcaagtcgtatgattctttttaaacaaaccatcaagtatgattcattatatggttatatcccaaataagaaaatatatagataaatacatttaaatattgcatgatgtcatgcaccaaaaagcaacaatatataatcaacatgatatagaacttcgaccccaactcctccttcttacttgaacttgtttttggaattgatattatttttgggtaaaattaatggttaattcatttgagtcaggtttattttcttttgaattcaggtcggactttgaatttctttttcttttcttagtcaatatcatcatggttagatgcgaaccatgaccgggacaatatcggctatgtattttctgttttggtacatgtcactatgtcaccttgtttaattttagttgttctgtttgtgtaactacgagtctacgaatacattgtctaatgaaatgtgttgttatgttatatcacatgtcatatatagtgtaactcacaaaagatgtatcatgtcattttctttatttaaatcgtgttacgtaatgtgaagaacttaacaatatattagcaattttaatacatctgaaaatcattcaaaaaatcgaaaaacagaacaaaattttgttatcgtaaacaaccaagttaaatgatagatgaacacaatagatcaaggataaaaaaaagttgagatttgagatgaatttgttttttttttgtttttgtcactgaaatctttattgaaagcccattaacttacagataataggcccaataaacaaaatttacacgccgtctaaacccgatttccgacgacctacagaaaaacttcggtcggtcagtgaccctttaaaggaaagctattagcgattgattcgagagatgtgcaaagcttgttgatttgaggctctctctctactagggtttgttgatttgagttttctattcctcctatacgtgttcttcgattctcctgggatttttttttgaaaaagggaatagaagaagaagttgctgaattctcgatatg

SEQ ID NO: 23817 - DNA, 3000 bp, Unknown; identical to SEQ ID NO: 2311
  misc_feature (1)..( 3000): 2750-1469P.txt file - cDNA_ID_2153387; gDNA_ID_1620518; Annot_ID_159372

SEQ ID NO: 23818 - DNA, 3003 bp, Unknown
  misc_feature (1)..( 3003): 2750-1469P.txt file - cDNA_ID_2153439; gDNA_ID_1620519; Annot_ID_159389
tactacaccagttgtatggcaatttttcttctcaagtatgtcgattctaaggtctactgctatgaaacggccaccggatttacggctatgagtcctcaaccgctcaaccattgattcagccactgcattcacttcaggttgcaactccaaagacccaaacattgctaaacaggctacaggatcagtttcgccatcttgtgaggattttctcaagtttacagaagggaagtatgatgcaactcgaatgtttcctttagatttaaagatgggatcaatgtgctctttaatgtaatcttctgtaactctggtagggaccttcacaatggccatgttccttagagaaacttcttcaggcaattttttcacaactttaacgacattttccaagcttttaatcagcttatccgcatcatagatatcttcaaaattcctagataaagcagttaaaattagtttagaaatctaagaaacaaattagtaaaccaaaaatgaacatacaaaaaacaaccctaacctttcatcaccaggtttgcttcctcttatatcaggaagtactagagttgctccaagatgcttagccaccattacagcatcagtgatctaaaccaagattagcagaattaaccacacaaacaagaagaagaagaagataacaacacatctaaagaacaccactttagagttgttataaagcatacctgagagatatggtactcaggaccattggtaagtgagaatgtaacataccctttcgatgatacagcgtcatctgcaacaatcaagtccttagtaaaaaagtccaaaataaatgatgcaaagaaaataagaaagacacataccagatagtaatgttggccaacaaggagtaagatcagtgttatcttccatccaaagtcctttactgccttcaacggttccgacaagaccatctttcacagagactttagatccttcaaattcaatatcttgtgcatctccctgagctttctcctgtacaaaaatacccaaaatgacaaagatttagagtaagattttgagttttggctacagaagtttcactattagtttacaccaaacgagatgaaatcaatcatgtcctaaagatccgcagaaaaaaacagttgagtctaatttgggtttcttatgatcaatgtccaatccaacttatgatccaaaaatggaaggtcttgttttgatcaagtaaatttcacagaacaactaaattttctaactttgaattagatctaacttcaaaaggcatctaagataagaatcaacacagaacctatctgaactaagctgaaatgagtatcacattaagagtgaaaaaagtgtcggcaaagaagattacctgaagagaatcaaagtaatctctatgaagcatctgtccaagcatcacaaacatggtaatggtgagaataccagcaactacttgcctcaaatcaacacccatttcttacctttctctctaacaaaaaaaaacagaggtttctgagttaaaatagactaagggaagaagaaagaaaaagagagtccaacaaagagaggtgtttgtggggcagatagagacaagctatcttcctcaaatacgaaatctcagttctctttcaattaatgttttgtcaaaaaagctctttttttttttgttttaagggagtgttattgtcagtgtgttgattgttgaagttgaagtcttacgctatcttacacacaaaacagccaccgacacttctgtcatggattttggtataaacactaaccggtggctggtttcactaaaccggtcaaactaatacaacattctaaattatttttggtaatctttacagttacattacattttagagtttaacagtttatactttagttctttatactatgtaaagaattattagaccttacactccaaccaaatgaactatagttccaaactaagaattcatgagagtcaaaatttttgttttaaactagactaattgtaaaattcaataaattaagctgttaaataatttatataacttcgaactcacaaattgttgagctcgttcaattggtttttacatttgttagtgttacattagcaactataaaaatattattttaaacttcaaaatgtggttgatgaaaaaagaaaaagaactttaaatcacggactcatcactaaccgtatcaaaaagaggagttggtaatgacacaatacataaactaaaatcccctttatatataataaaaatagttatttaacaaacaaattataagcaaatgataaagcactggattacagataggttttgaaacacattttaaacatatcataatgttagacatgagactaatttagtaattatactaccccaaaagcaattgtaatgatgcataattgcatatagtttttgttagagagcccacgtacgagttcaactttttgctaatcacacattgtttactaatcatttaattatcaatgtaccgaatcattagtagtacattagtcatatcccagaaaattggtggaacatgaggaaaaacacacatgctgatcaatgattataatccatgcatgagtcgacctgtttttttttttttttcgtgtcttctaagtttgtgaggggatcacaatgagcacttgattgattgttgaatggtagcgtaacgctgtgtgcaattactacaccacttcataactttttgatgtaaatctcttcttcttctttttttacccaatgcaggcgtcaatatatctatctacgcaatcatatactatcgttgtatatgattttggaaacacatataagcaacaaataaataatgaacgaaatcctattttcaagctaaaatagtctcggagacccattaaaccggggaaattttgaataaccggggaaattttgaatttgtttcggttaacatcgataccgtaccgatcctccggtttgttctttcggaaggtttatcttgttttcgtcaaacacagcgatcctctctatcagagcaaccaaaatg

SEQ ID NO: 23819 - DNA, 3003 bp, Unknown
  misc_feature (1)..( 3003): 2750-1469P.txt file - cDNA_ID_2153493; gDNA_ID_1620519; Annot_ID_159405
caaacattctgatgccttaggaaatgttcgtaaatctgacaaaggggaccattttccacttgaaatgctttctagtcgctcaggaaaggccttcagggacaatcagagagatgatgttcatttgaaaaataagtttccaaggaataaaaaagatggtgagtcagccattcgaccttcattacctaccgagacatccgatagaaagcccgatgaactggatggaagtgacaaggatcccaagaatgtttcaggcttgagcataggttcttctcccttagatagccagagaacatatttggcgaaattacctaagggaaatggacctgtcctccaaaaacaagtttcggaattggagttgggtgaactccctgagccattgggtgaagatacagcattgaagccgatcgaagagaaaacttcgtttaggcagtcaaatttaaaaccaagcacttcagagaaattgggtattgactcggataaacgaaggtctaaaaaatctgactcaaaaaaggcagctcctccacatacagtaaatggtagcaacgaacacgttgttgaagattcagaaagatcccaaaagtgggctttgcagtcacatgggcagaaccttacaggtacagatactgaaatcagctcacagaataaaaatttagaagatgcagcttataaatctagacaaaaagatagtagagcaagagtagggaacagtgtggaaggttatggagaaacaaacaaaaaaacgcctgttgtaaagcatggctccaaacgagcatccacatcccgctcttcaagggagagcaaaagacattcgtctgtctcaaattcaatcaatggacacaaagatgcaacttcaataccaggtggcagtgttgtccgggagaaacaaatgacatctttcggtgaagaagactcttcttatttgaaatacgagaaagcttctcctgagcttaagggacctattagtgatcatttgcagtgagtaaaatgaaacttcaatgtttggagttataaagtatttctgttttgagtagataacaatggttttgtttttctatttcaggtataaagcctatatgcaggagtataatgataaatatgatagctaccactccattaacaagatattagagagccacaggtagctagatgaacactcagatcatttgtgttgtcctagattgtcagcttttttgaactttatgtttaccattattcgcagaaatgactttcaaaagttggggcaagaccttgggtttgcaaaaggaagggatgtggagagatataacaaaattgtggagcagataaaggaatcttattgcaaatatggggaggtaatcttctatctataaccacttcatagttatttgtctcttatattttgtattaccaaaatatgaaacttttgtaatatatcgttgaagatagaactcaacttatataccgaagttttctttgcatcagatgatttttagcgtcgtataaaaatttggaatgataaatttgtttgcttgtgtatgatttgagaaaatttgaaagacatgaggagctgaatattatcctattaaggtaataggttaaattggatttgggtgagaaattgttacctagattgatcttcatgagaagaagtgactatattatattgaaagggaatctctcagcttatgtgcattttatttacggatccgattatgtgagttttttttacgatacttgctgttgactcatacttaagcatttttccccctatttgattgtacactatgatacttgatgatggctttcttatatatgttatctctcactcaatctgcagagacacaaacgtttgaagaaagtatttgttgttctccacgaagaattgaaggtgagttacaaaactcccctataaaccgtagtgttggttgttcatctcccacatgcattcttactttagatgtaccgtgcatcttcatggatggatactaatgaattatgataacctcttgcagcacctgaaacaaagaatgagagactacgcatcatctcatggaaaagattgatggaaactggaaccaaaactctcctttggtggagtcatcttgttgaaacattagctctgtttttctttctttcttgtgaaattagaaatgattcataggcccaattttgtgtgagttgtacttaggaggacctttggtagattttattcttgttgcagttggtttagttggagcgctcgataaacgaatatgtacatacatgggtatcaagatcaatgtagattcttctggctctgctttaatttaactttgataagtcatcatggcattttggtcttccatgtgaagcttaacagagaaagcttaatgggtctgattggtggtgacctaaaccattaaggatgattgtacgtactaccattttctgacagcgccaccgccacggttgcataaatcgaaatcactgttgtagtcttgtagaaggtgaaaaaaaaaagtaacctaaaggaaaatctaaaacgcagtcgttttgttttcttagtttggtatcaaaaactctgaaatcaaaagaaagaagaaaaaaaagtctctgttttttctctcttccctgtttttctgtgtctttctcctccgtgttccgtcgtcttctctctctgcgttccttcttgaagccggaggaagcccaaaacccttggaataaaaaacaacggcctctctgctactgattgatagaaaacaaaaatctcaaacctagagaagaaagcgacgtactgtatattctcaagactaactggatctctcgttgatcttcaataaaccctttttgcaatcagtctcataagagtctacaactcgtgggcttctatttttcttgttggggtttcaacgttttcctctgtgaagaaagagattgactttcatggagatgaacctctgctggaatttgtagattcaattagggtgttttctgggttttgtggtgcttcgataggggtttttggtgcgttggtggtgggtgatg

SEQ ID NO: 23820 - DNA, 3000 bp, Unknown
  misc_feature (1)..( 3000): 2750-1469P.txt file - cDNA_ID_2153511; gDNA_ID_1620520; Annot_ID_159420
tacccttttttgagccataccgatacgtcttcaaccacaaaaaaaatcaaatgtcgaaatttctcccggaagaattagccattgagattctagtgaggctatcgatgaaggatcttgctcgattcagatgcgtctgcaagacatggagagatcttatcaacgaccctggattcacagaaacgtaccgagacatgtctccggcaaagttcgtgtcgttttacgacaagaacttttacatgcttgacgttgaaggcaagcatccggttattacaaacaagctcgatttccccttggatcagtcaatgatcgatgaatctacatgtgtgcttcattgtgatgggactttatgtgttaccttaaagaatcacactttaatggtttggaatccgttttcgaagcaattcaagatcgtaccaaatcccggtatataccaagattcaaacattctgggtttcggttatgacccggttcacgacgattacaaagtcgtaacgtttatcgaccggcttgatgtttccacggcgcatgttttcgaatttagaaccggttcatggggagagagcctacgtatttcttatcctgattggcattacagagacaggagaggtacatttttggaccaatacctctattggattgcgtaccggtctagtgctgaccggtttatcctatgctttaatctctcaacacatgaataccgaaaactccctctcccggtttacaaccaaggcgtgacgtcttcatggttaggcgttacaagtcaaaaactctgtattacagagtatgaaatgtgcaagaaggagattcggatttcggttatggagaaaaccggatcatggagcaagattataagcctttcaatgtcgagtttcatctctgtacaagatcgtatctacgattatcaagtcgaattcgtgtcgtttactagaaagaacgatctcgtcgtaacattcactggatacaacgatcatttcgagatggaacctgaagagcgtacgaagaagaagatgttcttgtacaaaaccggaaacgagagatctgaagaagtccggttctgtaaccctctagccgggttacggtttctctgtgaatgtgtggagactcttaagattgttaatcgcatatttatttgacaaaaaaaaattaaaatcgtcaacgttgtgttgcgggtgctacacggataacgtgacaaacaattcaataaattttatatactttaatggtaaccggtccaattaaaattaaagatccaaatatctcaaaaaacttggtggcaatagtagtgaatatttgacgaggcagagctttggaattctatatgaactctctaaacaagggacaatatgattaaagataccattctcttcaagtaactcatcaaataatggatctcctgctttggttattcgagaactcgttttccttaaattcctaagatgattcttattcattccaatagtgtctctctttatataatgcccaaaataaagtgatcataaactaaagaaccaaaacaacaccgaaaatcaaggaagataaaataaacttaagaaatccaaatcaaagcaaatacttcttatcttacaagttacaaaaccatagaattatcatgcgagtctccttccaaataaacaatgatattagcgaaacaacacaggttcaagtttgtgactcagttatcaaacagtagcagcaagagcacgcactagttcataagttttaaacagtagctgcaagagcactcactaggactcttccccactagtggtcctcggattatcgagggccagagccccacgcgccatccaatcgccggtagttcattagggttttgggaatatacggatcctagcgtttaaagtaagaagacgaagcctttgttttgctctcgaaggaacaagccggtttggtctttgattcaataagtaaaaccaatttcatctaaccggtttgggctagccggttttggttttctattttgtcattcaagtgaggaggaaacactttatagattacaaagaattgattaaactcgaaaaagagattaagaaaggatattaatggagagaggaatgaacaatgggcaatcactctggcactctcagtcaccgaaaactccaacgacgatgctagatcgggctctttcctctcgccgtcctcactccgacgccgatctctctgcttccggcgaatccggaaccgacgaatctaaaaccaaacgcccacacatctacctccttgcttccaatttcctttctcggatcggtcatcagtggtggccttgtctcattctcgctctcctcttcctcgtccttctcttcctcatctccgttgctttccattctcacagctttgtttgcatctcccgcttcgatcccgctgctcggatcgggtttttcggtcttgatggcctcgaatcggattttggtgccctaggtgttccttggtgtaagcacttgagatctctgcttatttttaagccttggtgtgttttgtgttcgacattgtgaattggttctagtggaatctctagtgtttccatgtagatttattcaaaatgctttggttagatttgatctaggtttccatttctgttgatagtattcaggtcaatttgaaaattgttctctaaatctgattcagatgaggttttagtatcattgaattgaagccttgtagcttccactggttaatctctggatagtactatagtagtggctgtgctgtgtgttgacaaatcaatggagcagaaccattaactcctctagtacacttcgattacgagttttatactgttagatagctatgttgttgttctctatttttccatcaaagcaacatgataatgatttgttgtgctatggaagtatttaatttttttctttggcaaaaggcagatcgaaacatggaaaagaagttgagtggacatccaaagatttactcaagggtctagaagagtttgtgccgatatatgaaacacgaccgataaagaacaatatg

SEQ ID NO: 23821 - DNA, 3003 bp, Unknown
  misc_feature (1)..( 3003): 2750-1469P.txt file - cDNA_ID_2153530; gDNA_ID_1620520; Annot_ID_159425
tttatttgtatgttcgaagaaaatgtcattaaatgtaaaaaaatagtctcaaacgacggcaaaaagtctctctccattgagtatcctctacggttcttgaattggtttggatacatatttcgtgtatgaaaactgaggcgtatcaaggctatggagaatttaaatcataagtgggatcgttgttcctcttctcatcaaactcctctttctttcaaaggcaatcagaagcaggtttgttgattaattttcgagattctttgttatagcgtagagaaaatgtcaatctttgacattttaatatgttgctatactttggatctttttttacttgctgtgtacacttgaattctcaaattctttgtagattggacaaggtcagagagaagtgttcacacattttgtgtcacttccattagccatataccctgacttgacgaaaaatatcgaggcttttcagaattctgtattgggaaacaatgataaggatccattgaagtttcagagtactttagctggtaagatcacaaaccaaataaagaaatgttttaagtgtagaacatgtttctatgacatgtttttggatattggacagaaatgggaatagaaaaatcgatctttgtaactcccaaaactttccatttgactgtggttatgttaaagttagagaacaatgaatctgtggttaaagctcagaatatccttcaggtataagtgattcctattctaagagacatagtgtacttgttcttcttcttaggattgctttgatgattgaggtgttgtctttttctgaaaagcagagtattttttctaatgtgaggcaagctttgaaaaacagacctgtcttcataagactcagaggattggtaattgctacaatttctagtggcttgaaacataatctttgaatcaatcccaatggttttttgtcttgttaaggaatgtatgagtggatctttagacaaaactcgcgttctctatgctcctgttgaagaagttggtcgtgagggccgcctgctaaatgcttgtcgtatcctaatttctctaagcgcttatttttacttgtgtgaagacatgacttcaaattactatgcaagtgcttctgaactctttaactctctagtttagatgttatcattgatgcatttgagaatgttggatttgctggtaaagatgcaaagtcacgcttgaaggtaatgcttgtcacttttctgttgtttacgtctttgactaggacaaagaaaaagatggatataacaatgtttcagcttctccttcatgcttgttccttatttgcagctacacgccacgttgatgaatgcaagctacagaaaagataaaagcaaaaagatggatacttttgatgctcgagagatacacaaagagtttgagaacaaggattggggaacatatctaatcagagaagctcacatctcacaacgttataagtatgaccccaatggctacttccattgctgcgcttcactaccttttccacataagtgacattgacaacgatcaaatctcctccacatgatttgcattaggaaaattaatgtcaaaacttaggtaagtatggtatgtcactgtgtaactgtttttatatgtgtgtgtcacagcgattggtaactatgtgttgtgtaacttttgtttgtaagttaagttttggacagtaatattcttccttccgatgattggattagaaaattcgtgaaaagtgtttgattttgtattatttctgtttatatcgcatgttacttcttttggtaattttgtagaattgatggtgtattagggtttacgagtagatgttttctagaaacaaaagtatttctcctaatgtgaggcaagctttgaataaccaacccatcttcataagacgcatccttgagttatacatatttagtggcttgaatcatctttgactttgattatctatccaacttttaattcctaaaacatagagattcataataaatctgtaactttaattcgtctctttaccaattgaatgccaaatctagatagatcaaaaagcgaaccagctctttctagacgaataagctctttaaactctgtcgtatgtgttgtttcataggacctttcatctttttcttcttctcataattagttaccagtggcaaaaagggaaaagtctaaaaggaactctagagtgaatttagtatgcaattaaataaatcatttactagataagggtttgattacaaaccttaggataaatatttgattgtatctcaaagtataagaaatgtgtcaagcagattctgtgttttttttgtttcgattaaaaccgctaaaaccttgacaaggttgtctccacaaacaatattcatatcaatctcaaagaatgcaacatgcaaaatgttgtgcatattgtttgtggaggaccaccatcgtaagaggatttatgtaacataacttaaaagaaagtggctatatataactttttttgaaacctttttctacaaacaccttggatgttctttaaataagatgaaaaggctattattctaatgaacaacatgaagccaaaagaaaatccaaggcgtttgcagaaagaggttataaaaggctccgaaatatttcatccgaaccataaacttgttaacacacctaaagaacaatgatgcagtaatgggaatgaatacacacgtccatttgactgctgtgatggaaaggattttataaggtgagaaatttttagggttttgattttgaataacttaattagttttctaaaaattgaactaaaaaatcaaaacaaaatccgaaaggaggggaagtaaatatttctttcgaaatttgtggagatctatatttcccttttcaatactttgatctcgcttttttttttttgaaagtatacggtcaaatatataattttctaaacgtaatggggtttagcagcaaatagtcgtaaatactggcggaagaaaatgatattttacggctgaatcatcaccggagaatgagaggaagatg

SEQ ID NO: 23822 - DNA, 3003 bp, Unknown
  misc_feature (1)..( 3003): 2750-1469P.txt file - cDNA_ID_2153534; gDNA_ID_1620520; Annot_ID_159426
atttatgtacttggtcagcttatttctattcactcatctgtcatgttgcttatttgctatattcttaaggattgtatgagaggaccattagacaagactcgtgttctctatgctcctgttgaagaaattggtgatgaaggccggcttttacgtgcttgtcgtatcctagattttagtacgaatgttatttatagtagtggcatggttagaccgttaaattaagagtttagtgtaaatgctttcgattttcttaataccaagttcagaagttattactgatgcatttgtgaaagctgggcttgttctcgagaaagatgcaaagcaaagcttgaaggtaaaagctttctgagtatgacgagattgttgcagtcacttaacgttagccaaaggctcagaactaatggaattggaagtagtgaatcgtgcttctgtttcatactttttcctttctttgcagctgcatgtgaccgtgatgaatgcgaggcacaggaaaaggaggtgattgattcccaactccagacttatgtttagataaagaaaacaatgttacaaacctctgattatctgaaaacccttttggtctcagaaagaacaataagaagaagatggagacgtttgatgcaagagagatacacaaacagtttggaaacgaagactggggagaatatctgatccaagaagctcatctctcacagcgttttgtgttcgaccagaacggttattaccgttgctgtggttcaataccatttccaggagaacagagagcctgagaagaatcatctaaccagcggccacagtctcaaatctcaagcatcttcacaggttttggtcccgtggtatgagcacttacaactttgagaagagaacctgataaaattgtaaagttgtaccggtcatcttgtgttaaccaaatagttgtcttcggtttggttctttcttggtctttgttcaataaaccgagccaaaacgttcttgtactctttctacaaggtaataaaaaggttcttagtacatttaatagaaaaatgattatttacagctttattagaggctattgattgatttagtaatgaactaataatgcaagtcaacagatctaaaattggaaagattattggcaatggaggcaggacaacgaaaatcaagcatattaaactctttaagattcgtataattccaccggcctaaccaaatctctaagcaattgttgtttatgtattataatatagttcaccatctatttaagcttaaacgagtgtctaatacatagacgtatatgacaattaattaatgatccgatccaaacgacccttggcgtatttggtaaggtagcagtgatgtgcttaattattaaccaacgatgtactgagtttctagaattagtaagaaccataagagttttaaaaagtgtaaaacgtaaaacatcaacacatgtcattccagttaacatacatatatctatatatatgttaacgtgtttgcataatttttttaattagagaaaaacagcacactatgcaaaagatcgttcatatatctaacgtgtgatttaatcgatctaacaactttttattcccttttatattaccaaaatatttatttccattgatcatatatttgaagtagcaaaaattggtaaaattttagttaaaaatgagggagatgaaaactgatatattatgtaaatctcaagtttttgtaatgcataagaaaaatgttatcaccattgcaactatccatggtagcaaccgtatatctcagcatatgatacaaaaaaaaaacaagaagaagctcatattcaaatttcttacgttcaaacgaataacttgattgctaaacaacaaatctagatagcattggattcatcagtaagagttaaaatcgtacagcattgtgaatcataaaatgttgtacaagattgtgaaataacaaataatattgtaaatttatcaaaaaaaaaggggattgtggatcaatgaatatgatggagaatgttcatagaagaggtaaataatagagggacccaaaataacattgttgaaatggaatataatcataaatgagtcacatcttcaaaatctgatcaaatcacttggaaaaaaaaagatcaagtcacatgcaaccagtaaccacaatcatattttggccggtctatcaccatacacattgtttacagctcacacttgtccctccttatatttgttcgtatccatttgttttcttctctctctactctaatctcatctttatgtttatccctttttgaattttgaagctactctgtcctttgggtccaccctccaccacctctaatttcaatcacgttaaaccggccatattactttaaaccgaccgttttctactaataggaaaatccgacccaaatttttgactaattataagacataccgccgctataccatgatattgtcaaagaaaaagtttctaaccaataaccactatagactaaaagatttcaaataatttgattgatactgcattgaacattctacaattctacttatattgtgtagttcaaataatgagaacatatcggaaagactagccgctattagattatgaatgcgtatgaatacattatacattatagtatatatatatatatatacacatatattaaaatgtattactatataataatttgtcttagtatagtactcaaagaaatagagttttcttacgtagatgtcatatattttagtcattttaggcaccttcctaactcaaatcacgaatagaacttatgtagcaaaatgtaaacacatgaaatcatttattaattcgggtccaacgtaacccaccacaccacagaaactcattaaatagtatttttttataaaacttaagttatatgcatggatacatgaacgatactcctatataaagagaacagcattcaaaaggtcttatcatcttcttcactaaacaaaaaaaaacccttcaaaacatttccttattctttcttcttcatctacaacaatg

SEQ ID NO: 23823 - DNA, 3000 bp, Unknown; identical to SEQ ID NO: 2335
  misc_feature (1)..( 3000): 2750-1469P.txt file - cDNA_ID_2153536; gDNA_ID_1620520; Annot_ID_159427

SEQ ID NO: 23824 - DNA, 601 bp, Unknown; identical to SEQ ID NO: 6183
  misc_feature (1)..( 601): 2750-1469P.txt file - cDNA_ID_2153543; gDNA_ID_1620852; Annot_ID_170363

SEQ ID NO: 23825 - DNA, 3003 bp, Unknown
  misc_feature (1)..( 3003): 2750-1469P.txt file - cDNA_ID_2153543; gDNA_ID_1620520; Annot_ID_159429
cttagaggaatctggcagcaaacctggtgaaacagcagttatatatgtatgtgaattacctgaaatcaaaggaaagtttgatccaaagaaggccatggctcttggattgagagctggtccaaagtacagttatcttcagtctggacagtcagtcaagtcagattttaaagatattacggtatgtctcaaagagcaatcattgggaatcttcacaacccaatatcagtttctatacaagcagactaacactgttcacgcttaatcataggttcatccgagtgatgtgatgggaccttcagttcctggtcctgttgttttgcttgtggattgtccaacagagtcacatgccgaggaactgctatctatcccgtctatgaagacttattattcatgtcttgacaattcaacagatggagctaagcttgttaattgtattattcatctaagtccagcttctgtaacaaatagttctacataccgaagctggatgaagagattccattctgcccagcacattctcgctggacatgaagcgtgagtcttctcaactatggttctttctcataaaagaactgttgaatttatttgtctgatatgtagttttggtgtttgtccaggaagaatatggagtttccaatcctgagagccagttctagaatcacagccagacttaactatttatgtccacagttcttcccagctcctggattttggtctcatcaacatgataataactcgataaaccccacttctttgagcaaggttacaaacgcttttctgatattttctttttgagttgaatctggctgtgttcatttagtcaagttgtgttcttttcttctcttgtcagtgcttcgattcgaatcttggtgaaagcatttctgctgaaaatctcctcaaggtattgaatgttgcttcagtgcatcattccatatgaaacttcctttctttagctcttaagtctctcgctttctctcattgatatattgtgggcagttcactttgcgtccacatggtaatcttggggtagacagatctagtatccctagtcgattaacagctttacgagtgatggatgagcttctttcagaaattcctgaaatcagcagtaagaccgaagaaatcaagcagttatggaatggacaacacaacaagatgatgatcgaagagccatggctgggtgaaagcactgttccaagctgtcttgaaaacattagaagagacgacatggagatagttcttttgggcactggttcctcccaaccctcaaaataccgaaatgtcacggcaatttacatcgacctattctctagaggcagtattctcttggattgtggggaaggtaccttaggccagcttaaacgaagatatggtttagaaggagctgatgaagcagtcagaaacttgagatgtatatggatctctcacatccatgctgatcaccatacgggtcttgcaagaatccttgctcgcagacgtgagcttttgaaaggattggctcatgagccagcaattgtggttggaccgagatcgcttaagaactttctcgatgcatatcaaagacttgaggatttagatatggagtttctcgactgcaggaacaccacaacaacatcttgggcttctgtagaaaccagccgccctgagaaaaataccagtagcggcaatgcagagggttctttgttcagtaaaggaagtctaatgcagagtatatataaaagaccgagcagcccactgacagacaattcttcagctttaccattcttgaagaaactgaaaaaagtcctcggcgaaatggggttggagcatttgattagctttcctgttgtgcattgccctcaagcctttggggtttcgttaaaagcagcagaaagaaaaaacattgccggagatgagattccggggtggaaaatggtttactcgggagacacaaggccttgtcctgagatggttgaagcttcaaaaggagcaacagttcttatacatgaggtgcttttctatataagcaaaactgtgtaaaacatttacatctcattcttaaaatttaccatcttttcaaacttataacaggcgacgtttgaggatgcgttggtagaagaagctgtggctaaaaaccatagcacaactaaagaagcaatcaaagttggatcttcagcaggtgtataccgaaccgtactgacacattttagccagagatacccaaagatcccggtgattgacgaatcacatatgcacaatacatgcattgcctttgatatgatgagtataaacatggcggatttacatgtgcttccaaagattttaccttacttcaaaactctattcagaaaccaagtggttgaagaagaagaagaagaagaagagactgatgatgatagcttaatacgtgacaaagtcccaagctttttcatcaattagtatatagattagaatgttctgttttgtcccctgtttttgactgtgttgtattgtctttagaaataatatcaatttaattgatttttcctgtgagtgtgacagaggaaataaatcagtttcatgtgcataatgtgaattgtgaaaaagaaattaaaaaaaatcggaactttgggaaataaggaaagacaccgaagaacacacaaccattcctctttattgaccgcttccttctttctctgtcacatacgaatcggtgagtttttttcttctcaatttctccgttctctgctgatttctccgaggttattgattcgattccgcttgacgcatgattgtgttgtctcaagggtctaattttacctccgcgttgattggtttataggggaaatttggatcccgatcgtgatctttagtttggtgaatttgagctggaattggagcttaaaggatcggttttttgactgatctaattgttttgaggatcggtctttcataaagttgttgtctttgaagcttttttgactggtgaggacgaaaaagttgtgattttgggaattagggttgttttgtttcgaattcgccatg

SEQ ID NO: 23826 - DNA, 3000 bp, Unknown
  misc_feature (1)..( 3000): 2750-1469P.txt file - cDNA_ID_2153549; gDNA_ID_1620520; Annot_ID_159432
gctgcggtatctgcactatggcgtgagaatttcggaggatctgatcttccaccacctccaatgtatactttggatgaccggtccgatttctctcctgagtctggtattgcagactactctgcgtctccagatgctaagtctgacagaagaacaccattccagagttctggaaagaatattgtaactcctggtaaaggaaagttggaagcaagcccttctttttctctactgaatgcacaacagagtcagcaagtttcagggagtccgagttggtggtcgcagtcaaaggcaggtagtagtaccgagcaggatgataaagggaagggatctcctgtagaaggggtggttcagccaggtgcattggtcactcttccgccgccaagagaagttgctaggccagaggttcagaggcagattatacctacaggaaaccttgatgaggaagagtgggtcactgtctatgggtaaggccatttaagctttattgctctcgtttttctcactttactgttgcaaatgttcttgatttgtcaacattctcgtgtctctgaaattctaggtacatggatgataacagttatattggtactgggtagtgttattaagtgccttaacttgtgtctgtctcccatgtttcaatcttagagaactgttcataataaatgctgttctttaccatcatgatgctcaaatatcagcctttgattgtgattttatgttttgatcattgtgaattctgactctttacatggataataactggtagtgttattaagtgccttatcttgtgtttatctcccatcttttcaatcttaagaactgatcataataactgccttcagattttctccaggtgatacaaatttagtactacgggagtttgaaaaatgtggtatggtcttgaaacatgttcctggtccaagaaatgccaactggatgcacatcctctaccaggttactgttcttcccttcaaacctgtttgatgcatgttgataagcattcatagttcttctagacgagtcatcatacatgatagtctaatcaaatcttttatataaaggaaacaacgaactgacaatggtctgtgtatttgatacagaaccggtctgatgcacataaggcgctgaacaaagcagggatgatgataaacggagttgtaatagtaggagtgaagccagtagacccaatacagaagcaagcgttaaacgagagactcaacaaccaaggattcatgcctttacctccaccatcatccactagaaacactgctcgacccctgtctcgtcctcagtacttgcaaaacggcagcgctttctctcctcaaccaagtggtggcgctatggcctctccgtcaaagtcaatggtctcaaagttctttgacttgatgttcggtgtttaaaagctacttcaatggcatttcccgaatgattcttctttacacatagtttgaagtttttgagagcagagtggctaagtaaatcttagagcgtggtcaaaattaaaaattgtaagaggtgtttcaaattgtcttttgtattgacgacggctaaaaatttggtataaatctgattattaaaatctcctcttttagccgtttcattgttgtttgtatttgagcagactagtcatgcctcgtgaatgattgaaagaaagacactgattccatggaagcctcacgggcagtgttttagaaactccattaggaactagccacgtatctagcctgttgtgtttatatatcccctctcgcatgtaaattacattacaaaactcagtaactcacaatggcgaaagcagcagagcagaaacaaaacccgaccgttgcgagtgcagaagcgaagcttgatatccgcgacgtggtcaacacagccatcacttacggcgaagataaccgtcacggcggcgggaaacgcaatgacgtggccatgtttgtgctaagagccatgtgcatggccgtatcaacggtggctgttacgttaatggtaacagcacgcgagactagcatgaccactctctatggcttcgagtttcagctccacgccgtttggtctctctcagattctcttatgtaagcatatttcataaatttgacatcaccagtgatatgtattccacgttgcttttgaaactgacggttcttttacagatatctagttgtggtttcatcggcaacggttctttactcgttgattcaactgattataagtggaacaagactaatgagaaaatctccggtgattccgacaagaacacaagcatggttttgcttcgttgcagatcagataataggatacgcaatggtgagtggaggatctgcagctttaggagtgacgaatatgaacagaacaggaatcagacacatgcctcttcctaatttctgcaaatctcttggtttcttctgtgaccatctcgctggctccatcgtcttcgccttattcgcgtttctcctcctcgccgcttcttcacttctcgacgttctccatctctcacgccaccgctaaaaatttaattactgttttaccctcttgtacttctcgtcgttaattaagtttttcatcattacaataatcatttacgttatggggttgctttttggaatttgattgtttcaatcgatattaccgaatttcaatgttttgaattttgttgaccatgttccatatacacgacaaaaaaaatattcaaaatcacccgcgacaaacacatacatgagtgacactgacagaccggtttccgcgtctcgattcgtttttagcgtctgggcttcttaatgccttttttagagttaaatggcctaagtttttgttattgggctttaagaagcctttttatattacgattgttctgtgttctgtttcttctatccctttagcctgggaaatgatgaagctcattgctacgttttaatggcgatcactctatctcgactagcttggtttattgcaattcacttcttcatgtaagttaaattcactctacttcaattgaatcacatcatg

SEQ ID NO: 23827 - DNA, 3000 bp, Unknown; identical to SEQ ID NO: 20962
  misc_feature (1)..( 3000): 2750-1469P.txt file - cDNA_ID_2153565; gDNA_ID_1620852; Annot_ID_170355

SEQ ID NO: 23828 - DNA, 3003 bp, Unknown
  misc_feature (1)..( 3003): 2750-1469P.txt file - cDNA_ID_2153565; gDNA_ID_1620520; Annot_ID_159440
tttgagaaactgcaggcgattcatggagttccgaagattaaagagaagtataatccggcgacatggatgctagaagtgagctcaatggctgcagaagctaagcttgagatagattttgctgagcattataaaacatcatccttatatcagtaagttcaacctaatattcaaagctaagatcattccagatattttaactcaattagaattgttcgtggtgtagacaaaacaagaatcttgtaaaggaactaagcacaccaccacaaggagcaagcgatctctacttctcaacgcggttctcacaatcattgttaggacaattcaaatcttgtttgtggaagcagtggataacttactggagaactcctgactacaatctagcaagatttttctttacattggctgcagctgtcatgctcggatcaattttctggaaagttggcacaaaaaggtttgtttaattacttgaatcgaatacagaggcctcaaatctagtatcagagtccttacttatatctaaactctatacaactgttttcaaaaacagggaaaacgctaatgatcttacaaaggttattggagcaatgtatgctgctgttttattcgtgggcgtaaacaactcttcatctgtccaaccgctaatagccgtggaaagatctgtattctatagagaaagagctgctgaaatgtactctgctttaccttatgccctagcacaggtgagattaaactagaaacgttttagttacttgacaaacaagaaaccttaatgggtcgtaaagcagtctttaactaaaactttcccatggtttcaggtggtatgcgaaataccgtatgtgctgatccaaactacatattatacactaattatatacgccatgatgtgtttcgaatggacattggccaaattcttttggttttacttcgtatcatttatgtccttcctctacttcacatactatgggatgatgacagttgccctcaccccaaatcagcaagttgcagctgtttttgccggagctttctacggacttttcaacctcttttctggttttgtcattcctagaccggttagtgttggttacttttctggcaagaaagctgaaaccctaaatgattctctattgattctatcataagctggttttactttcctcttgcagagaattccgaaatggtggatatggtattactggatctgtccagtggcttggactgtgtatggattgattgtttcgcagtacggtgacgtggaggatacgattaaagttccgggtatggcaaatgatccgacgataaagtggtacattgaaaaccactatggatacgacgcagattttatgataccgattgctactgtgttagtgggctttactctcttttttgcgtttatgtttgcttttggcataagaacgctcaacttccaacaacgatagggtgtagttgcctgccggatatgtttggcgtgaagtagaaaaaaatgaaaaatgagggtttatgccatatagtttgtgattgatgctttattgattgtaagtaaagtgtacaatatatacaacacaatagattgtggggagaatttacaaggacaaatctaattataattaacttaagatctaaatttatgtatatcctaacagttatatccgttttgtacactattttaaaactttttacagatctaagataaacatagatttattttaagaatcaaattgtgaaaactctgcgtggaaaaaattaatcatgagtcatgacaatgatgagctagttaaggttccaagtgattgcaatcacattttgtgagcactaaagaacacatacacacactatatatatattcttgatcacctaacgagtgaatcaaaagagatgagtagtttattgtattttgggacaaacttcgattaaataatatttacactatttcatgaaaacatttgatcactcatcaaatacatcttatgaaggcgcatatatatctactgtttatgaaatctaatctactttactatatgaaaaaaacatacaaatttgccggagctttctaaagacttctcagcttcttctccggtattatcatccctagaccggtcaattttggttacttaagttgcaagaaatctccgtgtaacccaaatttcataaatgcgtagtgggatttactcttcttcttttttggtttcatatttggtgtttgcctttcgcgtaaaataccaacatatagcaaagagcgtttagacgtcaaatgtgtttgttttatttgtgtagagtatacatacttttttaagaaaagaaaaaagaagttatgaaagcttgttcttttttgttaaagattatgaaagcttgtttaaatcctaatcacatctcgtactaaataaagaactatatgtgtgtgggtaatattatccaatctctttaaatttaaaccacttgtctcatctcatatgcaaaacgtgtatcttgtaagaacacacgctcttctaatatagaaatagatcgcgtaacaagtggacttggaaaagctatagtttatggcgttttcggacagatttacacttaaataatattatcctcacatcttttaaattcaattatttcattatcttggttatcagaactgagttttgtcggtaacattgtatctttaaaaaaaattatcctaaacaaagaacgaaacgatacaatagtataaatttgttcttgtcataaacgataatttccaggtaagattaaggataaaacaaaaaagcttataatagcaatttaaaacacgaattcaacgtacgatccaccacaatcctcgtcgtctttcaaacttaaaataccgaaactacccttaccttcttctttccataagaaatcaaaaccaagtcctatggtcgcaattgtatctctatctaaaaatcttctttgaatttgtgtatacacaaatcttattcaacgaatcatttatcaccaaaaggttctctcttttttgtttgtttctgtcttgtgtgaatg

SEQ ID NO: 23829 - DNA, 3000 bp, Unknown; identical to SEQ ID NO: 6169
  misc_feature (1)..( 3000): 2750-1469P.txt file - cDNA_ID_2153571; gDNA_ID_1620852; Annot_ID_170354

SEQ ID NO: 23830 - DNA, 3003 bp, Unknown
  misc_feature (1)..( 3003): 2750-1469P.txt file - cDNA_ID_2153571; gDNA_ID_1620520; Annot_ID_159441
aactcgggtctatatttttattttacttttatgattatgattagtcgttatcggccgatttatttgttatttaacaatttgtttaggattatagctttttcggattgggaggaatcatgttcataatatcgcggaggtgtaattattcacgaaagtgatagaggataaaaataaatttgtttagcatatactttatttaacgggtgatagatgattgaagttacatctttcaaataattggatattattgaatttatattaatagttgagaagaatgtttttaattgagtaatcaacacaattaaaagaattaaaaatctgtttgtgtgtcgacatttgaacttttaaggagtcatcttcaatcacgaaccagtcaacattgtgccctttatacgaaatacttagttcaattaggtgctaatagctacttctaataactttagtagcacaaattctggcatcatgtatatccaacaaaaaatctcaagataactttccgaagaatatctatcatttaaaaataaactttctctaaacatgtattaatcttccaatcataggaattaatagtggaacaagctagccttctaaagtattacaagactgattttgtcttgaatatgaatataagttatattacaaactagcctatagtctagcaatttcctaataatatatgaaaactaaatctctacatattttctcccttcgaattaattagtcatttgtaccagaggcagagatgatagttacgagttcataataattaagagttaagactatatatagccttaaagcttagaaatatacaaaagatcataagaacaaaaaataattttcttttataaaattaagatcacatatatatataaaggaataattggattgtgtaacacatatacaacaaaatttagataaatgtcatgaattttgtcctcttttattagaattttatcttgtataatactaaaaggtaaacataataacatttgatttaaatacaaaattggggtttatcatgtaaaaccaacctcacaagttttggaatgaattgttttgtttcttctaattttgtggtattacatatttgttattagaggggaggtcggaattaaggagaataatcgagatgagacagcaagcaataataaaacttagattctaaacccacttccaccgaaaatatgtagtagacaagtcctttatgtgagattggtttggtgggcggaggaataaataaagctgatttttttttgtatatgatcaatctctctctcttctgtaattcgatctcacgatgcttgtctgagagagaaagagatatagaaaggaacaaattatgctgtaatgataaaaagatcttttatgtctttgtgtcaatcatttagatcacacttgttatgtgctcttcagtttttcctttttagatacttgttccttgtttccaataacagaaatttatggtttattttttactcgttggatatatgtataccttattctctctctctctctttttggtttcctacttctttctttttttgttacaatatagaagtaggaaacacacgcatccgcacaagtactagcctttccttggcacacaacaccctctcacctccacacattaatggaagaaacttggaaaagatttgcatctaatttttcaatgtttgttgcagcggtcaaagagaaagaaaacacatcaaacagaaaaccccaatagaaatctatttatttctggtcttgatcatgatactaaccttgactatgtttttaatataaaaatgtcgtttaatgtttatcacaagatataatccttacttagtaattgaattccggaccccaaactaaaatacttcgaattagtattgctttctgttgttgaaacaaaagataagcaataatagtgtttgctagtgtgctagattccaacaattttttcttccaaaagtacaacttttttttgcccatttcgtaaattcatatgtacatatatagttgaatgttgtgggtgtacgtaattggtaccattaaaatcaggaaatcacaaccttaaaaataacaaaaaaaaaaagaaaaaagaaaagacaatgatattatagaaaactttgtgaaaacatgaattaaattcagtaattaatcaagacggaaatggtctgttcagaatatttttcttgaactgtatactttttcaatctataactttctttttcactttcaggaaaattcgtgtccacatacattttactagtatatatttgcctcatttccaaaggtgtgtttcgtatagtatcaacgtttagcttttaggttctatattcgaaattttacatgtttctatgatgtacgtatatatataatattagtcgtattcccattcgtgagatcctttgattacttattaattaagatgcatttcagttatatttttgggcaatagatcaatcatccacagtagtttaagtttcataatggaccatactattaattaaacaatcaacattgaggaattctctaattgaaatctcttattcaaaactttaacataaacactatcttatatatataaaagattactatacattcaaacttatatatcaacacacatatatgatcatttgataacacctaccatttgtgttatacatatattttatagagaagttatagaaaattatactgagtatacatctatgtgtcatcgaaataagctgataataacgaatacacgttttctttttatgtctggagtagaatacagcattcatgcccttacgttgcaggttcccatcattttacaaatattctcttctcttttctactttctcttttttgatgtaatacgatctatttatttattctatatttcactatatatatctcagatgtccaacgtttcagtattgcattgccactcgaattacctaagataaaaacgaattatcactttgatttttcgcacttatagttaaatctattctcaaaatttaaacaaacatg

SEQ ID NO: 23831 - DNA, 3003 bp, Unknown
  misc_feature (1)..( 3003): 2750-1469P.txt file - cDNA_ID_2153638; gDNA_ID_1620784; Annot_ID_50393
aatatgtgcatcttgtatgtgggggtcttccatgccagggacttagtggttttacaccgatttagaaataaagataaaccacttcaagatgaaaaaaaacaatgaagtgacggtttcatgaatatcatagactatacttgaagcccaaatacgtcttgatggagaacgttgtaaatcttttaggtttcatggaaagatttgttggtcgttatgttgtagctcgtcttgtaaacaagaattaccaagcaagatgaggcataatggctgctggtgcatacaatgttcctcaatgtaggtacatggtgtattagtatcggtagattaaggatcccaaatcaattcatgaagaggaaatgaggactaagggaagaaaggctagagtttgggagaagatgaagattgtggaaagtggcatgttgttgctgttccagtcgggattgccttaggatacatgtttgggatggcgagtcaaaggttgtgtgatgataaacctgtcatagactaccctttcatgtatccctgaatgtcttaagagaaaggtagattctgatagattaaagatcccaattcagttcatgaaaaggaaattgaggactaaggggagaaagccgagagtctgtgagaagaagaaaattatggaaagtggctaagtgtcgagtaaaggagtattgaagaaacctcttcctgagctagaggattttttcttcttattatcttcctttagaggattccaaaacaactgttgtgatctcatctcttaataacttcttcattgtttatcttgctttgacttggatttatattaggatttaggactgtttattttttttcttttaaatgatttcattaataactctaaattatctgctaggtttcatgatactatggggatcctcagcttttgttagataggtttgaggaacttagtgaagaaagtacacatcttgaattatgggtggatactaagaattaaattatgaatttcgtatttattagattagttgctgaggacgaattattgttggagtgactaatacttgacgaaatcttgatgcactctattctttcctttttatttgctctacttcaacatgaagactaaaactatcaaaagagagtttagatccatggaaatatggaatggatgtatttagggatggtagagtgtacaccaagctagggcatgtgcagaacctaacctaaagcttaggcagcaactgttttaagattttacaaccaatttttttttaaatagatcatgggatcataggggccagagagtgattgcgcctatctacccgaactattaacatcagataaatcaatcgtgtctctccatcttttgcaattaccatattctcttttaaggtttttttttttttgtttaactggtcaagttacttattactctatctgttattttttaattgattttctagaaaaacacacaaacacatattaaaactaattataaatatattagtttttgtgatgtagatttttttataattctaaaccaataattatttgtcttaaagtttaaaattcatcaataataactaaaaatagtgtctagaaaacttaaaaatcaactttttaaaaacaattttttttctaaaaaatcaaataataatgaatagagggagtatcgaccaaaattaaattttgttattataaaaatgtgaaattattttttcacaacaaattatttagcactttcagttgggaaaatggacacaaaaacaattgataatttctttacggaaagataagtatgttttcatataaaataaataagtcaaaataattaaataaataattcgaaattagtgaattacctctgtgaaaactatggaaaagtagaattttccatatatttttaatttctatctaccaagctttttatttcaaaaacattcatccaattaataaaataaattgaaatgtcaaagtgaatccaataaacgaataagccgacaaataaaattttagcgtgaagcccacgaggttttttttatgggccccacttttctccgcaccaaatcactgacttctctttctccgtatctttcttcagctcctaaaacccagaaccttctttttccggcgagggaagagcttcctcagccctaatcgctaaatcgatgaaattatgctcccaacgtttaacggtttaaagatcattccaaaaactcaaccttttgcgtgtctcctctcgccatgaccctaatctcaaggttcgtctctaatctcatattcagggtctctcgtgaatctctaatccgattaattttgattgcccttttagccggagattgcttaaattgattgctatgtttaaaaattgaacctttgtttataaagttttgaacttttctccaaagtcttcgtttgattagatcttcattgggtgggtttggttttggtttcttttgcagatttttgatctctagagtgattagtagaactctgttttcgaatcagaataatagaacagctattaatgtttctgtaaagttgccacaattcagaattcagagtaatggatatcacacattgggtcttcttcataatgttaaaggaaggtttttaggtagtaatcatcatcagcttgcgcgtaggagctattcgattgcagttgcgagtaatgtagttaagcaacatgctcaagtctcttggggaaggcttgtacagagagtaactctgagtcgtagttggaacttacctcggataagtcagattgctcaagcgtgtagcttgtctttagcccgttcgcacttcttgttacctggtttattggctcttacctatagacaagtggcgtatgcgcaaagggtggttccaaatcctgtggtctattctccttcacacatttctccttataggagttcgataaacttccctatcgttctctcgtctttagtgttttctgcggtcaagggtgttgttctgatcgggagagctctttatttagcaattttgttttctccaaatgttattatg

SEQ ID NO: 23832 - DNA, 3003 bp, Unknown
  misc_feature (1)..( 3003): 2750-1469P.txt file - cDNA_ID_2153638; gDNA_ID_1620784; Annot_ID_168063
tctactatcatgaatcaaaatatatccgttttatattgatatcctttatatattgatatcatttacagattttcttttgaaaatcttttacgtgaaggtttttttccataaaacattcgaatgaaattgctcatatagtttatgaagtttgttaattgttcccaatatatttagaatcacagaagtaacctttaaattgtgacatagtgttacaaagataacattggtaaaattactttatttttggctttttttttatatgaacggtaaaataaaattatctatttaaactagaactgtacggttttctttggaaaaaaatcagtccaaaataaaagagcttacatgaaaaagataaaacctcgtgctattgccttttttgcaagacaatcagcacgtatattgtttataagagtcctctttttaaatgctagtcatcatgcatgggattaactatatatcaactttctcttatgttacatcatttttaggtgtattagaaggaatacaaatcagaagaagatacttgggagccgtatgatggattggggtaaggttttttaaattactgctttggccttctcatgttgtcctctaatctgtatatggtttcattagaaaatacaaataaaaacttaaggaattcgtaacgaagggtttcaagtcaaatttattgccacttcttgtaagctaagtcatgttaattacacatgtaaatcctccaaatatttcttgttccccacttttcgtaacttttcgaccttgtgtcgttcttttaggaatatgtgcatcttgtatgtgggggtcttccatgccagggacttagtggttttacaccgatttagaaataaagataaaccacttcaagatgaaaaaaaacaatgaagtgacggtttcatgaatatcatagactatacttgaagcccaaatacgtcttgatggagaacgttgtaaatcttttaggtttcatggaaagatttgttggtcgttatgttgtagctcgtcttgtaaacaagaattaccaagcaagatgaggcataatggctgctggtgcatacaatgttcctcaatgtaggtacatggtgtattagtatcggtagattaaggatcccaaatcaattcatgaagaggaaatgaggactaagggaagaaaggctagagtttgggagaagatgaagattgtggaaagtggcatgttgttgctgttccagtcgggattgccttaggatacatgtttgggatggcgagtcaaaggttgtgtgatgataaacctgtcatagactaccctttcatgtatccctgaatgtcttaagagaaaggtagattctgatagattaaagatcccaattcagttcatgaaaaggaaattgaggactaaggggagaaagccgagagtctgtgagaagaagaaaattatggaaagtggctaagtgtcgagtaaaggagtattgaagaaacctcttcctgagctagaggattttttcttcttattatcttcctttagaggattccaaaacaactgttgtgatctcatctcttaataacttcttcattgtttatcttgctttgacttggatttatattaggatttaggactgtttattttttttcttttaaatgatttcattaataactctaaattatctgctaggtttcatgatactatggggatcctcagcttttgttagataggtttgaggaacttagtgaagaaagtacacatcttgaattatgggtggatactaagaattaaattatgaatttcgtatttattagattagttgctgaggacgaattattgttggagtgactaatacttgacgaaatcttgatgcactctattctttcctttttatttgctctacttcaacatgaagactaaaactatcaaaagagagtttagatccatggaaatatggaatggatgtatttagggatggtagagtgtacaccaagctagggcatgtgcagaacctaacctaaagcttaggcagcaactgttttaagattttacaaccaatttttttttaaatagatcatgggatcataggggccagagagtgattgcgcctatctacccgaactattaacatcagataaatcaatcgtgtctctccatcttttgcaattaccatattctcttttaaggtttttttttttttgtttaactggtcaagttacttattactctatctgttattttttaattgattttctagaaaaacacacaaacacatattaaaactaattataaatatattagtttttgtgatgtagatttttttataattctaaaccaataattatttgtcttaaagtttaaaattcatcaataataactaaaaatagtgtctagaaaacttaaaaatcaactttttaaaaacaattttttttctaaaaaatcaaataataatgaatagagggagtatcgaccaaaattaaattttgttattataaaaatgtgaaattattttttcacaacaaattatttagcactttcagttgggaaaatggacacaaaaacaattgataatttctttacggaaagataagtatgttttcatataaaataaataagtcaaaataattaaataaataattcgaaattagtgaattacctctgtgaaaactatggaaaagtagaattttccatatatttttaatttctatctaccaagctttttatttcaaaaacattcatccaattaataaaataaattgaaatgtcaaagtgaatccaataaacgaataagccgacaaataaaattttagcgtgaagcccacgaggttttttttatgggccccacttttctccgcaccaaatcactgacttctctttctccgtatctttcttcagctcctaaaacccagaaccttctttttccggcgagggaagagcttcctcagccctaatcgctaaatcgatgaaattatgctcccaacgtttaacggtttaaagatcattccaaaaactcaaccttttgcgtgtctcctctcgccatg

SEQ ID NO: 23833 - DNA, 3000 bp, Unknown; identical to SEQ ID NO: 5406
  misc_feature (1)..( 3000): 2750-1469P.txt file - cDNA_ID_2153638; gDNA_ID_1620785; Annot_ID_168096

SEQ ID NO: 23834 - DNA, 3003 bp, Unknown
  misc_feature (1)..( 3003): 2750-1469P.txt file - cDNA_ID_2153903; gDNA_ID_1620773; Annot_ID_167589
cattatgaacaatgaagattttaacgccgatgaactcctcactttcgtcgcctataggttatgttttgtacttctgtctctctagactccatatataactcgcaaatactcttttgaattttgttttgagaagttgtgttgttttaatcccacttgcttgtaacagtgtgctgattctaggtctgaattaaatttgttgtccttctcctttatgtcttagaccatgttttttgtaaactatttttcagatcaagtattctgaaacgccttggacgtatgatgtgtcatgccgttgctctcagccaaggcggctgtgtagagataaacattgaacattttggcactgattctctcctcacctacattgctgataggttctctctctacccctatcccacatgcacacaaatatttatcgttctaacgaagtttataaagttgtacgtctacataagtgggattgattttatatctaaaacggttatgctaatttctaggtctaattctagtcaggattgaagaacaaaatatctcagttggtttagtggtaaaggatatgtttgttccttagtgccttttccttatgaggattaggagaattattttggttaattcgtatttgacatcaacgtatattgagtatggacatactgtatataggttccacccgtctctcttcttatactcgcaagcattagcacacaggttttgagttcatcgctactagtacagtttcataatgatattatatttgtatcttgaattgttcttctatctcttgatttttgtttgttaactatacttgcagatcaagtaatttgagacaccttggacttgctaagtgcgatcaaataacgggcatgggactgttcacagaagccatgaaacttccattgcttgaagacctcgagctttcatactgcttaatcaaaggaaagaatttggaagctataggcttcgcttgcctgcatttgaagacattgaagctaaactgtcaaggtttcaagttccccggctttacgtatgatcatgatgccctaggcattgctaaaagaatgcccgaactgcgatgtctccagctttttgggaacagagtatcagacgtagggttgaacgcgattttcgacggttgtcctcacctggaacacctcgatttacgtcagtgtttcaacattaatcttgtaggggatctggagaagcgttgtatggagaggatcaaagatttgagacgccccaacgattcaactgctgattacccatatgatacaagtttgctcgatctaggcatttgaaatcgttttgaagtctgtttagctggtcttgactacatcaaacaattttaattatgggattaggctcgagacggctcattttattaagcccaagaacgatggaaatatatatatatatatatatatatatattttttttggttagcatttgaaagaactaatctattttaaatagtttttaacatcgaatggtaacaatgtattaatttcggaaaagacattatatgcataaatgtgtaataagcaaagaaagaaataaaataaattgctgtcacaagaaatttcttatcaacttttacacgaattatatcatacataaaactatttcatcatgtcaaattatacacaagtcactatcccgtcagtcgtgtcataacaaggagagtaaaaaaaatatgttgttaacattaacttttagaaaaattaaatgaataattggtttaaattctaagaaccagcttttatataatagccaaaaaactagattttagcattaattcttaacatttttctattttcttctttttgaagatgtccctggaatccatgataatccgaaaaaattgatctgaatccgtatccgaaaatttagatttattctattaggtcttaaactcataaatttgaatccgaatcaaaacctgaacctgaacccaaatccgaatgttttattcgaaaactcaaaattttcgcagaaatttatctcttttaacaaacccgaatatttacccaaaaataagatggttatagaaattctcatacgtatattgttttatttagtcaaattatgtatcaataaataaataaaatatgttagacactagaactcgacttcgtgatcaacgtacgcatcaataattgaaatatgatttggtcgagtatatatgaaatttttttggcagaaatcaatagtttaactaaccgttttcgtttatgtttacatcatgtttgtttaaatttttatgtcatgtctgtttcaaattttataagttgtaataattattaagatatttaaaattaaaatatttttattttaaaaagtccaagttaagaaccttttattacagtcaaaattttaatcttttaacaaaattcttaacgtcaaaattttcacaatcaattataaaaatattcctaataataatgctcttaagagcactactatcgaaggacgtctcaatttgtattggtttggagtaatccggcgtggctacacagacgaattgtagaagaagcttcactaagagcatttccattgcataaccttttattgatgtctttaagactaaccatagtaaaaatagattaaccatgattaaaactaaagacatttgcttttttgggtgtctaaaatgtcttagggaagacatatttgacatcaaaaaaggtgaatgtctttaattttaactatggttagtctttaaaacacacactagaagttatgcaatagggatggtctaagttctttgctaggttactttaattcttggatttttgaacattgctctgtttttttttttagtcaaacaacattgctctgtttccgaaacaatccgctatgatattggcctaatgtattgtatgatcctaggcccaatgcttattgggccagtaagcaattggcacaaattgtattcgtagattttttagtgcgatgaggactagatagtaaacttgtgatctcaacaattttccgattcccacagaaatg

SEQ ID NO: 23835 - DNA, 3003 bp, Unknown; identical to SEQ ID NO: 23834
  misc_feature (1)..( 3003): 2750-1469P.txt file - cDNA_ID_2153903; gDNA_ID_2926216; Annot_ID_203000

SEQ ID NO: 23836 - DNA, 3003 bp, Unknown
  misc_feature (1)..( 3003): 2750-1469P.txt file - cDNA_ID_2153909; gDNA_ID_1620773; Annot_ID_167591
ggcggagcttccgccggaactaacatcttcgattcttctccatctcagcacgattgagatactgagaaacgctcaaattgtatgcagatcgtggcgacgcgtctgcaaagacccatccatgtggcgcaaaatcgacatgagaaacaacggaatctttggttacgactacgacagtccgtcacgccgttgatctcagcgaaggtggtttagtcgaaatcaacatggtacacttcggcaacgattctctctactcctacatcgcccaaaggtttgtttctattcttagaatttttggttggtttcagtaaactttctagggtttagatcagattattaacaggattggagaaggaattgggcgaattagggcaaaatttaacaaagcttgtggtttttattaactggatatgttgccttgggattgtgtgaaggccttgcaagttagaggtcatgttgttgaatctgtggttttgataaagcagtgttctctaagatttaagatgaatatggttatgtggtatgtatatatgcttctgagttgataagtattgatattttatcacaattttctttttttcagatcaagtaatctgagatgccttaggcttgcaatgtgctatccactaactggcaatggatttgtcagtgcagtcatgaagctctcattccttgaggaactcgatatttcacagggctatacacaactggatttgaaagctataggccactcttgcccactactgaagacattcaagctaaaccgtccttctttcagccggttcgttaaatatgatgcataagggttccctttttctagacatttcaagtagaaagagaaatgaacagagttggaggaagacatgtagatgaagtgtggacttttgtctagacgcactcgggttagcgtttcgtcagacaaaactgctaatttcccatcgtgcccaactttaatccaatttttcaaatcgtctattctttgttctgaaacgtagctaactattagagcaagtattggctctagaatatataacctgcaattcttcatattttgctaaaagggacgatgataagttagaggaatgataaatatttggaacaattcaaggaaacttatttgtttaggtgcgaactgaaacatgtctgcagagtgtccacgatttggtatgacaatgatggcacgggaatgtggatggatgcttgactgagtaggaagattaggatcgacgttgatagggggctgttttatgtaaaggtttgtattgagcaaaacggtttacaaaagtgagtaataaaatggaagtttcaataaataattaatattccggagcgatcaagcttagtggggagaatgggtgtagttataaaaccatttcctgaaaatgttggagacgaggtaacggccgatgaacttgtttatatatttgtgccaaaaaatagtcaactaccacttgatttaataacgtaacatatgaaaacatagattcttaaatgaataacatatgaaaacatagattcttaagtggtccgcaaatgtgaagaacattaagaagaacaaaaatgaataaaaacatagattcttaagtttcttcgcaaatgtgaagaacaataagaagaacagaaatgaaatcagtacttatgaaacacatatgatgacatagaccaacgatactcattgaggttctgatggtccgaccaacactcaccgtaatcctcaaactcccaggaatttttgtatgttccttgatgacgtggaccaacctcgttaatatggaacattagcttatctccgaataagtcgacttcactaaatttatagcacattcgcttgtactcagtataaaattcccacggaattgatccatcgcaactatggagcatgatgtaaagtagaccagcatgtgaaaaaacatcttttatgccatccaaaatatcaatcacttcctggagctcacacatatgaaataccaacactaaactctaaagatatagggcatagggatttttgaaggcgaggcatttggtgtaaaacatgtggtaactagaaaattcttgagccatatgaatgaaaacaggggacttatctagtcgaacagaagaaagagtttcccttgaaaaaacagcggctttgcttcctccgttccctgattttcagatgcctgacacgtagctgctaatatactaatcttagtttttgaggacggtgtagatatgttaaaggcttggattcaatcatgactaaaacattacctgtatgtgaaattaaccaaatgttgatgacgaggctggacggcaaattgatttcccctaatatggtcaaggcacttggtggtcgccagtaatgtctagtaggggccatttatcgaagatgggtacatttgcctttctcgcagataattttgggcattctgtattatcaactcgaatagtactgaaagtggtgtaaaagtagcaatataaataagaaatttgaagtaaaccagaaaactaggatcgaacctcgcaaatgggaacagacttgagatagtgatagaatgggaaccctaatactctggaacactaaagaggggtggggagatgggttactggcggcatatgtggtgggccatacaaaataaaaaaaattagacatggcaataagtatatgtaaatcatgtgtgtccaaattatcatatccaaagttatatatctgcatggtatataccatatagacttctagaacatgtattgttacaagcaattcatgtggaactcatttattggggattcggttctagaattttgtttttgctttggtaaacatgtgaagagactaggttatacatacatagactgaactcattaaacaccaacaacaatgttagattgataagacttaggaaatataaaaatgtagatggaatagcaaacaagaatttcacataacaaagacagaacagtagacgcagaaatgcaaaagatacaagttttagaaaatataaacatgtagatggacagataatgatg

SEQ ID NO: 23837 - DNA, 3003 bp, Unknown
  misc_feature (1)..( 3003): 2750-1469P.txt file - cDNA_ID_2154097; gDNA_ID_1620799; Annot_ID_168592
ccatggatgaggtctcctttaccaggatatatggggccggattttgttccagccccaagagatttcgtcccaagtgaagttatttggcccgaaaagttttttggtcaaacgaatctatttccggagatgcatgaagcatgtcaaatgttcattcaaaaggtaaatgtaagaatagtgtttcgttgttgccaatgtggtttggtttagggtttaatcaaatttcaggtttagggtttagttgtgttgattgttcgttatattaggtgaatcatatagtggtggtatagttgtattgatggatatttagcgagaaattgacatttatattgttggacaggtggataatcaacaccaagcttatcgaaggcgtcaccgccaactactcattaagttgcaagacctggagagaggtatgaggcggttggaggctcatccgaaagactgggtgagatacggtttcgacaaagttgctgacattccactgccactaaggagatggtgtgttgagcatgatggatcgtcaccgaattatgcgtgtttcgcggagccaattcccattaaggaggacgatgaaccagatgatggaagttactacaggagagtggatgagcctccacgcgagtatcctcctgactctctctttcaataaacattatgtctttgttttgcttaagtttgtaaaataaatctaaatctaaattgtggttttaaatctttattttgctaactatctgtgttttgaatacaatatatgaatctaaatgtttgaatataattatctgtgttttgaatgtaaattttgctaacaattatataatcagtcgaacggaggtactttattggtcgaaccatttggacaacttagtcgagccatttggactattagtcgaaccggatgaactatttgaactaatcagtcgaactggatgaactatataggtcgaaccgtttgaactaaccagtcgaacacatttgaaccatttgaactaatcagtcgaaccatttgaactaatcagtcgaaacgtctcgcacgcattcaaatcgccaacaatccttaacagaaactcttcaatgtttccatcattctttgcaccagcttttactaccttgaccaagaagtacaacagcactaacttcaacctatctgaaccatgcttcatcttcgagcacttagcaagaacatctaaaacctttatcctagattcttttttgaatatcctcgaacaaagttaatattccccattgtatttagttcttttggggaactgtggcaatcaaacccacttaacaacgcatgctctttaatggaatacctaataggtactccatttaccacaaaccaagcctcctcgagcaaatttgtcttcactatgcgtaacataagcacccacatgcctgacgattaacgttctctaccccttcttttagaattgtattcaccatttcctcctcctccagctcctccccattcccgtctttcgcttcttcgaattgttgaatgacagcgtcaattagaggtttcaaagatgtacctgtctgatcctcttcaatttcggcggttcctttaggagaagcctcatcaccatcacgcggttcctccatagccttttcaatcttagcggtttcttttgtagtatcattcgccgcaacatctcgtgctgctggttcggtcggaaccaagtcgacggcatctccgtcgttctcaatttctgaagtaactggttctgatgtcgaaactttaccggacggcttgtccgtcgaagtaactggttctgatgtcgaaacttcaccggacggcttctctgtcgaatcatatacagggccacctttaccgtctccggcggcatctccgtcgttttcaatttctgaaggaactggttctgatgtcgaaacttcaccggacgacttctccgtcgaatcatatacagggccatcaataccgtctctaacacgagtcatcaaactattacacgaatcaagaattcgtcggaaaattgtgaaaggcgagaaattatgaatttgattttggaaaatttgaattgaatgagagtagaaacggtttgattttagaaattagggatttcgcttaagtgtttggaatgggttttgggttgctaggcatggatcttaattggatcggatattttgttgggtcgtctgagtttttggtcttttgccaattatttggattttctctcatttatctttaattcgacaaaaattgggaattagaagagtggcattcctggttactttttcgcagatagtggcactccagacatttgaacttttatcacttatgccacttttttgaaaaaactgatctggactgccatcagttaatctgaatgccaccgaaaatgtgatataccagttgtacccttaatgagttgattaaaaaaatgaaaaagaaattcaaaagctaaataaagaaaatcgagttcggagattctcctcttcgtcgtcgtgttcttcttctttggtcgacgttcatcttcttcgttggccaccatcgatttcctcatgccgccgacttgaaatccggcgtaaaagccacgaattaggtcagtttcttctcatatttcctttgacattggtgcattgtgattttagattgggattttgaattctatataattcccagctcgattcaatttgatagtttgatgattggtttgcaaagtaaagagtaatcgattagaggttgccgaaacgttatttgaggtgatgagcaaaggaatgtaggttgaatgtgagttgaatttgaattccgagatttcatattaaagatttggggggtttgtgtttgcaaagtttagattaaccaattagtttaacgaataggtatgtattaacattggaaatcaattgaaaggtaacgaattaggttcagtagaatcgagtgcgacgagagattgatttcaacgtatgataagagtacatgtggtataactattaaaatgtttgattggagttgaactggttgtattttcaggagcgatg

SEQ ID NO: 23838 - DNA, 3003 bp, Unknown
  misc_feature (1)..( 3003): 2750-1469P.txt file - cDNA_ID_2154433; gDNA_ID_1620800; Annot_ID_168609
ttatcctttttctcatcaaactccactttcatcaagtcttccaaatctctttaagtcctttttcttttttgattcatcctctaaacacgctcttctcaaatcttctagaaaccgatactcacacaaaactgtcgcatcctgaattatttcttgaatcattcagcaattttatcagataaaatcatgtattacttcttgtatcattcaacactttcatcagcagcagctacatcttcaacttagtcctgtaatttattttcttaacatacaattgaattcagctaatcgtccttgcgaatgatcaaatgcatagataattgtatcatcctaaataaaagacgtggggaaatcatatgacatctagaactttggagaagggggagataagtgatgatgcatggaagcatttcccaaagataatcgaatagattctctcttttcttttgtgttcgtcagtttttctttaccattccccgagacaatatggtgggtttattaattattttgattcttctataattcttcccattatttttatatattctttttaagttacccattcttttttcttcaatgtcgagacgtcgagttagttagcttttacggcgacttatggataaggcattacgctcggagccatggactgagttggatagatataatgcgtataatatttaatccccataacctatattttaattcctatacattgtaatggtagcatctcaactttaaggttagagttggaaccttaaagtttatgaatattacaaaacacttgtatgggggtggagtgcatgaaaattagagctgggatgtatatatgggaatatatatgcactacattatcttacattttacattgaaaaaatattagaagatattgttcttcatttatttaagtatatttttactgctggtgtattctactgccctatatatatctcgaaagttaaataaattcatatgttatataacttttagtcattcgtggcattcttctgttacatcttactgtggatttttcgtcttattatcttatagctgactcttactttagagagacaagtataccacaatggaaagggtgatttgacggtaaaaaaagcgattgcagtgtacccacaaacgacaatttataatttgtatgtgggatatatagtaagggaaataaaaatcatagggttaaatagaaaaagtgaatgaaactgtcttgtagttgtagtagacgaatcaaaaggacacgtagatggtcaagatacgaacctcaaagccttttccctcccatttaatgattcttgtttttgttttaatctataatttttcatgattttcttaagtctttgttttgaaaatcacgaacgaataagttctgatggatgtacttgaatattagtaacaagactaattgaattaaagaaaagagaagttattcctttgacgtttataattttccgcggctaagggaacatatacgttccttgaaactgttgccatgcaacttttgctttaacagtttagagagttttttacttcatgctacatcctttttctcctgacacacacaagagcatattatacatccatgtacctcctccatcgaccatcaatatatagatacatgtgattattaattatctacataaaaagttataccacgaagttgcgattgataatatgaaagtggtacatgctcgaaatagataatgagaatatatcagctttagttgtctcatcgttagtcaatctatatgtgcatatacagttaacaagaaatctataagcatatacgaactggggtcccaataaggtctaagaatcttttttttctttttttcttttctttgctttgctttagtttagtttgtgaaatttagtgaaaatttcattttgtctcatagagaaaccacatgttagtcaaaaattatatagtaagtccaagaaaactatattaatatacccatattaccatatagtcggagatttctagtatctctagtttagttcttcttattcattatcaattcaagtgttataaaacctcgagaccaataaaataggattcactctccttcgtgcccccaaagatataggtttacatatctatatttccacaccaccattttaaaagcaagagttaattaaagagatattttttagtcatcttggtatgtaatctggtaaactttttagtttgttatcttgtataaacaaccagtaagattttggttcttttgtaaatacttctctttgaatttaggactagtgttttaaaattactttcctcccatatttttgttttgatctttcaatttaaattaaaagttcgtttacaacccatgcatgcacacttccgaatttaaactcggattataatttggcactataataatctattagaatacgtcttgattaattttaaaatatttaggtgtcttaaaataagtacgtacgttgataaatatggagatatatacatctgtcaagtaaatggtattgaatttgccagtattagcttttgtgaagctgacgcaaaatgaaaacggctgatatctaaagctttaaccttgtgtttcttttttttgtttaaaatagtggggtctagaaatgataaattaatttaaagtcctcgatatatataaatagataaatttgtttcttttgggaataacgtagtttacggagaaacccaaatgttaaagggaaatgcattaaagctgtagcaaaataagaaagtaaaaaccaattgaaaccctaatttcacttcaaaaaatgttcccggttgttaaaggaagggccttttgctttgtccatataaatatattgtgagagtacaacaacaccttcataagctcttacactcatttcaactctctttttcgtttccattaccctcaggtaatcataacatatatataagttacatttgtagatacatatgtctttagttttgtgtaatttgttacttaattattattttctatggtgttgtagaagaagatg

SEQ ID NO: 23839 - DNA, 3003 bp, Unknown
  misc_feature (1)..( 3003): 2750-1469P.txt file - cDNA_ID_2154448; gDNA_ID_1620800; Annot_ID_168615
ttatatgacagcttttgcaggtttaaacacacagaaattcacggaatctattttcctcatttttcgcctctgttcaaggacttatttagttgattctaataatagtacccagagagagacatatgagcgcaaaagtacctgcatatagatttatggcatttataattttacataccggtagacaaaataggtccaaactgtgtttagattccatctttttacattgacattaactacaattattttggttgactaacgtaagtttcggtcataattagcatttaaataaggaatgaaacatagcaacatatcattgatacggtaatagataagagagattcatattaatatcgagcaccaagagcagaggttgtaattcatagcttttctcaaaaccacaaaagaaaattcccaaattctcaaactgaaatctttcttaaaaactatacattgtactctcttttcccagagacaaagtggggaaaatgtagaaagagatctcctaacaatatatcatgaacttcatatcatccatttgcaaaagaaacttaagaagaaaaaaacttcacatttttttaaggactgatcaaatcaggaggaggatacgttagcgttgcggatacccgaagatgacgatgcactactcccatcattcttttgtttcgaagactctgtgatgatctcaggtacatcaccaatgtccagtgtgtctggaaggtattcctcagcttcagtactgtaaatctgtagaaaagaaacaccaaacgtcattactatgcttaatgcaggaagactgaagaatgaattacctcgagttgattcagcatttcgatagttgcatcaagatcacaagtgttagccaagtaaacatcattgatagactcttgtgaaagaccagggtatgtagctaatagatactcaatatccatgtccatctccaaatcctcatccttcagctgatgattgtataccatctcagatggtgacttcttaggtgacatttgagttccttgataacttcccattccttgaactccatacccataataaggttgttgctggtggtgctgctgctgcatgtgttgttgtgtgacaggctttgtatcaaccaaagaaccttctcttttcgagagtggtacataagctgctgcgtaaggattcaatgtagaacttcctgacttcattgctaagtgacacaatccaacaaacgaaagaagagttcaaatcggtgactacaaatcagatccctaattgttcaaaaattgattccaataagaagaaacgtgaccttaacctaactaatcaaaattgatgccacaaactcgatgacctaattcttcgtgatgcttttaggtacagatcaaaatcaatcaacgcaatctttaacagaaacgaacaacgaaaccctaaggaatcgattctaagattctaaaagcttcataaacatagttgaatcatgaatctaacggagatagtagataaacatgaatcatgaatctaacggagatagtttcttctcccatgatcgaccaatcaaagcacgattcgcgtatcaaatcaacatagatcgaagaaatcaacagatagaatcgaaagaaacggattcaaaacggaagaacaaaaggcgagatgattgcgattacgtcaacgatcgtcgtaagacgcttaccttagagaagaaaatccaaaagcgtcgttgaagaagaagaagacaatggtgaatatttgcagagagagagagatctaagaaacgctgaaaaagtggggagaggaaagaaaacgactcttttgatcaataatggacttttatatgcaacaaagaagaagaagcgtttacttgaaggtcgtatcattttaggggtctgtttggaaacgtgaattatcttatccctaacctggttattgttatcctaatattcgttttctttataaaaaaaaatctttgatatttttacctggtatgctgacgtgtcttttacaaagtggctacctcttcgttcctaaatttatctctacatttgaaaaatgcgtgactaaacgagatgaaagtgattttttcttatgtcctactaatcatgattatataatttgttaatgtattatttaaaatactaaatcaattagattttctataaccaagaaaaaagaattaggtcaatggaatctgcccaacctaatcacggacgatgttttggttaaacatatcgttaagatttggatgaatcttttatgtcatgtatggccggttccaagtgtgactacaggatttgggcaaattaacaaacacatttataaaacatttataacataatttagattaaacacacaatttaaaaatcaagtcttagttttattgtttggttttgaatctatatatcttaaggtcgattaatggtttcgtagtgcttcaatatgttatatatggtggtgctcctcttttgtaagttatgatcatcagatttggtttagtagacatttcggttaacttaatattaaggttcacaacaaacaaacaaacccccctaaaaactagcatcatcacatactgttttatgagcatcatcatctcagacgctaaagtagtgggacaaattcatttcaaatttgccaagtcaattcaaaataaattataccaaaaatcttaatttacgctaaactagtgggtctttttctccctaaaactaaacgtgttatttacttattcatcgtctcattgtaatagaattgaaaatgaccaagagaaaacattagtttttagacattctcggtcaaagccaatactgtaatgaaaaaacaaacagtttcacataaatctactaaaaatagcgttacaatttttttactctacactcacatctaataataagaatcactacctttcactgctaatctctctctctttacaaatccaaatcttaaagaaaaccaaaaaaataataaagaagaagaagaagaagaaggagagtgattaacaaaaacataaaactccattagagtgtgatg

SEQ ID NO: 23840 - DNA, 3003 bp, Unknown
  misc_feature (1)..( 3003): 2750-1469P.txt file - cDNA_ID_2154452; gDNA_ID_1620800; Annot_ID_168616
tttgcgctttgaaggtcaaacaaatttaattgtatgattgagaattaggtaactaaataagacattcatgtaatggcatcaaatatttatgatctcagacattttggaaagtttgaaattctttggtgacatctggtcttatagatattttgctgtcaacttagggcctgactggtttaaacgcagcgggtgcggttgcggttgcggaagtttgcggaaacgggcggttgcggtttcaagcgttatcaagtgttttgaacgactggttgagcgtttggtaatgggtgcgtttgcgggagttttatgactggtaaaccagcgggtgcgatagtaattaaataaaaaataaccaaaataaatataatatattactattaaaaaaaaaaatacaatatattattatgataaattgataatatttgaaaaattaaacatacttaataattaaaaccataaataaaactgaaaattcaaaaataaataaattttataagaaaaagcttaatactttatgcatttggtacatcaccaaaattgcatcaagtagtgtgataaactgtaaataacgttgaactcgcgggttttccggattgcctctatacatatgataaagtttcttcaagatatccaaacgatttttaacacatctccaactcaaattttttccaaacgttaatattcttaagaatattttctttttgaacatcacttagaaatctgattttggggtctttggattcttccgtttatttctccacaataacctgttgcagtaacgcaaatgtggtctcgtttgaccaaatgattttctaatcgagaaaacaaatcaaaacatgtattcaatcaaaaaactcaaaaaaaaacaaaaaaaaaataaacaacaatgccatgaaatattccgagaattacactagctaatgaatggatgaaaggatagatcatacttacgtttgattcttgattttgactttgatttttgtcagtttgggtggatgccataattgagagaatagggtttcattgattagggttttctgataagaataagtatagggtttgggtggaagatataattattttaattaattaatttttttttttaacctaaccgctaccgtccgcaaccgcaaatacttgcgggaaggagcttttgaaatctggcaatttcgaacggtatctagcggtttctatgattggtgccaaccgctaataaccgctaccatctgcaaacgctgcgtttgcaggtggcagaaggagaaccaatcaagcccttaaaacatatagatttggttgacgtttcttaacccaaagaaacaatcaaaattcgaagtatgtggaaacatttcctttataagaaacccacacgcatttttttttacttatataaatctcctcacctgcaagagaaaaaaaaaactttcattttattcgtcgtcagtttcatcttgttgcttcggagcgagcgagaattatcgtcggagaatttatcgtctctctctctgaaaattctgatcggtgaagaatcgtcggatcgaaagttcgtttatcttctcgtttacgtttccgtgatttaaatcctttggggtttttttttcttggtaatgtctgtgtttctgaatgtgtggttgatttttgttcgtacactttactttgatcgattaggtttatgtatagttaattgaaattttttggaagatttcagaagaagaagagaagaaacaatccgtaatctagacccttgaattgacctaataataggatacatatgatgactatgaagcagtctttgagtggcagggttcttaggggggtctttggtatctatctgtaggagggcttttaggtgctgtttcgggagattaaagccagattcaaggtgagtctgagagcttggttcttgtatcttcttgtttaccaatgggaatctaggtcactgagaaaccatccttcttgttgatctagtggaaaaaatcgattatttttctatcccaagtagttgctttttctttcttaaccttaacttgtgcaatcttcattctacctaagcatttccccttgataatgaaactctttaatcatctctgatttggccaagagtgttctttttttttgtcatctcatctatggtggattaacagaggttcctcttagttattcttcaagaaggcggcatgaatgctcactttgtttgtagtctgcttatctcagctatggtctccatagtgagtttcccttagagcatatctcgttgttgtccatgatgaagtttttgctccatgcggatcttgtgaacttgctagtagaatttttccgggtaacggcatcagaagatttttattccttcgattatggggttaccatttaggtcaagccaaaacaggtcagctttaaagatgggggtccattaactaggagtacccttcaagcctttgtttccttaaagaaatttctgattcgtatgttgactgaagagatctggtgcaaagtggcagtgggaggtaggtctatcctctttggacacttacccatctctttaaaacccggttatcccaagttttatgtcagtcccaaaccttgtttgatggtgtttgccttgcttttacgataggttggtcatatccggttgaaactggatagatttcccaagattgaaggactgaagtgaacactcaatgtgctaagcttttatttctctatgaaagctccatcaaccaagagggctgtttttagttgtttaacagggtatttgtagatcttcttgttttggtgattgttcctcttggagaaagctgattggagctgtttcaaaaatggattgtcttggtgtggtgcaatgtagatggaagcaacagttcatcgagtttttttgctggattttcaggtgactgataatgtttgcgaaatgaggaatagattttctaaatattttcttacttgcaggtttcataagctttccatcaactagcagtatctgccaatatcacagacagataattcgtaatg

SEQ ID NO: 23841 - DNA, 3000 bp, Unknown
  misc_feature (1)..( 3000): 2750-1469P.txt file - cDNA_ID_2154464; gDNA_ID_1620800; Annot_ID_168620
aataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacctcagctcctttctactaaaacccttttactataaattctacgtacacgtaccacttcttctcctcaaattcatcaaacccatttctattccaactcccaaaaatggcgattcgtcttcctctgatctgtcttcttggttcattcatggtacttataaactcaaaacgaacaaaacatgattacattcttactactttttattcattgtggtttgatgttattttctttttattattgaaggtagtggcgattgcggctgatttaacaccggagcgttattggagcactgctttaccaaacactcccattcccaactctctccataatcttttgactttcggttaaaatattttactttgccattcccaactctctcacttatttttgttcttaatgttagaaatacatgtttgttctgaatttatattatgaatttatattatggttttcactagtgttagaaatacatgtttgccattccattcccaactctctccataattaactgttttttttctttcttttctttaaaacacacaaaaaatatttatttacataaatgcaaataaagatgtgtttgacttgtattattacaatttcttttatatttcaacatatttttctgaatttgtatgtagcaaataaatgtattcttttttagttgttaataaaataaatgtttccttaccaaactttttttttttgcagattttaccgacgagaaaagtaccaacgtccaagtaggtaaaggcggagtaaacgttaacacccataaaggtaaaaccggtagcggaaccgccgtgaacgttggaaagggaggtgtacgcgtggacacaggcaagggcaagcccggaggagggacacacgtgagcgttggcagcggaaaaggtcacggaggtggcgtcgcagtccacacgggtaaacccggtaaaagaaccgacgtaggagtcggtaaaggcggtgtgacggtgcacacgcgccacaagggaagaccgatttacgttggtgtgaaaccaggagcaaaccctttcgtgtataactatgcagcgaaggagactcagctccacgacgatcctaacgcggctctcttcttcttggagaaggacttggttcgcgggaaagaaatgaatgtccggtttaacgctgaggatggttacggaggcaaaactgcgttcttgccacgtggagaggctgaaacggtgccttttggatcggagaagttttcggagacgttgaaacgtttctcggtggaagctggttcggaagaagcggagatgatgaagaagaccattgaggagtgtgaagccagaaaagttagtggagaggagaagtattgtgcgacgtctttggagtcgatggtcgactttagtgtttcgaaacttggtaaatatcacgtcagggctgtttccactgaggtaaaaatactaactactgttttttaattaccggtttagttttgactgaaaacatataagattaatactaaatataagataatttgtatataatcaattcggttttctttggataattttttggaaaggttgatgtagtttctgtcaaatttacttttcttcttttatgaataaaaaataaatataagacataaataactatgatagatttgggtcaggttgatgtaaaaaacatatacaaatagctactatgtacttagctataattatttttaagaaatattaaacatggttcgatctaatttttcttagatagtttaacatagaaattatttcttaatttaagttcgtgtggttcgtttatactcaaattaattggtttacgtttggctttagcttcggtttctttggatttacatatataaaccaatctaaccattcatgaaaacacatggttcggtttagttgcagttgatttgtatgtccacaccatatatattgtggctaatattttggctataaaccaatgtaactttggttactacaggtggctaagaagaacgcaccgatgcagaagtacaaaatcgcggcggctggggtaaagaagttgtctgacgataaatctgtggtgtgtcacaaacagaagtacccattcgcggtgttctactgccacaaggcgatgatgacgaccgtctacgcggttccgctcgagggagagaacgggatgcgagctaaagcagttgcggtatgccacaagaacacctcagcttggaacccaaaccacttggccttcaaagtcttaaaggtgaagccagggaccgttccggtctgccacttcctcccggagactcatgttgtgtggttcagctactagatagatctgttttctatcttattgtgggttatgtataattacgtttcagataatctatcttttgggatgttttggttatgaatatacatacatatacatatagtaatgcgtggtttccatataagagtgaaggcatctatatgtttttttttttattaacctacgtagctgtcttttgtggtctgtatcttgtggttttgcaaaaacctataataaaattagagctgaaatgttaccatttctatgttttggcttaattgacaggaaattttaattttcagcaagtagaccatattaattggtgatacccaatatgagtgtttaaaacattttgtagaattaattttattactagtttaatatgagtgtttgaaagaggggatatcgctccctttttcacttcttatagtgtcttcttttctttacttcttcttgtttcctgatg

SEQ ID NO: 23842 - DNA, 3000 bp, Unknown
  misc_feature (1)..( 3000): 2750-1469P.txt file - cDNA_ID_2154647; gDNA_ID_2926133; Annot_ID_197019
tgtaataaatacgtattagaaaatgatgaagatattagatattctctcgaaatcaagtcgagggccattaaaattgatgattattagaaaaaaggttataaatacttagttggaagacctagctagctaataactaagaaaattaatagaagaaactctctcttattgatatgtcgtcgtccatgcttctatattggatatagttctcgcatatgagtaaatctactatcattaatacaaaaacaataatatcaaacgcttaattagcatttgaacaataaaaatcatttatgtattcatgcataatttagacacacacacacacgcacacgcacgaatatatacatgttgtagtacactagcacttaggtctaaattttgagaactacgcaatatgacaagtaactaaatctttgttaacctaactaatgcgttgttgttgacatagatgaggtacgaaatggttgtaatatgaattcttatacacattagtatatgtggaagccaagtagccaacgaaacacttgcatgtaaatttttttgattattctttacaagcttaaacgttttttatttaacctatagaggtaaaagaaaaacagtgattttggttttgacttatataaaccgaaactctttctatcactctatagagataaatatacaaagaaatgagtaagtttctctcactatagcattaatggagctttagatcatcataaatgcattgcaccctctctatgcgctcatcaataactccttttaaatttcttattgcaactccacctgttcttttccttcctctcttgtcctcttctccttcttcttcttcaacaacaaacttccattgttcttaatacctagctagctcttccccggtttgagattatcccaaaataacaccggttctcgggtaaccggtcggtttttccggagcaaccaacccttttacttctctttatcattgtctcagatcttctgttcttcaaaggcaaaaatgggcataaaccaaagatcattgtgaattagggtttcactgtgtctccaaaagtaagatctctattatcaaaaaagatctttctctctctacacatatatgtatgcatatgcatttgtgtgtatgtatcttaggttatgtttatagatcggatccatattgcatgttgttgagactcttagatcttctatttttttgtttatggtgttttttggttctcaagatctcgatgcctatgatttgtttttttttctagattattttagtttaatttaatttaatgttttttgtgtctttttgcggagacttatgatctaagataaataaagcgttaccaaaaactttcttggagttagcagtttcaaaaggggtttgacgaaatctacttggtggttgtgtcacaaaaaaaagaccattgacttattgtcaacgctttaattaaccctatatactatatactatttttaatcgcttttaattaatcaaccctatatatcctgtattaaactaattaaacttagcctttttcattagttttgttactggaaacggttcgtctttagtgcacaaagaccaaggtcaatttaattctttaataaattcaattgagagatcagaagcttgtgaatctggttctctctctctcttctcttactagcttttgagtcgacaaaagagagagaaaagatcattaaactcgaatccaaaacttcaaccaacaaaagggaaaaaaagaaaaaataactacaaagagatctatctttagggtttcaaaactttcttgagtttcagatcgaattgagtaagtatttatattatttaagtgttcttcttactgtatcatttctgaccatacaccaaactagggtttcttaaagatcataactctctctctctcgcttcttcctacactagatctgtccgatagatctgatgctttgagaagtcttgtgactttcaagattgatttttctttttgtttgtttgtttatatgtacacatacttggagatagatatactctcatatatgttactgtgcatatggatggatccatcttaagtgtgaataaaaactacccaaatctcatttttgtttgtttcttatctcatttgttgtttttgtaaggccgtcattataaatctaaaacaatttatccgttttcgtaaagaaaatcgctttccaaaaaaaaaaactttgaagtaaaaatatcattttgggtctatattcaaatctctcctcatatttccatctcattatttgtaaaattaatatattaggtcattatcatattgattatagagtttatatgttatgttataaagtaaaagttatatatgtaaatattacgtttgtaatatatatatttatacatatgtacgtatacataatttgtatgtatatgtgcctcatttttaacaaatattatcgttaatctttagtttcattataattttttagggatgtatacattatataaatattttatgttatttatatctgaaatttctatactataacatcttagatagttttcatacgtaattaagagttttaattaatagttacataattatgattagatgaatttatctataaattgtatgcaaaaatatatacatatccaaccgaaaaaatggagagtaaacaaaaacctaacaattaatggtttagtacttgtgaaaatgataaaattattaatttaatatatagtttcataacagctagaaataactttcccttaatataattattttcttccatttccataatgattttcttcttcttcattctgtatacatatatgagcgtttcatatataatcttttactaattcgattgtgattttgattttgggcagtggaagatatacttggagaagaaaatcaaatcacgaaaatatattgatcagtgccttgaaggaaaccaaagttgacaactccaaaaatccatttcgttattaatatctaactgagtgatcatagtcaatcatccataacaatg

SEQ ID NO: 23843 - DNA, 3000 bp, Unknown; identical to SEQ ID NO: 7882
  misc_feature (1)..( 3000): 2750-1469P.txt file - cDNA_ID_2154647; gDNA_ID_2926133; Annot_ID_138803

SEQ ID NO: 23844 - DNA, 3000 bp, Unknown; identical to SEQ ID NO: 23842
  misc_feature (1)..( 3000): 2750-1469P.txt file - cDNA_ID_2154647; gDNA_ID_1621171; Annot_ID_173972

SEQ ID NO: 23845 - DNA, 3000 bp, Unknown; identical to SEQ ID NO: 7883
  misc_feature (1)..( 3000): 2750-1469P.txt file - cDNA_ID_2154662; gDNA_ID_2926133; Annot_ID_197023

SEQ ID NO: 23846 - DNA, 3000 bp, Unknown; identical to SEQ ID NO: 7883
  misc_feature (1)..( 3000): 2750-1469P.txt file - cDNA_ID_2154662; gDNA_ID_2926133; Annot_ID_138805

SEQ ID NO: 23847 - DNA, 3000 bp, Unknown; identical to SEQ ID NO: 7883
  misc_feature (1)..( 3000): 2750-1469P.txt file - cDNA_ID_2154662; gDNA_ID_1621171; Annot_ID_173977

SEQ ID NO: 23848 - DNA, 3000 bp, Unknown; identical to SEQ ID NO: 15422
  misc_feature (1)..( 3000): 2750-1469P.txt file - cDNA_ID_2154680; gDNA_ID_2926133; Annot_ID_197029

SEQ ID NO: 23849 - DNA, 3003 bp, Unknown
  misc_feature (1)..( 3003): 2750-1469P.txt file - cDNA_ID_2154925; gDNA_ID_2926140; Annot_ID_197404
atcatatgatttgaatatacatggatattatgcagcggaaatatgaatcatattaattcgaggttggtttagcactccaagtattgtgcctctactggtatccacacgcatacaaactggatcaaacccagaatggtagttcctttgagatctaatctcaaaacttaaaaaaacaatttttctctttgtttttaagagaatgttacactctaaggcacttttttaaaaacatttccgtgattaggcactttctaaagagaaggcactttgaatgaataatttgactcatttaccctttaatcagatatcgctctatctctctttatcctatcctttctctctctttctcttactttctccaaaaataaacaaaaatcaagccaaaaaaatagatttctttcctttttctttcttccctcttcaacaaatcatcagcttttatgagaaagagagattgagattcagctttttaaattttccgcgtctgttttgatctgatttgaaggagaattttttcagaccatcaatttgagaatctgtcctatctggctgatttggttacatgactcgttgaatgcttgaattggatttggggtttggttttcgttttatgtttttgctgtttgttgcaaaattaatctgattacttgctctttgatttctttgtcttgcttctccaatttcatattcgagattattctcttgaattggagattaaagcctcgtagtggacttcgaatcgtttgatagcaatggttgaatcactaattgatggaactcgttgcttagttcatgttctgtgaatttgattcatgattatatttgggttgtatcttttcagaaagtctggttttcttatgtgttcatcataaaaggtttataagttttttgatggttgattcacttattgaagaacattgttgctagtgaaattgatggaggttttagcttagatctgagactaattttcattcacagatgttagattgatttctacgtttgtgtttaagatataaatgttaaaaaattggtgcaaaatcgagaagatcatcttaactgagttaaatgaacagacctttgtggacaacgatttttggacacgttcttctttacctttttcatctcaaaatccaatcgagaagatcatcttaacagagttaaatgaacagacctatgtggacaacgacttctggacacgttcttcccttgaatttttgatcatctatgttatattttgagatgttttgtatataaaatcaaacttggacttgtattttaaaacttcaaaatccaattgagaagatcatcttaacagagttaaatgaacagacctctgtggacaacgatttatggacacgttcttctttacctttttatctcaaaattcaatcgagaagatcatcttaacagagttaaatgaacatacctatgtggacaacgatttctggacacattcttcccttgaatttatgatcatttatataatattttgagatgttttgtatataaaatcaaacttggacttgtattttaaaactttaaaatccaatcgagaagatcgtcttaacaaagttaaatgaacaaacctctgtggacacttctgtggacagcgatttctggacacgttcttctttacctttttatctcagtttacttgaacttgtctctaagttttttgctgtcaaattctatggctattgaaaaggaatggccctgttttttttgtaatcactacatcagcgatcgacaactgaaattttttaacttacttgcatgtaatgtatgtggagactaacatcatcattctcgtgaaaagagtcgcagcgactataaaagtggtcgccgtttagtctagtgatgccgacgacaactacatctcttgtaaaagtggtacaccattactatttcttcttcgtttcttttgctgtaaaagtggattgacgatgtgagctttgtttgtatctactatttctaatcgaaagagagggaacgaccataattgatgattttgaaagagggaatgaaaatgatgaaaaacaaaagaacatggaagagagacgataaactaagaatagtttctcaatcacacgttcttatccggagtaagcgaggagtgtttcattataaattattttaaataattaagataataaatgtttttgatcgttcagttaaggggtaaaaaagtctaatttttgtttaaatagaaggaaaagtgcctcatctctgaaaagtgcctcaaaaggaataaaattctttaaaagtgcctaaatgtatcacattcccttgtttttatgggttgaagataatttatcaaatttttagagaacataaccttaataaccgtaactgtggtcatgcctacatttaaaacatattaattatgccaaaatagacataccatcatcagtcgttaaaacaatttgataaattatcttcgactttctttctcttctctcttaatccttcagagagagaaagtctccgatggttgtttttggtggcaacgacatgtttcttcacttgcgttggctctcatatgcccagcacagttggttacctcaacgacggtgactggttttctcgtccgatttcggtggattcatctccgccgttggtcggctcccgtccggaattgtctggctcacatagtagagatgcccggctttcgtccagcaccgtcgcgtttccatggtggcatgtggctggctttctcctacgcatcctctttcctttgtttatctgtgtttttacttttgtttgcttttaataatctcacatacatgggttggtaatgacagtgtaagtaatctagctttctagtgttatgttccgatctatttcatgttgagacttgattgcagaaatcaaatcagagatctgagaattatgatgaagataagaagtggaatccgtcgcttattaatcattgccaatttgctgatgtatctttaattggagcctctttactatctaccagtgagaaacccttaagaatccatg

SEQ ID NO: 23850 - DNA, 3003 bp, Unknown; identical to SEQ ID NO: 23849
  misc_feature (1)..( 3003): 2750-1469P.txt file - cDNA_ID_2154925; gDNA_ID_1621145; Annot_ID_173012

SEQ ID NO: 23851 - DNA, 3000 bp, Unknown; identical to SEQ ID NO: 7434
  misc_feature (1)..( 3000): 2750-1469P.txt file - cDNA_ID_2154939; gDNA_ID_1621145; Annot_ID_173017

SEQ ID NO: 23852 - DNA, 3003 bp, Unknown
  misc_feature (1)..( 3003): 2750-1469P.txt file - cDNA_ID_2155063; gDNA_ID_2926145; Annot_ID_197695
agagggcaaaagagatggctcttaacgatgtcgcatctctcaccggcttaaccacaataaacctttcaagacacctagagaatttaagtaaaaaattgttcactattggaaacagtatacacaatactccggtgaaacgagtagacatggttttgggagatacacgtgtaagttttcatattatagcgtattatatttacaaatattaaaacgctagtagattgtcaactatctgaagtatagtagaatacatggtcacacatgtcaagtaaactaaaagatatttagctacctcacgtatatggattgcatgaccacatatacgaagtataggggtgtcaaaatgggtcaaaattcatgggtcaactcaactcaactcaacccatgaacgtaatgagttgaaaatattgactcaaatgagttgatgggtcaaattagttattgggtcaattggtttgatgaataaaataaattgggttgtaatggttaatggtttcaatggtttacccaattaaccattaagttttgtaaaattgaattaaaccaactaaaatctctaaatcaatgtccatttaagttgaaccaacacatctaaaccaatttaataaaatcaatatttttccaaatttcttaaatatacaagcgatgaaattgagaagaagtaaactcgtaatttttccaccaaaaaacacaaaaccgtaattttctctccaaaaacgaaaacccgtgattttcccaccaaaaatgtaaacccgtaatttttccgccaaaaaaaacataaacccgtgattttcccgcaaaaaacgtaaacccgtaattttcccgcaaaaaacgtaaacccatgttttttccgccaaaaacgtaaacccgtaattttccgccaaaaaaacgtaaacccgtgattttcccaccaaaacataaacccgtaattttcccgccaaaaacgtaaacctgtaattttcccgccaaaaacgtaaacccgtaattttcctggcaaaaaaatgtaaacccgtgattttccgccaaaaacgtaaacccgtaatttccccccaaaaaaacgtaaacccgtgattttcttgctaaaaacgtaaatctgtaattttttcgcaaataaagtaaacccgtaattttcccgccaaaaacgtaaaccattgattttttcgccaaaaacgtaaacccgtaacaagtggaatccgtaaatatcctaagtttgatgataatgaattaataattattaataattatttattattattttataataattattaattaaattgttacttaaatggacccatttaacaactcaacccatcaaatgaaatgagttatgggttgaccttacccatttaacccatttaacccattaatcatttaactttaaactcatttgattatgagttgagttgagttgggttacccattttgacatccctaacgaagtatatgacgtcatgtagttaacatcaaaaggataacatcgctggacaatgggtcattattgaaaaattttctgtgtctcagaccatgggagaatttatggcgatgaagcaataattaccgaataaaaatcatttactccatgatttataataccaattaaatagtttataagttattcttttttattttttatttaaatttatctgtatatcaaatttcatttttcgtgcataaaattttgtaccaaactacatcatttcacatatgtaaaaaatatccctcgggattagttcttttgagtttaattgattttggttgataatatatatattatatatatatatatcaatctccattataccaaagttaaaactatatattaatattattttagttgatattagtaaaggttaatataaatacaaattaatatttttagttaataaaatactatattagcaaaaatctgggataaataatttgatatcttgtcaacattttgatacttcgataaataatgtattaatgtgttatttctttttgtcattatctacaaaatgtctaatgtaactaaaatctatttgataaaatgatgtgtaattttaatcataatgttttacaaaatgtctaatttaattagatatgtttaaaattaaatataaattttattaaaataatattaaaatattaattttatgtggatgagataatcattggggctcactaatggaggtaaaattgaagtatgagtttttctaaataaaacattcaaaaaatatagtctaatataattgagatatcatgtgggtatctcaccaataaagatgatctaagcgttgtctaacaaaacattataaccacctaatattaaacaaatgtcaaacttcgacattacaacatttagaatattcccaacatttttatgcattaaattttatatgtatatttaatccgggtcaaatggcacccctttctccttagtggatctgccacttaacatcattcattttcaataggtttgtgaaggcaagacttgtccccttaacggcaaataagattgaaaacgactatctcttgtcacacacttcgttatgtcacgagctatacggttactttgactttgaggcatcactaccttgaacttatacaccactagaaacttcgaactaggttgtgtatatggccaaagtatgtccgagaacgggcgcagggttattcagagtttcaatagatcatgtcagcttcgaaagaatccacaaaatataacacaatattgccgtaatcttgttaagggtatgtagaaaagcatcgtagcccacgcagcaacaccacatacaataaaacttgaattagtccatgaagaactcactatttacattctttgggcttattattgggttacaaaaccatctttgggcttattattgggtcacaaaaccatctttgggcttattatcagtgatccataattattcctttggaacttttttttattaaccctttatttctcatttgctctcactatcgttcgttacgtctctgtaaatcactgagaaaatg

SEQ ID NO: 23853 - DNA, 3003 bp, Unknown
  misc_feature (1)..( 3003): 2750-1469P.txt file - cDNA_ID_2155073; gDNA_ID_1620778; Annot_ID_167822
gtaaatcacactcaatttatattgtagttaatcaagctcaacaacactgatgagcagcatctacgcactcgatttaacatcaattaaaatatgagatcatcgattctaaagtattagagtatttgaaatagagaaatgatctctaatagcacataatcaagtttcacaaaaagcaccataaactctttagataaattctcacaaatagcacaattttaagttttttggacaaaaatagcattaaaattttttttgacataaatcgcattcaaataattattttatatttaattattaaaatttaaaattcaaaaaattcaaaaatacacaaattctttaccaaaaattcccgccaaaaaattcctgacaatattttcccgccaaaaaaatttccgtcaaaatttttccgccaaaaaaatagaaattcatgacggattttacaaaatttaggaaggattctaagcaattcaagaaagattttacgaaatatagaatatattttttttgtatcccttcctgaatttcataaaatccttcctgagttttgtaaaatatttcctaaattttgtggaattcttcaaataatcattttctgaaatttaggaaggattctacgaaattcaggaagggtttcacgaaatttttatttgtgaaagctttcctgaattacgtgaaatcattcccgaataccgtagttaccttcttgaaattttttttgcggggaaacttttacgaagattgttttggcgggaaaatttgataggaaagtttttggcgagaaacttttttacgaaatgtttttttgtgggaaaccatttgacggaaaatatttacttttatttatttattttagttaactaatcgtttatatttaatatttaattaaagttttgagtgctatttgttgattttttcaaaagagatgttatttttggaagaaaaaactttttagtgctatttttgtaatcctcctaaattttaatcaaaccttaaatataaattaataattaagaaaatacaaatacgaatacacaaatttatcgccaaacaaagattattaagtttttcatatgtatttatactataaattgttttgtaaagcctttaatttgtggactatactataaatttttcagtagggcctttaatttgtgggcttttttttacatacaattatataaactaaaacctaaatgctagagttaaaaaaaagggcgatttgtgagtcaacttaatttttgtacaagtaaaaatcatagtttttgaggttaattgttagttttgcttatgaatttattgttattcttcctttctatcgtggcaaaatttgtaagaaaaaaaagatgcaaatcttgtgataatgtgattagttaaactccaattttagaatggatcgatcactagctttgttaaaatatgagacacaaactttcatcaaatttaacgtatttgaccttgatttgtgttaaatatttgtcgcaatataaagttgtaaacgttatataaggaaatgttcaatctctcttctttttttttgaattctttttaactgaatttgtagatgttatataaaaatatgacatatgacaatgttttataaacatgagtatatttgtcacaatgtttaacataataattttgaaaagagagaacaaactgcaacaatgttgttatataatacaattttccattaatattgaaaatatgagatttctatgggatattgcacaaaagctaaattacaattcataagattaataaaaatctttaagtacaatgtatcacaccaattctgctagttttagaaaaatataatatcttttttttgcctttttcataatgagtcaaatttatgtttatggaggatagaatctcaatgttaaaaaagagtaacaattcataaaattaattaaaatatttatgtgtaatgtatcacactatttttgccagctccaaaatgttacttttagaaaataaatgagaataggatatttgttttttgtctttttcataatgagttaactttatgtttacggaggatagaatctcaatattaaaaaggggtaacaatttatacgattaattaaaattttatgtacaatgtatcacaccatatctgctagctctaaaatgtaataaataagaatataatatatattttttgtctttttcataatgggtcaactttatgtttatgaaggatagaatctcaatgttaaaaaggggtaacattcattagattaattaaaatctttatgtatatacaatgtatcacactattttcgccagctctaaaatgacagttttcgaaaataaatgagtcaactttatgtttatggaagataaaatcttaatttaaaaaaaggtaagaaaatcttctatataaattggtcaaacttcctttcagtcttcaattcaaatcattgttttttattactaaaaggaaatataggatttaggatagtcccccaaaatgctaagtttcaactaatataaaaagaataaatctaaattacagctcatctctttaaatgaaattgtaatggacagtgtatcacaagatttttgccagtcctgaacgttctaaatctttaggcgtttatttgttctatttataaatatcaaatcgtagctttataatccattcatagtcctttgctcttgttttactactctcactaatttttttataaaaacaattcttagctactagctagctccatttataatcccttcactcaactttcttgtttcactattctcactaaacgtaagttttcttgcatcatttttctaaattttattgtcgatatcaaactagattcgaaggatttcaattgaaagtcttatgatatttaattgttacgtcgatataatctatgtgatgtagaaacactcatttttaggggtctaattacatctattcaagcaaatcttttatttaaagtgtgcatgctaatgatttggataattttgtttcaaattagggttttctcggaaatg

SEQ ID NO: 23854 - DNA, 3003 bp, Unknown
  misc_feature (1)..( 3003): 2750-1469P.txt file - cDNA_ID_2155663; gDNA_ID_2926213; Annot_ID_202754
aaagtcacactcacatatatcgttagccggtttagatttggttttcgtaagtatattatggtatattgttggtttcagattgaatttgtttactttattttactttactagaaaatgtacatctctagctttggtttcgtttcaactttcagccaaattttttatatatagaaaataaatttaaaatcagataacttgaattttttttaaaaatttggttagggtttctggttcggttaaaccagctgatttaaggagtgacataagctaaattgactatgagtcggatctcatgtgtttgttttataatattgttagatacaccaaacctaatcatcaatgcttcaaaagttcaaacactttggtgttatttttcttgcacgaccaaaaatagttccttctcacgtgatttttcttgcaaaaaacattgaacaaccaaactttatactactcaaaattcaacatccaaattttagtttttgttaggtagaaataagaaatctatcctatgaaaagacaaaaccattaatttttatttcaactcttgctgctatatgacgttgaattatgataatttttccgtctcaagttcataaacgatttttcaaacagagttgtgatgaaatttatttattttctaaaaaaaaaggaagattgatagttttgaagaatatattattgatggtagccaaataatttaccggaataaagtgtaatatcatctcaaactgttcctttttatagcaaaatcgctcctttttatccgcagttagagtataagacaaagaaaccaaattccagagcatcaggaaactctttcccatattttaaggtgaaatcactattttgaaattattaacttagtttaataaccaattattgaataatacaaacaaagtacttaaaacccggtttaatgttttatttcgattttataaatattggtttggccaaaataatatagtttataagtggcgtaagaccacgccagaataatacaagaagaaaaaatgtttaactatgtatagttcggacgtggtagtccattaataatggaatcaaattctgcattaataaattcattatcaagattccagtcttttgtattccttccaattacatgaaattaatataattcttgaacaaatatctttggacaaaagaatttcaattatttacttaaatctatataaaagcaaatctttaatccattcaaatagcagatatgtatctctagggattaaggtagtatacaactataacatctcaaaagaaccaaattgtgactgcacaatgcaatatcataatttgtatatcgaaaacatgatatgttcacatggttcgtccataaacagtacttatattcatatttgaccactaaatatttcacattaaaaaatcgaaattagaaataattatggatttagttctgcaaactcgattttttttaaaaaagattcgaagatgcaagattgataatgaaataaaattgagggtacatcatacatgtgggggaagtgacgtttaaaaacaaaaaggaaaaagaggaagaagatagatgccaatattgttatcatgacaactatgaagcagagttagagtccgtccgtccatacaagtattttgtgtgagtaccaccgaatttgtctgtctatgttatctcccttctttttctcatgcccacgaaccaacatgacaattatgttttgttcgttttttgaaaaattctagagttttcatttattaattatcgttgagttatgatttagtatgattttggtttaaaaattccacttcttaggactcattgtttgatctttgtgtttcttatttatttctttgcacagtactaaaaatcatgcattagttcttaccattcacaaatcttcaaaacttaattagaaaaagaaaaaaaaaaatcgatcaatacaatgaaaacgttctcctatgcactatgcagaacaagtctcgaggattcgtatggtcaaatttattccgatcaaattattcgcgaaagtgtgagaaacaaatacgtactttatttctcttacctcctcctacgtcacttctacgcattcgtgccctaccttcatcagtactcttccagtttctaaaggttaaaaccgagtcgatgatccacgaccgtagagttaaatcaagtaatcaacttaagtcattgtaataagaaagcctccgctcaaaaaaaattctacaatattagtttgacataaaacttcaaatgatagaaatatgaaatcaaatagttgtagacttgtagtctagtactttcatttggctcatttggcaattgcaaagtttacgtggtgattactaaactccttgtcggtataaatgtttttgatcatgaaaccatataccgaaaatattggtatatatagtcctgcctaactccactaacaaaaagtcaggatttttaaattaccaactacaacttgaattgtcatttggaagattgattcattggaatattgtgtatcttaagccataaacaaatcccataatttaatagtgtgccagaattttgtattcatattttaagcagtaaaaacaaaaacaaaatacatatatatattctcaatcaaactataatactttagatttaaagctattaagaaaaacatttagctagtcaaaaaaaacaattaacacttttcgaaaggtccatttccaaggaagctagagaccgtccttttttactaattcgcctgcaccatccccttgtatcgagggtctaattctacaccttattccattttatattccctaacaatttttttagtttttttttttatattactttaattctaatgaaaactcctatcttccttcctctccatcctttttcatctacctttgaatcttttgacacttgtatataaagctttacttcctcctttgttactccttttctatcaatcaccaaaacacattcattgtcttaaaccctaaacctcaagaaccgaacaaccacaccaaaaaatg

SEQ ID NO: 23855 - DNA, 3003 bp, Unknown; identical to SEQ ID NO: 17791
  misc_feature (1)..( 3003): 2750-1469P.txt file - cDNA_ID_2155673; gDNA_ID_1621088; Annot_ID_170542

SEQ ID NO: 23856 - DNA, 3000 bp, Unknown; identical to SEQ ID NO: 6298
  misc_feature (1)..( 3000): 2750-1469P.txt file - cDNA_ID_2155718; gDNA_ID_1621088; Annot_ID_170573

SEQ ID NO: 23857 - DNA, 3003 bp, Unknown; identical to SEQ ID NO: 17765
  misc_feature (1)..( 3003): 2750-1469P.txt file - cDNA_ID_2155718; gDNA_ID_2926212; Annot_ID_202707

SEQ ID NO: 23858 - DNA, 3000 bp, Unknown
  misc_feature (1)..( 3000): 2750-1469P.txt file - cDNA_ID_2155720; gDNA_ID_1621088; Annot_ID_170574
tcccgtatgtgtcacccacgcggaagcagctcatggttgatctcatgtcgacggtggagaatcgcctccaatcacaactccttccctgtaacctccctccagatgtacgaaacttcaataaccctaacggttccgccgaagcatctcttcatatcagatccggcgacaaatcttctccggtacttgcgacgattaactctgtttttcagttatgagatcgaaattgactgttttgcatgcttgttttagagctcaattgcttgattttaagtagaaacagacttcaatttcgatgtaaatcataaccctaaaaaaaaactttttagagaatcttaaagtttgttttgttttgcagattgattttgttataggaagttggatacattgcaagatcccaacaggagtatctttgaatataacaagcatctctggattcttaaactcatcaacaaaagctccaaactttgtggtcgaactaatacagagcagttccaagtcgcttgtgctaatccttgacctcccacatcgtaaagatcttgttcttaacccggattatctcaaggagtattaccaagacactgctcttgattctcatcgacaatctctccttaagctacctgaagttaacccttatgtgtctccttctctctttgtccgttctgctttctctcctactgcttcgatgcttaagattgatgcggaggaagaggataagttggaggagatattgagagatcatgttagtccagctgctaaggaggttctcgaggtttggttggagcggtgtgtgaaggaagaagaagagaagattgtggttggggaagaagagagaatggagttggagagaagagataaaagctttagaaggaagagcatagaggacgatttggatttgcagtttccgagaatgtttggtgaagaagtttcctcccgtgttgtacacgctattaaagaagctttcggtgttctctagattatgtaactatatatatacatcagttaatgttcattgtactaaacatttactttcatcaatgtcacaagaacgcaagatgaccatcaaacaagtcctgttttctcctaagaacgtctttgttgtgaatcatctctgaatcggattccttctgattcattttaatactatgggattgtaaatttatcaatcaagtttctaatttatctgtaaaaaaaagtcttgaattattgtttttctcatggattttaaagtttttttttcactattttacatggatgttttgttaaatttctcgttctctagatcatgtcattttacattagcaaaaccaatataatatatagattaatattaacgaaggaacataaacgtgcaaaactaaaagttttaaagctaaatcgctttcaaaagagttagtaaccagacaaaaaagagacagatcatcggcaactaatctcgtcatcgcatgcatcataaaccaaattaactaaatcatccatttaatccatttgttcttatcagatcatccttttccttcctacacaagaaatggttagtgttttcttttctcgattgtctcttagtttagattctttatccgactactttgttcatcggttttgtttttctttttgtcttccggaaggcgaattacatgtcggaagcagcacagctcagaagaggtctaaagcctaaagggaagacttatgggttgaccaatcagaagagacgagagatcagagagatctttgatcttttcgacatagacggttcaggtaaactattaaaccgattctttatccgatttacaaagttattgctcacatgatttagtgcatcatttcatatgtaggtagcatcgatgctagcgagctcaacgttgctatgaggtcaacggcaatttttctttctttttcaaagttattttcttcaagttctagttaagtatagtactaaaaaattatcagctgattacaggtctcttggatttgagatgaataatcaggtttgtttgttttccttccttttttcttctttgttttaatttcatggtttagatcattgtacgtagaaccaacttgtatttagtttggtcatgttcattgttgcagcaaataaacgaattgatggcagaagtagataaaaaccaaagtggagccatagatttcgacgaatttgtgcatatgatgacaaccaaattcggagaacgagactccatagacgaattgtctaaggcgtttaagatcattgaccacgacaataatgtgaataaatctaaacctgtcattatttcattctttttaatattatctttttttgtttggattgatttcattgtgtttgactggacaacttttggaatgttttaggggaagatttcacctcgtgatataaagatgattgctaaagaattgggagaaaatttcacagataatgatatagaagaaatgatcgaagaagcagaccgtgacagtaagcaaaaacacataataattttgcgttttatctataatcggtccctcaagttcatgtttttgccttaacctacgcagaagatggagaagttaacttggaggagttcatgaagatgatgaagagaacctcttacggctaagtataaatcaattagtaatggttgtgaataatatttgttaatcaccttgatttataataataaagaagtttgatttgtggcttggtcgaataaaaatgtattgttgtataaaaataataatgtaattcacatccattattttgaatatgtaaatgtccttgaacgaacatttgttttatcattttttatgtataaatgtctttgaccaaaaaataaattatgtaaaatatgaaccagaaacgatgttgtttagatctgatacttacatataaccaaacgacgacgttgctagagtaataaatctcaaaagactggaaacgactgcgtataagtccgtgacctggttaccggagcgtaacttctccggcgaattggacaattttgagaaagacggattatggactccatg

SEQ ID NO: 23859 - DNA, 3000 bp, Unknown
  misc_feature (1)..( 3000): 2750-1469P.txt file - cDNA_ID_2155735; gDNA_ID_1621088; Annot_ID_170584
aacgttagacggatttatctcgacacaactctaattcagtttgaccggactgaacacttttatcaatattaatgttgagttgttgacctatatattattgtaataatgaataaacaacgccatgattgcgtactatctatcagactttatagagtaactactttgattaaccattacattttgtttttatgagaatgttttcagttatatatctttatcaacacagttgaaacctgttcttctatgttaaagcctttgaatttgagtaattttacttttgatagctagcctttttaaaatgaatgattatattgttaggttccaagtggggagttgtcttggggatctcatttgacgtgtgatcttgaatttttgatagagatcctaatgatctcgtggtccctctcgcagagtttatgtaaccatctaatatataacttcatgtctggatatggagaatccaaaacttaagaaatgcacgtattagcattcgtagttgtatatatgttatgtattttgcgtcaaatgcagaacaaaataaagcaagaagagaccaacaatcttcatatggagaattgtaaattgtccaaatcagcaatatatagatgtcttgaacaataaaaagataaccgagtttaacattagaccaaaaaaaaagaaagataaccgctacagaatttgtgacgaaaagaaaaaagctttggagaaaaaaacagagtaagaactgtttttgttgtgtgagaagagtttgtccttaggtcgcataatcttttaggatgtagttatatgtgttaagtgtaacacatgcatatcatttacttctgcaatatatctcttctggagtttcgtaaggtacttatggttggtttgtcttcgaaactaccaacgaacaacttaaaaaacattgatctttttaatagcgtgagtttgatttatgttatccttgttatggtgcatatgtattacggaaactttggtctgttttagatgggtaaatagttgtatatgagtaaatatgatattgccagtgttttatataaagaaaaagggaaacgatgataaaaggtgaaaaagaagtttaggatcatctttgttttttattttgttttccgactttcaaatcagacaagacaacgaggtatgggtcttttaacatacagagactcaacttgaaaattctatcaaaccaccaattaaaaaaccagagaaaacattcaactatcttcttagaatctagacaaaataaaaagtgtatcatgctgattttgaacaaattattaaagagatctcaaccatcgtttcattaatatctttgacaattctagaagccgtagtaaatcttgtctttttatgtgtatatcttgttgaatttgataaggatattcaaaataatgagatatgtatgttgagtaattgagtaaaatcagatcccttgtttaatttgacgattaaacgcttttttcattattttttttcgcattttgttgtgtatgttctcaattacaaattccactataagcatttggactctacaatgtcactttctaattctgatatttaataaaacaattattttgtatatgtataaatagtaccagaaaaacgaacttaataaaataattgaatcaaaagcagatgctgaacaaatagctgcagcttttagcaattgtctcccatatgcttttcctttgtttcaaaaattgtatatacgaggttaagtgaatgttgcaatgaaataaatgatgcagtttgtgcattcatcaagcgaacaagtacgattgatgttttcagtgcaaaaactaaaataaaatactactaacaactatatagtgtaaatatatataactttaacttctttttttttaagtcttcatacgctgcgaacgatcaaaatatatttacaaatttacgaccaatattttaaaaatacttcattaaagaattgatgctgctgtctgcacagttgagaacgcaattggaaactttcgtgcattcactttgttcgccgcaaattggatatgtgaacgtggtcatcattatttatagaattattctataaaacttactataaaacactagatataaagctggatcatataaaatgaatttactaaaaattcgatagttaattatagcagatgttatgttccaatttgaaagcatacgaacgaggtatatagttgaaaacacacaccgtaaagttaataattttcacaacacaagaacaaatcaaagtcgcaagtaatttaacgcatgtcagtagcatgggcttcttatatactagtcaatagaataaactagcaaacaagcaactaatgtattcttgtttatcacgccacgggttacaatatcatacaaaatttgaatactaattaatggtaacaagtaaaaaaacaaattactagaaatggaaatacttttgtcaaacaaccaagacgtataacttttgttttctatagattaatggacttcttaaaaatctctccatcagattaaactttgagatatacaaatacagtttttgttttcttctaaatgatatgaatattaactttatcgatttcatccgtagcagatttccattttaaataataaactatgagaaaacagataaaggttgtatattatttgttaccccaaaaaaaaaaaaaactaactacgagtagtagtttagtgtgtctcacgtgcgacgaggaaaagttttgggagagtaaaaacatttaatatttacgactagtttgaaaaaccgtgagctgacacaagctcattgctaatgctacagtaacagctaccttcacttttaactaaatgacagaccaatcattttaacctctgttttcttagctggcgcgtgacagacactctccctctctccatgcccataaaatctcaaagactgtttaaaaaaaaaaatgttttagctttaactgctttttttttgttgttggtgtaatgatatcacagagagaagaaagagaagagaagaagcagagagtgatg

SEQ ID NO: 23860 - DNA, 3003 bp, Unknown
  misc_feature (1)..( 3003): 2750-1469P.txt file - cDNA_ID_2155735; gDNA_ID_2926212; Annot_ID_202697
ttcaacgttagacggatttatctcgacacaactctaattcagtttgaccggactgaacacttttatcaatattaatgttgagttgttgacctatatattattgtaataatgaataaacaacgccatgattgcgtactatctatcagactttatagagtaactactttgattaaccattacattttgtttttatgagaatgttttcagttatatatctttatcaacacagttgaaacctgttcttctatgttaaagcctttgaatttgagtaattttacttttgatagctagcctttttaaaatgaatgattatattgttaggttccaagtggggagttgtcttggggatctcatttgacgtgtgatcttgaatttttgatagagatcctaatgatctcgtggtccctctcgcagagtttatgtaaccatctaatatataacttcatgtctggatatggagaatccaaaacttaagaaatgcacgtattagcattcgtagttgtatatatgttatgtattttgcgtcaaatgcagaacaaaataaagcaagaagagaccaacaatcttcatatggagaattgtaaattgtccaaatcagcaatatatagatgtcttgaacaataaaaagataaccgagtttaacattagaccaaaaaaaaagaaagataaccgctacagaatttgtgacgaaaagaaaaaagctttggagaaaaaaacagagtaagaactgtttttgttgtgtgagaagagtttgtccttaggtcgcataatcttttaggatgtagttatatgtgttaagtgtaacacatgcatatcatttacttctgcaatatatctcttctggagtttcgtaaggtacttatggttggtttgtcttcgaaactaccaacgaacaacttaaaaaacattgatctttttaatagcgtgagtttgatttatgttatccttgttatggtgcatatgtattacggaaactttggtctgttttagatgggtaaatagttgtatatgagtaaatatgatattgccagtgttttatataaagaaaaagggaaacgatgataaaaggtgaaaaagaagtttaggatcatctttgttttttattttgttttccgactttcaaatcagacaagacaacgaggtatgggtcttttaacatacagagactcaacttgaaaattctatcaaaccaccaattaaaaaaccagagaaaacattcaactatcttcttagaatctagacaaaataaaaagtgtatcatgctgattttgaacaaattattaaagagatctcaaccatcgtttcattaatatctttgacaattctagaagccgtagtaaatcttgtctttttatgtgtatatcttgttgaatttgataaggatattcaaaataatgagatatgtatgttgagtaattgagtaaaatcagatcccttgtttaatttgacgattaaacgcttttttcattattttttttcgcattttgttgtgtatgttctcaattacaaattccactataagcatttggactctacaatgtcactttctaattctgatatttaataaaacaattattttgtatatgtataaatagtaccagaaaaacgaacttaataaaataattgaatcaaaagcagatgctgaacaaatagctgcagcttttagcaattgtctcccatatgcttttcctttgtttcaaaaattgtatatacgaggttaagtgaatgttgcaatgaaataaatgatgcagtttgtgcattcatcaagcgaacaagtacgattgatgttttcagtgcaaaaactaaaataaaatactactaacaactatatagtgtaaatatatataactttaacttctttttttttaagtcttcatacgctgcgaacgatcaaaatatatttacaaatttacgaccaatattttaaaaatacttcattaaagaattgatgctgctgtctgcacagttgagaacgcaattggaaactttcgtgcattcactttgttcgccgcaaattggatatgtgaacgtggtcatcattatttatagaattattctataaaacttactataaaacactagatataaagctggatcatataaaatgaatttactaaaaattcgatagttaattatagcagatgttatgttccaatttgaaagcatacgaacgaggtatatagttgaaaacacacaccgtaaagttaataattttcacaacacaagaacaaatcaaagtcgcaagtaatttaacgcatgtcagtagcatgggcttcttatatactagtcaatagaataaactagcaaacaagcaactaatgtattcttgtttatcacgccacgggttacaatatcatacaaaatttgaatactaattaatggtaacaagtaaaaaaacaaattactagaaatggaaatacttttgtcaaacaaccaagacgtataacttttgttttctatagattaatggacttcttaaaaatctctccatcagattaaactttgagatatacaaatacagtttttgttttcttctaaatgatatgaatattaactttatcgatttcatccgtagcagatttccattttaaataataaactatgagaaaacagataaaggttgtatattatttgttaccccaaaaaaaaaaaaaactaactacgagtagtagtttagtgtgtctcacgtgcgacgaggaaaagttttgggagagtaaaaacatttaatatttacgactagtttgaaaaaccgtgagctgacacaagctcattgctaatgctacagtaacagctaccttcacttttaactaaatgacagaccaatcattttaacctctgttttcttagctggcgcgtgacagacactctccctctctccatgcccataaaatctcaaagactgtttaaaaaaaaaaatgttttagctttaactgctttttttttgttgttggtgtaatgatatcacagagagaagaaagagaagagaagaagcagagagtgatg

SEQ ID NO: 23861 - DNA, 3000 bp, Unknown; identical to SEQ ID NO: 3131
  misc_feature (1)..( 3000): 2750-1469P.txt file - cDNA_ID_2155860; gDNA_ID_1620658; Annot_ID_163695

SEQ ID NO: 23862 - DNA, 3000 bp, Unknown; identical to SEQ ID NO: 3707
  misc_feature (1)..( 3000): 2750-1469P.txt file - cDNA_ID_2155902; gDNA_ID_1620658; Annot_ID_163715

SEQ ID NO: 23863 - DNA, 3000 bp, Unknown; identical to SEQ ID NO: 3707
  misc_feature (1)..( 3000): 2750-1469P.txt file - cDNA_ID_2155902; gDNA_ID_2926187; Annot_ID_200702

SEQ ID NO: 23864 - DNA, 3 bp, Unknown
  misc_feature (1)..( 3): 2750-1469P.txt file - cDNA_ID_2156237; gDNA_ID_1620804; Annot_ID_168752
gaa

SEQ ID NO: 23865 - DNA, 3000 bp, Unknown; identical to SEQ ID NO: 8182
  misc_feature (1)..( 3000): 2750-1469P.txt file - cDNA_ID_2156241; gDNA_ID_1621199; Annot_ID_174815

SEQ ID NO: 23866 - DNA, 3003 bp, Unknown
  misc_feature (1)..( 3003): 2750-1469P.txt file - cDNA_ID_2156241; gDNA_ID_1620804; Annot_ID_168754
gctgcttgtaactttgatcttgagttcatatatgttctaagtggatgggaaggttcggctcacgattcaaaagttctacaagatgctttaacaagaagaactaatagattgcaagttccagaaggtaatagattacaagttctaaaaggtgatttatcatatgataatttatttctaatagtgtgcttccatgtttcaggaaaatattatttagcagattgtgggtttccaaaccgacgtaatttcttagctccactacgaagtactcgttatcatctacaagattttcgtggtgaaggacgtgacccaacaaatcagaatgaattgtttaaccttcgccatgcatctttaagaaacgttatcgagagaatttttggtatatttaaatctaggttcttgatttttaaatctgcaccaccgttttcttttaagacccaagcagagatagttctttcatgtgctgccttacataactttcttcgacaaaaatgtcggtcagatgaattttcaagtgacgaagaagatgaaacagatgttgacaatgcaaatcagaattctgaagaaaatggtggtgaagaaaatgttgaaacccaagagcaagaaagagagcatgcaagacattggcgagcgaccatagctgcagatatgtggagagatgctactaatattggtagccaaagatagtaattcactttttataaagttcatgtatttgtctttctttggtgttgatggagacacttttcccgtgtttgagctgaaagatttatttttgaaccctttacactttcttttattattattatgaacgagttcttgtcgtgaaatgatatatgacatgcttccgggctaatctcatcgacataattagaaactgagaagttggccatgggaaaatggtacaagacatacaaatacagaaatgacaatgatgtcagcatgacacttgaccataacgttttaaattatgttctactcatatcggtggtggaataattataccttgacctaagaagtatgggtttatatgtattcttttgtaaacgtttaatactattaattatgaacgagttattctacctctatcatctatgttacagctaagcttttggagttatactgtaaaacattgttcattattcaaatcatatcaattaaaataaaaagtacaggatcatatcaattagaatattactttgatcatcataatattctagttgctactaaagaatagaatcatattacttagaatatatattaccatgatcatcataataatatcacaatctttttgttatattaacgtatatctttacgatcgcactatctctataaatgtcacgtacatctctcttctcattctctaagcatacaagctcattcgactgcaaagaaaaaggttcacttgttcttacttttttcttttgttcttatttacagaatcatatgttggaagtgtgatattgattaacttttgaatagttaacttttgtttcccgtctcactatttccttgttttttgcattgacgtatggttattttttattaaaatattgcaactttttcatgttttaacgtatatttgtttttccaatttgtcataggtatcactatgggagattcacaacccaaaaaaagaaaaaagggggattataatccgtggtctccagaggagactaagctgttggtgcaacttcttgtggaagggatcaacaataattggcgtgattctaatggcacaatcagtaaattaaccgtggaaacgaagtttatgccggagatcaacaaagagttttgtcgttcaaaaaactacaatcactacttaagcagaatgaagtatttaaaaatacaataccaaagttgtcttgatcttcagcgttttagttctggttttggttgggatcctttaacaaaaagatttacggcttctgatgaagtttggagcgactatctaaaagtaagtatcacattttcttttttaagtgaacatggtcgtacttacatattattaatatgtccctttgtttttgtaggcacatccgaacaataaacaacttcgttatgatacatttgaattttttgacgagttgcaaatcatatttggggaaggtgttgctactggaaaaaatgcaattggattatgtgatagtacggatggacttacgtacagagctggagagaatccaagaaaagaatatgtggatgattttgacaacgtgtatgagtatgatactacaactcatcatgagtcatcggagcactacgcaccatttatgtctcatggaacttcagaaagtcctaagcttcccccacgtaaaagaacaagatctgagagaagtacttcacaaaaagaagaaagtcctatgatggttgttagcagtaaaattttggatataatacaacaaagagaagagaggcaacaaaatgaagtggcacagaaaaagaataacgtttgggatgctataaaagaaatttctgacttggatgaatgtattcgttacaaggcacttacgaaaatttatcatttgggaatacaagacgttttcgtgagcatgtcggtggaagagaggctaggatggattcaaaccattatggaataatttgagcttaatttttattttctttgtttttaaagtttttaatttggattcaccaaaattattatgaataaattctttatcttattcccaaacttcaaaactctagaaaacttgaaataaaaaaataaaaaactggtcaaagttttgttagatttcgattagattataaaatcatttgttatagagttcatatctattagaaaaccaaatgacatcatatatcactgaaaatagacttccacgacagaatgaatagtgattcagtttaaatgaactcagatgttttaaaatctgataaacttcaactctaatggagttgacttcaacttcactaaccaataacaccacctaaacttataaaattcagaaaaataatcataaaccggaaacaaagctaattatg

SEQ ID NO: 23867 - DNA, 3003 bp, Unknown
  misc_feature (1)..( 3003): 2750-1469P.txt file - cDNA_ID_2156256; gDNA_ID_1620804; Annot_ID_168759
aagcagcaaagaaagctgctgatgtggccaacgctaagggtgttctctcaggtaaaccagaggcgtctcgctgcattaacgctctctcgttattgatgaagatcaacattactccaaaaccaaaagaaccaaggagtatgatggataagcttgagggacttacaaaacataaagaccgcaagatttgccatgttgcatcagcccttcttcacctttggagacagaggatcagagaacaagaacgtaaaaagtctgttaccaaggcttcatcaaagaacatacaaagacgaggaaacttagtgatgtgaagatcatggcttgaacaaatcaaagtctcttgtggattcaaaaggttctgaaccattttattgagatcgaatataagtgtgaggaagagataaactcatttgtaagcatggttgagtgctgagcaagtatactggtgaatttctcgtatgttatgtagggttccacattggaacctgaatttgtaatcttttttgtgtctttacttttccctgctttgtttgttacacaagagactaacttagtgcaacaatattgtggcgaatcttaattctctaaaccaaattagagtagagatagttcaatagatgtaatgaataccaaatttattatcattgaaaaaactaaaatcacctcatttttttcactatgcaattgtttagcatgtgttgacaaaaaaaaaattgtttagcttgttcattaacaaaatagtcatattgttgtttacgttcactcgttatttatttgagtgtagtaagaattacacgatttccactatttgtccttaagttcaggtttacttgtccgaatttcttaaaccatatatcaaaaatatttacactatcgcatcaaaacagatacatgacatgcatgaaaatatatatgcaagtgagatgcgtactctttaaaaaattcaagttggggtatgatataaaactgtcaaatacatatgaaataataatcaatatattaaaaataagaatacataaccatatatatatatatataatttatttatattcaaattaactgtaatatcttcataattttttttatctcttactcgtcgcttttcactttccctttttaacatcacaacaaataatgtcgttcaccataatatctcctatataattttaacaacacgttttagtaccaaatttttatatgtatgtatattactaataacgtacagtttatttctgaaaattttcccaaaaaactatgtacgatgaactgtaaaagcatgtgttcaagataggtaactgttggaattgtatcctttgattgaacctgtaaaagagagaagaagcctcatgagatgaagaaggagaagagaagaagtcaagccaagaagaagagcaaaaggaagaagaagaagttgtcgtgaaacaaggtcaacgacaaagaggaaggaacaaagtcaagataatagtgttgggcttgtgttgttttgtaagaataagtgtttgggctaattgttttgttcggcccaaatgagtaagtgttttatgttagtcaaagtgtagcttagtgaaagactagagttgtgtaagagttgcttgtaagtttggttatagtcttagggtgatgatgcctagaagtatggtctaggtctaagtagaagcatggtgcaagtgtctgtactaagtagaagtaacttgtataagtatatgttgtgtgtcttgtaagaagtatctggtgatccaagtttattatcaatgtagtctttcaaaaagaaaaacgtgttcgtgtgtttgtctctaaacaagaacaaaacagagtgcaacaaagagagaaactaaagagatagagtgaaaacagagaatcataacaaaaactctatagaaaccgaaacccttgctcccaagggtgttgccattcaatagcttcacaatagatgcatcttatttctccgtacatgccgaagaaagtttgctaaaggccaaactattcaagaagccatcaaatgatcaatgtataccaatcttaaactatatccattttctaatagatttctaaaaaacaattttgcactaatttttcatataaatatcacataaaccaaatatttttcaaagatcagatctaatcttagtgctacaaactcttccatggacgagcgagatcatccctatcaagaccataaacccttctagtattctgatttagttagttttatatagtcgattgatatcttaacaaatatcctgtattttgatattttaataaaaaaattaaagtcgattaatgttttagaatgtatttcctttatcatttcgctaaaagctaaaaaattatcaaatatatttaatatatattttcatacaattactgaatttatgtagtttgggtcaaccaacgtttttaattataaatattagcataaatacaatatatattgtgattatgtgaattaaattaatcattttagaaaacaaaattttatataagaaaaaaattgttttctttttgttacgtgaatatcgtattattacatttttcacaaacaaaaaaaaacaaattgttttccggttgcgaacagattaaaggttttatatttttcaaacgaaaaataaaaaataaaaaaataatgtacttattttcatgaggtccacccaacaacagtcgtcacactagtcgcgttggacttgcatgcgcatattatactctatagtcaaacccacactaacctacgccgatattcttatccaccaccacctcttattagctcaaaaaaatttcactaacccatagtcattattgcttatactccgtattaaaaaatgttaaaccttttgatctgacgtttaaaagcaggtttctttctatttccagataaaaaaactttactcatcgagactcgtttagtgattcgaaatttcccttctcggctcaaatcttcgatctgggctttcgtgtctttttgcgttttgattggtaataaaaagaagctttttaaaaactttttccatg

SEQ ID NO: 23868 - DNA, 3003 bp, Unknown
  misc_feature (1)..( 3003): 2750-1469P.txt file - cDNA_ID_2156274; gDNA_ID_1620804; Annot_ID_168764
tattatttttaaattgatatcttcttaattttttaaaacatgagacaagtagaactctagtctggtgaaaagctcacaagtaaaacatgaaaggagtgtcttaattcaactttgttttgtcggcagtacacatcacaatgtcatatagataggttgtagacggactattttctgaattgaactgggtcgtgtttgtagactatttttttttttttttaattctatcgactgatccggtgagtttcaataaaagcacactgaaatagttcagagagaacgttttttcgaaagaccaccacattatatgtcctaaattttaaatgttttctaactaataacagggttaatcagactacatgtatttatgattattagataaatcaattgagccaaaacttaactaatagattttccaaacaaattttccaaacaaatgtgacagattatttattttacaaaaaaattgttttacattaaaactttaaataatttctacaccgaagaattgaatttgcagcacaacataagaaatcatgaatgatggtatggcatgcatatgttaatcctaacaaaattcatgattccctatccacgcaagctagcttgcttgtccaaattagatttgttcaactgcataaacaaattgtcaatttccaaagaggcaccaaaagtcaaaccataaataggtagtttggacaattattggggatataatggattagatcgtagattcaggagaatttaaggcaagtaagttggttctctatctaatgttccaagggtcttatctatgtacttcgtttcgatgattaattgatgtagttagtagtttcaaattccaaacgactatttgtatgtacaattacatatggattaattgtcagataacatgttgaattctaacatgtttctgtctatccgattttagattaaagttgtttatacaaaattttagacaacacttaaattagtactatcgttagttatatagttccattaatcatttctccttctgtatggtttatttggacagatatgtcattaagcgtttaaaaatatttgtagatttgataatttgtcaaaaatagcatttattgatattatagttgatccgtacgcgttacgaattctttagttgacctttctttttttataatctcctaatatttaaaattcagcagcagactgatgaataaaattaaatacttggttccatttctagatggtaacaggtacaaatatagatcctcacgtaagaataataacaacggaggacaaaaacgttaaattatgattaattaaacatttaattaaaagtattagcaaactcaatcaaagaatgactaaaaggttctaataacttgtgaggtatttaaacaagttaatgtaaaaaaagaaacaaaaaggttgaaacgtacggttttcatccaatgattatgaatgactataaatgattgttttttctacatcaaatatggagttccatcgtcatccaattttcttttggttacgagtgaaaacttcttaaaacacccgaatataggatctgattgataaccaaaagttgtacaagttttttagctgttaactttatcgaaatagtgcaaaactgttaaaagagctgtataaaaaaactgtacaaaaaatctaagaagaaaactttttgtaacgtttttgataaagtttttgtgattgataactatcaatactgtacaaagctgtattgtgttaccattcaaacttataatgttatagtcttggagagatattttttttactcaaagatatgaatttaagttaaaatattccataatccaaaccagcaatatatacacattaatataatttaaattgcatggaattcaaaataatacttatcgtgaatccatctagatacgttgagataagggaccaatcaacaagagaagacgtcacttttacaagttgagaataatctttcagagagaaaaaaagagtaactgtcgatttttgttgatccaaggtaacgtatatgtcctgactcagattattgcttccaattatatgtgaaaagagctttctccacattgacatataactaggatcattcgctatagacgattaatcgttgtttataatttgttataaaaaaaactttggtattttaaagaatatgtcaatatttttttcatactacagtatttttaattcgtcaaactatttaagaatacgctcatgacaaatgatcatataataataatttaaatagtacttgtatttattttttcaagaagaaaacttagttgaatgaaatttgacttaaaatgatataaagggtttgaatggtaaccattttaataacaatacagttttgtaccgttttgacagttaccaatcacaatttttttatcaaaaacgttacaaaaagtgttttactctcagctttttttatacagttccttttaacagctttgtactattccgataaagctaacaaataaaaattttgtacagcttttggttaccaataaaacccaaagtcttacaaaaaaggtcttacgcgtccacgttagctttccaatccaacccttaattagaagtcttcaccatttgctggttaaaggatattttttcaaagtgtttagcattttgtatacgtcaaactattttagaatccagatgatgaatgatcatatactaatacttagctgtatttttataatttaaaacaacaaaacttggtttaatgaaatttgacttgatcttgtttaaaaaaacgtctcacgtccacacgttagcttttccaatccaaaacccctaaagagtagaaaaccaaaataaccatttttaattcccagcctctttttatacgtagtctaaattgacaaacacatcattcgctctctttctcttctttctctagctctcttggttttttgctaaaaacagagcattttctctctagctctcactgtttctttaccataagtttcgtcatattagtacatgcaagtgtaagggatg

SEQ ID NO: 23869 - DNA, 3003 bp, Unknown
  misc_feature (1)..( 3003): 2750-1469P.txt file - cDNA_ID_2156278; gDNA_ID_1620804; Annot_ID_168765
acaagtttcacttattcatcagcccgatgaaagaaatcaaacttaatttgaattattttattttattataaaaatgatcaaattcagtttatggtgttatatttgtttatttacaaacaaggatttttttttttcattatgtaattactactttatttttctgggtaattagccccatttttatgatgtatatttacgagatgtaaaacttggcctacgtacatgtgtattttatctctaaaattgcaaatgtaatatttttcggacatatattaaagaagagattgatttctagtattgggtaactagggtaattaatgatgaacaataaacatgcgattaattaatctaaactgttaagtcctaatattgctgtttaatatgaagtagctagtatatttagaaaactatatatttcgaaaacgtgatatctcataaatttgatttaacattggataacatttgtggaccaccatgcatcatgcgtgctggtaagttgattcgacaaatttctgacgtttgtaagttgatggctaatattaattagattatgcattggaaccacatagatatttcaaaaacaaacatatttaggttcgattcatcactagtaatatattgttttgaccaaggactttactcatgccctgaagcgacaatctgtctatggtgttgcatgtttttgaaacgaaaatctgtctcacaaaccctgtggttaatatctcctctggctgaagaatatgaaaccttagattggaaaaccatctatgaatttttgtctttgaaggttttatcactaccgcatctattatctctatccgtgaatatactgagcttatcccggagtgtcaatttagacacatctctgccggacgttatcttcatcgactatccactgaagcatcttgacaccacttcaatctagcggccaaaactaggagttgtgatttccctgtttttgcttaagctttttcgaaccatagctaactgttccccgacacacatccagctagcttccgatctagaatttcattcttacctgacttcaagggtcctcgccatccaagcttccccgtcatggaaagaaccttggctctggttccatttgtcgtttgtgccggcgaatagtgagactaagtacctttagtaatcgtcacaaaatcttttgatagtgactagttctaaaatacctgaattgttcgtggaagtctctttgacacaccaagaactcgcttgtggcatgttgctagctagcttctgtctctgagattttatcataaaatttttatgggtctatcctcaatgcttttaacttatcctagctatcttatctttattgtaagaatgtgcttcaagtacttgtatcctttgtttctcctcttttgggtttgattgaatgaaatcaattatgttttgcacaaaaaaaaaagacaatttgacaaacacgtgaatgcaatttgattgagttaagattaattagtacaaaacataataattgaaacccatgtaagtttggttgattctatgtaaacaaccgtttttctcaaaaggtatatatttttttgtttttggcattcaaaagctatagtttgtttctaaagtaatcatttttagctgatcaaaaccaagtaaaccgattaattattgtgtgaatgatagttaggtgttgcatttgtgtgtaaatgaccttaatgtatagtagaacggaaggttgctgttacatgattatctaaccggttctcagatggaatcgaaagtagaaaattcatatggaaccgaagttatgcgattcaataaaaccatatcaaatgtacaatatatttacacggtaagtacattgcattagtaagtaggtatgaactcctgactccatgtatagtagaaaagggattgattacataaaatacattgactgcgtgaaatgtatgataagtgcttggtccttagtcctttgttgtgtataaggagcaatttatcgggttttcgatcataaaatgatatttttcattttctaatcataggctttttaaggttttttttttcatcctaagcacaagtgactttcaaattaatcttcatttttatgactaggagatgtaactattttctagagagtaaactctttcctacatgtatcgaacccgtgatctccaaaatctctacgttttcagtaatccatggatttaaccatttgaccaactcgaagttgatttatttttgttctgatgtataatataccaccttttgtattgatttcaaggtgaaacaaatttttttataagacaatttagtttgaaaaaaaaaagggagattaaaaaaaatacactatttatttttaataaaacttaaaaacatctgttaacatagaaacaaatcaacgcatagttttgtttttttaagatacaaatagttagagaacataaaataaaatttagatttaaggttagaaaaataaaaatcgaataaaatgcagcaaaagattatctataacatgtgataaaatggaataatatttaaaatagctgtactttaatttcttttctttcttttggtgcaaaactttaatttcttaaaccaataaaatttaactggataataatctgacccataatttccttaataaaacataaaaattaataaaaaaatctcacatacagttaagtacaatccaatcccttagatatattcccccccccccccaattgaagtaaaaatcaagtattaagagttaacaatcactaagcattccaataatatatttttcaatggaatggaattaccattgtgacataactttttgttttttgtcaaactgtgacataacataaaaccattaaagaaaacatgtgtccctcctttaataagaagcacattgtgacaaacagagcattctctctctctcacactctcctctgtctcgctacctctgtctctttctcgagcactcactgttttatttaccagaaattgtgttgtatcattacatgcatgcataaaatgatg

SEQ ID NO: 23870 - DNA, 3000 bp, Unknown
  misc_feature (1)..( 3000): 2750-1469P.txt file - cDNA_ID_2156294; gDNA_ID_1620804; Annot_ID_168771
ttgaagccaagaagaatatttaaaaccaaaaattttgatccttttttctttctttcctggtatcaatacacagagaactatttctctactgctcagaaggtgggattcaatcactcaaacaaaatttagatcatcaataaattttctatgataaaacagtacctgggcaaatctgttccatttccaggaaaaatctctgagtaaggtaagaaaacaaaaagagtacctgggcaaaggagtacatgagagtggtgctgagtgatcttggagcagaccatgcgtgtatcacctccattaaagacgatccctttgaaatcaatctcaacttcaacaaaactattattgccttagtccgtgtttctctttataaacaagaaccagacgataatcttggacttatgtaaaaaaaaagatcaaatttttatttttttacacttttgggaaagattacaagtttccaaaagaaattgattgatgttttttgattagtttaatcttcacaagtatcttatcttatctcctgccacatcgaagttggtgagtgataatgtaattatttgcactcccagagatcctccaatttctgtcaaaccataaatcaaataattgcaacaaccagtgattgcgtttagcggttgtatatataacccttaatctaagatcaacatacacatttccgcaaacacatgaaatgctaataaccgcgatttcaaccaccaaaccttcgacctgaccaaccaacaaccatcttggaatatgtttcgaaataacggtccaggaatatttgatttcaattgtaaagaaactaaattgcttctgaaagaattacattatctggaggatatggagaagagccgaacggttgagcggtcatacgaatgcatatatggtaaaagctcaaagcgaggcgtaagttctgcggtcacgtctgtgatggaaaggtccatttggtctgcaagtgtcaagcacacattaaaagtgtctacattgcggatcacagatgcgatataagccaccgcgggactgtgttcttcttgtgtcgtgtctctgtcttcagtctcgagagagccatttcctcttttgggtgggttctttaaaagggctactagcacccgaagtagatgagggagacatgacggatcatagattacatctgcgcctagactgttaaaacgcaagggtcagtgagataagcaacatcttctgctatataattctagattttttactcacacaatatctggacgatattggcttagttcactttccgatgcagtttcccatggaagatgagtgcatttaactcgctgtttaagaaaaaataagaatcaatcttgaataggttacgtgtatcctatatactctgaatcagaaagcaaaaagagagtttaacactcactgtactctgagcttctccgggttgtttgagaaactcgtcatcatagtttaagtgatttctctccaaattaagcttcatgttagacaaagttaaaagatctccgtctgttagtatcacctgctcaagaaaaatatttgtgtgtcaacatagctttgtacttatgatgtgaactttggtaataagcaattaagggatacctctttggcctttacatgtgcaaggcaaatcccgaccataccaactccagaaccaacctaaacaaagcttcatcgaatcatgaaatgaacataatagatcacaaagtaaacctcatcagtcaataaactaacctcaaaacaggctttattggcgaataactctggaaatgacaaaacaaattctgacagaaacagactcgatggccagatggaacacctgccagaaccccaagataaaaaatgagcaacgtgaaacgagactcttgcaattgaatgatcatataaacactcctacccggtatctccttcaagcatgttcaacgaacaatgcagcggaataactaatttcctcgaccttggacaactcgggtgtttgtacgaacctaatccacataataagtcagcaaaacacatctcaatagtaactacaaacaataaacaaacacacacaacaaagacatgactttaccttcagggaaaagaaaagaaatgaatttggttatccttatgttttctttcaccaatatatcttcctaaaacacccaaccaaacttagttttgtttttccatcaactacagaaaaaccaagaaaacttcaaatagcaaagaaaaaagtacaccttagaagttaacatgtaaagagcatactcttcatacacttcatccaatacttcaccattctctaactcaacttcatttatgagtttcttcagtaacttcttcgcgtatgatccgttaccattcgcagcctaatccaatacacgagtttcacagtaaattacacattactacaactcaagattcaattttgcaaacactaacaagtcccaaatcaataacttgactacaaatatcttaaagcttccacatttctccgagttttcaaaagagtagaatttacttacagcttcaacgcaaatttcccagaaaaatctctgggcgttctcagtaattgatcctccagtgcaccctctacacaaaaaagaacatacagaagcaaaatcaaacgccggagctaatggaacaaagaagctagcggcggcgggaatgatggtggttttacctagcgagagtgatgacggagtccaccggttcgatggcgaggaaagcagagagtacattaaggtactgtgattctgcctccgtctccgccgccatgacttcaccgtgtcaagctccgaggatcactagccacatcaaaagcatgcaaactttgggcctaatgggcctatatacaaaaggaccaaataacccttcaaaaaaaacgaaatttctattgtacccttcgccttgcaccatcatttgtcttctaaacacttcagagaatctccccacttcttatccattcgaagcaatgaagccttcttctatcttcttcttcttcttcttcttcctcttctcatg

SEQ ID NO: 23871 - DNA, 3003 bp, Unknown
  misc_feature (1)..( 3003): 2750-1469P.txt file - cDNA_ID_2156314; gDNA_ID_1620817; Annot_ID_169292
tggcctcggttcatcagcagctttatgtgtagctctcacagctgctctccttgcttcttctatttcagagaaaacccgtggtaacggttggtcatctctcgatgaaaccaatcttgagttgctaaataaatgggctttcgaaggcgaaaagatcatccatgggaaaccttctgggatagacaacaccgtcagtgcatacggtttgttctaactgtaaaactccaaattctcggatcaaagtttcaataatatgttagagaaaaccgtttctgtttcgtggtggttgcaggcaacatgatcaagttctgctcaggcgagataactcggttacaatccaacatgcctctgagaatgctaattaccaacactagagttgggcgaaacacaaaagctctggtctctggtgtgtcacagagagcggtaagacatcctgatgcgatgaagtcagtgttcaacgccgtggattctataagcaaagagctcgctgcgatcattcagtctaaagacgagacctcagttacagaaaaagaagagagaataaaagaactcatggagatgaaccaaggtctgctcctgtcaatgggggttagccacagctcaatcgaggctgtgattctaaccacggtcaagcacaagcttgtctccaaacttacaggagctggtggcggcggctgcgtcctcactctattaccaaccggtaaactttgtcaggaactttcaatcatcctttttgtcaatttcggttctttattcttaaattaacccctctctgcaaaacaaactcgtttcagggacggtggtggacaaagtggtggaggagctcgagtccagcggttttcagtgtttcacggcattgattggtggtaacggagctcagatttgctattgatcaggtcggaaaaatcatatttggcctctcaccattcttaaacttgctgacgtgtacgtcaagaaggctgcaattagaaattcaaagagtcgattttttcttataaatgatgtgttgaatgtaaaattgctttattattataccatgtgacaaataattgaaaaaagcaaagattgtttagtttttttttttgtattttgaaattgttatgtttcatgatgggaaatataaaatgacaaagtttttacttagattgtcacattgatcacattatttcctcgtatattcatagtttgtccaacttcatcatttcatagatatcataagctggtcttttggcatgttcatgcattctaagtaacaatctgtataatggtaagcttgcaagaccaagacgatgcaaatctctaacatatgcagttgcttcttcaattttctcctctttctcaaagtactcggcaatcgccatgacgatgttatgggatggcctccaatgacaccgcctcattagtacaaacacttggtgcatagcatcaatggctttctccatattctcacatttcacccatccctccattaagatttcccaggtcttgtagtttggagtacctcctctctccaacacacaaccatgcaatgactcggctttccggatttctccattacgcacataagcacccaaaagaacattggagaccctaacatcatagttaaaacattgagcctcccactcactaaacaccctttcagcctcttcaagatcaccagttttcaccaaagacgacaatacacatatgtagttcacacaactaatcctaccacaaaccgatttagaaacttcccacaaacgaacaactccttccttattccctaaagacgcataaagcgtgataagaaagaaatatccaagcctattacttctattcaacatcttttccgcatcctcaagcaccaacctagccttctcatcaaaaccactcttaatataaacattagctaaagtacacaacgaactccacccaacttcaacactcttatcaccaaccatttccttataaaccgtttccacagccgcaactccagacacttcacaacatgcattcatccaaagattatacgaaagaacgtttcttggtatcttattccctttcatcatcgaaacaaccataactactttctcatactgaccactagcttcataaagcttcatcatttcgttaaacgggtgtggagtaacaagaaaccctaatccattcaacttctccattagagcttccgcttctttaaccattttattcttcacataagcacgaagaagcggaagataagccgatttcgctactctcatagacacagaactatgtagcagcttctcaaaatactcctctccttgtttcaagccatgagttttgatgatcaaatccaatctaagagcaatgtcataaacactaaattcaatatctttttgattctccatccactccatcatctgtatatacacacattactggcaaaatcaaaatcaaaagcttagttctcagttttaattaagggaaaaatttcaaacctggagagcgagatcgtaacgatttgatctaatgagacgcttggaaatcaatcggagctccgataaagagacggcatgacccgaatcgatccgttcctgaagcagagaggtaacgctgcgtcgtggaccgttctttctcagtatctccttcaagctattccgatttgcgactgatgacgtgtccgaaccatctgcaagtgaagacacgagccttgatactacgccggtggtgttgaacctcgtcttcgcaaccgcaacgcaacgaatcagcatttggattttggagccgccgcgaaactggttcggtctttctcgagaatctcagagaagagacggtgagagtggatttgggccgtattaaattaagttgggcttacccggcccatatcaatagttataagcccgtttaaagaaccgacgtcgtatggtcaaaaacctgaaacattagcttccttcttcttcctcaccttcaagcgccgacttcgttttcttcgaatccaaatttctgtgtctgcttttgattcacagagaaggagcaggaaagatg

SEQ ID NO: 23872 - DNA, 3003 bp, Unknown; identical to SEQ ID NO: 23871
  misc_feature (1)..( 3003): 2750-1469P.txt file - cDNA_ID_2156314; gDNA_ID_1620804; Annot_ID_168778

SEQ ID NO: 23873 - DNA, 3003 bp, Unknown
  misc_feature (1)..( 3003): 2750-1469P.txt file - cDNA_ID_2156350; gDNA_ID_1620817; Annot_ID_169302
aagacaagcttatatttcagctaagcacgttatcgcaagcttgagacagtagtaaataaatatgaatggggtttgaaatgaaaatggtacctgaattgctggattcgaggtcaataaaagagaaatcccaaggccatcaaatgcatttccccatgaaccatctgttagtgtcttccacaaccctttagattttccaaactcgcttgtttgcatcctcgatgaagctgtatctagaggctacaaaaacatacaacttaaagttaagcaaagcatatagttttgaagcagagctgagtgcaaaaaaacaaaaaaaacgtacttgagtcaaaacagaggtacaagcaccagcagcagcagcaatgaggagattagcctttgttccaatagacttagaaccaatcctttgggaatgtaacctcttgaaatagctataactatagaaatagatgaaggacgaaataaaagactgcaaattcttagtcccaaggccttgatacaaggagagaacatttcctgatgaaattgcttcccaaaacacatctgacagatatctgtaaacatcacaaaaacagctttaggtacctcaatattatctaatgacaatcacatatgaaccattataatacctaaaaaccttaaccaaaaatagtgattcaaaagcttaagctcattgagaagccttgatcagagaactgaaattttcgatttagacgaggatctacaagggatcaacatagaaatcataaacctaatccaaaaactgaaagttaaaaccgatttcaacaattcagcaggaacacagctaaaattgaagcgtgatgcagagacataaagaagcaattctcaaattctagatcatcatcatcgcgtcgcaatcaaatggaaaaagggaagaaggagagaaacctgtatttctgctgaccgcgaacacgaatctcggcttggaacttggatttacaggtatcaagagggtataaaatggtggtgctgagaagagatccaatggctccggaggtggcttcggagatggattccaaatccaaatcaacacccatatcttcttcttcttcttcttcttcgaagagagaaatgataattgatggtatgggcgatcacaagagaatgattttcgtcttgggattttaaacaaaaagccgtgtaagattgttttttgtgatggtgacgtcatccttttcaatttttcctttttttggtttagtcggtcaaatcatagaatgtaaacgataatatcaaagtcgggccacgtggttttcatgtttaaaaccggcctctacccaatattatttcgaattagggctaggcaaaaatgccgaattcgaatcttaatcgaaacactaccaaagaaggttgattagaaaattccccaaaaaaatatccaaatgaatcttagagttaggtattttgggtatcggataatatataattcgaatcgaaactcgaactagttagtatccgaaaaaaattaaaattaagtaaagtcatcaatccatattatatagttttgagtaattcatatattttcgagtaatttgagtgattaaattagttactttccaatattttagataatttgtttatttgttttttctaccgagttttatttatagaatttggacattttcaaatacttttcaatattttttcttgtaattttgaatacggatcgaatccagataaaagttaatctaaatagtaaaatctgatcgaaaacgaactatgaaaaactgaaccgtatccattccagcccaaatattacaaatatcctaacatgaaatatgagcctaaaaatccaaaaaaattgaaaaacccaaactgaaccctaacgtctaaccataatttaaatgatgtaaacgggtcagacggtatgatcaaacaaacaaaaaaatcaagtagttttaaaagtaaattatgaatattatacagaaaatatgaattaaaggataatacagtatataatatatgttgaaatagacaggtaaaaaaaatataatgaatgatgcgaaacaaattgatagtaaaaacatattaaaaatggttaaaaacataaatgttgtagctgaaatattttactgcataatatgattataagttaaaatcaatacaaattttagacgaaaaaataaatacacggactgtacatgaaaagtataacaacgacaaaactggtgtatcacacacccatgcggttcacgttcaccaagttttactatgtaaactgaaccatttttttcttttttctttttctacttttttttttaatcataaagcgcaatgttgtaagaataatcatgaatggaagacatggttacaatccaaaagaacggtgatatacccgcattcgtccgcgttaccactcaatggcatggtctcatgtcatttcctgtattataatgacattgtcactagctaggtgatattttgttgtataattttatgaaactaaatcataatcttgtaataaataaaacatattgctatagcgatgttgtatggaacatgttttttttgtttaacgtcactgtattcaacacttaataagagggagatgtctacttcaatgtattcaacaactagaaaagactttagtatgcatgattcaataaacgtaaatgcacatttttgtgcctaaattaaagtcattgattaaaaaaactagaatcatttgctttaattgtgcctaaatcatttgcgttacgttcattgatttaaaaaaactagaaaaagagactttaattgtgcctaaatcatttgcttcctaaattagatactcccgattgctgcctatatagtatatggacaggaggaagaatttttaccaaaaaaaaggactaggaatggagaaagaataatcatatgattcgatgaacgtaaatgcacatttttgtgtatatatatacatgatggaaacacatacatagagagacctaaactacctaatacctatacattcaatatattttcatcatctttatctacacaatg

SEQ ID NO: 23874 - DNA, 3003 bp, Unknown; identical to SEQ ID NO: 23873
  misc_feature (1)..( 3003): 2750-1469P.txt file - cDNA_ID_2156350; gDNA_ID_1620804; Annot_ID_168788

SEQ ID NO: 23875 - DNA, 3003 bp, Unknown; identical to SEQ ID NO: 18862
  misc_feature (1)..( 3003): 2750-1469P.txt file - cDNA_ID_2156368; gDNA_ID_1620681; Annot_ID_164449

SEQ ID NO: 23876 - DNA, 3003 bp, Unknown; identical to SEQ ID NO: 18862
  misc_feature (1)..( 3003): 2750-1469P.txt file - cDNA_ID_2156368; gDNA_ID_1620627; Annot_ID_162502

SEQ ID NO: 23877 - DNA, 3003 bp, Unknown; identical to SEQ ID NO: 18862
  misc_feature (1)..( 3003): 2750-1469P.txt file - cDNA_ID_2156368; gDNA_ID_2926186; Annot_ID_200634

SEQ ID NO: 23878 - DNA, 3003 bp, Unknown
  misc_feature (1)..( 3003): 2750-1469P.txt file - cDNA_ID_2156476; gDNA_ID_2926178; Annot_ID_200005
gcagggactactttaggaggtatacttactctctgaggtttacaagatcaatagtcactctgaaacaaaatcttctttagctttctaatatgcaacaatgctttaaagttctttttctctcatatgtctttctacagattactatttcgtctctcggttaccggtggtagagaagagacttgcacaaggcggaattcgcttggcagggactcttaaccgaatattttctgcaaaacggaagcttgctagagcatgaaaaaagatccaggagaatcacttgaacatccatgaacactcttatgtattaataatgtgtaatggtagtagttaaggttatggtttggtattgttcctgcgttttaactataataagtatgaaacgaaaactgtacgtctacaagaaaacatagcatttgacttgaaaaatcaaacttaactaaaccaaaaccaagatgtttgaatttgaatcgaaaaatgaactaaaactagcataaaatcttacttgttttatcattcataaacctgaaaaaaatagaacctaagtgaaactatagtttgagtgcaaaaacaaaaatctgatcattcaaatcgaaaaaccgtaagccaaaaaattcgcatcaagaaaaacacatttcaatgaaattacaaagtttgatcacgattcatgatgatagatatcttggagtctgacatccaaaagaagagaaggaaacagagccaaggtcaacttgccggacaccagaatcagttaattagattcattggtaaaaaaacccggcaagtcatccttggctcaacctcattctctattcttccatgcaagaccctctgatacaactagagactctcatcatcgtaatcatcattatcatgttttctctacctttcttttcttgtcttgtgatcttgtcatactcgtgatgaaggtatttataggcatattgaaatgggaaatgtgtggattaatttaattgaaaattcatataatgttattatatgcaataaatccatgcatggttttaaactagtagtgcatgcaagctacaaaataaaatggaattttgaccacaaccgtatattgaagaatataattactttaaaagattggctgaccttatattatcaaattcgaataagaattttatgtgaataatattcgtactctgaaggcatcgacgcatcgtactagtgtgacataaaaatccacgtgtcgtatgtttcttaggattggaatcatagtcttgtgtggggttgatcaacaaaaggtgttatcgattgtcgtagaaacaatttagaaagattctttataaatagtctttttaaaaacattgccacaaatttcaaatgttgcggataaaatggaatatatattgaaaatttcagattgtcctttgggttgagaatatatcatttggagactcatcacattgtgaagggggagtactagtaaataaattttttcccaaagccaattgttgcacgagctagtaaataaatagtaatacatgtgatccaaagctattacacactctttatagctactagagtttcgatttgtgttatagctcccgatcgattaattgggataagccggttttattccatcaacatgaagcttccataaattcactatatcaaataaataattaggccaaaatataggaaattaaataagaccatttaaatagatctaagacgggagatattaggattgattatcttcaaattatgttttcaatttcattagttaggatttaattacatataggaatagaaaaattaccatcaaatggggaagatgagcaatgttcatataggattataaacaagtaaaaaaaaaaaaaaaatttatttttgggtaagaaatatatgagaattttgtgcgcgttccaaaaactcttgtaaattttggcaagcttatgaatattacataaagtttggtatataactggaaacatatttatattactaaaactcgtttaatattaattgctaaagaaagaaaacaggtaacaaaagcgttaaagttaactttgattctatttattgatagatcccatcattagattatgaaatatcgtatccgattagataaattcattaccaacctttttttctttccttttggtaaactctttcattttaaacatattgaatgttaagtgggattgctaacataaaatagtaaaagtttttttactataggacaacgatccaattccaagctaaagattgatatataactagaaatggtatttaagagcttatgactaacactagagaccccatctaagcccataaaatgaggttatctaagcaagttatgtctcacgtaatgatcattattgggctttatgggtaatctatcccgttactccaaatctagttcagctgccacgtcactctaactaactcgttggaggggaaagagtgatattgaagcaaacaagaacaacgacgattatgggttttggggttttatccatttctttgtctaattttatcagattttgtctagatttttggatccaaattattagcggaaatcgaaattgggttttacggttaaatctcgttcttgaaagcttcccttccatggggctttttatctggacttaaaagcttgtgctagtctcacttgatactaatgtaaaggaaggagctttggaatgcttaattggcaagtgactagtggcacaactgtcagtttatatattttgattaaacaaatcaaacgtgggtctgtggatgggcaataaacaacaacataaattgaagaatatcatcaccccaaatggtcaatggatagattagagaaatagaaaaatcaaaagaagctttggcaaagagctaaagatcaaagcttttctttgaggtaattcgtttgactctttttttttttttttttttgcttgaatcgtgttgttctctttgttctgctagagatttgatctgtaaattatgtgatttattaagaaattgaaagctctgtgtttcagaatg

SEQ ID NO: 23879 - DNA, 3000 bp, Unknown; identical to SEQ ID NO: 3253
  misc_feature (1)..( 3000): 2750-1469P.txt file - cDNA_ID_2156487; gDNA_ID_1620635; Annot_ID_47343

SEQ ID NO: 23880 - DNA, 3000 bp, Unknown; identical to SEQ ID NO: 3267
  misc_feature (1)..( 3000): 2750-1469P.txt file - cDNA_ID_2156487; gDNA_ID_1620635; Annot_ID_162856

SEQ ID NO: 23881 - DNA, 3000 bp, Unknown; identical to SEQ ID NO: 3253
  misc_feature (1)..( 3000): 2750-1469P.txt file - cDNA_ID_2156487; gDNA_ID_2926178; Annot_ID_140438

SEQ ID NO: 23882 - DNA, 3000 bp, Unknown; identical to SEQ ID NO: 3267
  misc_feature (1)..( 3000): 2750-1469P.txt file - cDNA_ID_2156487; gDNA_ID_2926178; Annot_ID_200010

SEQ ID NO: 23883 - DNA, 3003 bp, Unknown; identical to SEQ ID NO: 18950
  misc_feature (1)..( 3003): 2750-1469P.txt file - cDNA_ID_2156491; gDNA_ID_1620635; Annot_ID_162858

SEQ ID NO: 23884 - DNA, 3003 bp, Unknown; identical to SEQ ID NO: 18950
  misc_feature (1)..( 3003): 2750-1469P.txt file - cDNA_ID_2156491; gDNA_ID_2926178; Annot_ID_200012

SEQ ID NO: 23885 - DNA, 3000 bp, Unknown
  misc_feature (1)..( 3000): 2750-1469P.txt file - cDNA_ID_2156549; gDNA_ID_1620677; Annot_ID_164279
aatggaatataatgaaatgaaaagcaataatatgaaaccgaaatttcttctctttttctattaaataatatactactagaaaatatagagacaatgtaaatgtttgaccaaaaaaaaaagtgtgtaaaatgaaattatgaaaatgaggagcacctagtcaaattgtgtgagacacgaataaattccttcgtttcccttttcagcttttttctacttataattttatgttacaaaatcataaaagcgacagaccaaaaaaaggaaagagagtgaagtgtgagcagtgagagaacccaaccaaactcttctgtcttcaatacaataataaaaaaacctcaaagttggaacctttctttcttcagagtctttcttcttcttctctgctccgtgacaaacgatgctctgtatcaaagccgaagctcttcatgaagatcaaaaccttgcttcctcttcttcttctcctagcaccgatcgcaccttcggaaatgccacttttcgtcttcccatcaattggtatatatactctctctaaatctatacttcttcttccttctctctatgctcccgatttgttttgtttttttggtttgctgatgttttctgatacaggggaagctcgatccggagatatctgaagaagactggtacattctcgagaagatcttactcttctggtgatggctctttgttttttcctgatctcgatgtaatgtacctctttctctctctcatatatctctgccttttattcttatctgatttcttggaatgtatttagtaaatctagggttttgagggggttatggtcacgccaaaggttttgaaattgcatttttgttttttttttggaagcaggaaagcaagatgattgatcaaactagtggtagatttgatggaaagaccaaactatggtacaaatgtgagcttgaacaagatgtaagtcactcagatccctcacttgcttctctttgtcgtacttatttatagaactaagtcacatttaagaaaccactgaaaagtttgtactactactgctaatggtaatggttaatgatatttgggatgatgatacagattaagagattgcagcagcagttacaagaggagattaacttacggttagctctaactagcgcagttgagcattctagttcaccgtttatggattcgccttgtgaacttcctgataaggtactcaatcctctttctccgacatataaaaatcttatttgttgtttttgctattgagtttctttaataactttatagagatttttttcaggcacaggagcttttggatagcttagcaatattggaaatcacggtgtcaaagcttgagcaagaatcagtttccttgagatatctacttaggcaagagaaaaacgagcggcgtctctctgagattctacaaaagaagtctcattattctgctccttcaaagttcactaatgctcaaaatttccctaacaagtcggtatgactctctttacaaagttttctgccttcttttgttctagtttctaaacagataattccttctggtttgacaggtgacgaggaaaagagagagtaaacaagtggattctttggatagtgaagctttgcaagtagaatgaagaagcaaagagttattatgtgatcttagggatagccatattggctggagagatcaacccatgggcaaactctttctcctctaattttagaatcacctttcagactcaccgagctggtccctgagcatctattcaataagaactctgagatcttagaaagatacactaaggggtaaggttgataggacgggttatgccctgcaggaggagctgcagtgaggagcttaattgtattctgcatctaagcatagaatccattgtggtaggcttataatcactaaggggattattggttgtataagttaaagtcatctcccttggatttaaagtaaattacgtaagatttttaattttttggttcctctattagtttatcataaccttattaaaatttgtaacaaccatacaattgttgcattgaaaatattaacaaagaaactgttgataatggactaatgcttgttgattagaacatgaactagtagttgccatccggaactaaatttttaagaacttaaagagtaggttttgtaattacaattggactaacagaagatataaaagtaattaatctatattatgatcggttaactaccgattaaattaaaagaatgataatgtgaggcgttaggtttataattatattgagccttaatggataaacactatggcctgtccaaaatataaaattacacctgaagattgtgattgctgcattgaaaatattaacaaagaaagtgctgataattgacaaatgattgttaatttagaataagaagtagtgtgtagttgtcatccggaattaaaactgaagagttggttttaaattttaattacagttggtttttggggccttattatgtcttttaatcagtagtttaccgattatattattataatataaattaataacttttatctattttgttagtcaaagtcctaaaatatttttgaaagcccattaatgtcctaaatcggccctgttccaaattttttggcttagcaaaatggtgatatccgattataagcacggactaaaaagataagataaggttttgttaaagttttattgttaaaatttatatatggtagtataaattatatttaaaaaagttataattagtagcgatatatagtatgtttttggaatctttaaaaccaggtcacatggaagtgtcgaacaaaagaataagataatacaggtaattaacaatccttagtgggctgaacgttgaattaagaaataaagccacgagtttggttttcttgttatttaatttacgtctctctctatttatatgtttaacgttacacttattaagatcgtaccttagggaaaaaacactcaacagacaaaaaaaaaaaggaaggcgcatcagtgatg

SEQ ID NO: 23886 - DNA, 3000 bp, Unknown; identical to SEQ ID NO: 23885
  misc_feature (1)..( 3000): 2750-1469P.txt file - cDNA_ID_2156549; gDNA_ID_2926204; Annot_ID_202029

SEQ ID NO: 23887 - DNA, 3003 bp, Unknown
  misc_feature (1)..( 3003): 2750-1469P.txt file - cDNA_ID_2156553; gDNA_ID_1620677; Annot_ID_164281
ctacacactacttcttattctaaattaacaatcatttgtcaattatcagcactttctttgttaatattttcaatgcagcaatcacaatcttcaggtgtaattttatattttggacaggccatagtgtttatccattaaggctcaatataattataaacctaacgcctcacattatcattcttttaatttaatcggtagttaaccgatcataatatagattaattacttttatatcttctgttagtccaattgtaattacaaaacctactctttaagttcttaaaaatttagttccggatggcaactactagttcatgttctaatcaacaagcattagtccattatcaacagtttctttgttaatattttcaatgcaacaattgtatggttgttacaaattttaataaggttatgataaactaatagaggaaccaaaaaattaaaaatcttacgtaatttactttaaatccaagggagatgactttaacttatacaaccaataatccccttagtgattataagcctaccacaatggattctatgcttagatgcagaatacaattaagctcctcactgcagctcctcctgcagggcataacccgtcctatcaaccttaccccttagtgtatctttctaagatctcagagttcttattgaatagatgctcagggaccagctcggtgagtctgaaaggtgattctaaaattagaggagaaagagtttgcccatgggttgatctctccagccaatatggctatccctaagatcacataataactctttgcttcttcattctacttgcaaagcttcactatccaaagaatccacttgtttactctctcttttcctcgtcacctgtcaaaccagaaggaattatctgtttagaaactagaacaaaagaaggcagaaaactttgtaaagagagtcataccgacttgttagggaaattttgagcattagtgaactttgaaggagcagaataatgagacttcttttgtagaatctcagagagacgccgctcgtttttctcttgcctaagtagatatctcaaggaaactgattcttgctcaagctttgacaccgtgatttccaatattgctaagctatccaaaagctcctgtgcctgaaaaaaatctctataaagttattaaagaaactcaatagcaaaaacaacaaataagatttttatatgtcggagaaagaggattgagtaccttatcaggaagttcacaaggcgaatccataaacggtgaactagaatgctcaactgcgctagttagagctaaccgtaagttaatctcctcttgtaactgctgctgcaatctcttaatctgtatcatcatcccaaatatcattaaccattaccattagcagtagtagtacaaacttttcagtggtttcttaaatgtgacttagttctataaataagtacgacaaagagaagcaagtgagggatctgagtgacttacatcttgttcaagctcacatttgtaccatagtttggtctttccatcaaatctaccactagtttgatcaatcatcttgctttcctgcttccaaaaaaaaaacaaaaatgcaatttcaaaacctttggcgtgaccataaccccctcaaaaccctagatttactaaatacattccaagaaatcagataagaataaaaggcagagatatatgagagagagaaagaggtacattacatcgagatcaggaaaaaacaaagagccatcaccagaagagtaagatcttctcgagaatgtaccagtcttcttcagatatctccggatcgagcttcccctgtatcagaaaacatcagcaaaccaaaaaaacaaaacaaatcgggagcatagagagaaggaagaagaagtatagatttagagagagtatatataccaattgatgggaagacgaaaagtggcatttccgaaggtgcgatcggtgctaggagaagaagaagaggaagcaaggttttgatcttcatgaagagcttcggctttgatacagagcatcgtttgtcacggagcagagaagaagaagaaagactctgaagaaagaaaggttccaactttgaggtttttttattattgtattgaagacagaagagtttggttgggttctctcactgctcacacttcactctctttcctttttttggtctgtcgcttttatgattttgtaacataaaattataagtagaaaaaagctgaaaagggaaacgaaggaatttattcgtgtctcacacaatttgactaggtgctcctcattttcataatttcattttacacacttttttttttggtcaaacatttacattgtctctatattttctagtagtatattatttaatagaaaaagagaagaaatttcggtttcatattattgcttttcatttcattatattccatttcggtatttatttttccataaattacgaaaaatgcttcatgtgtttttgaggactcaatgtatcatgtgtagggtaaatgatgacgcagataaacaaacagtggaatatctaactttaacatgttctttttctgaatcggactcaaaagaaagacctgattgcaacatatgagtcacacactcacatagagaaaaagattccaatcgtatcaaagagtgaaccgtattatggtttagtcaatttgacacaaaaccggatcaacccaatcgaaccagcctcaatgacaattttgggaccgacttttaaagacgtgtgtctctttattgtcgccgttcaattggtaagaggccacggcgtaatcgtaggacgacgacgaaacatatttttctttagtgtttattttatttttgtgttgggtttcagtttcaaagagtcccaccaatgaccaaaaagtgctccaatgcatgattattacgttggagcctcttcgatagagagatttttgctttctcaatttattattttttgtgtctctctctcgcccgatttggagtttttagggtttgatttttgtaatgtgagaaaggtttcgttatg

SEQ ID NO: 23888 - DNA, 3003 bp, Unknown; identical to SEQ ID NO: 23887
  misc_feature (1)..( 3003): 2750-1469P.txt file - cDNA_ID_2156553; gDNA_ID_2926204; Annot_ID_202031

SEQ ID NO: 23889 - DNA, 3003 bp, Unknown
  misc_feature (1)..( 3003): 2750-1469P.txt file - cDNA_ID_2156563; gDNA_ID_1620677; Annot_ID_164286
cagctgcataaacagacacactgcttctacttctaagccattttgagctattccggcaataactgaattccacgaaatcaaatctcgttcactcatattgtcaaatactgtcctagcgaaaccgaattttctcagtttacagtacatgtttattagactattcgaaacagtaagcatcaaatcaagtcctaacttcaatgccatacaatgaacttgctgccctaatgctaaactatctactttaacagctgtagctaacattaaaataaatgtgacttgatcacattccacgtcggactctaccatatccgcaaaacatttgagaagagctgaatactggcctgaatggagatattcactcaatcctttgttcctgaatattatttctgaaacagaagaagcatcattaccatttgcaaaggatttcacttgtcctgcatcagaatcatcacctgaaattctagcaagtaaacgcagagtgatttcattgggatttaaaccacttgaatgaaatgcagaagagaggtctattgcttcttccttaaaacccatttccagataagccttcaacatcaagttccataacaccacatctctataaggcatctcctcaaacaaaaccttaccttccttaaccttaccaaacttcaaatatatgttaacaagagctccggcaacaaattcatcaccgtccaaaccaatcttgcaagcatacccatgaaatgactctgaagcccacacatacccagaatgcaaacaaagtttcaacattggagacagagtcattcgactggtatacacaacgtcctggcgtaatatcctgaaaagaagaaaagcttgttgaatgttctcgacaacgcattcggaagactgagcataggcagctaaaatcgagttccaggaaacaagatctctgtcaggcattttatcgaacactcggcgagcataagtgagtgatccacacttggagtacatggagatgagattgttaatcaggaatcgttctgggttttcctcgaaggttaggatacgtgcgtgtgtacattttccgagcatcaagtccgacgaggtgattgcattccgaagaaagccgaaccattgtgacgaagacgaggaagatgaagacggcgaagcagcagaagtaaaacgcagaggacggagacattgaacaatgagagatgtgtgaaaggagaaagggatggccttggaggttgatcgcatgatcgggttaaaaatgtaaccttttaaagttgagaggtgttatcttgcaaaccaagcaactcatgagatggtaaccggtttttgcgtaatcttgtctccggagattccaattagcatttgaccaaattaattggttcaaaattaaacctaacaaacaagttttcttatttaatcgacgcttagacaaccaattaaagtttatttaatcggcgcctatacaaccaattaatttttccatatgcccgttaacttatattcatgtgctttaaaaggttaaaaatacaactatattttgatcaaaagttaatgtacgtgcctaaaatagtttaaaaaacaactgtagtcgtttgtgcttttggtccaatccttatagcttttatacctctctttaagttgggttaggtatccctttatcggggttgggtcttttaagtttcagtttttaaaaatatttgggcttgacccattttgtaatgttccatcttatgataaaaagtcaataaacagatctttaggcaaaaaaaaagaaaaaaaaactgtacagtagtgaacaataagttacacaacaaatgaaatctcgacccacgcgctgcaggtcctctcaattttaaatttatgaaaaaatccccaaaaaggagggttatagtccacggattatagtctcacgcgctgcaacgcgcatgtgatgcgagtggttttgtatttttaattcctacacgcgtgtagttctatttgaataaacttcaccaatcacaaccataatcgttctatgtttctttttgaataaacacttcggatttcctatatttcggactccaattcggattttcatggctaaggttgtctgaataaattaattcctatgaatttaacacgaaaataaaaatacaactatatatttgctcgtattaaaaacaaaaatatataaaagatttttttaaaaagatagaaaaccccttaaactaatacaatgtacgctcaggcaaccatgaaacacgttttaggctccaaccacctgaaaatctgatcttggcctaagaatattggacatatctaaacacaagttttaagatttgacacgaatttcgacataaataaggctttaaatgggggagatttatcatttgagtatagttttgtttttttggcagctgtaaaaattttgttattatatttttggaattttgttttgagacacaaaaatcgtaaaaacagtttttggattctctaccaaaaaaaaactcctagattttaggaaaacaaaatctttaagaagttgattaggtaataaactgttttttttttaatagtaaatctaagaaccgttgtctttttgtttggttcaacttcaaaaaccattgtaatatctagtttttttacatggactttagaaatcattcttgtacagattcaaggaaaaacaattatcgtgtatattaaagaatggaaacaaatataaaaatcacaccattccttcaacgttacatccctacacattgaatacgattatcttccatattatgatctttttaaaaaaaaagattttgtccatttctcaccctttctcatactctctttttttctcggacaagaaggctacagaaagatatgtcgctgtcgtcttacctcagcccgacgcgccttctagaaggctacctccgccgttgtctcagggcggcaggactgacgtcgcagacgctttccatagactctgaaacaaccatccacttctggggcccaccacctctagaccaccggagcgacgatgacagaccggttatg

SEQ ID NO: 23890 - DNA, 3003 bp, Unknown; identical to SEQ ID NO: 23889
  misc_feature (1)..( 3003): 2750-1469P.txt file - cDNA_ID_2156563; gDNA_ID_2926204; Annot_ID_202036

SEQ ID NO: 23891 - DNA, 3000 bp, Unknown; identical to SEQ ID NO: 3977
  misc_feature (1)..( 3000): 2750-1469P.txt file - cDNA_ID_2156571; gDNA_ID_1620677; Annot_ID_164288

SEQ ID NO: 23892 - DNA, 3000 bp, Unknown; identical to SEQ ID NO: 3977
  misc_feature (1)..( 3000): 2750-1469P.txt file - cDNA_ID_2156571; gDNA_ID_2926204; Annot_ID_202038

SEQ ID NO: 23893 - DNA, 3003 bp, Unknown; identical to SEQ ID NO: 19210
  misc_feature (1)..( 3003): 2750-1469P.txt file - cDNA_ID_2156638; gDNA_ID_1620649; Annot_ID_163397

SEQ ID NO: 23894 - DNA, 3003 bp, Unknown; identical to SEQ ID NO: 19210
  misc_feature (1)..( 3003): 2750-1469P.txt file - cDNA_ID_2156638; gDNA_ID_2926215; Annot_ID_202935

SEQ ID NO: 23895 - DNA, 3000 bp, Unknown; identical to SEQ ID NO: 3472
  misc_feature (1)..( 3000): 2750-1469P.txt file - cDNA_ID_2156681; gDNA_ID_1620648; Annot_ID_163317

SEQ ID NO: 23896 - DNA, 3000 bp, Unknown; identical to SEQ ID NO: 3472
  misc_feature (1)..( 3000): 2750-1469P.txt file - cDNA_ID_2156681; gDNA_ID_2926214; Annot_ID_202844

SEQ ID NO: 23897 - DNA, 3000 bp, Unknown; identical to SEQ ID NO: 3481
  misc_feature (1)..( 3000): 2750-1469P.txt file - cDNA_ID_2156691; gDNA_ID_1620648; Annot_ID_163322

SEQ ID NO: 23898 - DNA, 3000 bp, Unknown; identical to SEQ ID NO: 3481
  misc_feature (1)..( 3000): 2750-1469P.txt file - cDNA_ID_2156691; gDNA_ID_2926214; Annot_ID_202848

SEQ ID NO: 23899 - DNA, 3000 bp, Unknown; identical to SEQ ID NO: 3493
  misc_feature (1)..( 3000): 2750-1469P.txt file - cDNA_ID_2156727; gDNA_ID_1620648; Annot_ID_163345

SEQ ID NO: 23900 - DNA, 3000 bp, Unknown
  misc_feature (1)..( 3000): 2750-1469P.txt file - cDNA_ID_2156755; gDNA_ID_1620648; Annot_ID_163360
catacgtcaggttgtaaaatgttatcagccccggtggcaacgatcccagcttccacagtgttctgtcttcattctgcatcaatcatatattaattgacacatccattcatcatccaaaaatatttatatgtatttcttttgagaaatttccaatgccttaccaagtcttgccaatagtgatatatccctgtaatgttccgtttcctccactctttcaggtcaaacatattcatcccaaatgcccacccacaagcaccagcgtcaaaattctctgaaatctttggatttgagaagttgaggtacttgtcaaatctgtggaagctctccttgcacgtctccaccgcaccattcacttttccttgcatgtctatttcccatagtggtgccaggtccttctgcaccacaatgtcatcgtctagaaacagaatcttctccagcttcggataaacctcaggaaggtagaatctgagatgattcagcatcgatagatactttgggttgcggtactttagattatctgcgccagctgagattgatgaaggatgatttgctttgaaatagtattctttcagccttgcagattcaagctgccgtagaacagagcagtaagaggagttcagccacttgaaatcatttatgttttcaacttgaatcgtcgcatcagcaggagcattgatgcgaaaccacatcttcattgcaccaaaattcagtttgtcagttactatatggaacacatgcctctgcggttcctttgcattcaagacagtggagttcaccaccactgatgtagccagaacgttatccgaaaagatcgcatagtgatagagcgaaggatcttcaagcttcttttgactgacatcctctttcactgcatcctcttcattgaaacctagaataaaatagtctgccgctagctgcagactcaggcaatgcaatggcttgggaaatgttttggcagctagctgaattaagaaggttccctttttcttcagtccatctactttgcgttcagtggactgaaggatggcccggaacttttttgcaagttcatggcagtcatataactcgtcttttgcaagagagagtgcatggcccatggcttttgcttgatcaagagcgctagcaaagaaaatgggatggaaaaagtttcaacaaagattgttgtcccacaaagattgctgacaagaggaatgtaaaaaagtaccttgaaggaaggtcagcatcagaggttgctttacctataacacgtttattttctccacactgctgcatcaagaaaacgtacagattggttacattttttgatttggcaatatttgcatatgcttttgccattatgatctggtctctcataagcttcaagatagcatcagcatttgggctctcatagtctctcctccatatactgtatttccctatgactgagttttcaaagctcattgacttctgaatggctgcttcttgcatctgctcatcagtttccttttcttgtcggatcagctctaaagttcgttgacctctcctttcctgacgtaaaatctgaaagggtctacagttgttacaatctcagtcatatagtgttaaggcatccagagattagaaaagaaggctatttgacagatcacctgccgcttcagttttgctgggcttgcaaaatccacgtttggaaactgattttcgctttcatcagtctgattagttgtagaatggcttgcattatcttccattccagtatcattttgaaatgaatcccgtggtataactagctaattccatacaaaaaaatgtcagcaactagagaacaaagaatatgagcaagcttaaggataaattcaagaaacacaaggttagaacaaatgaagttcatgagaggtattttttgctcggtgagaagagtggtaagtaatcacttcacacactttaagttttctactatagaactccatatgcccataggatatacagttctattcttaaactgatgatcaaatctcattaaaactaaaaaccagaacatgaaatgtttggtacctgcgaaccttttgttttgcggctaacttgataggcaggattctccaaaacccaagaaggtgaaagatcccccattttcaccctaccaaggcgtatattgccgtaatggtcactgtatgtcgcaactatgttcacatcctgagataacagctttattagaagtaggaagcatacaaattgtattcactactcagagaaagaggactgcagccttactttcagatctggatcgtagtgcactgcagcagctgaggaagcatacacctcctaaaggcaaaagtggataacaaaaacttaatcacagcaaagtctgatatttgaaccaaataagttatctggagaacaagaggagaatgggacctgtagattattatcttgcagcggacgataagctttaagttctctgtggctgcataaggaaacatcatggcaaaaagaagaaaagagtataaaaataaaatagaaacagtgtagccaaaagacaagcttcaaggagatgtatcattacggtgcttgtgactctaaaatggctccaccgacatgaacagcatgtagcactactacctgcaaatcgtcgacatgtcaaaaaattaaggcacaatttgatcagatgatccattttaagagagtagtgcgaattccaggacgagctaagtaaatatagataatcatatcgaacggagagagaacaatcaagctaggtaccagcgataaaaaggcggcgcatgtagagaacgtcgtcatctggatctgactgatattaccacatcgccggcgagctttctttaaagcaaatcaatcaatcgagaggtttgttaaaacctgcacgtgctgccgtttcgtggtaagaaaaactacacgcagtttctttaagtagaagacggagaaaaaaaaaaaaaaaagagacgacgactttgattagagcagagagatggttggttcgttggttcgtcggaggagaagagaatg

SEQ ID NO: 23901 - DNA, 3000 bp, Unknown; identical to SEQ ID NO: 23900
  misc_feature (1)..( 3000): 2750-1469P.txt file - cDNA_ID_2156755; gDNA_ID_1620652; Annot_ID_163481

SEQ ID NO: 23902 - DNA, 3000 bp, Unknown; identical to SEQ ID NO: 23900
  misc_feature (1)..( 3000): 2750-1469P.txt file - cDNA_ID_2156755; gDNA_ID_2926215; Annot_ID_202902

SEQ ID NO: 23903 - DNA, 3003 bp, Unknown; identical to SEQ ID NO: 19082
  misc_feature (1)..( 3003): 2750-1469P.txt file - cDNA_ID_2156784; gDNA_ID_1620678; Annot_ID_164329

SEQ ID NO: 23904 - DNA, 3003 bp, Unknown; identical to SEQ ID NO: 19082
  misc_feature (1)..( 3003): 2750-1469P.txt file - cDNA_ID_2156784; gDNA_ID_1620643; Annot_ID_163101

SEQ ID NO: 23905 - DNA, 3003 bp, Unknown; identical to SEQ ID NO: 19082
  misc_feature (1)..( 3003): 2750-1469P.txt file - cDNA_ID_2156784; gDNA_ID_2926213; Annot_ID_202781

SEQ ID NO: 23906 - DNA, 3000 bp, Unknown; identical to SEQ ID NO: 3375
  misc_feature (1)..( 3000): 2750-1469P.txt file - cDNA_ID_2156792; gDNA_ID_1620643; Annot_ID_163105

SEQ ID NO: 23907 - DNA, 3000 bp, Unknown; identical to SEQ ID NO: 3375
  misc_feature (1)..( 3000): 2750-1469P.txt file - cDNA_ID_2156792; gDNA_ID_2926213; Annot_ID_202784

SEQ ID NO: 23908 - DNA, 3003 bp, Unknown
  misc_feature (1)..( 3003): 2750-1469P.txt file - cDNA_ID_2156864; gDNA_ID_1620678; Annot_ID_164316
ataaatttaccttccgagattgaactatatccaacgtcttctggaaatcttcctctcgacgtttaagttcagctagtgattcccactgatctggtatttccaggaaacgccttaaaaaagaaaattagagaaaccaatattaacgatttatccaaaaatacattatccatgtctattagaaatatttaataagcatatctataaaataagatatttactccaattgtttttccacttcggccagtcgtgcattgacttcttcgatctcatcttcgatctcctattttaagaaaaaaaaaagcatgcataagtactttaacttttttttgtttatatacctatatattgccaaatcatgagatttttattttattttaatcaacatgcctttggttgaattagataacgaagcccatcgtcaagactctcgtcactgcacttggtttctgaacgcatctgcatgaccaaccgttgtatattctagattctccataccaatcaagaaaaacaaaaaatttaggtaacgttaaacaaaatcactatacgaaaatcgagatgaattaaccgttagatagttttgatttttttaccggttcatgagggaggctgtgttcgatcagatggaccaaccgagtacaatatcaggagttcatgcatatgtataaaataagaatattagaactcatacaataaaattaaacaaacctattactttatgttcttatatataaatgcatgcattaacacaatgaatttaccgtgtgcgtacagcccgagcaagaaacttgcatataatctcttcgggtctataatcatgaacaataacgatgatttgatatcagatgatagtaataatatatatgatgaaataataaaatattggagctacaagaagaagaagaaaatgaaaacgtaatttattaatataatatacctctctttggcataaaagacgaagagtttaccagaaggagagaaaagaatgagagcaactggtacattacatagaacaaagagttcataagctttctttaaaagcccattttttcttttggcgaatgcaatatttctttgttgcctatcatttattcttttaatctgtatttttactctccccattttttcttgtcttcttttcacaatgttttctctttctcaattagctttcaaaatattttttataagtttatttatatagttatgagaaagaactttctatggctaaacttgtagattttccattaaattgtatcaaaattactaattactttaaattaaataaatttattaattaacatagaaccataatcttgtttgtcaatcaaaagatttagttttcttagttaatcttttcttctccagatatataaatgggtattatctattgcacatatattttataaattgaagtaaataattaatatatttataatataaagtaaatgttatattcattagattatgaatttggataagaaatctcatttattatggctcagtggcccatttcatcccatatatgaattgtgttatcaaaatttatgtcctggatgaattttttttaccaaatactatatgtaatgaaatgttttgaccaaatatatgtaatgaaaaaaataaaaaaaattgggtcaaaagggaaagaaatccttctctagaggataatggaccccacttgtgtaagataaaacagtctctctctctcccccacaagaaaaagcctcgaccacctaacgataatggtggctatgagatctccgtcttttctccgtcgtgtttctcaccgccgattataaaatacttatctactaccatctccttgtcggaaacggcgagctaagtcgattaggtatttattccttttatctcttttatctgttaaagctttcttagggtttttgtttttgttgttttgcatttgaaattgtgatctcatcgactatcaagcttcgaactttacattagggttttgtgtaaattcgtgttcttcttcactttctctttccaattcgacgcatatggatacgtgatgaaagttttcgaaaatttgttcaatttcaagtttagttctttatgactctactgattccggatttttctagggttttaattgagaagaaataaaaaggatattttggtatggaggtgaaggaatcgaagatagatatggatgattcagtcaataaggagattggggaattaccaaaagatatgccttgtactagtaactatgaggaccatagttttcataatcatgttgaagaagatgtcactgaggatcttccttgtggtggtgatgatattgatgctgatgcttctattaaaaaagaggttgcagagttcgacgaggacgaggttgatatattggaatgcaatgataacattgagattcaagtctcagggtgtgatgatgggactgatggatattcgagttcgtttggtggaacggattctgaacatgagaatgatcaagaagttgactccatgatttgtaatgagacttcacttcctctttgggtgaggtaagctctttcctcacgcttcttatttagtcttttatcttaatggtttccatgaaggtttgttgtgtgtttaaccaatagcagaatgagaaaaaaatgtcctcttgcttaatttggttttgtagagattttgatggttttggtagcttgtgtacttttactttttaattgaacactatcagttccatctctatgttgctggattcttaaaagactgaaatttaggagttacttgggttcctgtactaatgagaaaaacgtctgtagcttaatttggtgttgtagattttcatggatttggtagccttgtttactgttacttattattgaacactatcagttccatctatgtgttgtttgattgattctgaaaggacttaaatttgtgtgttactttactacgacttagctagctgcgtctttgatttatctccttttaaggaagtcaggagaagaattgctctatatcgtgaatggtatg

SEQ ID NO: 23909 - DNA, 3000 bp, Unknown
  misc_feature (1)..( 3000): 2750-1469P.txt file - cDNA_ID_2156872; gDNA_ID_2926213; Annot_ID_202769
gagcatcatcaaggataaactctctgtacgcagcaagaaagataaagttattgatctttctaaagatgagaagatcgaaaaagtcagtgtttctttcttctcgcgtgaatgatactcgttttatcattgttctcttactgtatttcctcacgagatgcagataatgcgtgctgaaacgtgtgatgagctacacaatattgttggtgaggatttctgggtggctacttggtgcgacagtaccggatctgaagggtgggtttgttgatttgtcccgtaattctcttcactgaagattttctgttatgttgattttgctttctttgttcatatcttcaggaaacgcctcgaaggaactagaatcacctgcattcaaaaaccgtaaattttactttttgttgcatgtgattaacacaaatcctaatcacaccactttcttcaataaatttctctcgtgtttatccaggggaaggctggggtatgatttttcaattcgaactccatgtacacctgcaaggtggagcgactttgatgaagaaatgacctcagcttgggaggtaagacctaagcatatgcaaataattggtatttcttttgtttctgagaaaacaaactcaaaagtctaactgaatccacaggctttatgcactgcctattgtggagagaactatggttctactgagctcgacgctttagaaaccgttagagacgccatcttacgcatgacatattactggtaaacgactatgacaacctaacgtatgattgattaattactcggaagctgttggtatttaatagcaatcattggtttttttaccaggtacaattttatgccattagctcgaggaactgctgtaacaggatttgtagtgttacttggacttctgcttgctgctaatatggagttcactgagactatcccgaaagggttacagatcgattgggaagctatacttaatgtcgaaccgggttcctttgttgattcggttaagtcttggttatacccgtccctgaaaatcaatacgtcgtggagagaccatacggaaatttcctcggctttttcgacaacaggagcggttgttgctgcgcttagcacttacaacgattgagattcaaatctctctctctctgtctctccttctctctctgtctctctgtgtctctctcacaatctttcataagaggtgaagaaggctaactaaaccatgagcagtaagaaaacttgtgtttcagtcaaacatcttccgtctgtttctgatctaaaaaacaaaaaaaaagctagaaaagctttgttagggttttaactttattaactctcgtgtttaatataattttacagatttaataatgtatctaaatatgatttctctggtctcaacatgagaggttccaacatgagagtttacaacccttggccgatcttatgttgttttaagtttattctgacacctctttttttaatacaatcttctgtctgctctgattgacagcattgataccatgatcatataaccgttgcatgtttctgaaatcaatctcaaaataattgcttcatagtaaaaaatgattacaagattcgagtttcatttattatcgttataacactcactgtctcattcgtcaaagtctttaacaaagtcaacgaacgaccattagcttgggctttctctccaccgacgcgccgctctcagaatttccacttactcattgtctttatattcaaaaactcaaaaaaaaaaaagtattaagaatggcttaagaccgaaacgtgttttctcctagtctggcaaaacacaaaataataaatataaggaaacgcttatgaatacttttcaatattctacataaagtcattgaaagaaggattggaacaaagtgagaagcaacaaaaagaaatcaaaatcgtagctcctaagcaatacgtttcttcattggcaacggttttgattccatttcgactcgaatgaaaaaaggccaaagagtattcaggcaattacggtgacggtggcaacaaattatagattaaaacgagccaaaatagaagaaagtgccaacaaatccgtgtgggcaccaatccaaagtggcaaaatcaatcaaccagctgtcctctccctctaacttccgatcaaagactctctttttttttgtttacgttttcttttcctcattctccttgtcttattttgattgcattatattgaacttgagtttaatcatttttcattattaaggttatttatttatagacgcatgatgcatcaagtcataataatttcacccgtgatgatcacataataatactaatccaagactccatgtgtcgtaccccaaaaatttatctcaattatactatgtaccttatattgtgctatttttttaactaataatttcccgacaatttagtagttggaaatttctcgaccgtgtgatataatctataatataaaatatcataattattaaacaatgataaaatttgtgagcgacattggtatcaatttcaaatccaattattatgttgacacaagactagtgatttatagtataaccaatttaatgtctaacgtaaaaacaattactattaattgattttctatatctgatcatatgttcaacaaaacacatgctaatctacccaccattggcgaataaatttattgcagaatataacaggagaaaaatgccaagaaaaaaaaatccttataaaaacgcacaagaaaaaagtaaaagagctattctgtaaaataaaaatgaaaaaagtattgaatcctacattaatagatacaggatatgatgttctgtttctcaacggctacatctgtctgtgatccttttttaatccaacgatccagatctctcctcatcgcctatataaaactcacttctcttacatcaaacaaacaacacgcttggttaaactccatcagtactttaaccatcacttcaaagttcaaactcttttttttttttttgtttgatccaaattttaacaaaattatg

SEQ ID NO: 23910 - DNA, 3000 bp, Unknown; identical to SEQ ID NO: 3994
  misc_feature (1)..( 3000): 2750-1469P.txt file - cDNA_ID_2156875; gDNA_ID_1620678; Annot_ID_164318

SEQ ID NO: 23911 - DNA, 3000 bp, Unknown; identical to SEQ ID NO: 3994
  misc_feature (1)..( 3000): 2750-1469P.txt file - cDNA_ID_2156875; gDNA_ID_2926213; Annot_ID_202770

SEQ ID NO: 23912 - DNA, 3003 bp, Unknown; identical to SEQ ID NO: 19609
  misc_feature (1)..( 3003): 2750-1469P.txt file - cDNA_ID_2156878; gDNA_ID_1620678; Annot_ID_164320

SEQ ID NO: 23913 - DNA, 3003 bp, Unknown; identical to SEQ ID NO: 19609
  misc_feature (1)..( 3003): 2750-1469P.txt file - cDNA_ID_2156878; gDNA_ID_2926213; Annot_ID_202772

SEQ ID NO: 23914 - DNA, 3000 bp, Unknown; identical to SEQ ID NO: 20275
  misc_feature (1)..( 3000): 2750-1469P.txt file - cDNA_ID_2156899; gDNA_ID_1620721; Annot_ID_165812

SEQ ID NO: 23915 - DNA, 3000 bp, Unknown; identical to SEQ ID NO: 20275
  misc_feature (1)..( 3000): 2750-1469P.txt file - cDNA_ID_2156899; gDNA_ID_2926191; Annot_ID_201046

SEQ ID NO: 23916 - DNA, 3000 bp, Unknown; identical to SEQ ID NO: 3996
  misc_feature (1)..( 3000): 2750-1469P.txt file - cDNA_ID_2156949; gDNA_ID_1620678; Annot_ID_48305

SEQ ID NO: 23917 - DNA, 3000 bp, Unknown; identical to SEQ ID NO: 3996
  misc_feature (1)..( 3000): 2750-1469P.txt file - cDNA_ID_2156949; gDNA_ID_1620678; Annot_ID_164323

SEQ ID NO: 23918 - DNA, 3000 bp, Unknown; identical to SEQ ID NO: 3996
  misc_feature (1)..( 3000): 2750-1469P.txt file - cDNA_ID_2156949; gDNA_ID_2926213; Annot_ID_142091

SEQ ID NO: 23919 - DNA, 3000 bp, Unknown; identical to SEQ ID NO: 3996
  misc_feature (1)..( 3000): 2750-1469P.txt file - cDNA_ID_2156949; gDNA_ID_2926213; Annot_ID_202775

SEQ ID NO: 23920 - DNA, 3003 bp, Unknown; identical to SEQ ID NO: 20201
  misc_feature (1)..( 3003): 2750-1469P.txt file - cDNA_ID_2157018; gDNA_ID_1620716; Annot_ID_165643

SEQ ID NO: 23921 - DNA, 3003 bp, Unknown; identical to SEQ ID NO: 20201
  misc_feature (1)..( 3003): 2750-1469P.txt file - cDNA_ID_2157018; gDNA_ID_2926190; Annot_ID_200967

SEQ ID NO: 23922 - DNA, 2922 bp, Unknown; identical to SEQ ID NO: 2345
  misc_feature (1)..( 2922): 2750-1469P.txt file - cDNA_ID_2157321; gDNA_ID_1620522; Annot_ID_159494

SEQ ID NO: 23923 - DNA, 3003 bp, Unknown
  misc_feature (1)..( 3003): 2750-1469P.txt file - cDNA_ID_2157334; gDNA_ID_1620522; Annot_ID_159499
aaatcaaatgaaaataaaagggaaaagatctttctttttgtcttctatatttattatttattgcaaattatgagaaatgttacatacacaattctaacacggacaatttcttccgacccttattagatccacgatagataacacatccttctccatgctcttgattttaattcatttaaattctttgtcatttattgtcgaaagagtttttctaaatatttaaatttcaagtccaaaactacaggatttataacatccaaaacactaattttatttagataaaattgtcttagttcatttttcataaaatttaaacaattgaataaaatctttataagttaatatcagtatacattaataaaatagcatggtactaacattatcaatttatagatgttttattgtattattgatgagtaaatatgcatatttatgtccactgaaaataattaattgataaatttaaaatatattgaaattatagtaatcttaattttaaatttaatttcatgtaatagtatttgttttgtgcccatgatgatgagcccatataatttgacatcatgttgttttaaaaaatcaatcgttgagttatataaatgattgcgacgtatcgcacgatattaccatcgatagaacgaaggaaacttccatttagcagttttttttattcaaaaaacatatctttcatataatagaagtggaaaagttacaccaaggaaaattgaacctacaatcgaaataaatgagataacaaaagtattacaataaatttattgaaagacaccaaaccagatgaatgatccgttgagctatccaacaagggtctagatgacattgaagaatgttaatgataaataatgagaactgaggctggctttgaggatgaattatgcaatcttgcattgcgcttttttccatatggagtacagtgaggcttgataggcaattcgaagaatcaaagtagttttcttgtcacgacaaggattcttcaaccatctaacttcatcctcaaattgatttagaggagaaagatgggctttatcatagaaatagtgtcatacctttgcaacataagagcagtcgaagaataaatgttagcgagattcatccatcaaattacagagaagacacgacgaaggagtagtcatgccccatcgaatcattttgtctctagtgagaagtctatgatgagactttagccaagcaatgaaagcatgcttaagaatccttcctggaaatcacacagattcaaaccgatccatctttgtgtcaggaggatgaagatgtgcataagtttttttttgaatattaatgtgcctaagttttagcagcagagaaaatatttgatgcatggatatcatcaccttccaaaggtaaacatcatcctctacatcctcttgtaagttaacagtagaataggaaggaagacattctttaagcaactgaataatgggactgcgacttcgagaatttgtaagccactattgtctctttctcaatgcatccgcaaccacaacagaacgagggagaagagaaattcttagtcataaatcttcaggttagctcgacaaatatggtcccaaaaaaatccaattatcagtccagaaattacaagttatttctgaaccaatttcacaaacgatgaaaaacctagttaagggtcttaacttgcaaagattattccaaatccagcttctccaagtgatacactccatatcccaaattttttaaaaattattcaaacaagatccatgtgtattagttttctcttttggtaagtaaaatagtggtatccataagatgttggattatcgggcatctatttgctaatgattgtttctaaattagaacttagatttgcgaatctaataatacatcacttatcaatagataaacctttgaccattttttcaacgaactcataaaagatccaacaaaatattttttgagttattaaattaaatactactataaattatctttaaataaatcaaattatgggagtatttggtgtttctttcatcaatgaatggagcaaaaataaaaagtatttaaaataaacaacgctaacatttatgacaactctattatctctctctcactctctcacttcaaatactataattcattgtccttttcatcgaatccaagacctcaaaaaaaacaattattatttttcaacgatcaagatctcaagagtcaaatccaacggtcaaaaagaagtgactctggtactgacaccacctctcataattctcgttagtaggacctctcttcttcttccttctctccactgtatcggatccgggtcaaatccgggtcgggtggagtcgggtcgggtctcttataagaggaggaaaaccacttactcactttcttcttcttttctctctctctttcacccccacgcactcttcttttctctctctgacacatatctttttctctcactaaccatttctttctctctctctcttctgtttttgaaagccaaagtgtctctcttggacagtgatggaactgcttcaagagatttaattttttacccacgagagaagtcaagttgttgaagaagaaagatttgttcttttgtcttgtttctttcattttttcatccacaaagatctcaaagacaagagtttttttttttctgttggggttgcttcaatgcgtacttgtagtagagagcttgtgttgttgttcatggtttgatgatgagaagaaacagattctggttttgaagaaatggggtttgttctgtttcttgtgtttaagggttttatggatggttttttgattcgaagctttcactgagtcttatggttgtgagtgagatttttgggggtttgaacaaaggagatggagaaagacgagtttgtacttccggagctaaagagttatagctactgtagtagctggaagtgaagaagattttttaatagattgtacggaaaaattagggttttcaaagtttggtttcttgaagttgaattagacatg

SEQ ID NO: 23924 - DNA, 3000 bp, Unknown; identical to SEQ ID NO: 2337
  misc_feature (1)..( 3000): 2750-1469P.txt file - cDNA_ID_2157410; gDNA_ID_1620521; Annot_ID_159480

SEQ ID NO: 23925 - DNA, 3000 bp, Unknown; identical to SEQ ID NO: 2338
  misc_feature (1)..( 3000): 2750-1469P.txt file - cDNA_ID_2157416; gDNA_ID_1620521; Annot_ID_159483

SEQ ID NO: 23926 - DNA, 3003 bp, Unknown
  misc_feature (1)..( 3003): 2750-1469P.txt file - cDNA_ID_2157424; gDNA_ID_1620521; Annot_ID_159485
ttgaaaccgaaactgattagagccaaaattgaaagaaattgggggaaacaaaaagcccaaaaacgcaaaccttttcaggaattcgaggaagacattctcgacttgaatcgcttgttcatccattacaaatccaccaaaagcttccatttttcaaattctacctcactcgaaattttcctcttcactaccaaaaactgtttgcgacaaaaaccctaaaatcgtttgaacggaaaacaaaacctttctccactatgggcaaagaaatggcgagcttgttgtggcgggagttttaggtggggtcctctaacattttcccgctaaaaagtatagcgatacgtgaattgggcctaaactttgggcttatatattgggcttataatttggacctttaaaatggaccttttcaaatatatatttgatcaagacaaccatgcttattctaaactctaaagataatcgattctggttattaagaaaatcgatagaacaaaaaaaagaaaacgaaccttcacgaatgttttgctattttttcttcattagaaatacaacttgataagatcatttgaatgttctgtttactaattatgaacaagtaaaacttaaaagatttgttgttatactatctctatcttatacttctctatttatagattaacataacaaattgccataacaattctcttgcctatataattctgagctctattcatcttttcacaacaaaccaagtttcaacaatcaatcataaaaatgagaactaaatatttttctttgctagtgtttattattgtcttggcttctaatgaagttatagccaagaaacactcttcaacacctaaattaagaagaagtgattttccaaaagattttatttttggagctgcaacgtcagcttaccaagtcgaaggagctgctcatgaagatggtagaggtccaagtatttgggatacattctctgaaaaatatccggagaagataaaagatggtaccaatggatctattgcaagtgattcttaccatctttacaaggaagatgtgggtttactacatcaaattggtttcggtgcctatagattctctatctcgtggtcgaggatcttgccacgtgggaatctaaaaggaggtatcaaccaagctggtattgactattacaacaacttgatcaatgagcttttgtctaaaggaattaagccattcgccaccatttttcattgggacacaccgcaaagccttgaagatgcttacggaggattctttggcgcggagattgtgaatgacttccgcgattatgcggatatttgcttcaagaattttggagatcgagtgaagcattggatgacattgaacgaaccattaacagttgtgcaacaaggatatgttgctggtgtaatggctcctggaaggtgttcaaaattcacaaaccctaattgcaccgcgggaaatggagctaccgagccttatattgttggtcacaacctcattcttgctcatggagaagcagtcaaagtatatagagaaaaatataaggcatctcaaaaaggtcaagttggtatcgctttgaacgcgggttggaacttgccttataccgaatcagctgaagatagattagctgcggcacgagccatggccttcacattcgactatttcatggagccgcttgtaaccggtaaatatccggttgacatggtcaacaacgtaaaagacggtcgcttacctacatttactgcaaaacaatctaagatgttgaaaggatcatatgatttcattggcatcaattattactcatcttcttacgctaaggatgttccttgctcaagcgaaaacgttacattattctctgatccttgtgctagcgtcacaggtgaaagagaaggagtgcctatcggtccaaaggcagcatcagattggcttttgatatatccaaaaggaattcgtgatctccttctctatgcaaaatacaagttcaaggatcctgtcatgtatataacagagaatggtagagatgaagctagtaccggtaaaatcgaccttaaagatagtgagaggatcgattactacgctcaacatttgaagatggttcaagacgctatatcaattggagccaatgttaaaggattctttgcgtggtctttgctagataattttgaatgggcaacgggctactcagtccgatttggactagtttacgtggatttcaacgatggacgtaagagatatccaaagaaatcggcaaaatggttcagaaagttattgagcgaaaagaaaaggaattgatgaaacatgcatcattacattatattaaccaactaggttaatatatgcacgatgtgtagtttgtttgagtaacaatttatcgttctgttataaatattgtttggttatcaaacttgaatactaaaatagtgattcaaatgtaaaaattttgtggacactatattaaatgaaacatttccaatatttcaagtttcagtattctagaattgataaattaattgtactttaagaatcaaatatttaaacaaatagttgatgaaataacactctatattgaatattatattaaaataattaaaattattagttttttttgagatattaaaatcatgaatgcaaaatataaaagttatattatttattatttttgatttcataaaatgagtatgtattcttttagagataaaagaaaaaaagaaaaaaattggcaagttcgatgcaaaaccccttaaatatggggaatcctaaatatggaaaacacaatagtaattttatagtattatccaagtagcagttgttcggaggctatctacatgtctcagccactcgtattattctccaatctataaaaattcaaattttcaatctccctttcttaagattaaaagtggcaaagttgagattttgatcgtcttcttcctctggaaatttcaatcgaaactatatcttcagagatgcagaatctgtgaaattgtagaaacgaatttcacatttttttttgaagaaatg

SEQ ID NO: 23927 - DNA, 500 bp, Unknown; identical to SEQ ID NO: 2339
  misc_feature (1)..( 500): 2750-1469P.txt file - cDNA_ID_2157428; gDNA_ID_1620521; Annot_ID_159486

SEQ ID NO: 23928 - DNA, 3000 bp, Unknown; identical to SEQ ID NO: 2356
  misc_feature (1)..( 3000): 2750-1469P.txt file - cDNA_ID_2157465; gDNA_ID_1620525; Annot_ID_159561

SEQ ID NO: 23929 - DNA, 3003 bp, Unknown
  misc_feature (1)..( 3003): 2750-1469P.txt file - cDNA_ID_2157469; gDNA_ID_1620525; Annot_ID_159563
tccaaactcagtcactgattccaattaaccagctagtacagtacaaatgtgaaaccctaataaaggaaagaaacagaggaagtacctgatgttgacgttgtcggtggagatgtgagtagagacatttttagcaacccatttctcagcagctttcaggctagaggcgagagtcgcaagcatctcattgggaataccaaccatgacttcgattccggatttgcccaaagctctgagagtgtcgtattcggcgtcaaagagctttactttctgaataccattctctcttagcatccgcacaactatgtccggtggaagtgggtgcgacgcctgtgtgccccagttagctccgattgaacttgccctctgacaaagaagagccaccgccagtaatagcaacaccgaaccccaacccatctcaggctcgccgatctgactcttcgttcaccaaaaaagctatacaattattaaacactgagctttgagctgcgagcttagctggtactatttcctccagaccagtgggttttaaagcggccacgcacgagcgagtgccgctgctttttggcaaccccataacgacaaaaaatgacacgtaagctacgcgtcaaacgatgtctttaaagtctaaactgttttagttcggtcttctcaaaagtcattacggataatgtgggcttttgtatcacaggcccatatcttgaaaataatcaatcagtttatattgtctctttagtgctctcatagagtcattacggataaggtgggcttttgtatcgcaagcccatttcttgaaaataatcaatcagtttattatattagtcaatgttatttaaattcattgaaaataatcaatcagtaagacttttttttttttggttgagaacttgagacggtaagaaaatattggctaatcgaaggccggaaaaagaaatctgtggaaagacaagaaaaaacgagcacagtggccagtgtgggaatttttgctggacgagagagcaaaaccctactgcgatttatcgactactaggagaagaagaagaagaagacgatgcggagattcggggctgggaacagatccgtttccaagctcgtactcaccatttgtgtagctatcctggtacgatcccttcgttcgatctgtcgcaagattagtatttgatcaaaaccaaatttgaaaattgatgatgagctgcgatgttatctgttaatgcttttgtttttaaactcacctttctctttctcaattgagtttgcgtaatttgtttgattgatttcgtggcttagttcataccatctctatcgtatggagcttcacaagggaaccggaagacggcgaagtcttctgtgttttccttgttcaatcttagggataaaagcagattttggagcgagtctgtttttcgtactggtatgtgttctgtttccaggcctctctttgcttttggatttcctatgtcttcatttgcatcacaatttttcgtgctgttatcagattttgatgatttggagtcttccgttcactcgaattctggtgtgctgaattacactaagtcaggtaagtaattgcctttcgtttctgtgaatggctaaaggacttactagctcaattcgcaacaccacgttctgatttggattgcatcctttcaggaaatattgcgagttacttagagcttatggaagtcgattctgtctatcttccagtgccagttaattttatcttcatagggtttgaaggaaaagggaaccaaggtgaataacttctgcctgtcttgcttttatttgaattggagctatcacttgactttctcttttgtccgtaactttttccacacactttccagacttcaaactccgtcccgaggaacttgagcgttggtttaataaacttgatcacatgtttgaacatacacgagttccacaaatcaaagaagttctcaatcccttttacaagattaacattgaaaaggaggtgcagcaccatcttcctatcatcagtcgcgtgaactacaagtacagtcatctttttcttaacttttttcctggtggttcattcacggtggtgttggctttaagtaaagtttaattgggcatttgtttccctttgtcagcttttctgttcatgctatacaaatgggagaaaaggtgacatcagtaattgaacacgcaatcaaagttttagctcgcaaagatgatgtggctaccaataagtaatgcattacaaagaccttttttttgcttcagtttatgtcgtatggacgtccatttctgtcaatttatatgcagcgatatctgagcctgcagaccacttggttctagtaactttatgtcactcatgctacctgcttccaacttttttaagtggtgtcctgattcttattttttgtgttggttctatattaaactatctcgttttatggtaacagagatgaggaaagtgctctactgcaagtggatgctgagatgatggaattcattttcactagccttgtcgaatattttcatctcgaggatgcatacaacctttttattttgaatcccaagcacgataacaaaaaagccaaatatggataccggtgagcacctgctgtctatatgatcatcttattgtaatacagtcgaggaacatactagacttataaaaggattttgcaggagagggttttcagagtcagagatatcttatctgaaagaggtatgtcaatcttttcatgcttgaaagcaattacatcataaacaatcctcactaaaaaagaagaatgtccttggagtgatctcttggttaagttcgctgttaagtgcttctatgtttttaccaagttcatattactcttactatttctcgcagaacaaggaaatactaaaaaatcttcttcagtctggaaaaccgtcagaaaatattttaggtacagaatggaaaataacaatgatatgtctccattgattatgtacattccagttttcttatatgaaacctgctgcgagtatgttgtagcatttgatatg

SEQ ID NO: 23930 - DNA, 3000 bp, Unknown; identical to SEQ ID NO: 2355
  misc_feature (1)..( 3000): 2750-1469P.txt file - cDNA_ID_2157479; gDNA_ID_1620525; Annot_ID_159566

SEQ ID NO: 23931 - DNA, 3000 bp, Unknown; identical to SEQ ID NO: 2360
  misc_feature (1)..( 3000): 2750-1469P.txt file - cDNA_ID_2157495; gDNA_ID_1620526; Annot_ID_159571

SEQ ID NO: 23932 - DNA, 3003 bp, Unknown
  misc_feature (1)..( 3003): 2750-1469P.txt file - cDNA_ID_2157503; gDNA_ID_1620526; Annot_ID_159574
tatcttgtgtcttaacaagacaaaacacttcttactatcatgaaaatgccaacgtcactaagacactaattttttcatctttacttttctttcctttttcaataaagaaaaatatcaattaccacatcgaagggaaaaaattataattaattactactatctgtgcattttttttttgttagttacacgaaatattatcttttatataattacaatgatgacatcggtttttaaaaatatgtatgttttagaaaatgctttcaaatttgttttttttttttgatcaaaaatatgtatgttttagaaaatctgtatgtaactaacccacaccaaaaagtaacaaaccaatgatgacatcggtttttaaaattatgtatgttttagaaaatactttctcaatttttttttttttaatatttaaagctgtttcacacatgttaaagaatttttaatttttatttattttaaactaaaaaattatttatctaaatataattcagtcaataaaacaacaatctgcataatataaattgtcaaaaccaatataaaaataataattaattttatgtttaaatattatattttaaaattttcttctaaaacaccaaatgaaaaatatggagggattatattacaaacctcatctgtccaaccgcgacaaaaactgttacttatattaaagaaaattaaagaaagaaataaacatcatctccgtgaatgtcattgcgaaaattggagaaaaaaaagaaaaacaaaattaaagatccgacccaaattccataacaaacaaaaccaaccaaaatttaacccagcccaaaacaaatatgttaaattgaacccaaccacctacataacccaacccgaccctccccaaatgacataaatcaatcagatatattttactcgatgtaattagtaatttcataaggctcacattcattgcatgtatacaaatttaactaaattgaaaggaaaaagaatattcgtgtgcgacaatatggtcatattactcccgactacaataacatatgtaaagtagtcataagatacgaacttgaactctctatttatttttgttcataattaattttattggttttcaattatatatatatatatattttgactagtaatctataggttaattcagtaacgaataaagatagatgaacggatggaccattaatccactacgacgcttagggaccaactttccacaagtgaggaaataggaccgcgactaccacttcctacacacccgtgataatattgtcaacgtcattcatgctttttcacctaaatttctttatcttagtggactaggcaatcaatttgaaaactctactacactgagttccaaagtttaacaaaaccataaatgaagagtgctacaaatatgtcatgtttcgtcgtacaacaagtttcccctttggctatacactaaaaaaaaccaacaattttccctgattatacactaaaaaaaactaacaattttccctgattacggtcaaatgctagctgatacacagtgtattttacacacctcgtcgtaatgatgaaagttagattcttgtttcttgacagtcgacttgtcttcgacgtaaattcgtcaaaaaagtcaatttccaatggatttctaaatgttgtatccgtcaaaactcagaaatgagttcttttattgtaatatatatggttatactatagagttaacaatcgtaaggtgttttattaacatcggaaacttttcaaggagttccacccctctttcatagtccctcatttaaaacacaaataacataaaacttgtcctaaggaaacctaaaatcgataactctatagaaaacacaacacatctttttctgttctttataaactgaaatttttcaattgggaacaagtttgtttacttagtatcatttggtaaaaaaaaaaaaagatgctccaataaacccaccaacatcttgggttggtcatttagatactctttgaattatatcagagaaaaatatcttatggttggtatggcagacgaccgataagaacctgtatagtataaccatatccgacaatgacttctctgttatccgaagacatactagacgatcaccaagaaaaagaatttgaaggtaaaacccataaaacatcataagtttgatgtaacaatcaaatttttttgtctctttcccaagttataaggacaacgagaaaataattcaccgaaaaaaggacaacgagaaaataaaataaacattaacttttttttactcataaatgaagtgtcctggaccatgaagaatgcaagagaatacggggtagggagcatttctagggaaagacgggcgacaacaaaacgtcaaaacctaacctataaaaatattaaacgcgaatcatatatagtgaaccataatgaaacaagaaaaaattaatagtgaagaattcaagataaaaccaagctagctaccaaaaacaaaaaaaaagataaaccaagctaatgatgagtcttttgaaaataacatagtttcacatgtaacttaacacacacaaaaatatgtttataatgaccaagaaataaactgaaataaactgaaataaactaagggaaacttaaatgatttcttaggacatatacatgatgaaaactgaaaacgaacaaatgctaggaagtgcattagcaaacaagagattcttaggaaaacatgaataacttagacattttggtaaagaactaaaactcccaaaagtcattctttttgggcataatctataaagtttaagaacttaagaataaataaataaatcataaaataattgaatacacagtaaaactaaaatctacatctcttgatagttaaaaagagagttgtgataaggtggtggggcctttcatttggccttcttttttttgagtccatatatagagaaattggaagaagttgatcaaaaggttcaaaacaaaaccacttttcaaacattggaactatctaagtattgaacacaaagatg

SEQ ID NO: 23933 - DNA, 3000 bp, Unknown; identical to SEQ ID NO: 2366
  misc_feature (1)..( 3000): 2750-1469P.txt file - cDNA_ID_2157537; gDNA_ID_1620526; Annot_ID_159586

SEQ ID NO: 23934 - DNA, 3003 bp, Unknown
  misc_feature (1)..( 3003): 2750-1469P.txt file - cDNA_ID_2157541; gDNA_ID_1620526; Annot_ID_159587
caactttcagaaactgtatttgagctttaattcagcatccgaagcgttgagaataccctcttagtgttcttttagcaagctcacagtgatatgtttaaaatctattttcgaaaaaaaaattgagcaatacactcaaatgaccttagaaaacaattatatacggtaagaaacacgtgtcatcaaatgcaagttctttgagagaaagaacaccaaaagacaaagagtacacacgcccatccttttgaggaaacatacgacgcattgagttatcaaaccagtgttaaacctgtttcataatcatgtccacgtacaaacgtacccgtttttatcagccgatgccaatggtttcccgatcccactccaagaacaacacagtataggagatgtttgctccttgagaatgctcactatattgcctttagatagcgaccatacatgaaccgaaccatctgcagatcccgcagccacataatcatcatctggacttatgcatgaccggctccaattcgatgctaatctgttccccgatgctctcagtgtcccacatatttccaaagtccgggtatcaaatacattatgcacgttgtctctcccgctcgtcaagatcctatttccgttccgggacaatgatactgaggtcacagcagaagaatgtccagctacttcggacagaagtttcccagtttgaatatcccataacctaagattcccatccatgtggcctgagaataccgtaagcccatctatgctgaggcagattgcattgcagttgctggtaaagagtactgtgttagtgcagtaacctttatgcaaatcccaaagttttatggtacggtcatatgctgcactgacaacatgtcggctagagaatttgctcacatccacagcacaaaccttatccgtgtggcctgtgagtgtatggcgtaccctacccgagctaacatcccatacaaacaaattatttgagctggttgctgcgatcacggatttattgtcgtgggttacggccatatcaagtatattcccaagggaaccgtataagcttttgattaaagttccgctattggtgtcccacatttttactgctcgatcttgcccaccagtaaacagagtaccagagttgtattcaaagactattgaaccacagccaccttcatgagcatggatacgattcgcacatgttgacggaatggttgactcaacaaagtgatcggttccatcttcattgcggcggacaataccatcaacttgctgccgagcaagagtttccaaaccatttgccttcagcttagctagcatttcttcatagagatcatttgcctacgtaagaagaaagaattaaggccatcctaaccaaatcgaagaaaggggacgaacaaactctaccattaaagactcatgaaaaataaaagtccctatgtacctcattaagacgttctgcatcctgcatcttctgcaacatccaccgatcaattaacattttattctcagtctctgctttttgcactctacttgtcatctcctccaactgagaccgtatttccaggttttcagcaataagtacatccaccgtcttggtcttttcctctaactcttcttgtaatcgtgtacaatcctccctacagaacaactctagttttaaatatcgcacaacataattccttacagtcactgtaaaaccattcttaccttctttgtgttaattccttctgcaagtcattaattaacaactccttctcttgtaaaatagcctttgaagttctggattcagctacttctatcaccagttgttcagatagtcgagattgagctttgtaacattgctgtaactctgtttccagcttttctgttttctccttccattctgaaccctgcatacagatactcaaaccagatcaagacatgtgtcaaatattccagagcataaaagtagaaagaaccaaatctacagagacgctgaaccaaaacaaaaggattcaatacaaactttgaggcatactatataattgaagcaagtataaacttaactaaactacatatacttttatacttctctgtgacacatgaactcacaaaatgcactgaacaaacatactgagagctacaattgtttttttttctgaaatccaatgaaacgcattacaagaatctacaaggattaaaagagcctttgttccatctaactacttattccatagtgcaaatctttcaatgtttactagcaatttgtatacttcgataacaaggtataaagttgaaactggtgaaatctgaagcaatgaagaaaggaacaaaacaagattacctgagagattaaaggcttagagagagcagaaatcgcaggagcatgagctccttcttccagaagatgacgcttccgcaaagctctcaaagcgtcatttattgcttccatagctttctcctcctgtaccctgaaagttccgacactcatcggaatcaaaatttcaacaatcgcaaaagcttatgcaacaagaaaaggagatcaaatcaagacttacatctctcgattcagatcaaaaagagtcgtgtagtgaggaattagggtttgcgtataacggaagactttgatcggaaccggtggcgacttgaattccaccgccgcttacgagttacgacccaaattagagaaattacaaaagctgcaagtgaattggggattttcccccacaaatttagtttattgaaaattgattataatcagtttttgtattaatgattgattaattagaatttaattgcaccgttttacctgaagttttgttagtagtagccggaaagcaatattattattgggcctataaaagcccatttacattgtgttctgttcctgcaaagtgcaaagagtagagatcacgtcatggtccacgtggcaaccaatgaatccaactctggagaatgaacacgaacacacaaacagaacaacagatcatcagagaagaaactagaattgacaaaattattaaaaagcgaaaaaagaaaatg

SEQ ID NO: 23935 - DNA, 3003 bp, Unknown
  misc_feature (1)..( 3003): 2750-1469P.txt file - cDNA_ID_2157549; gDNA_ID_1620526; Annot_ID_159589
ctacattggaattgtaagtgagaacatttctaatcataactcacaatattaacactcactgagctatcaaaatcaacgccttgttcgttcctcagccacgttcactttaattgctctgccttccaaattctgcaaacacagagagcaatgaataaaagaaatggtaaagtcacaagaagataaccataaacgcatggaggagtgatttcttttacctgtccatcaagagcagcaatggcaacgttaacttcattctcattcgacatttgaacaaacccaaacccacgtgaacgacctgtctctctatcagaaaccactcgggcatcaactactttcccatgctcgctaaataatcgttccaaacgaccactatccacatcccatggcaggttcccaacatagatcctaaacgcagcatcatatacacgaggttgtcgttcaggtcttgatcctcttggagctgctctgtttactgtcaaacgcctcccattcacttcctacagttgtataccaatcaacttcaacatctataatcactatccaaatgacccagaagattgagaaacaagaaaatgattgcttacaaaactattgaacttctcaacagctttctctgcttcttcaactgtactcattgttacaaacccaaatccacgactttgatcagtgtccctattgtatataacctgcaaaaaccagatttcaaagcagacccatgaaacataatcattcctttaagccaaataaactataaaaccagatttcaaagcagacccatgaaacacaatcattccttcaagacaaatcaaactatgaattcgaaacactaaactaactttctcaagaagtaacaatgccacagaaaaatttagttccaattttctcaaccatttggattcaaatgtcaaaaagcacaaattagcaatatatacctctgaaatctcaacagtaccagcttgttcaaagagcatagctaaagcttgactatcaacatcgtacggcaagtttccgacgaataatttagcctcttccggtggctccgggaatccaacaccgtcttcagactcgaaactctcatctacagtgactgaagtacctccgatgcttccatcctcaccttcttcttcctcagcccaattcgaagtttgggaaacgaaagtaacaacaggagatgagttacgaagagttttggatttgagagagagtgtgagattaacgggtcgtgaggataaggaaaaattgaagcggtgagattcagaggacgagatgttgaagatagaaggaatacaaaaaagggtcgaagaggaagaattcgtcatagctaaaagctttaagcttggggttagtactgaagaagtcatttttctgattttggagagattacaggtgaagaggaagaagagtgagataaaaataaaaaaatgttataatctgattagactaaagtttagtctaatatcttatataaacagtaatctattattgggccttacttgacccaataggcttttatatttccttattcacaccgacctactccaccaaaattaagactatatagtacacaaagagccgtttctagcaagatttctttcctcggccttatcgcgtcgaattcaagccggcgaacgaatacatttatttttctgaaacaagatggattatcggttacagattttagaagcaaacgcaattcatgacactgcatcctctttgtagtgatgtgatgtgcgtgttagctgtgtgtgtccgcgtttatcttttttttttttgttacttttctcctaacttagttgttattacgtgcttttcccaatatcaagttaaatcacacacacttcccaccaccttccttcattttctttccgaaatttagcattttagtcctcttttgacaaatagtatcttctttcttaaatttaagatctttctttagtctttagacaacagttattgtaatgtcttttagttgaatgacataagttaggccaaaataatttgagttcaattttcaaaagcgttgatgaaagctaaaaccaatgactaaaaatgacatctaatcggctcctgaaaaccataatcagatatcatatgacaaatactaaaccaaaatttttacctttcaaataaaataatatttgcagatagatttaaaatagtaaaggttattgaaaaaaaaatacaatagaaaaacataatattacctaatatttattacattttaaaagatatatagaaaaacaaaatcttagtttcgacgatggaatttttttttttatatagaacatcacataccaaataactttagttctcttattgtgaaaacaatggaagaaattgactttttaaaaataattttgaaattgatttctttgttcacataccaaacaacttcgttttattatcgtgaaaaaaagataacgtaaatggttagccacacatgcacggcttttccaaattatcataaggatccatatttgtaaaagaaaaaaatacataatccacataattaatcatagtgaggttacatgaataacagagttcctagctagtaaagataaattgttgcgtacaagttgtgctttgattaattatcactatacgtgcttcatataaaaatgtcattttacacttatatatattaagtcatctcatcgccgactatttcccaaaatcatcaattattgttaccaagaataagaaaagtaaaatgagagagcttgcttgcgccattaaatcaacataaagttcaattatagtttgaaatctttatgaatctccattaattaatgtatccatgtcactaaccttgaaatctttgttgaatcccacaagtaatcctttaaccccttttggtacttttcattacatatcgtcatcacaataacctctcaccaatgtatctataatccctatataaacactttctctttagtcctgattaccatcaacaaactcaatcacaatcacaagtaaatacaaaaatcaccatagaaaaatatg

SEQ ID NO: 23936 - DNA, 3003 bp, Unknown
  misc_feature (1)..( 3003): 2750-1469P.txt file - cDNA_ID_2157561; gDNA_ID_1620526; Annot_ID_159592
aaaaagttcgttatctcccccgaatccgttaatcccgacaaaaaatatgagatgatttaggagctgacgttgtcgtgtaggcgttcacccacctgtcagcttgcattcgactaaagtcagacatgttcaatagtgaacttgcattttgtttgttagtctttgatattatatggtctttgcttatcgttttgtatcttcactctcttgacatctctctttattaggctaggatttgaggttaaactttcattttctttgaatctttcactaactgggcttctctactgctacttacttatagatgggtttcaactttcaagttaaataccaaacctaattataactttaaagtttgtctcacgtcttttgctcttaaattgtgaattttgagcctttagcttcgctagaaagtggaagctgagccatgtccatggcgtcttcttctcttgcgacccaatcctttttttcttcctttcctctatctcaccgacttcacttccctgtaccttatcttcttcttcgttcttctttctttcgaaaaccacttagtctctctgctacttccccttcgtcatcttcttcttctccttccattttcctctcctgcttcgatgacgctttgccagataagatccaacaaccagaaaattcgacaatcaatagcgaagaaagtgaatgtgaagaagaagatgatgaagaaggagatgatttcacagacccaattcttaaattcttcaagtcacgaactttaacatcagaatcaactgcagacccagctcgagaatccaaattctccctccagaagaatcgtcgaacttcctggcatttagctccagacttcgctgaccccgaaactgaaatcgagtctaagcctgaggaatccgtctttgtgacaaaccaacaaacacttggtgtgcatattccattcgaaagtggcgtcgctagggaaatcttggaacttgctaagaatttgaaagagaatcaaactttgggagagatgttatcaggtttcgaaagaagggttagtgatacagagtgtgtagaggcattagtgatgatgggtgaatctggttttgtgaagagttgtctatatttctatgagtggatgagtttacaagaaccttcccttgcttcgcctcgtgcttgctctgtgttgtttacattgctcggtagagaaagaatggctgattacattctgcttctgctaagtaatttaccagataaggaagagtttagagatgttcgtctctacaatgccgccatttctggtctctcagcttctcaaaggtatcatctttttcctctttgcacgatgattcagttctaaagaatgaaaagttgtagtttttggtcaaattgtgtagttggtgatcttttgttaggtatgatgatgcttgggaagtgtatgaagctatggataagatcaatgtgtatccggacaatgttacatgtgctatattgatcacaaccttgaggaaagcaggacgaagtgcgaaagaagtttgggagatattcgagaagatgagtgagaaaggtgtgaagtggagtcaggatgttttcggtggccttgtgaagtcgttttgtgatgaagggcttaaagaagaagctcttgtgattcaaacagagatggagaagaaaggtatccgttcaaacacgattgtgtataatacgttgatggatgcttacaacaaatccaaccacatagaagaagtggaaggtctttttactgaaatgagagataaaggcttgaagccttcggctgcaacttataacattcttatggatgcttatgctagaaggatgcagcctgatatcgttgagacacttctgcgggagatggaggatttaggtttagagccaaatgtgaaatcgtacacgtgtttgattagtgcgtatgggaggacgaagaagatgagtgatatggctgctgatgctttcctgcggatgaagaaagtaggtttgaaaccttcttcacattcttacacagctcttattcatgcttactcggttagcgggtggcacgaaaaagcttatgcttcctttgaagagatgtgtaaggaggggattaaaccgtcggttgaaacatacacatcagttcttgatgcattcagacgatcaggcgacactggaaagctgatggaaatttggaaactaatgctgagagaaaaaatcaaagggacacggataacatataacactcttctcgatgggtttgccaagcaaggactctacattgaagcaagggatgttgtatctgagtttagtaaaatgggtttgcagccgagtgtcatgacttacaatatgctgatgaatgcatacgcacggggaggacaagatgcaaaactgccgcaactgttgaaggaaatggctgctcttaacttaaaacctgattccatcacatattcaacaatgatctacgcgtttgttcgtgttcgagacttcaaaagggcattcttttaccacaagatgatggttaaaagcgggcaagtaccagacccaaggtcctatgagaaacttagggcgattctggaagacaaggcaaagacaaagaacagaaaggataagactgccatacttggtataattaatagcaaattcggtcgggttaaagctaagacgaaggggaagaaagatgagttttggaagtacaagacgaatcgaactacttctcctggtcgtcaccgatcttgaaggtagcctaaaagctatataaatgctttagtggtacatagtgaggattctcaagctatacgaatctagttgtattcaatatatgttcctctgttctttgtacttatagccttatttattagcattctaattttttatgttcctaggacataccttggtcatgtgtagtaaaaagtgcaaaagtttagctttattattccgacaagcgaagtatctcttaagtagcaagcaatctttagatataactcttagctctctgcatcaaagatcacacacatcactctcttgtaaacaacccaaataaagaaaatg

SEQ ID NO: 23937 - DNA, 3000 bp, Unknown; identical to SEQ ID NO: 2375
  misc_feature (1)..( 3000): 2750-1469P.txt file - cDNA_ID_2157589; gDNA_ID_1620527; Annot_ID_159603

SEQ ID NO: 23938 - DNA, 3003 bp, Unknown
  misc_feature (1)..( 3003): 2750-1469P.txt file - cDNA_ID_2157614; gDNA_ID_1620527; Annot_ID_159609
agcaaaactttctcactttcaccagattctgtgataccgctactattcaagagcttgaacatatacgtctgtagaagaaattggagcaaaatcaaaacataaaccctaatggaaatcgaatcaaatgaatcaggggatttgaagcttttcattgtagaaatttgttaccttgggagatatatcatagacgttggagcatctcataccgattaatcgcttcaagcacttgacttcggcggcgacgtccgccgtgttcattcgtaccttcaccatatcttagtctctctcgaaatttcgtgattcagtgtcgaatcgaagaaaggttttaatctgtttgtcaaagttagaaattaaaattcggtctgtgctaagctgtgagaaaagaggaagaaggagaagagaaatttgtgagctattcatgtgtgttgggccgactagaagggcctataagcccaatataaaagacgatcattagttatctaaaccaatcaaaattacatgcttttttaaaaccggttagtctaatacactaattagagaagtttttaatttgtctcagtttgaatattgataattgataaataatccacatataacagttgtatgtattatttatgaacaataaaatctatgcagcaaaaataaagtaactaaaatattcaactcctattcaagaatcaaattgatagagtaagctgcaatttatggtgaaagtagttttaccataaggttttctcctaattattttaagaatatatttatttcccacaattggttaataaaattgtgaatgaatacattttttttgtctacaacttgtattattgggtttagactcgaaaatgacacattgataacatttgcacaaataactagatcatatgtttttgtcatattttgagcacaatttgtgcatatttcaagcaaattttgaacatatatcaaatccgtcataaccaattaatgttattattagtacttgttttcattataataatgacgtcataatcaatactgaacgtaccagcgaaatgatggtacatatcggctttaaaatagtattcaccaaatattgctggaggcttgtaatcttttttgctgaagacaagtcaattagggccatttccatttgactaaatctatttgtgcctaatggaaaaatagagatatatactttaagttgatgaagcttttcgtttgcttttatgttcctaatggcaacggtatcaactcgatgatttagactcttaaggaactttaccatatctttatggagaattaggaagtttgtggtgttggataaagggtagaagggaggaaccgcgaaaaagagtgttcttgtgaatggatacacacagaaatactatggattcgggtttttttcctgctcacaagatgaacagtgaatagaagtggtagagaatgtagatattagttctgttaaagctgaatgtgtacaaaacaatatggaaagttagataaataagatctttaggtcggaccaattgttagaagccaaaaataatctctaaactctctttattaaaactgagaaaatgatagcgtaacaagattagagtaaaactcctcaaagagaaactacgtcctcttctcctcggcctaattcgacagaatcctccaaaactctcaattgcttggatgcttttcaaaaacgagactacatccttatttataagtaaacgtaaacaagcattcaaagaaaataaggaaaaataaaaaattataggcaacttcctaaatctaaacagaaacgttgattgttttccaattcacagattgacttgttcttgattattctttttccacatacgtgaataaacaatccacggtttagacttctagaaacattcatatcagatacttcagttttttttttcactttttttttgttgttgtgcgaaatcagatacttaactatacgacatatgcaactatgcaaatctgaaatgtacttacagtttgttgtgaagacgaaaagcaagatcacgattatgattcttgaactgatcatcattcttttcttttcctctgcttataactaatggctcaagtttcttcattttggtttatgtgtattattttattaaattacgatagaagaaattaggaattaaagtctaactactagaatctgcaaaatcagatcatatattgttttcctaatttagttcaaggccaatctctactagagtctgcaatattagtgtgcaggaggggggaagtaatcatttaaaccagcaaacagtaaaacactgatgtgtcgtttttacaagaactggtaaaagaacatcctgttttgtccaaaacgaaaaagaccacccggttattgggactcttagttaaatgagaattccaaatatcaaattaatcaaccagtttggattaataaccggttttaatccaattattgggactgcttgtaaacctcataataaaactaatatgatcttttaaattaataggggttaaagagcgacggaaaatgctttggtcaatataaaattttcccggtttacgcaataacattatgcattgcttgcttgaaattcaaatcgttgatttgtggtgaagaacgatttcgaatatttgtttaaaactttttatttccaagaaaatttaggggagacagcttcatatcccaatttattgcttctactagtaactttccaaacccaaagttaaaaccattttaggattgatcaaaaaaaaaaaaccattttaggaatgcttttaaacctcatagcttcactcgctaatagacaaaatagtaataaaatgtctattgatttaaatacatttggaacaaaaatttgcaaatatttacataatttataaattaatttgtgaaaaagtgttcacgcaaaaaaaaaaaaaaaaacaataaaaaaactttgggtgggccttgtaacacaagacgccgccgataaaaggaaatctcacgatcgtatcatctccgaaacaaaaactcgtggaggagatatg

SEQ ID NO: 23939 - DNA, 3000 bp, Unknown; identical to SEQ ID NO: 2373
  misc_feature (1)..( 3000): 2750-1469P.txt file - cDNA_ID_2157618; gDNA_ID_1620527; Annot_ID_159610

SEQ ID NO: 23940 - DNA, 3000 bp, Unknown; identical to SEQ ID NO: 2372
  misc_feature (1)..( 3000): 2750-1469P.txt file - cDNA_ID_2157630; gDNA_ID_1620527; Annot_ID_159612

SEQ ID NO: 23941 - DNA, 3000 bp, Unknown; identical to SEQ ID NO: 2385
  misc_feature (1)..( 3000): 2750-1469P.txt file - cDNA_ID_2157664; gDNA_ID_1620528; Annot_ID_159628

SEQ ID NO: 23942 - DNA, 3000 bp, Unknown
  misc_feature (1)..( 3000): 2750-1469P.txt file - cDNA_ID_2157692; gDNA_ID_1620528; Annot_ID_159636
agaagagagaacctttagcttcctttcttccctagatgcctgatctagcattcctttgctggctctcaaagcaaccttcttcgcctgcgccagcttccatttcctctcagactcaaagtcctacaaaaacatcaacaattagcatagaaacgtcatgcatgcataacaattcttgcagaatgatccaaatagccacccttcaattacctttgacagccaagccatctcctccaatacatggtcccagtgagttttaggacgacgtggttctttaggagcttcgagcgtcttaaaagaaaaaaaaaaacagaaaccgttaacactttcaaatagtgatcagctcaaactagaatctaccgtaagaagatgaactcagacgtaaaaatgaaaacttggagctaaccttctgacgcttagctctggattcattatcaggtttagatttcccactcttggacgccattactatatcaggtttagatttaccacctttagacgccattactaacgcctttaagcaaaatcttccaagaagaagatggttagtgactgcagagtgcaaactgtgtgactgcacaaagcccaagaaattagggtttccacttcagcgcaaaaaaacccaagcaacgatttcatcactaggttcccgtcacccaaaacattacagtaatattcgattccaaatcttaaatctagctgaaatttgttttcctcaagaatcgaacgggaacaagattagtgttttttttcttctcaaatctcttcacttcattcttactaagatggtgtgatttgagatcgaagaaaactaaaaatgggagatacgaattggtaaaaaaaggaagaagctttggttttgagattttttttttttttaatctagaagagcctctgcttcagagagaaagaaacccgagctcgcggcgcaaacagatgtagaaaattccaactcgatacccttttttttttatttgtaaaaaaataaattatttttattaaattcctttaaaatatctaggattatataccaaattcggatttagataaaacttacgtattaatattcacccaaaaaaagaagctttcgtaattaattaaaaaaaaaaaaaaaaagtttttgtggttattaatatttggtaaataacgaaaacgctgactatcaatcgaagtcatatggtaacaaatattgtaattagtagaaagataatgaatttgtaatttggcactaaaaatagggagatatttaaagtaaagtttggttagtaggtgaagaggtccaagtaataagaagaagagacagacacgcgactggctccttttattttattttattttgtcttaaagcttttggcgagtttgcttgtgtgtgagtgtgtggttatggactctccgttcaaacctgatgtcgtcagaggtcaagtggctctcatcaccggtggtggatccggtatcggttttgagatctcttctcagtttggcaaacatggagcttctatcgctatcatgggacgacgaaaacaagtcctcgatgacgccgtctctgctcttcgatctcttggaatccaggtaatcagcgatttttgttttgaggactttgtttgttggatatgtgtttgaatctgtctgatttctgtttcgtttgaaggctattggattggaaggtgatgttcgtaagcaagaagatgcgagaagagttgtggaagcaacttttcagcattttggtaaacttgatattcttgttaacgccgctgctggcaattttctggctgctgctgaggatttgtctcctaatggcttcagaacaggttcctttttcgttttctcattaatttgatcatgatctgagaagaattatgcctgaaagtttgtcaatttagctcaaggaaacgtttttttgttgtgcatgtgcagtcttagacattgatgcggtaggaacattcaacatgtgtcacgcagctctcaagtatcttaagaaaggagcgcctggaagagactcatcaagcggtggaggttcgattattaacattagcgcgactttgcactacacggcttcttggtaccaaatacatgtctctgcagccaaggtaatttgattagtctgatagagtcattcaatgtcttgagttttggttagagaatcaagaactaagtaataggaacaaaagatgtagcaaaaatgtgatcttaggagtttgaaacttgaaacaggctgcagttgatgctaccacaagaaacttggcattggagtggggaactgactatgatattagagtgaacgggattgctccaggtcctattggaggtacacctggaatgagtaaacttgtacctgaggagattgaaaacaaaaccagagagtacatgcctctttataaagttggagagaagtgggatatcgctatggctgcactctacctcagctgtgattctggtatgctgagttaaataaagcacactctttaatataaaacatatatacatggttagatgatgtaactcattgcttgatttgtttaacagggaaatatgtgagcggactaacaatggtggtagatggaggactgtggcttagcaaacctcgccacttgcctaaagaagcggtgaagcaactctctcgtgcggtggagaagaggtctagggccaagcctgttggtctcccaaccagcaagctgtagatcatttgaatttcagatatcaaataagtgcacattgaaaaaatgttttggtttattgaattacattggagactgagaaaatggtattaagattatgtagatcaaactatcttatgcacaataaagtagctttctttgcaaaagaggcaaaacagtaacgaatatatgatcaaaaagataatcgcttttgaacctctcatcagtgataagagagaaatattccaaactcataaaatctcaaatggctaataaataagaacattgtgagtcactctctctgtttctcatctcctcatctttttatcttctttgattgatccacatg

SEQ ID NO: 23943 - DNA, 3003 bp, Unknown
  misc_feature (1)..( 3003): 2750-1469P.txt file - cDNA_ID_2157699; gDNA_ID_1620528; Annot_ID_159638
ggccttccctgaaagatcaaagtgttcaactttagttcaggtgatggaggaatcaaacgtaaggagtgtgtgggaataatattaccagatgagtggagaggataactttagcaccattttcaatcaaatacttgatcgttggaatggcggcacggattctggtatcgtcagtgatagtctgattatcatcgagaggtacattgagatcagctctcacgaaaaccttcttccccttcaaatcagctgaggtcagatctccgacgctcttcttcgccatagaaaccactcctctgcttcccttcccacgcaccgattcaactttggaagcaacgtggagagagaaacgacgggaatctagagtggcggagaagcctagaggacgcgcggaaacagaggtagagggaattggcagaagggaggcacgtgcgcgagttccggcggaggaagcaacagcgccggtggacttaaggagtgaaaaggcggaacttgcggcagcggaagccatgtggatcaatcaaagaagataaaaagatgaggagatgagaaacagagagagtgactcacaatgttcttatttattagccatttgagattttatgagtttggaatatttctctcttatcactgatgagaggttcaaaagcgattatctttttgatcatatattcgttactgttttgcctcttttgcaaagaaagctactttattgtgcataagatagtttgatctacataatcttaataccattttctcagtctccaatgtaattcaataaaccaaaacattttttcaatgtgcacttatttgatatctgaaattcaaatgatctacagcttgctggttgggagaccaacaggcttggccctagacctcttctccaccgcacgagagagttgcttcaccgcttctttaggcaagtggcgaggtttgctaagccacagtcctccatctaccaccattgttagtccgctcacatatttccctgttaaacaaatcaagcaatgagttacatcatctaaccatgtatatatgttttatattaaagagtgtgctttatttaactcagcataccagaatcacagctgaggtagagtgcagccatagcgatatcccacttctctccaactttataaagaggcatgtactctctggttttgttttcaatctcctcaggtacaagtttactcattccaggtgtacctccaataggacctggagcaatcccgttcactctaatatcatagtcagttccccactccaatgccaagtttcttgtggtagcatcaactgcagcctgtttcaagtttcaaactcctaagatcacatttttgctacatcttttgttcctattacttagttcttgattctctaaccaaaactcaagacattgaatgactctatcagactaatcaaattaccttggctgcagagacatgtatttggtaccaagaagccgtgtagtgcaaagtcgcgctaatgttaataatcgaacctccaccgcttgatgagtctcttccaggcgctcctttcttaagatacttgagagctgcgtgacacatgttgaatgttcctaccgcatcaatgtctaagactgcacatgcacaacaaaaaaacgtttccttgagctaaattgacaaactttcaggcataattcttctcagatcatgatcaaattaatgagaaaacgaaaaaggaacctgttctgaagccattaggagacaaatcctcagcagcagccagaaaattgccagcagcggcgttaacaagaatatcaagtttaccaaaatgctgaaaagttgcttccacaactcttctcgcatcttcttgcttacgaacatcaccttccaatccaatagccttcaaacgaaacagaaatcagacagattcaaacacatatccaacaaacaaagtcctcaaaacaaaaatcgctgattacctggattccaagagatcgaagagcagagacggcgtcatcgaggacttgttttcgtcgtcccatgatagcgatagaagctccatgtttgccaaactgagaagagatctcaaaaccgataccggatccaccaccggtgatgagagccacttgacctctgacgacatcaggtttgaacggagagtccataaccacacactcacacacaagcaaactcgccaaaagctttaagacaaaataaaataaaataaaaggagccagtcgcgtgtctgtctcttcttcttattacttggacctcttcacctactaaccaaactttactttaaatatctccctatttttagtgccaaattacaaattcattatctttctactaattacaatatttgttaccatatgacttcgattgatagtcagcgttttcgttatttaccaaatattaataaccacaaaaactttttttttttttttttaattaattacgaaagcttctttttttgggtgaatattaatacgtaagttttatctaaatccgaatttggtatataatcctagatattttaaaggaatttaataaaaataatttatttttttacaaataaaaaaaaaagggtatcgagttggaattttctacatctgtttgcgccgcgagctcgggtttctttctctctgaagcagaggctcttctagattaaaaaaaaaaaaaatctcaaaaccaaagcttcttcctttttttaccaattcgtatctcccatttttagttttcttcgatctcaaatcacaccatcttagtaagaatgaagtgaagagatttgagaagaaaaaaaacactaatcttgttcccgttcgattcttgaggaaaacaaatttcagctagatttaagatttggaatcgaatattactgtaatgttttgggtgacgggaacctagtgatgaaatcgttgcttgggtttttttgcgctgaagtggaaaccctaatttcttgggctttgtgcagtcacacagtttgcactctgcagtcactaaccatcttcttcttggaagattttgcttaaaggcgttagtaatg

SEQ ID NO: 23944 - DNA, 3000 bp, Unknown; identical to SEQ ID NO: 2389
  misc_feature (1)..( 3000): 2750-1469P.txt file - cDNA_ID_2157796; gDNA_ID_1620529; Annot_ID_159673

SEQ ID NO: 23945 - DNA, 3003 bp, Unknown; identical to SEQ ID NO: 18935
  misc_feature (1)..( 3003): 2750-1469P.txt file - cDNA_ID_2158031; gDNA_ID_1971919; Annot_ID_177179

SEQ ID NO: 23946 - DNA, 3003 bp, Unknown; identical to SEQ ID NO: 18935
  misc_feature (1)..( 3003): 2750-1469P.txt file - cDNA_ID_2158031; gDNA_ID_2926265; Annot_ID_204910

SEQ ID NO: 23947 - DNA, 3003 bp, Unknown; identical to SEQ ID NO: 18933
  misc_feature (1)..( 3003): 2750-1469P.txt file - cDNA_ID_2158039; gDNA_ID_2926147; Annot_ID_197822

SEQ ID NO: 23948 - DNA, 3003 bp, Unknown; identical to SEQ ID NO: 18933
  misc_feature (1)..( 3003): 2750-1469P.txt file - cDNA_ID_2158039; gDNA_ID_1620633; Annot_ID_162762

SEQ ID NO: 23949 - DNA, 3000 bp, Unknown; identical to SEQ ID NO: 2424
  misc_feature (1)..( 3000): 2750-1469P.txt file - cDNA_ID_2158115; gDNA_ID_1620533; Annot_ID_159791

SEQ ID NO: 23950 - DNA, 3000 bp, Unknown
  misc_feature (1)..( 3000): 2750-1469P.txt file - cDNA_ID_2158118; gDNA_ID_1620533; Annot_ID_159792
tgccattgaactttaaaaccgtcacataaagtgtgctttgggttatctcatatctttttcttttttttttgataaaaaaatgtgccttagttcttgcgtgctatatacttcatctcgttgatatccaaatctgtcccatgcaatcaaatttacttcatctcgtaaaatccaaatgatttgaatttttagtaaatttttatatgattttgattattttaggaaagttaatataatttgttgtaaaatttttaaattttatttaaaaccatcaaatttagatttctttattttaagtaaaaaatcttctcaaatcctctcaaatccttcaaaattaagaaaaatcgaatccataagctgtttttaataacagtagaatcagtcaatgttccttgaagacatgatatctatttgatttgctacattctctaggctattcatggcgcataagcgcgtttgccattcaagttgttgttgcactatagaatttatgaagtgcaaccgttaaaacttgaagaaaaaagtgtacgttatacatctgtgaataaaactacaaaacaggcagccggtggcgaaataattaagcccatacgtgcatagtcaaccgatgttcgaagggtgtgtcttaatcctctggggatccttacatttgatggaggctatagaaaacacattcacacatgaaatttatgtactctctagaaggaaaaatgtgcgatggatatacaaaatctgcagtgcacagatcataaacagagttggttctttggacttccatcattgtcgctgtccgggtgggaggcaagttgacacttccatgttgagaagcaaagcaaagaaaagtgagttcgaactttaatggtgtttttgggctgaaagaaaactaactttgttgggctggaatttggcaatgactgacctgattgaacggcgtttcattttggacatttattttgtagttggaacttctaaaaagtgagttcttaattttgggtaattttttcttctaacacgtacgtcttattcaagtttggatcttttcgatcacatgttaatattcaataaaaagttttaaagtataatctcaaaaccatctattaaaaataaattaatttttatgtttaaattactttttaaggataatatatagttgttttctttttaaaggtttttgttttatatttactctaagcttggtttatgcatatttttaagtcaatattctctctaacaatatacggatttgacgacactcttaatcgatcagtgaaacatgtggaccaacttagaatataggctaaggatgacaggtccaaattatagcgtgtataacttttctgctagatgatttcataaacttctaagtttagatatcttttagataacagtctacagacggacagatcgtctccatatataaattttcccaatgtcttgtaatcattaaagcttaatgctttatccttagaaattgttcttttgctccacaccaagtcaataacgtgacaatttagcttatcactttcccaactttaatcggtgtaacgagatcacacttatctttttaataagaatcatattgtaagactatagaatttcaaaactaattggataatattaaaataaagaatatgtttggtacaaaataagtttataattttaaggatcattttataaataaaaaatttaacttttaaaatatgaagatgtgattaatattccttcaattaaaaataaaacactatttaattttattttatttttgaaaatgaaaatgaagcatattgaaaagaaacaattcattttatttttttgaaacaattcatttttatctttaaaatgaaagaaaatatgaaatttgaagcaccattagtaagtaaaaaaatgttaacattcaacatggcatgcttctttccctctttgtcttatgctgagtagggaaacgtcaatccgaatttttttgttaaatccaaatatagcattccaagcctactacgtcagaagttctgaatgttcaataaatcattgatttcacacacacacacaaaaacaaaaacaaaaaacaaaagaattcaagatcatggtaaaggttaagtcattagcaaaaaaaaaaaaaaaaaaaaaaaaaaaatagaggtttagttttcatcttcatatttgtacctcaacatgtgccattcaggcttgcctcaaagaaaagtcagggtcactgtctaacttatagaaaaattcaaattatcatctatatattcatatttttgaactttggctcaaatatctcaacaatttcaagaaatgtaaaatctcaaaaaaaaaaaaaaaaagagttaaaaatgggtcaggtatcagagcatctccaactctctagttaagagattctcacataaagaaaaaattgaaaacaatattatttaatttaaaaatggtgaaaaccccatggcacgtgtatttttaaactggtttctatttaatttttcaattctaaaattttattacctatataccaatttaaattaaatattcttctttttattttcttataatcatgaaataaaattatctttatattagactccattatgtataattcaaattatatattaacattattttaattgatattaattaaagtaagtgcaaaatattaaactaatattgttttaattgttatttgatatctttaaaagctaaaagtaactaacacaatacattgatgaatatatttatatttaaaatgtaattgaatatatattttaaaaaattaatgaaagtttttgcataaaaataatattaaactatttatatcatattgatgagatattttgatgattgaagtactatatccgaaaattcaatgattgaagtactatatccgaaaattcaaaattgtatggatactactagtctactagatctcggttgccgtgttgaactattaatggaaagaaaaacagagcaatattatttttcacttctatcgataaccaaacgaaaaaaaacatg

SEQ ID NO: 23951 - DNA, 3000 bp, Unknown; identical to SEQ ID NO: 2421
  misc_feature (1)..( 3000): 2750-1469P.txt file - cDNA_ID_2158136; gDNA_ID_1620533; Annot_ID_159798

SEQ ID NO: 23952 - DNA, 3000 bp, Unknown; identical to SEQ ID NO: 3384
  misc_feature (1)..( 3000): 2750-1469P.txt file - cDNA_ID_2158274; gDNA_ID_1620644; Annot_ID_163147

SEQ ID NO: 23953 - DNA, 3000 bp, Unknown; identical to SEQ ID NO: 3384
  misc_feature (1)..( 3000): 2750-1469P.txt file - cDNA_ID_2158274; gDNA_ID_2926217; Annot_ID_203045

SEQ ID NO: 23954 - DNA, 3000 bp, Unknown; identical to SEQ ID NO: 3391
  misc_feature (1)..( 3000): 2750-1469P.txt file - cDNA_ID_2158280; gDNA_ID_2926217; Annot_ID_203048

SEQ ID NO: 23955 - DNA, 3000 bp, Unknown
  misc_feature (1)..( 3000): 2750-1469P.txt file - cDNA_ID_2158305; gDNA_ID_1620644; Annot_ID_47565
tgcaaaagtcgctgactttggtctttctaaagatgtagcttttggacaaaaccatgtcagcacggccgtgaaaggaagtttcgggtacttagacccggagtactttagaagacaacaacttaccgacaaatccgatgtttattcctttggtgtcgttcttctagaagctctgtgcgcaagaccagccatcaatcctcagctaccaagagagcaggttaacttagctgaatgggcgatgcaatggaaacgaaaaggacttcttgaaaagatcattgatcctcatttggctggaacgattaatcctgaatcgatgaagaagtttgctgaagctgcagagaagtgtttagaagactacggtgtcgataggccaacaatgggagatgttctgtggaacttggagtatgctcttcagcttcaagaggcattcactcagggcaaagcagaagagaccgagaacgctaagcctgatgtggtgacacctggctcggtgcctgtgtctgatccatctccgatcactccctcagtcaccaccaacgaagcggctactgttccggttcctgctaaggtggaagagaacagtggcacggccgtggatgaacactctggaacagccatgtttactcagtttgctaaccttaacggaagataaaaacaaactaacagataaataattaaaaaaggacataaagaatgcaccaaaccgaatttgtcgttataaacagtaattgcaatagaaaaaacttgactttttaaggtgatatatttgtttctttgtatgtttttttggtggtggtcggggagatgtgtgtgatatttctatattttggtgtattttataaaatttatatattttttgtatgaagtgtaattttgtgggtggatatgtatatgtatgtatgtgtacttctaaatgctctgctgcatttactttacttatcctccttcattgtagttgttaatattagcttacaaatacaaattcacattgaaacataagtgtgtgtgaatcttacttgaaatttacatcattttgtacacacaggaaacaaaaagttctctttttgtattctaagaaagttggttttacagtctggactctgagcatctgtttcagagtagaccagaaaagatctgtttcagagtaaaaaaatttttatcatctggttttgcaaatgaatctcttctctaagaaagtacctaaacattaactggggaataatgtgttcgttctcccatagtctttggaaaaaaagggtaacctattctcgtactttgttgtctagtgtaaactctagttaaagctgtcacatttgaacctgaattagtaatattaaggaaaaggaactcaatggtttgtgtgttgttatatattggattcaagctttgattcattgaatggaattttagtgtttggtttacgacctctgttagttaataatcatagacaccatttccttctttagatgggttagtttggttctaatcagggaaagccattaatttttccatctaatcattgtagaaaccttgcaatattgtgtatatgtaaacatacacaatcgtaaatgtttggatatcaaactcttcacaagtgtttgtaggagaggaagtataggtgagaaaagattagggtcagtcacagattctgcaaaaagtaagagaaccatgaaagtaaaataaaacataaacccagaaatagaaaccattcccttcaattaagcaaatgagttctctttccttttctcttcttatgtgtatatatagaaatgaatagcttaaattttcccacaaaagccaaagagacccaaattattgttttattttgtttttgttacctcgcttatatctattatcatggaaaacataagtgggttggcttttgatatgggagagctaagaaacaaccttcccaaaaagtaaaatcctgaaaaaggatttcattgattatgattgtttgtttaagttatggaaatccggattactatctaattttggattttgtgaatggttgtaaaataggagaggattatcaaggtactattcaggaaaagcgagatcattcatatgtatctcagatgtaaaatgccttgaggatctgaagaaaccaacccaaacttttgatgacgatgatgatgatgaggcttacaagaagaggaagaagaagaacaagcaatcatcttcatcttcattttctgcagctattaacagcaatgtgaatttctcaaactacccttgtcgaagggtctctagtagcacccactgttcctcaccttgtgttgcttaggaaaaaagaagcttacactttctcaatttatttagtagctcctttggtttttattctcaacccaacactgaaaacacaaacttcagttcagtgtgtgggggcgtcattcatatccaatttttgattttctttactgtttttatgtcttttttttgtggttatctttttttcttgcgcaaattatgtagatttggatgtgtttgttccaatttgcttattgggacaaaaatgttggaaatcctttcgaatgtaatcatacgtacgcatagaattgaataataagtgaataaatatagaattgaaaggttcttaaaatattccttagcatttcctatttatctgaaaacatgcaacacacaaagacaaagtcaggacaagtcataatgagtaattgcttacgtggctaattttacatgattcacgacaaaagggagcggcctagaggcgcgtatcacacacgcgcttccacttaaaagctgacgtggtcaattggctatctgacattctatttacccattttctccctttctttcctctatattcacgatcctgccattgtacacccaatcatacgctcctgagatcctcatgacttgttcttaccgtactccgcgagacatgcgattgatgattcttgactgtattcattgagaaaaactgttcgcaaaaaccttgagcttcatcatcgtccattactcacctttcagtttcagatg

SEQ ID NO: 23956 - DNA, 3000 bp, Unknown
  misc_feature (1)..( 3000): 2750-1469P.txt file - cDNA_ID_2158305; gDNA_ID_2926217; Annot_ID_142280
gcaaaagtcgctgactttggtctttctaaagatgtagcttttggacaaaaccatgtcagcacggccgtgaaaggaagtttcgggtacttagacccggagtactttagaagacaacaacttaccgacaaatccgatgtttattcctttggtgtcgttcttctagaagctctgtgcgcaagaccagccatcaatcctcagctaccaagagagcaggttaacttagctgaatgggcgatgcaatggaaacgaaaaggacttcttgaaaagatcattgatcctcatttggctggaacgattaatcctgaatcgatgaagaagtttgctgaagctgcagagaagtgtttagaagactacggtgtcgataggccaacaatgggagatgttctgtggaacttggagtatgctcttcagcttcaagaggcattcactcagggcaaagcagaagagaccgagaacgctaagcctgatgtggtgacacctggctcggtgcctgtgtctgatccatctccgatcactccctcagtcaccaccaacgaagcggctactgttccggttcctgctaaggtggaagagaacagtggcacggccgtggatgaacactctggaacagccatgtttactcagtttgctaaccttaacggaagataaaaacaaactaacagataaataattaaaaaaggacataaagaatgcaccaaaccgaatttgtcgttataaacagtaattgcaatagaaaaaacttgactttttaaggtgatatatttgtttctttgtatgtttttttggtggtggtcggggagatgtgtgtgatatttctatattttggtgtattttataaaatttatatattttttgtatgaagtgtaattttgtgggtggatatgtatatgtatgtatgtgtacttctaaatgctctgctgcatttactttacttatcctccttcattgtagttgttaatattagcttacaaatacaaattcacattgaaacataagtgtgtgtgaatcttacttgaaatttacatcattttgtacacacaggaaacaaaaagttctctttttgtattctaagaaagttggttttacagtctggactctgagcatctgtttcagagtagaccagaaaagatctgtttcagagtaaaaaaatttttatcatctggttttgcaaatgaatctcttctctaagaaagtacctaaacattaactggggaataatgtgttcgttctcccatagtctttggaaaaaaagggtaacctattctcgtactttgttgtctagtgtaaactctagttaaagctgtcacatttgaacctgaattagtaatattaaggaaaaggaactcaatggtttgtgtgttgttatatattggattcaagctttgattcattgaatggaattttagtgtttggtttacgacctctgttagttaataatcatagacaccatttccttctttagatgggttagtttggttctaatcagggaaagccattaatttttccatctaatcattgtagaaaccttgcaatattgtgtatatgtaaacatacacaatcgtaaatgtttggatatcaaactcttcacaagtgtttgtaggagaggaagtataggtgagaaaagattagggtcagtcacagattctgcaaaaagtaagagaaccatgaaagtaaaataaaacataaacccagaaatagaaaccattcccttcaattaagcaaatgagttctctttccttttctcttcttatgtgtatatatagaaatgaatagcttaaattttcccacaaaagccaaagagacccaaattattgttttattttgtttttgttacctcgcttatatctattatcatggaaaacataagtgggttggcttttgatatgggagagctaagaaacaaccttcccaaaaagtaaaatcctgaaaaaggatttcattgattatgattgtttgtttaagttatggaaatccggattactatctaattttggattttgtgaatggttgtaaaataggagaggattatcaaggtactattcaggaaaagcgagatcattcatatgtatctcagatgtaaaatgccttgaggatctgaagaaaccaacccaaacttttgatgacgatgatgatgatgaggcttacaagaagaggaagaagaagaacaagcaatcatcttcatcttcattttctgcagctattaacagcaatgtgaatttctcaaactacccttgtcgaagggtctctagtagcacccactgttcctcaccttgtgttgcttaggaaaaaagaagcttacactttctcaatttatttagtagctcctttggtttttattctcaacccaacactgaaaacacaaacttcagttcagtgtgtgggggcgtcattcatatccaatttttgattttctttactgtttttatgtcttttttttgtggttatctttttttcttgcgcaaattatgtagatttggatgtgtttgttccaatttgcttattgggacaaaaatgttggaaatcctttcgaatgtaatcatacgtacgcatagaattgaataataagtgaataaatatagaattgaaaggttcttaaaatattccttagcatttcctatttatctgaaaacatgcaacacacaaagacaaagtcaggacaagtcataatgagtaattgcttacgtggctaattttacatgattcacgacaaaagggagcggcctagaggcgcgtatcacacacgcgcttccacttaaaagctgacgtggtcaattggctatctgacattctatttacccattttctccctttctttcctctatattcacgatcctgccattgtacacccaatcatacgctcctgagatcctcatgacttgttcttaccgtactccgcgagacatgcgattgatgattcttgactgtattcattgagaaaaactgttcgcaaaaaccttgagcttcatcatcgtccattactcacctttcagtttcagaatg

SEQ ID NO: 23957 - DNA, 3003 bp, Unknown; identical to SEQ ID NO: 19269
  misc_feature (1)..( 3003): 2750-1469P.txt file - cDNA_ID_2158341; gDNA_ID_1620648; Annot_ID_163361

SEQ ID NO: 23958 - DNA, 3003 bp, Unknown; identical to SEQ ID NO: 19223
  misc_feature (1)..( 3003): 2750-1469P.txt file - cDNA_ID_2158384; gDNA_ID_1620652; Annot_ID_163505

SEQ ID NO: 23959 - DNA, 3003 bp, Unknown
  misc_feature (1)..( 3003): 2750-1469P.txt file - cDNA_ID_2158388; gDNA_ID_1620649; Annot_ID_47686
gaaaggattagttatagtttagttagatgtcatcatcgtggatacaaaatactattcaatagacattttcattcttaaccaaatggatcacatacataatcagcttctgtaatgtcagattgtcagtttcttcaatgaactagaatttccaacaatccaaattccaaagtaatttaaaatgtaaaagatgtcattggtaaaatgggtttataatccaggaaactttgagcccaaaaaaggcccatagatcatcgaaggcctttgatatctgcgacggcgagatcagcttcgtcttcctccaacgctcgatttagggaggatggtggtttctccggggctgctctcaactgtttcaggtcactattcgctccggttgcttcttctatatactttcccactgctttttgatattgtccttagtaatcatctagcttcgattttggttcataggcgtaatccgattggctccgtcacaccggattctaagacgcgatgggttcggacccatttgcttcaagttttctggggatttggtaatttacctttctttctattgcggcttaacagcttaagaagcttttcacttaagctctgtttgagtgtgtagagtatcaatgggagagtcagtcataaacatgtgcgtggaagtggcacggtgggatctgtaggttccgctcgtgaaagttggagctctcataagaagcttcccgaagaagagcccttatggctgagtcttcttagagacatggtctggtatgaaattctcccactgagtctagcttttaatatatatatctgctggaagagtctgaatgttgcattatattgaattgcatttttcttgtgagaaggagcacgagatctctcttgtctttcatggctgagcaaccaagtcagctgaaatacatagagtggccaacttttgcaagcacggtatgtcttgttgttgttgttacaacatatgagaaagaaagagatagtttgtgggtgtaactttgtttttttttgttttggtaacaaacagctaaagactgctacactgagtctgtgtctggtagctgtattcattgttgcgctatcatcggtggatgctgctctttgttacatattggcgttgatcttgaggaaagccccatgaggaaggcaactccattatcatttgtctcttgtagccttattgataggtgaatgtttttgatgtagatagaatgcaggaggatgtactcaaaatcaatgtgtttctaaaagttgaattgaaatgaaacctctctggtctagtatctctcacacattaagggaaatccaatcatatatgtcccaagcaaatcacaccataaataataaggaaggattcaacatgttgttggtttacaagtaagagaataagatgatgctaggtgctacttgagaacaacagcagcattgcgaatggagagatactggtggacttggtcggaagaaagtgatctcacagtctggaaaacatgagcattagcatagcggaggtttgttcttgggtccacataaggtgcctgcgagggattagagaagctcattgagttttgttgtttttgggtagtgaataaatttgtagaaaagaatcgatcactcaaaaacagaataaaacctcatatccagtaatatcgcaaagtctcttgcatggttgagtggaaggaggcgattcaatgttaacatctgcgaggcacaaagaagatttgatttttgattcaaacagagtcaaaaatccattcaaaatcagaaatcagagagagagaaaagagttacaagtggggaggtcgggaggaagatctgggaagttctcagcttgaagaatctgcttgaggtgtttccaccttctgctgcttgattgtgcttttgggtacttttcgtaggcttgcttcttcttaaagctcaatcgcgacgccaccactatatctgcctccatcaactctctctccatctctctctctctctctggaaaaaaaaaccttattaattccgacgaggagaacgacgacgacgaaggcttctttcttatacggtgtcctcttaaaaatcaaaccggtccggtacggtagtggaatgaacaatttagtaaaccgatagcagtgtttacattggaaaccgaattgaatgaagtgaagctgtttctttctagatcccccaaagcgagttcatcatcttcttcgcctggattcgatcaagactagcactttcatcagatttgattacaatctctcttatcttccaagttataatcataatatccgagcaatttgggatctgggtctttcctctacattcaatttcttaataaagctggcctctttcttccgagatggttcttgagcgatgatgagtgactctcagcgatcactttctgtgcgattgagccgccggggtgagagaagcaatcattactcacaatctaaaggtctcaacccaactctttttgaactaatgatcatcactttcttttaggtatagtggtttacacatgaaaatttgaagatgacccccgttatagtgttttgtttccactatagaagaatctaatgcgtaatgaatgattatgtcttcgtaatgaatccctaatggattctattactttgtctccaatgatgcagatgctgtggctggcttcttctctcccaccagattgcatgctgattacactttgaaaaaaatttggaaggcaggcttccttcgcttgcttcttgttggcggcattgtctggatgctactcattctatttgccctcttgtttcatgtttggtcctgtcaatcttccctttctttcttctcaggtttcctccaacttctttacacttgccattcttcactaaatctatcatttgtcatacactcaatagaagatgttgttattgtactagttactccaaccatcttctgcattcaccgcagattctatcacagtaacctcatgttctttgtaatttcgttgcagctatttgcaacaaagaaggcagactctatgtcatg

SEQ ID NO: 23960 - DNA, 3003 bp, Unknown
  misc_feature (1)..( 3003): 2750-1469P.txt file - cDNA_ID_2158388; gDNA_ID_1620649; Annot_ID_163390
ctggaggaagaaagacggagagcttctccgtgccatggaagcagacagacatgttgtcaattgtatagagtctcatcctcacatgccactgatgtgtagcagtggaatagatactgatatcaaaatatggactcctggaggaaccgagaaacctctgtcgccaggaaatgcgaaacaggtaatgccacatctattgctaacctcgtttgcttcttttatttttggtgtttgaagactcggaggatatgctttagttaacaagaatgtaactttggatacaatacatgtgactggaggctgaatttggttttggaaggcaaactaaatgtttgtatgtttgcttcttggaaacaggcttcgggttttggtaacccacgatggttcgacggatattatgtggatgacgatgatgattctgacgatgaatctagtgaagagagttcagatgatgatgatagttcggaagaggaggagaatggtgaagttgatgttgagattacgaaggatgatgataatgatcatggggatgatgatgatgatgatgatgaggatgatgatggggatggggatggggatgagggatgagatttgtatagacatgtatttatctaaacacaaaataaaacagcatatggtaacagtaccaaagaaaggattagttatagtttagttagatgtcatcatcgtggatacaaaatactattcaatagacattttcattcttaaccaaatggatcacatacataatcagcttctgtaatgtcagattgtcagtttcttcaatgaactagaatttccaacaatccaaattccaaagtaatttaaaatgtaaaagatgtcattggtaaaatgggtttataatccaggaaactttgagcccaaaaaaggcccatagatcatcgaaggcctttgatatctgcgacggcgagatcagcttcgtcttcctccaacgctcgatttagggaggatggtggtttctccggggctgctctcaactgtttcaggtcactattcgctccggttgcttcttctatatactttcccactgctttttgatattgtccttagtaatcatctagcttcgattttggttcataggcgtaatccgattggctccgtcacaccggattctaagacgcgatgggttcggacccatttgcttcaagttttctggggatttggtaatttacctttctttctattgcggcttaacagcttaagaagcttttcacttaagctctgtttgagtgtgtagagtatcaatgggagagtcagtcataaacatgtgcgtggaagtggcacggtgggatctgtaggttccgctcgtgaaagttggagctctcataagaagcttcccgaagaagagcccttatggctgagtcttcttagagacatggtctggtatgaaattctcccactgagtctagcttttaatatatatatctgctggaagagtctgaatgttgcattatattgaattgcatttttcttgtgagaaggagcacgagatctctcttgtctttcatggctgagcaaccaagtcagctgaaatacatagagtggccaacttttgcaagcacggtatgtcttgttgttgttgttacaacatatgagaaagaaagagatagtttgtgggtgtaactttgtttttttttgttttggtaacaaacagctaaagactgctacactgagtctgtgtctggtagctgtattcattgttgcgctatcatcggtggatgctgctctttgttacatattggcgttgatcttgaggaaagccccatgaggaaggcaactccattatcatttgtctcttgtagccttattgataggtgaatgtttttgatgtagatagaatgcaggaggatgtactcaaaatcaatgtgtttctaaaagttgaattgaaatgaaacctctctggtctagtatctctcacacattaagggaaatccaatcatatatgtcccaagcaaatcacaccataaataataaggaaggattcaacatgttgttggtttacaagtaagagaataagatgatgctaggtgctacttgagaacaacagcagcattgcgaatggagagatactggtggacttggtcggaagaaagtgatctcacagtctggaaaacatgagcattagcatagcggaggtttgttcttgggtccacataaggtgcctgcgagggattagagaagctcattgagttttgttgtttttgggtagtgaataaatttgtagaaaagaatcgatcactcaaaaacagaataaaacctcatatccagtaatatcgcaaagtctcttgcatggttgagtggaaggaggcgattcaatgttaacatctgcgaggcacaaagaagatttgatttttgattcaaacagagtcaaaaatccattcaaaatcagaaatcagagagagagaaaagagttacaagtggggaggtcgggaggaagatctgggaagttctcagcttgaagaatctgcttgaggtgtttccaccttctgctgcttgattgtgcttttgggtacttttcgtaggcttgcttcttcttaaagctcaatcgcgacgccaccactatatctgcctccatcaactctctctccatctctctctctctctctggaaaaaaaaaccttattaattccgacgaggagaacgacgacgacgaaggcttctttcttatacggtgtcctcttaaaaatcaaaccggtccggtacggtagtggaatgaacaatttagtaaaccgatagcagtgtttacattggaaaccgaattgaatgaagtgaagctgtttctttctagatcccccaaagcgagttcatcatcttcttcgcctggattcgatcaagactagcactttcatcagatttgattacaatctctcttatcttccaagttataatcataatatccgagcaatttgggatctgggtctttcctctacattcaatttcttaataaagctggcctctttcttccgagatggttcttgagcgatg

SEQ ID NO: 23961 - DNA, 3003 bp, Unknown; identical to SEQ ID NO: 23960
  misc_feature (1)..( 3003): 2750-1469P.txt file - cDNA_ID_2158388; gDNA_ID_1620652; Annot_ID_163508

SEQ ID NO: 23962 - DNA, 3003 bp, Unknown; identical to SEQ ID NO: 23959
  misc_feature (1)..( 3003): 2750-1469P.txt file - cDNA_ID_2158388; gDNA_ID_2926215; Annot_ID_142189

SEQ ID NO: 23963 - DNA, 3003 bp, Unknown; identical to SEQ ID NO: 23960
  misc_feature (1)..( 3003): 2750-1469P.txt file - cDNA_ID_2158388; gDNA_ID_2926215; Annot_ID_202928

SEQ ID NO: 23964 - DNA, 3000 bp, Unknown; identical to SEQ ID NO: 3520
  misc_feature (1)..( 3000): 2750-1469P.txt file - cDNA_ID_2158392; gDNA_ID_1620652; Annot_ID_163509

SEQ ID NO: 23965 - DNA, 3000 bp, Unknown; identical to SEQ ID NO: 4731
  misc_feature (1)..( 3000): 2750-1469P.txt file - cDNA_ID_2158468; gDNA_ID_2926149; Annot_ID_197948

SEQ ID NO: 23966 - DNA, 3000 bp, Unknown; identical to SEQ ID NO: 4731
  misc_feature (1)..( 3000): 2750-1469P.txt file - cDNA_ID_2158468; gDNA_ID_1620725; Annot_ID_165927

SEQ ID NO: 23967 - DNA, 3003 bp, Unknown
  misc_feature (1)..( 3003): 2750-1469P.txt file - cDNA_ID_2158498; gDNA_ID_1620667; Annot_ID_163975
tcgtaaataaattaaacaatataaaacactataaaaatattttagtcggtggcttgccttcatttatatgtacgtagattcgttcgatatgctttaaaacaagtgaatacgaaaattctaaagtaagacacgaaaatacacgtcgataaaagacaaacccattagaaaaacaaaacagaaaatggaaagttctaagcaaaaacgatgtcgctctagcgtagtcgagaccattgaagcaccattaccactagtgtggtccatcctacgtagtttcgacaaaccacaagcttatcaacgtttcgtcaaaagttgcaccatgcgctctggcggcggcggcggcaaaggaggagaaggaaaaggctccgtccgggacgtgacgttagtctccggcttcccggcggatttcagcacggagaggctcgaagagctagatgatgagtctcacgtgatggtggtaagtattattggcggtaaccataggcttgttaattacaaatcgaaaacgaaggtggtcgcgtcgccggaggatatggcaaagaagacggtggtggtggagagttacgtggtggatgtgccggaaggaactagcgaggaagatacaatattttttgttgataacattattcggtataaccttacttcacttgctaagctcacaaagaaaatgatgaagtaagctctatatgtttaagctaatcaataaactaatcgtagttatagttatgaatcattggattaagaaaaaaatggatcgttatggattagtttttaatctttaaggcttttagcattgcaataataataataaaaatataaagaatcggaataatatgctcgtgtggtttctttcttccgtgattgtaattgtctcttttctcctactcttttatgaagagaaataaaatgaaggttatttctacatttttacaattaggaatctttgaaataatggttttaaattgttgactcagttggtttagttactaaatatactgatttgtattgctgacaacaaaagttagactaaatacatgtttgaaaattttcttgataattctttgtccattttgcataatgcatagtaaaagggcatcatgtaagattcttaatttgaagttctaaactaattaatatcaatactttagtataatattattaggttggaaggtattttacactcagaacagaaagtatgatgacctaaactgtagatctcgtgaatttcatggccgtttgactcaaatctgttcggaggttatgaatttatgatgtccgttgaatcattgagctgttgaactaatggagtggtttactctataatactttggtgtgtttttatcaaaaaccgaccgaatcaacagatataatttattttgaacaagttggtgaaagacaaaatagaggttctattgatctaaatataacggtgaagattggaaattttcatgttttttcgggaattgggcctttatgaatggactattgggccttgctatttcaaagcttgggtgttggtggggcttgctatttcaaagcttgggtgttggtgggggagtgtgagtggttgccacgtgaaggatacttattcccttgtccttttcattcccgcaattttagggattttggtcaacgaaacttatttcactttctttcagtaaatcgatttttttctcaggtgtatatttctcaagttattgtctactttacaaattttcatgggtttctcctcctctttttgtattagatagattagaataaatgttcgcttgaccagtcgttaatttatttatagacacttttgaagaattggttattaataaatgtagtacctaccaaaacataagtaacgacaaacagatagttaagttatgattaaaagaaatttcttcaaataccatttctattagtttttctctcatttttcatactattattcttcattctttttttgtttgtttagcaattaaaaatcaaagttttgaatattggagacggaaagaggtggccgagtaatgttttttcctcttaaaacgattactatactacctagaaaacaattacataatctaaaagtaatatactatacactatgtaatctagaagtgaaatgttaatttatagtcaatatctaaggccggttgttttagcaaattataagtcaattttttggaatgttatgagtaattcaaagtaattaaattatatatcgtaatcgagccccatcatccgtcgaggcgaatgccgcgacttttctttcaaagactttaaacaaagtaaacaattagtggtgcattcggagaaaagaaaattagtgcttacattataaacgacgttgcgtggctcggaaaaggacacaacaacatgtgttacattaccaaagtcggtaatttggctcacataaatgtcttttctcactttttcttttattttgtttgtttcattacttttagagaaaaaaaaaatacagttgaaacttgaaccacaactactcctcacgttttgccttgaggaatatttcaccttattagggccaaatttgtgtctctgatcttcttgtactccgatgtctaacgacatcgttatgtattcacaatacataaaatttccaacaaaaagaaaagtagttgatctcaatatctcatcattaattttcaatcaaatctttgtgggggatgggatttattctaagctcaattataacttatataagaaatgaaaacaaccaaacacaaggttaaagagaaagtctctttattgacaattctttagtcgcacacttataatagattcatctgctattttcctaaactccagccttcaatctcggtcctagacattcggcaatcatttacacacatatattaatacattaactctattcttatttttccgattttcttactttaataagaacaactacaatctcaaacacatagcaagagaagagatacacaaaacaaagactctgtttgttattcttccttctttttgttttcaagaatg

SEQ ID NO: 23968 - DNA, 3003 bp, Unknown; identical to SEQ ID NO: 23967
  misc_feature (1)..( 3003): 2750-1469P.txt file - cDNA_ID_2158498; gDNA_ID_2926171; Annot_ID_199491

SEQ ID NO: 23969 - DNA, 3003 bp, Unknown
  misc_feature (1)..( 3003): 2750-1469P.txt file - cDNA_ID_2158506; gDNA_ID_1620667; Annot_ID_163977
gaagtagatgaagatttggatacggtttcttcaaatgtaagcttctctgttaactgcagcacaagtggagttagcgaaatcgagaagaccggtgagagatctgattgtgatgagaagtctagagaaagtcttgatctaatgatgtcaagattcttaccagctgctaaagcaatggctcttcagacacatcagaaacatcaatcttcttataactcttcagagcagaagctaatcactcagaacagagaagctctcgtagctcgtcaaagaagtcaactggttgcagaacatgaacatttcgccattgttcagagtctttacgatgacttaaacattgatgatgatactgaagacgacgagaatgatgatgatggtgatgattatggtcatgttgatcacaagatctacccagctgaagttaccaagaaagcttgcggattcttgccaaggctttgtgcgaagaactcattcaagtttctaaacccggttcctttggattcagtatcaaaccggtctatgaaacattcgggtgatcaaaccagtttaccaaactggtcaactaggcgtctttccggttttatctctccgtaccgaacctcttgttcggattccggttttctcggaactcccgagaaaccagagagcttcaaaaggctaaacagaggaataagcaagtctcaagaactgtatccaacaagaacaagaagagaggttcttcctaattactcaaattctggagagatcaaaatgtttagaaactcgatctctactccttcgaggatccaacggaccacaattcacgattctaggtttcttgttgaggaagtaaacagaagaaggaacaacaagtcagggaatcttcaacaaacatcgtcggaatatacacctgcgctttctcctcctccgttaccggaaactccgtctcgttcctggctcggacgaaccctcctaccgccggtgaacccgagaccgtacggcgtcgttttaggtcaagttggtatcaagaaactgaatcaagaagttcttgaatctacgaaatgggaaacgatcgttaaaacatcgtatgttcacaacgatcacgctcgttattctcaggtattaattactctttgaacatttttggttctaacaaatcgaattcttttaaaaatacgttgtattattgaacattttaatttatatatcttctctttgtgacattcttctatgcaggagctgattgtttatccatctcgccagcaaaatacataaaaccagacaaattacttcttgtttttacattacaattaagttaataaatagttttaaggtttgcctcttatttttcttgtaggcaacacaaatgtacccgagattgattctttatgtttcaatatttttgtgtgtgttataattgtggcgtttgttttccgaccgcattatttgtaattggaagacctcatgttattgatgttagatacaatatggattccgtgcctaaccagttctgacttagccggtttagaccggcacaattatacaacataaccaggctgattcatagtgtcgattcgataaaccgatgaagtttcttaaataatcatatatgatcatatcatcataattgaaattagagctatctttgtctaagacacacatataatataagattttgattgacttctttttcttataatatcagctgcaattgacatttgatcatgacggaataaaatattttaagaaagtaatgggagacatgttactagcgatgatgctcttttttttttgcttttgtcaaattacgggtgatgactgatgatgttcatgcacattaattcaaaaccccatgtcatgtgtggtagtgctcattatacacaaacgatatgaaaaccgttggattaccgatatccaacggtcacaaagattcactattttattacgcactagtaaagtataagaggcaggcacgtcccccatgccccatgagtcttgttgttgaattcgattttaaaataacaaaattagagagtgagaatagatttggatactaaaattaaaaatacataaatcgttcattttgtgttttaaaatacttatggtgacgtggcttagtgtagtatagttaagcacgtataattattaaaaaaaaaaaatagaaaccaaaagtaaactacaagaaaattaggggttgtgaaattggaaaattttcgaaataattaaaaaaagaaaacaaattgtgcaaagagagagaagagggaagacaaagggaagagggaggagagagaaggcaccaccctttggccctggagagaccaaagatggtcgaagagagacaactctgagatcatcatcatcatcctgcaaaaactaacgagaaatcgattttcaaaaatataatcaagatcgatttctagggatattttgatttctaaatcctctcaccaacattctcttgcttgccctacccgcttgctggtttcatccagaaacataataatacattgtttgcattataaggaattcctttatacagtaagttttatcattacctatcatttgtttggttcctttacgtaatttgcaatgttcctcattttaaagagaacaacataatgttttttttaggtatatatacgttgcttcttcgaaacggtatcccctttggtaattattgttatttttattgcattttcttcaggtatcaagagatccacaagaagctgttagatcccagagattaacactgtgatgaaaagggttttgtgaaaatcaattttcaaacctggaaaatgatgatcaaggacccttatatccgacaattttcttctttcttctgtacattgtaatatatagaaaattaacattttttctctttctttcttttttttcttttgatatttggtttggttatatagaagagaaagtttgtttctgggaaatgggttttttggattttggtttgtaattagggaaaaaaatctttagtatatagtgtttgttgtaaaaaaccttataatgatg

SEQ ID NO: 23970 - DNA, 1061 bp, Unknown
  misc_feature (1)..( 1061): 2750-1469P.txt file - cDNA_ID_2158506; gDNA_ID_1563590; Annot_ID_147954
  misc_feature (55)..(55): n is a, c, g, or t
  misc_feature (114)..(114): n is a, c, g, or t
  misc_feature (159)..(159): n is a, c, g, or t
  misc_feature (354)..(354): n is a, c, g, or t
caggcacgtcccccatgccccatgagtcttgttgttgaattcgattttaaaatancaaaattagagagtgagaatagatttggatactaaaattaaaaatacataaatcgttcnttttgtgttttaaaaaacttatggtgacgtggcttagtgtagtanagttaagcacgtataattattaaaaaaaaaaatagaaaccaaaagtaaactacaagaaaattaggggttgtgaaattggaaaattttcgaaataattaaaaaaagaaaacaaattgtgcaaagagagagaaagagggaagacaaagggaagagggaggagagagaaggcaccaccctttggccctggagagaccnaaagatggtcgaagagagacaactctgagatcatcatcatcatcctgcaaaaactaacgagaaatcgatttttaaaaatataatcaagatcgatttctagggatattttgatttctaaatcctctcaccaacattctcttgcttgccctacccgcttgctggtttcatccagaaacataataatacattgtttgcattataaggaattcctttatacagtaagttttatcattacctatcatttgtttggttcctttacgtaatttgcaatgttcctcattttaaagagaacaacataatgttttttttaggtatatatacgttgcttcttcgaaacggtatcccctttggtaattattgttatttttattgcattttcttcaggtatcaagagatccacaagaagctgttagatcccagagattaacactgtgatgaaaagggttttgtgaaaatcaattttcaaacctggaaaatgatgatcaaggacccttatatccgacaattttcttctttcttctgtacattgtaatatatagaaaattaacattttttctctttctttcttttttttcttttgatatttggtttggttatatagaagagaaagtttgtttctgggaaatggtttttttggattttggtttgtaattagggaaaaaaatctttagtatatagtgtttgttgtaaaaaaccttataatgatg

SEQ ID NO: 23971 - DNA, 3003 bp, Unknown; identical to SEQ ID NO: 23969
  misc_feature (1)..( 3003): 2750-1469P.txt file - cDNA_ID_2158506; gDNA_ID_2926171; Annot_ID_140111

SEQ ID NO: 23972 - DNA, 3003 bp, Unknown; identical to SEQ ID NO: 23969
  misc_feature (1)..( 3003): 2750-1469P.txt file - cDNA_ID_2158506; gDNA_ID_2926171; Annot_ID_199492

SEQ ID NO: 23973 - DNA, 3000 bp, Unknown; identical to SEQ ID NO: 19486
  misc_feature (1)..( 3000): 2750-1469P.txt file - cDNA_ID_2158536; gDNA_ID_1620667; Annot_ID_163997

SEQ ID NO: 23974 - DNA, 3000 bp, Unknown; identical to SEQ ID NO: 19486
  misc_feature (1)..( 3000): 2750-1469P.txt file - cDNA_ID_2158536; gDNA_ID_2926171; Annot_ID_199511

SEQ ID NO: 23975 - DNA, 3003 bp, Unknown
  misc_feature (1)..( 3003): 2750-1469P.txt file - cDNA_ID_2158683; gDNA_ID_1620726; Annot_ID_165967
ctcaacaagcttagtgttgacaagaatctgattaaggtttattctaaagacgttgagaaagaacaagtgttgctattagctgcaagagcttcgagaatagagaatcgagatggtattgatgctgctatggttggatctcttgctgatccaaaagaggtaagaaattttaaaaactctgtttttaaaatgtttttgtttcttgaagaaaaaggaactcttttttctttgtcaggcaagagctggaattagagaagttcacttcaatctagttgataaacgaaccgctttaacttatatcgatggcaacggagactggcatcgagtaagcaaaggaactccagagcaggtaactaaaactgactctgttttacttttaagtagagtagtactgtttccctctaactacgattaaccgtttattgatgattcagattcttgatctttgcaacgcgagagatgatctgaggaagagtgtccactcggcaatcagaaattacgctgagcgtggactcaagtcatttgccatatcttggttccgaaatacaaattgtaacactgtctttttttttccttaccaattatgttcagagcacaaataccatattgtgaacaagttgcaagagaggcatatttgtggtttgattggtgatggagtggatgacgttccttcgttgaagaaagcggatgttggtatcgctgttgcgaatgctactgaagctgcaagagctgcttctgatatcgttttgactgagcctggacttagtgttatcatcgacgcggttctagctagtcgagccattttgcaacaaatgaagcactacacagtgagtgagcaatgctcttattaaactatacacagcgttttgtttttcattttttctgatgttttctcatgtatcagatttatgcagtttcaataaccatccgtgttgtggtaagttaatcaatcttgaatgttttctttaatatcatcaaataatctctgtttatataatctctctttgtaccttttttacagtttgggttcatgttcatcgctttaatatggaagttcgacttttcaccattcatggttttggccattgctttgttaaacgaaggtgagtttttcttctttataaactttgtttacttgctataaaagccaaacaataaaaaaacattattaacaattactcaacagaaaccaccaaggctatcacaatggataatgtcaccaatccttctcctacaccagatagcttgaaactcaaagagatcttcgcaaccggcgttgtttatggcagttacatggctttaataactgttgtgttcttttgggctgcatacagaaccgatatcttcccggtatgtataaacaaatctctcttcaaatctcccataacaacacaagcatactataaagttataacctcttgttttgttttttatatagagaacgttccacgtgagagacttgagaggcaatgaagcagagatgatgtgtgctttatacttacaagtgagtattatgagccaagctcttttcttcgttattcaatcaagaagctggttttttgtcgaacgacctggagagttattgtttctctctttcgtgacagtacaaactgtaagtatatagaaaaacatgattctgtttcttcttttttatttttcattataaagaagtcttcattgactcataaacttgaccttgtagattgcaacaacactcgcggtatacgcaagttgggaaactgcgagaatcgagggaataggatggagttgggctggagttatttggctctacaacatcatcttcttttttccattagacataatgaaattcggaatccgttacatactaaccggaaaagctcagagtctctttgacaacatggtacacttagttttgaacagttatgcaaaactcagcaatggaatatacaaccatactcaagctgaccatacttactcactcttggaagtgtcaactcctccatcccaggacttgagaggcgttgggtgggtttaatatcataccgtggtctagtttgttttgttttagttctttttatttgtttttggtgtaattttttttacttttttttttaattgaaattttagttaaatagaaattagcataatttttctactactccgtcttcaattttaattttcttcaactcttttttttttctttttaagtgtttccttaagttatatcactaaattgaaaacaatatatatagtatacttaaaacagcatctccagtgataacacaaggaagaaccaaatttggtgttttggtatctcaaatctcacactaaaactgaatttattattattttattattaaatctaaaattattttatattttgataaacattatttatttatttttttaaccctcaaaaatcatttattgattatgaatattttatctattttgtaacccacaaaaacaataattattttataactaatataatattataatcggtaattaaaaataataataaacaaattattttagacatgaaaaattgaaccctgcaaactacatgattaaataggtagaccagtattttcctattttgatttatgaatcaattaaaacttacaattacatactagtgtataacaataaacctcaaaaacttgtgatgaatgatgtaggaaataatagtactcttttgaatatcaacttaaatgtattttagcaatttgactaacaaacaattgttcttcacttttaataatcatccaatagaaccatagagaaacttcaagactttccacaaaaattcatcatcatcacataaccaagaaaacaaacgaggaaaaaagcccaaaaaataagagaaaagaccttaaaacgacgagtttcaccgatccaatcttccattgcaattttcacataacaaatctttttctttccccttgctcactccaagtctccaagcccccaaattttttcacaatcaatcatttctttgttgcgaaccaaacttgtgatatg

SEQ ID NO: 23976 - DNA, 3003 bp, Unknown; identical to SEQ ID NO: 23975
  misc_feature (1)..( 3003): 2750-1469P.txt file - cDNA_ID_2158683; gDNA_ID_2926153; Annot_ID_198218

SEQ ID NO: 23977 - DNA, 3003 bp, Unknown
  misc_feature (1)..( 3003): 2750-1469P.txt file - cDNA_ID_2158701; gDNA_ID_1620718; Annot_ID_165705
tgttgattacatgtttaacagatttgatttctcatatttgattattgcgatattctttaggaatgtgtgaatgaagagaaagaacaactcagtccagtatcgatcttagaatgcccttttaaagatgatgacgaagacgatgaaatcactgaccaaaatggtaattttatcaaatgactactactcaataatatttagcaagtcgttatacatcacaagagaaatgtgaatttaacgttataagcaattaacatttgcagatacatatgagaaaattgctagaaaaagcaggagattaaatggtttggtacggcttgagccactagacttggataaacgcatagagaggtatgtagagagacaagaagagtactcatatcacactctggagacggaagaggacgaatcagaaaatcaagcaaaccgcttgtttgctcttgtgaagttgagaatcggcgaaacaaatgacctactagcttctaaagtagcggataatctattgttagactatcttcaagaagataacattgggccaaaagaggagacattaatggtgaagaaagcagaagattgggttatgggtagacaagatgagatgtttatgagttgggaagtgaaaacgaagagagaggtttatgtgaaggaaatgaagtggggttgcattaatggagatgagagagagaatgtggttgaagagttggctaatggtttcttcacttcctttgtggatgaattcatctacgacttagtgttgtgataaagttagtgttttgggaggaaagttaagattttgattagattcataatgtattagatatatgctatctcaataaaactatatgtagttttgcataaggggaatgattcgtataaaaacttatgtaggtcatatgttcgttttccatttttaaaatctagaatgagagttaagagtccatagtcatttatgtgttgtttgtttttctaactagatcttaatatgaattattagttttctttatggtttatttttcgaattatctaaatcaaattcaatagccaaaatatttgaaagtcaaacgaaaactgtgtccttactcattgtatgatttaaaaaaataaactgaaaagacatttataatgtttcacaatcttataaaaccattattaactctaaacaaaatgttatgttcaaataagtgttaaactttgtataaaaaattttagtagccatttttgtaccagagatgtcaatcagctttcttacatcatagtataacttaaagacttgagatctcaatgaaatgaacacatttgaccaaagttatgtttttggaccttttcttgtttattcgagtattttcagtatctattaatatgtttttttcactattttcgaaatacatagatgcataattaattaacaaatgggtgtgctctgtataatgtaggcagtcacccataatccagcatctaaaacgtttaattaaagtttgttattttatacaggataagtgttatatcataatacaatatattttttttttgtcaaaaacataatacaatatataagatatataatctaaatatcttagattatttacggaattagtcaaatggttgatcagtagtggttgtgtttttgggaaaacatcgaatatactggattttagacccaaatatgagaaactcggtcgtgaaggaaaatcattctttatgatgcgatgccttgttgcatcttatttcttgggaagaagcatttgcgaggcccctaacatagtaaaaaatgcatctattcatatagagattatatctcaacaccaattgagggagatgatgattgtttagttgagagttaacctcttaaaagtctcgacaatattttttaaagcaaaccattcagattattttacgaatagttaataataataaaaaagtgtaaaggtatgattcaaacttctggtttagtttgatgtcgacttggttcagctggttaaattgttaaattacggtttaatgtcgcttagacattgattggagaagaatgacttcggttttggatttacaaggaatcaagagaaagactcttctggtatagagggtttgactttgacctctgcatataaatagtcttcgtcttcttcctttgttcgttgtaacagaaaattcttatttcaattcttctcccttgtaacacgtttttgagctctgggttttgagcttaagtaaacattgattcatagtggattgctggattgaatccggctccagacgtaggatcatcacaccggtgatctgaactgagtaaacaatcgtgtgttcgtttcgttctttgtttgattgcgttcttgatcgatctattgagtgttccgcgaattgaagcttgatcgagttgtgttgtgttgaatcgagttgtgttgaatcgatttttgagtcatcagattgtaacaaaaagaatagttgcaattttctaactttatatatctctatcatttcaccaattggctattttcaatttttacatcggacatacaaacctgaaacctatgtaaattggaaaaatcatttgtccggtgccctgatatatatttttcttcttaccaaaatcggatttgttagtaacaaacctgtcaatcaaagtgtttcagcttctccagcttaaacatcagaaaatgagtgtgtttttagtgtgtcagacaaatccccgtgaaccttgccttaaaaataaaataaaatcactccaaaatagaaattatttttacaaacaaaaaaatgaaaaagaatgcttattagtattttccacaattgaaatttaaaaagtatatttcccattatttttcacctaaaaaaaaagcatctaaaaagaagtattttttttgttcttctctttttaaagttcgtatttttttttaaatgtttatgaagaaagacacaaaaaaccctaaatataatttcacgcagctgcctctcttttcttcttccgatcctccttccgccgagtgaagccgcgactgtgaaatcatg

SEQ ID NO: 23978 - DNA, 3003 bp, Unknown
  misc_feature (1)..( 3003): 2750-1469P.txt file - cDNA_ID_2158701; gDNA_ID_1620726; Annot_ID_165973
gttgattacatgtttaacagatttgatttctcatatttgattattgcgatattctttaggaatgtgtgaatgaagagaaagaacaactcagtccagtatcgatcttagaatgcccttttaaagatgatgacgaagacgatgaaatcactgaccaaaatggtaattttatcaaatgactactactcaataatatttagcaagtcgttatacatcacaagagaaatgtgaatttaacgttataagcaattaacatttgcagatacatatgagaaaattgctagaaaaagcaggagattaaatggtttggtacggcttgagccactagacttggataaacgcatagagaggtatgtagagagacaagaagagtactcatatcacactctggagacggaagaggacgaatcagaaaatcaagcaaaccgcttgtttgctcttgtgaagttgagaatcggcgaaacaaatgacctactagcttctaaagtagcggataatctattgttagactatcttcaagaagataacattgggccaaaagaggagacattaatggtgaagaaagcagaagattgggttatgggtagacaagatgagatgtttatgagttgggaagtgaaaacgaagagagaggtttatgtgaaggaaatgaagtggggttgcattaatggagatgagagagagaatgtggttgaagagttggctaatggtttcttcacttcctttgtggatgaattcatctacgacttagtgttgtgataaagttagtgttttgggaggaaagttaagattttgattagattcataatgtattagatatatgctatctcaataaaactatatgtagttttgcataaggggaatgattcgtataaaaacttatgtaggtcatatgttcgttttccatttttaaaatctagaatgagagttaagagtccatagtcatttatgtgttgtttgtttttctaactagatcttaatatgaattattagttttctttatggtttatttttcgaattatctaaatcaaattcaatagccaaaatatttgaaagtcaaacgaaaactgtgtccttactcattgtatgatttaaaaaaataaactgaaaagacatttataatgtttcacaatcttataaaaccattattaactctaaacaaaatgttatgttcaaataagtgttaaactttgtataaaaaattttagtagccatttttgtaccagagatgtcaatcagctttcttacatcatagtataacttaaagacttgagatctcaatgaaatgaacacatttgaccaaagttatgtttttggaccttttcttgtttattcgagtattttcagtatctattaatatgtttttttcactattttcgaaatacatagatgcataattaattaacaaatgggtgtgctctgtataatgtaggcagtcacccataatccagcatctaaaacgtttaattaaagtttgttattttatacaggataagtgttatatcataatacaatatattttttttttgtcaaaaacataatacaatatataagatatataatctaaatatcttagattatttacggaattagtcaaatggttgatcagtagtggttgtgtttttgggaaaacatcgaatatactggattttagacccaaatatgagaaactcggtcgtgaaggaaaatcattctttatgatgcgatgccttgttgcatcttatttcttgggaagaagcatttgcgaggcccctaacatagtaaaaaatgcatctattcatatagagattatatctcaacaccaattgagggagatgatgattgtttagttgagagttaacctcttaaaagtctcgacaatattttttaaagcaaaccattcagattattttacgaatagttaataataataaaaaagtgtaaaggtatgattcaaacttctggtttagtttgatgtcgacttggttcagctggttaaattgttaaattacggtttaatgtcgcttagacattgattggagaagaatgacttcggttttggatttacaaggaatcaagagaaagactcttctggtatagagggtttgactttgacctctgcatataaatagtcttcgtcttcttcctttgttcgttgtaacagaaaattcttatttcaattcttctcccttgtaacacgtttttgagctctgggttttgagcttaagtaaacattgattcatagtggattgctggattgaatccggctccagacgtaggatcatcacaccggtgatctgaactgagtaaacaatcgtgtgttcgtttcgttctttgtttgattgcgttcttgatcgatctattgagtgttccgcgaattgaagcttgatcgagttgtgttgtgttgaatcgagttgtgttgaatcgatttttgagtcatcagattgtaacaaaaagaatagttgcaattttctaactttatatatctctatcatttcaccaattggctattttcaatttttacatcggacatacaaacctgaaacctatgtaaattggaaaaatcatttgtccggtgccctgatatatatttttcttcttaccaaaatcggatttgttagtaacaaacctgtcaatcaaagtgtttcagcttctccagcttaaacatcagaaaatgagtgtgtttttagtgtgtcagacaaatccccgtgaaccttgccttaaaaataaaataaaatcactccaaaatagaaattatttttacaaacaaaaaaatgaaaaagaatgcttattagtattttccacaattgaaatttaaaaagtatatttcccattatttttcacctaaaaaaaaagcatctaaaaagaagtattttttttgttcttctctttttaaagttcgtattttttttttaaatgtttatgaagaaagacacaaaaaaccctaaatataatttcacgcagctgcctctcttttcttcttccgatcctccttccgccgagtgaagccgcgactgtgaaatcatg

SEQ ID NO: 23979 - DNA, 3003 bp, Unknown; identical to SEQ ID NO: 23978
  misc_feature (1)..( 3003): 2750-1469P.txt file - cDNA_ID_2158701; gDNA_ID_2926153; Annot_ID_198224

SEQ ID NO: 23980 - DNA, 3003 bp, Unknown
  misc_feature (1)..( 3003): 2750-1469P.txt file - cDNA_ID_2159919; gDNA_ID_2684237; Annot_ID_192463
ttctcggtggtttagtttctgaatcttgttgtctctttctctaggcttggttaagctagaaccagacctcttataccttaccaaagccttcctttccactaaagaaactctcttgattggtgaactggcctttctcaagtcatcatcatctctattatctccaactacctcctttacatatgattcatcgtcactcgaggaggaagaggaagatgaagacgacgatgatgacgatgatgatgatgaagatggatcctcagaagacaaagactccaccgttacattatctttggtgttattatcttcactatcttgattttcttcttcctcttcatcggtttcacttgagctatcttcaccatcactgatagactctacaattctgctactttcttcaaatagcttcttcttggctgaagctcttcttctagcttcagtttcagactcagaatctgaaagaatctctatttcgccagggactgatttttccaaaaccaaacctctaatctcaggggaacacttgtccttcaaaaatctgatttcttctgacacatcttttaacacagaagagctcggaactgatattacaagatccaaatcagcaatctcaggagaactcttctgcatcagacatgtgttcttctgttcagacacatcctttaacttagaaaatctcggaacaggtatcccaacatccaaatctgtaatctcaggggaacatttcttctccacgcccaaatcactaaccctaaaagacctctctttcagacatgggttctgctcagacccatctgttaacctagaggagctgggacctgatttcttctccacattcagatctctcattatcctagaaaaactctcttttacagagttgttaggtacagagtacatgttactgacttgaggaggaggaacactgtcgttgcaagttggtgtgatgtcctcaatgtcggagtcatagtttttaggtttcttctgccgtcgtttctttgggggagatgtcaccggagctacagtctccatcttcttccgcttgttaacagcctgaagacgctgccagctccgggacttcactctcttcccaatacactccattaaagcaaacacaaagatctgaaaaaagaaagactgttagaaatctagagaagacgacaatggggtctgtaaagaaacagagagagagaaaggtaacgaacctttagatgagaaaaaatcgaatctttcactcactcacacgggtctgagaagaagatgatgaagttcttgagtttttagagaaatttttgattttcactggtttcagaaagtggaacagagagagatgggcagagagagagagagagaagggcatgaagaaagcgtgatggcaaagccaaaccatgctatttcaggaggtctctcataccgccaaaacggtactatttttccacacactctgctttttggttttggtcaaaaaatttcttacatttcgttaaaaaaacagctcattaatcagtttccatttcaagcattgtttttttctgttctaaattacctttttgaccactctgaaattacagagtcaacacgtcactcaaaactgcaggaagagaagatatttcattacaagacaaacaatgtgtaataaattatgtcttactgcttctaatttttttttctgtgttttccttttgcttttgttttgaaatgtaatctttttagtttaccaatctagatttgttataacaatttaaatgaaaaaaatcgaatcatttactattttataaaagaatctcaaaccctttctttgaatgggattggagattggagtattattgaaatcaactaccttcctcttgctggcatttaattccactattagacctttatattatttttaaactaaagaatattgtgtttgaaagaaaaggcaaccaaaaatgattacttacaaacatatacaaacaaaggtttttagaatataaagtagcaaacaacatcattccaaggagagaaaacagagaagaatacttgtcattaatagagagaggtatgagttcttcacgcaaagtctttttgatattggaacttggtcattaatttacatcaccaacaagttctaaatatgatgaaagaaaatttatgtaccaacttcactttaagtgcccaccttttatctaatcgcagtaatgaacacatcacgtcctatgaggctttgacaaattaggaaaaaggctaaactgtgttagtcagaagataataacttacagaggggaccattattaatctcctaagtttatgtttttgtgacaagttacaaattcctcagaggattattagagaagcaaatatcgaaaactgtataacaaaactaacttcttaagaccgtaccgtcacataacatcaatgagccattaccatagccgaaaccagtcagctacacgagtacaagacttattatggtatgtagtcatctcatgatttaagggtataatgaagtatcaactgttagtcccccaagatcctaattgcatatgatcagaactctggactcgtttcttaagtgaggatttgcaaagctcaatctttgtcattgcgattatgttccggtgacgatgttcaaaatctttccggggatttagttccatcactgtctttcttttctatttgtttttgtctttaacaatgtcaaagtcaaaatctcaccgattctgtaaattccaagttatatgacgtgtcattgtattattggtgcgagcgatagcacaacctttgcgtctgcgtcggtagcgaactcttcggaaatatataatctgtaattaaaatgagactaatcccaatttaaaatcaaaaacctttttatttatttttgttttcctatagagatttcttagaaaagaaataaattacttctcttttatttttcattcggtttagctcgtggaactgaatctggtgtgtttgttgatcagagtaatacggacattgcaatttttctaaatccggcgattaaatatg

SEQ ID NO: 23981 - DNA, 3003 bp, Unknown; identical to SEQ ID NO: 23980
  misc_feature (1)..( 3003): 2750-1469P.txt file - cDNA_ID_2159919; gDNA_ID_1620807; Annot_ID_168892

SEQ ID NO: 23982 - DNA, 3000 bp, Unknown; identical to SEQ ID NO: 14248
  misc_feature (1)..( 3000): 2750-1469P.txt file - cDNA_ID_2160091; gDNA_ID_2684093; Annot_ID_190037

SEQ ID NO: 23983 - DNA, 3003 bp, Unknown
  misc_feature (1)..( 3003): 2750-1469P.txt file - cDNA_ID_2160091; gDNA_ID_1620791; Annot_ID_168284
aacttacactctgttttcttttgagaatggttttttatatgagtgtgcactcaagcagggggagagtattctgatgtgtcgtactctgttccggatgatgtgggagatgaggatgtggaggaagaggacgatgatgatgagttagatgacaacacttaattgcttagtcctggtcattttttttttagttgggcattgtgttagggggagtttgtcactgattgtttttgtgtgtttgtgaaaactccctgatcttgttctttatcggcttcttatcggatcttctgtgtgtttaatgattagtcttatgtatagaaccaagaactcatttctgtttcatgtttaaatggttatgtcttttggcagtagttgcttaaacttgagcctttggtttctatgtttggtatggaatattgcttggcttgtattgtggtctctactcttttgcagattacttgaggtgtcacactcaaataaaaagggggagattgaagaaacagagtgtctgaagttctacaggcgtgtctgaaacaacacagagcagaacagaggaacagaggaagcgggaaagtagcagttgcttttgccagcgtggcatgttgattggagtgaaggaaaggcgtatcgctttagacaaaggagacgaagtcgtcagacataggacgtgtgcctagtgtcaagataatgatgaggagctacacttgaacctgatggataaagtagagcatcctgccttttccgagaaactacataagagaagttttggtctcttattagggttagccactttacttgagaaaagtggaagagaagaaaagttaaatagaacttgttcttgtggtttcattggtgagtgaacaaagagagcacacggctgttgctgtgtttgtgagctgggtagttttaggttttgacaagagcaaatcaggttgttgatgttgcataacactgtccaaacttatctgtgattgatcagtttgaaagttgttctaataaagtgtgtttattggagttgtgatctttatcttgtcaaagtacttaggattcttttacttcatatgttagatataatattttgcttaattgaatatattttacaatgttcataagctataagatcattatatgatgcatacgttttatccaaccatatcttcacgtaaccaacttcttctcaattaccttaactgttcacatgtttatatatctaagcccatatttttaggtgttatacatatatatatttatttactttttgaggattctggaaaattgaaagatatgatacaacagttatacgatatatatattgaatttaaaactttaataattataattttaataatttgaatagacactgtaaatatagttttagtcggacaaaccttactcaacattcaatactaatcatataccaaaacataattgttttatctaatttagagaaaagaaacatgaagctatttattatcattgtggtgaccagtttaaccatctcaaaggtatttgacaaaacacttgtcaccattgaagcaagaaatttgaggaagatggaccgtcatgagcatttcaatgctaatgaagatttcgtggaagcaaaaatgttaaagaaaattgacaataaaaataatctaaataatagatgtataaatgattttgcgcctactaatccaggacataattctggtattgggcatccaaaagttataaacaacaaatttacaaaagattttgcgcctactaatccaggacatagtcctggtattgggcatctaagagttgtaaacaacaaatttacaaatgattttgcgcctactaatccaggaaatagtcccggtattaggcatccatgagttatgaatgtttaaggattgtaaatcttattatataaatcttaaagaaataaaataaaactaacaaaaaaacaaatttatatgtctatatctcaaatgtttttaacttttttttctgaactaaaagaaaaattaacaaatttgtttttatatgtgttattggtcaaataaattaggatgtatttatatttatttgaagaaaaaattagcatgtattaatttttttaaagtcatttaatttatgtgtacaaaatattattttacggttttggtgggaaaacgttggcttacagttgttgcgggaaaacgtgatttttaattttggcggaaaatactttttgtgtgattttggcaagaaaacactttttgtgattttagcgggaaaacgtggttttacggttttgtcgagaaaatgttggtttacggttgtggcggaaaaacgtaattttaatatttaaaccaaaaactgaagttaaatagaataatttagttttactaaggatgactaatagaaaaagaaaaataaatagacttaattggataccaatttatttatgtgaaaccttatttaataaatgagtttagttggcttaatccatttaatctcatttaacttgtttttcctaaattaatttaaatgggtcaaaaactcttactcataaccattaattaaataggatttgcatacccaaattaacatcactagtcctagacaaaaaccaaaatagaaaacaatatttttatccatttttacttttgctcatcgaccaaatttgggcctagtttgctacaagctaacaattgaaaagcctcttaagacacatgaaatagtaacgacgtcgtttactcatgaagcgaaagacggcaaacacgaacgggtttacgtagaccgtcaaacgctcctccgtccgacggagaaaaaacgagacggtgaagaagaagaagaagaagaagaagaagaacgactcaaagatctcatcgatcactctctccaagatctattcacgcatcgtcggaagaattttcgcttccgacgacgtttctctcgtctgattttgtctccgaacatcctacctaatcgtattcggtgctggatttgaatccggtgaactgaatctgacaatttcgttcccggaggtgtttaaaaatg

SEQ ID NO: 23984 - DNA, 3000 bp, Unknown; identical to SEQ ID NO: 14248
  misc_feature (1)..( 3000): 2750-1469P.txt file - cDNA_ID_2160091; gDNA_ID_2684093; Annot_ID_137027

SEQ ID NO: 23985 - DNA, 3000 bp, Unknown; identical to SEQ ID NO: 5466
  misc_feature (1)..( 3000): 2750-1469P.txt file - cDNA_ID_2160125; gDNA_ID_1620791; Annot_ID_168295

SEQ ID NO: 23986 - DNA, 3000 bp, Unknown; identical to SEQ ID NO: 7000
  misc_feature (1)..( 3000): 2750-1469P.txt file - cDNA_ID_2160220; gDNA_ID_1621121; Annot_ID_172073

SEQ ID NO: 23987 - DNA, 3000 bp, Unknown; identical to SEQ ID NO: 3071
  misc_feature (1)..( 3000): 2750-1469P.txt file - cDNA_ID_2160942; gDNA_ID_1620623; Annot_ID_47077

SEQ ID NO: 23988 - DNA, 3000 bp, Unknown; identical to SEQ ID NO: 3082
  misc_feature (1)..( 3000): 2750-1469P.txt file - cDNA_ID_2160942; gDNA_ID_1620623; Annot_ID_162390

SEQ ID NO: 23989 - DNA, 3000 bp, Unknown; identical to SEQ ID NO: 3071
  misc_feature (1)..( 3000): 2750-1469P.txt file - cDNA_ID_2160942; gDNA_ID_2926200; Annot_ID_141493

SEQ ID NO: 23990 - DNA, 3000 bp, Unknown; identical to SEQ ID NO: 3082
  misc_feature (1)..( 3000): 2750-1469P.txt file - cDNA_ID_2160942; gDNA_ID_2926200; Annot_ID_201808

SEQ ID NO: 23991 - DNA, 3003 bp, Unknown
  misc_feature (1)..( 3003): 2750-1469P.txt file - cDNA_ID_2160983; gDNA_ID_1620622; Annot_ID_162360
ttctccaggtatctctctcttcctctatccatgcttatgtttttttttgtggattgatctgtgttttagtaaaccaatgaaaatctgacttttaattatatacgtaattgctatttttgagctgctgaatgagtgaattgctatcttctacgtatctctttatcagttattctgaaaattccttctcatctagatccctttgggataattcagaaattagatacagtgagaagattagctcaagcgtttgatttctgatttcagggatccacatgggcaaaggccaagaacacaagttagatgcacacaagaaacttctaatcgctctcataatcacctcatcttctctaggactaatacttgtatcttgtttatgcttttgggtttattggtctaagaaatctcccaaaaacaccaagaactcaggtaataatcatcttaacattaagaatgagaacaaatctgcaaaactttacatttgtaacaagattctgtatcagtttcttcattgtgatctctctgttttgatatctaaatggtttcatgcggaagaaggtgagagtaggatttcattatccaagaagggctttgtgcagtccttcgattacaagacactagagaaagcaacaggcggtttcaaagacggtaatcttataggacgaggcgggttcggagatgtttacaaggcctgtttaggcaacaacactctagcagcagtcaaaaagatcgaaaacgttagtcaagaagcaaaacgagaatttcaggtaccaaaacaaaacacaagtactaatcatttttacttttttaccggattcttgatatctgattttatcatctaaatctcagaatgaagttgatttgttgagcaagattcaccacccgaacatcatctcattgtttggatatggaaatgaactcagttcgagttttatcgtctacgagctgatggaaagcggatcattggatacacagttacacggtaaaaatagctcaaaacatcttctcatcatcgtgtaatagatcatgagttaaattaatactatagtataacagagataaaacaaatcatgtgcccacatgaaataaataatttttgttttgataaaatttaatgtttgcatcattaatggttaaggaccttctcggggatcggctttaacatggcacatgcggatgaagattgctcttgatacagcaaggtactacactcaagtgcccacatttaacaatcctctctaccggttgattaatttcggtttaggtaaaccgttttcttatgttggtttggaaatagagctgttgagtatctccacgagcgttgtcgtcctccggttatccacagagatcttaaatcgtcaaatattctccttgattcttccttcaacgccaaggtaaacaacttgaatcattaatgatgattctgttctgagctaaccgaacaagatttgtttcgttgattcaagaatcatttcattcatttgtctttagttccatctctaacgatagatcaacattcagatttcggattttggtcttgcggtaatggtgggggctcacggcaaaaacaacattaaactatcaggaacacttggttatgttgctccagaatatctcctagatggtaaaatattaacatttccctctatattgatcgactttgactcgttgtcatatcactagagttatagcacatagtttgatagtcataatcatgtgaccccataacattaagtttctttcattacgtctaaaattgttgttctaaatcaaatcattttgtttgttgatgtattatttcaactaatcacacatagaaatcattatttgattagagatggtagttgttgggtcgctaaaccggtttattgagtttgtctcattgcaacatctttatgtccctcaggaaaattgacggataagagtgatgtttatgcgtttggtgtggttttacttgaactcttgttaggaagacggccggttgagaaattgagttcggttcagtgtcaatctcttgtcacttgggtaagtccggtttgtgttgacgttattgccatcaatacatgaatcagatagcattggttaatgagtgtaccgtttcgaaaaatttgcaggcaatgccccaacttacggatagatcaaagcttccgaaaatcgtggatccggttatcaaagatacaatggatcataagcacttataccaggtttgcgtcatcttttgtctttgtgtttaggcttaaaaatccgattggttacatattttttgtgttgaaacgtaaataaaaccggaaataaattgttcaggtggcagccgtggcagtgctttgtgtacaaccagaaccgagttatcgaccgttgataaccgatgttcttcactcactagttccattggttccggtagagctaggagggactctccggttaataccatcatcgtcttgatttaagaaaataatattttttgcttctttttttgaattttacagtttgatctctgattgctttgagtaatttaatttgggggtgaaaaatgtgaggacagaagggtattcacttgtcattattgtatttgtaaattgattaatatataaattgtgttgtcactaagtgtaaatattcaattaattgttgcatgaaccactaatcacaatccactagtatccatccatccactctttcaacttttaaacataatcctaaatgactatcttacccctatcaagacaagcctgagaagtgagaacaacttcgtagacatcgtcgtgtctctctctcgttgaatccttgttaatctttttcttcaatctctcgatctgatcgttatcgaaaccgcgcgattctaaccaagtccaggtgacaaatcagctctgctaaaatactcacaaagtctcgtgatcatattttgtggatcacatcattgtcttatttttggaattgcttatcctcgcactagttcactgatttgagatctgtgcagttaattttgtgctccatagcgattccatg

SEQ ID NO: 23992 - DNA, 3000 bp, Unknown
  misc_feature (1)..( 3000): 2750-1469P.txt file - cDNA_ID_2160983; gDNA_ID_1620623; Annot_ID_162414
tccaggtatctctctcttcctctatccatgcttatgtttttttttgtggattgatctgtgttttagtaaaccaatgaaaatctgacttttaattatatacgtaattgctatttttgagctgctgaatgagtgaattgctatcttctacgtatctctttatcagttattctgaaaattccttctcatctagatccctttgggataattcagaaattagatacagtgagaagattagctcaagcgtttgatttctgatttcagggatccacatgggcaaaggccaagaacacaagttagatgcacacaagaaacttctaatcgctctcataatcacctcatcttctctaggactaatacttgtatcttgtttatgcttttgggtttattggtctaagaaatctcccaaaaacaccaagaactcaggtaataatcatcttaacattaagaatgagaacaaatctgcaaaactttacatttgtaacaagattctgtatcagtttcttcattgtgatctctctgttttgatatctaaatggtttcatgcggaagaaggtgagagtaggatttcattatccaagaagggctttgtgcagtccttcgattacaagacactagagaaagcaacaggcggtttcaaagacggtaatcttataggacgaggcgggttcggagatgtttacaaggcctgtttaggcaacaacactctagcagcagtcaaaaagatcgaaaacgttagtcaagaagcaaaacgagaatttcaggtaccaaaacaaaacacaagtactaatcatttttacttttttaccggattcttgatatctgattttatcatctaaatctcagaatgaagttgatttgttgagcaagattcaccacccgaacatcatctcattgtttggatatggaaatgaactcagttcgagttttatcgtctacgagctgatggaaagcggatcattggatacacagttacacggtaaaaatagctcaaaacatcttctcatcatcgtgtaatagatcatgagttaaattaatactatagtataacagagataaaacaaatcatgtgcccacatgaaataaataatttttgttttgataaaatttaatgtttgcatcattaatggttaaggaccttctcggggatcggctttaacatggcacatgcggatgaagattgctcttgatacagcaaggtactacactcaagtgcccacatttaacaatcctctctaccggttgattaatttcggtttaggtaaaccgttttcttatgttggtttggaaatagagctgttgagtatctccacgagcgttgtcgtcctccggttatccacagagatcttaaatcgtcaaatattctccttgattcttccttcaacgccaaggtaaacaacttgaatcattaatgatgattctgttctgagctaaccgaacaagatttgtttcgttgattcaagaatcatttcattcatttgtctttagttccatctctaacgatagatcaacattcagatttcggattttggtcttgcggtaatggtgggggctcacggcaaaaacaacattaaactatcaggaacacttggttatgttgctccagaatatctcctagatggtaaaatattaacatttccctctatattgatcgactttgactcgttgtcatatcactagagttatagcacatagtttgatagtcataatcatgtgaccccataacattaagtttctttcattacgtctaaaattgttgttctaaatcaaatcattttgtttgttgatgtattatttcaactaatcacacatagaaatcattatttgattagagatggtagttgttgggtcgctaaaccggtttattgagtttgtctcattgcaacatctttatgtccctcaggaaaattgacggataagagtgatgtttatgcgtttggtgtggttttacttgaactcttgttaggaagacggccggttgagaaattgagttcggttcagtgtcaatctcttgtcacttgggtaagtccggtttgtgttgacgttattgccatcaatacatgaatcagatagcattggttaatgagtgtaccgtttcgaaaaatttgcaggcaatgccccaacttacggatagatcaaagcttccgaaaatcgtggatccggttatcaaagatacaatggatcataagcacttataccaggtttgcgtcatcttttgtctttgtgtttaggcttaaaaatccgattggttacatattttttgtgttgaaacgtaaataaaaccggaaataaattgttcaggtggcagccgtggcagtgctttgtgtacaaccagaaccgagttatcgaccgttgataaccgatgttcttcactcactagttccattggttccggtagagctaggagggactctccggttaataccatcatcgtcttgatttaagaaaataatattttttgcttctttttttgaattttacagtttgatctctgattgctttgagtaatttaatttgggggtgaaaaatgtgaggacagaagggtattcacttgtcattattgtatttgtaaattgattaatatataaattgtgttgtcactaagtgtaaatattcaattaattgttgcatgaaccactaatcacaatccactagtatccatccatccactctttcaacttttaaacataatcctaaatgactatcttacccctatcaagacaagcctgagaagtgagaacaacttcgtagacatcgtcgtgtctctctctcgttgaatccttgttaatctttttcttcaatctctcgatctgatcgttatcgaaaccgcgcgattctaaccaagtccaggtgacaaatcagctctgctaaaatactcacaaagtctcgtgatcatattttgtggatcacatcattgtcttatttttggaattgcttatcctcgcactagttcactgatttgagatctgtgcagttaattttgtgctccatagcgattccatg

SEQ ID NO: 23993 - DNA, 3000 bp, Unknown
  misc_feature (1)..( 3000): 2750-1469P.txt file - cDNA_ID_2160993; gDNA_ID_1620622; Annot_ID_162356
caaatggctcggttataactgatttatataccaataattgcatacaagtttgtttcttaaataaatcaagcaatattcataagattgcatgtgtattttctgcgaaactattagtacgaattcgtggatatgcaaatttaatgactatgcaaagtaggtgagaatgtaatagcgattagaatagctagggtttagcctaccaaccatggtaatccagtttcctaattatcgttagtttttgaatcccattcatgcttttatctatttttcaaccaatcatgtctttttaccaacaaagcatttccagtctaagcaatatggtaggtaactcggtacgataaacagaaagataatttattattcatctataaacgaataattggttctcacattactcatacagaggaaaaaaagggatatacaaaccctctctaaattatatagttttgaattcactgttgtttatcaacaacatatataactctcttacccaattcttattattgttcatacttcatagacattaacatgtacgtatagtgattgctacaatgaatggtatgtacagatattgagacagacagtagaaagggatgaatcgagtatttattaaagagaaaggaaagggccaatctatgcctagtttcaattatgaaactcaacccatgaactgatttaaatactttacctatcggataagacttttaagggtctaaaatattttccaactatttttcatttgcaacaaaccttaaagtaatatgctaaagagatcttttccaaaggtggaatgatttttttgatctaaaacggcccatcaaccaatcttcggtccattatcctgacatgattatttgggctacatttttttaagtcttttgcagtaaattgttgaaccaacaaaaataaagagttggagttggacctagtagctgatctgctgatgtgttggtgatggtcgtcgtgggttcctgtcttataaccctagaaaccaagccacttcatcattctcaaattcaatgctttactaaataatattattatcgaaatcaaaatactaatttagacgtatataaatctagaagcaaaccttaggtgaggtcgaaacagagatgaccttttgcgtgcactttaattaatatcttattacataaaatgtcacactttgagtaaactttacattattctctcatccataataaataaataaagcatactgggttttaggtcaggctgacgtcagcagtttctttgtgtttcattttttttttttttgtaatctaacgctccagatttgttgtcttctccacgagccctttgttgttgttggtaatggagattttcgctctaagtcattgtggcttcttcttctttatttagaaaccaattcatcaactccttcgttatttctaaatctctttgccactacctcttgttgctgcaattgaattggctcaaatcttcttcacttggtcgacgtaaagacgactttgacttggtttttaacttcacttctccgtcgaaaactatcccttctcttccgatcgaatcaatcggctctctctccacacaaaccaaggtaagggttaaccctctccggtgattatgctctgataaatttacttgctcggccattagtgttcagaaacttggtgatttatgcatgtttttttttgttcaaagaccgtagatttcggaattaggattgtaaaaattgaacctttacatcagtgtttttacaaagttataagctttacttggaaatcagtggttttttgggtcaaccaaagttgaaagatttgaagaagaatgaaactagttcgatttatatatcattttattgcttcttaagaaagtgtcgtccttggttctttatgaatttccaattgcagccaaatatgtcatgttattcacctaatttttgtattttccaattgcagccaaatatcttctcctgttactggagacaaacctgcatacatttctgtcatctctgttaaggtattacatttagtttacttgtttacttaatgtagctgcttattacatttttttcttcaagtctatattcttctttcaatagcattaaaagttatgtgtatcctcagattagatcttgctgactcgcaagtttttggattatttagcggtttaataagaattatatcttccttgaaattgtgcctaggtagtggaatcgttgttagcctactgtagctcagataggtgatggatcatttccgttcaattgaataatttgactatttaaggtttgcacttagttttgtctacagaatcaattcatcctttttcacagtcaagatattattctcattatcactattgtagacttcttggacttccatacattcatcagtcaacttttcgatggtgcgtttttatcacagtggcacaattatttaagaggctccatctccactgcaccactgagaagtttcgtgtggacatgtctaagcttagaattggtttggttgaaaactgaggagatggaagtgactcgtggtttctcttttttggacaagtttcttcgaaaggtctgttgattttctttgtctcttgtgaactttaatttcgtttttttttccttaggatgcaatgatatcttatctttagatgtcaatatcaaatgtccttaactattcattcatttacggattttgattactttataacagttggtatcttcttctatatatcgtcatcttatatgtttttatttgtatatagtctttcacagaaggagcgtattgagtttctcgacaatatatttgacatcttcttctgccttttctggtaagtgtttaacttttctgataccaattagttttcttaatcattgcatatttttaatgcttgtgcctttattaaagaggaaagttgcggtggattaaagcaccatcgtgcggagaatacgataaggctcttgcttcatttgaagttattgacagttgaatcgagccgctcaattggtcaattatg

SEQ ID NO: 23994 - DNA, 3003 bp, Unknown
  misc_feature (1)..( 3003): 2750-1469P.txt file - cDNA_ID_2160993; gDNA_ID_1620623; Annot_ID_162418
tgacaaatggctcggttataactgatttatataccaataattgcatacaagtttgtttcttaaataaatcaagcaatattcataagattgcatgtgtattttctgcgaaactattagtacgaattcgtggatatgcaaatttaatgactatgcaaagtaggtgagaatgtaatagcgattagaatagctagggtttagcctaccaaccatggtaatccagtttcctaattatcgttagtttttgaatcccattcatgcttttatctatttttcaaccaatcatgtctttttaccaacaaagcatttccagtctaagcaatatggtaggtaactcggtacgataaacagaaagataatttattattcatctataaacgaataattggttctcacattactcatacagaggaaaaaaagggatatacaaaccctctctaaattatatagttttgaattcactgttgtttatcaacaacatatataactctcttacccaattcttattattgttcatacttcatagacattaacatgtacgtatagtgattgctacaatgaatggtatgtacagatattgagacagacagtagaaagggatgaatcgagtatttattaaagagaaaggaaagggccaatctatgcctagtttcaattatgaaactcaacccatgaactgatttaaatactttacctatcggataagacttttaagggtctaaaatattttccaactatttttcatttgcaacaaaccttaaagtaatatgctaaagagatcttttccaaaggtggaatgatttttttgatctaaaacggcccatcaaccaatcttcggtccattatcctgacatgattatttgggctacatttttttaagtcttttgcagtaaattgttgaaccaacaaaaataaagagttggagttggacctagtagctgatctgctgatgtgttggtgatggtcgtcgtgggttcctgtcttataaccctagaaaccaagccacttcatcattctcaaattcaatgctttactaaataatattattatcgaaatcaaaatactaatttagacgtatataaatctagaagcaaaccttaggtgaggtcgaaacagagatgaccttttgcgtgcactttaattaatatcttattacataaaatgtcacactttgagtaaactttacattattctctcatccataataaataaataaagcatactgggttttaggtcaggctgacgtcagcagtttctttgtgtttcattttttttttttttgtaatctaacgctccagatttgttgtcttctccacgagccctttgttgttgttggtaatggagattttcgctctaagtcattgtggcttcttcttctttatttagaaaccaattcatcaactccttcgttatttctaaatctctttgccactacctcttgttgctgcaattgaattggctcaaatcttcttcacttggtcgacgtaaagacgactttgacttggtttttaacttcacttctccgtcgaaaactatcccttctcttccgatcgaatcaatcggctctctctccacacaaaccaaggtaagggttaaccctctccggtgattatgctctgataaatttacttgctcggccattagtgttcagaaacttggtgatttatgcatgtttttttttgttcaaagaccgtagatttcggaattaggattgtaaaaattgaacctttacatcagtgtttttacaaagttataagctttacttggaaatcagtggttttttgggtcaaccaaagttgaaagatttgaagaagaatgaaactagttcgatttatatatcattttattgcttcttaagaaagtgtcgtccttggttctttatgaatttccaattgcagccaaatatgtcatgttattcacctaatttttgtattttccaattgcagccaaatatcttctcctgttactggagacaaacctgcatacatttctgtcatctctgttaaggtattacatttagtttacttgtttacttaatgtagctgcttattacatttttttcttcaagtctatattcttctttcaatagcattaaaagttatgtgtatcctcagattagatcttgctgactcgcaagtttttggattatttagcggtttaataagaattatatcttccttgaaattgtgcctaggtagtggaatcgttgttagcctactgtagctcagataggtgatggatcatttccgttcaattgaataatttgactatttaaggtttgcacttagttttgtctacagaatcaattcatcctttttcacagtcaagatattattctcattatcactattgtagacttcttggacttccatacattcatcagtcaacttttcgatggtgcgtttttatcacagtggcacaattatttaagaggctccatctccactgcaccactgagaagtttcgtgtggacatgtctaagcttagaattggtttggttgaaaactgaggagatggaagtgactcgtggtttctcttttttggacaagtttcttcgaaaggtctgttgattttctttgtctcttgtgaactttaatttcgtttttttttccttaggatgcaatgatatcttatctttagatgtcaatatcaaatgtccttaactattcattcatttacggattttgattactttataacagttggtatcttcttctatatatcgtcatcttatatgtttttatttgtatatagtctttcacagaaggagcgtattgagtttctcgacaatatatttgacatcttcttctgccttttctggtaagtgtttaacttttctgataccaattagttttcttaatcattgcatatttttaatgcttgtgcctttattaaagaggaaagttgcggtggattaaagcaccatcgtgcggagaatacgataaggctcttgcttcatttgaagttattgacagttgaatcgagccgctcaattggtcaattatg

SEQ ID NO: 23995 - DNA, 3003 bp, Unknown; identical to SEQ ID NO: 23994
  misc_feature (1)..( 3003): 2750-1469P.txt file - cDNA_ID_2160993; gDNA_ID_2926201; Annot_ID_201854

SEQ ID NO: 23996 - DNA, 3003 bp, Unknown
  misc_feature (1)..( 3003): 2750-1469P.txt file - cDNA_ID_2161213; gDNA_ID_1620777; Annot_ID_167782
tttaagcaaaacgctgatgagtttatctgttctttattgcctggaatttctcaccctcaagtccaatactcacaaggaggattattagtgaagagtggaggaagtaatatgcaacatgtaacatctttgtcttttttgttactaacatactctaattacctaagccacgcaaataaggtggtgccatgtggcgaatttacagcttctcctgctcttctccgtcaagtcgccaagcgtcaggtaactaaactaaccaacattcctctgttttagcataatagagagattcattaacgtaagtgtttggtggcgtacgttaacataggtggactacatactaggagataatccaatgaaaatgtcgtacatggttgggtatggttcgaggtttccacagaagattcatcatcgtggcagctcggttccttcagttgtggaccatcctgatcgtatagggtgcaaagacggatctcgttatttcttcagcaataatcctaatcctaatttgctaattggcgccgtcgttggtgggcctaatatcaccgacgattttcctgattcgagaccttactttcagctgactgagcccactacttatatcaacgcacctcttttgggcctacttggttatttctcggcccattattgatttcacacctcgaactcgaacgaagcatgaaagtctatttttgttgtgaaacatttttagttgattgttaccgattagtagattcactagattctctaaatctacgaacaaataattgtataaattaatcgagtacacaataatcaatttttaatcatatgggagttaggaaaaacaaagagtaataatgagagaaagggggagacaagagtaattaatattttgatgaccaaactaatcaaaaatcaggaatttgtcttttggactttggtcggctgctttacgcttaacacaaaagaacgctattttgtctcctccacgcaattacctcttctcactctcagacattttgtcaaacagatggtgctcgtttctgaatcagcttaagaactaacaaggagacagacactaagcttggtttttctctccgattagacggaggaaaaagtgaaaacgaggggcttagacgagtgatgtgatagagatggaaggagttgagctagaattagaaagaagaagcaagttcttgaacagtttgatacagaagaagaaggctaaagaacagcaagatcagaaagatgagttcaatgttcgtgttagggcttcagatatgcctttgcctcaacagaacagagcctttagtttgtcgcgtgagattttgaatgctactccagggaaggctgataacaaaagactcgctcatgccctaaaaaaggttagatcttttgtatctctctcatgatttttctgtatttgggttgaattggagtcattgaagtctagtacttggattgagttttgaattttgacacagaatctaaaagtattgagctgcttttgggttctagggctacgtctcaaagtcgcatgctttttgtagaatgtggttatggtcttctctttcttgattggtttgaagatgtgatgaatcttgaatttggattttcgtttgtgtacttgcatattgttgaacttcatggatggtcccatatttgttaggttgcatttgactttgttccattgttgttgtcttttctatttgtagcttcggttagtctacttgactaggttgtttttgtattgcgaggataactgtagtaggagtctcgttgtgaaatgtcttgaaactggatgttcttgttgtttattgagatgattttggagctgtcttaggccataactaatgaggcatagcatgcaccatctgctaagcttctgtatctttgctgttagaaattagttgctacctaatgataactctgaagcatgcttgctttaggaagtgagccttgcctgaatacaaccttttacaaaggacttggttcgacaccccatatatagagttgtccatttatgcagttgtttctcgtgaggatattgttccttcttaaagcggctttgataattagcttttgattttaacttatggagcgaaatggagcagttccctcaatttatgcgactaggtagaggcattgattgatccatacattgattttatgaagtggttgagtaaaacaatttagtgttcacttatctgtgtgcagcttacttgtttgtctcagtgttcatcaatctcttaataatggctacctccctttggcttttaggattgacatacgagtcaatttctgctgttgtcttgttttatcttcttgttctggtaatatagatctcttatctcgaaatagatcttcatatgtttcttgtctctatgttttctcctaaatccagcttctatgttatccactgaagtgaatcttagactcccatctgtctaatgacatgttgcagctgatttaaaactatatattcacgaaacagttttccatctgtcttccatttcaggacttcgattcagcctacggcccggcatggcactgcattgttggaacaagctttggttcatacgtgactcattccacaggaggattcctatattttcagatcgacaaagtttacgttcttctcttcaagactgccgtggagccgttagatcaaaaatgagataaaacgttgatgatcagagcatcttcaatttaatccttttcttttagaattctctgtcttgtatcccacaatgtaattctgcctaagacaaaatctttgtggctcctattgtgtaattagaagtcatcttctctactgtgaatcgtttcaacttcacaatgcaaaatattgttcttctctttctcaaattctaattttgtttttttcgttgttgtgttgttgttgttgttgacattttcttctcttcaaaagagctttaaacccaaaacctctaataccaattttgctcctccgttttataagcatcaaagaaaaaaagaatcagtgaagaagaaaaaaaaatg

SEQ ID NO: 23997 - DNA, 3000 bp, Unknown; identical to SEQ ID NO: 4951
  misc_feature (1)..( 3000): 2750-1469P.txt file - cDNA_ID_2161213; gDNA_ID_1620748; Annot_ID_166699

SEQ ID NO: 23998 - DNA, 3000 bp, Unknown; identical to SEQ ID NO: 5302
  misc_feature (1)..( 3000): 2750-1469P.txt file - cDNA_ID_2161225; gDNA_ID_1620777; Annot_ID_167785

SEQ ID NO: 23999 - DNA, 3000 bp, Unknown; identical to SEQ ID NO: 5300
  misc_feature (1)..( 3000): 2750-1469P.txt file - cDNA_ID_2161236; gDNA_ID_1620777; Annot_ID_167789

SEQ ID NO: 24000 - DNA, 3000 bp, Unknown; identical to SEQ ID NO: 5296
  misc_feature (1)..( 3000): 2750-1469P.txt file - cDNA_ID_2161251; gDNA_ID_1620777; Annot_ID_167793

SEQ ID NO: 24001 - DNA, 3000 bp, Unknown; identical to SEQ ID NO: 5298
  misc_feature (1)..( 3000): 2750-1469P.txt file - cDNA_ID_2161264; gDNA_ID_1620777; Annot_ID_167797

SEQ ID NO: 24002 - DNA, 3000 bp, Unknown; identical to SEQ ID NO: 3218
  misc_feature (1)..( 3000): 2750-1469P.txt file - cDNA_ID_2161554; gDNA_ID_1620632; Annot_ID_162716

SEQ ID NO: 24003 - DNA, 3000 bp, Unknown; identical to SEQ ID NO: 3218
  misc_feature (1)..( 3000): 2750-1469P.txt file - cDNA_ID_2161554; gDNA_ID_2926154; Annot_ID_198262

SEQ ID NO: 24004 - DNA, 3000 bp, Unknown; identical to SEQ ID NO: 3225
  misc_feature (1)..( 3000): 2750-1469P.txt file - cDNA_ID_2161566; gDNA_ID_1620632; Annot_ID_162719

SEQ ID NO: 24005 - DNA, 3000 bp, Unknown; identical to SEQ ID NO: 3225
  misc_feature (1)..( 3000): 2750-1469P.txt file - cDNA_ID_2161566; gDNA_ID_2926154; Annot_ID_198265

SEQ ID NO: 24006 - DNA, 3000 bp, Unknown; identical to SEQ ID NO: 5274
  misc_feature (1)..( 3000): 2750-1469P.txt file - cDNA_ID_2161757; gDNA_ID_1620776; Annot_ID_167743

SEQ ID NO: 24007 - DNA, 3000 bp, Unknown; identical to SEQ ID NO: 5292
  misc_feature (1)..( 3000): 2750-1469P.txt file - cDNA_ID_2161778; gDNA_ID_1620776; Annot_ID_167750

SEQ ID NO: 24008 - DNA, 3003 bp, Unknown; identical to SEQ ID NO: 20713
  misc_feature (1)..( 3003): 2750-1469P.txt file - cDNA_ID_2161790; gDNA_ID_1620776; Annot_ID_167753

SEQ ID NO: 24009 - DNA, 3003 bp, Unknown
  misc_feature (1)..( 3003): 2750-1469P.txt file - cDNA_ID_2161851; gDNA_ID_1620534; Annot_ID_159829
tatacaaaaaaaaaattctttaattttttcaaccacaaaaattatgttctacaagaaaaatcattagaatcaaacccaatacaataaaaattttctgcttttagtttaaattttaatatcttaaaatgtttagaattatttttattatttagttttgaaattgaaaacctaactattagaagaattaatgcattaagtgtttttgattatacaacaccatagaaaattattttatattttatttttatattaaaataaatattagtgtttttttaaatattttttttgatcaataccagtcaatgcttgtcttcaccggactaaatttatcggtgtaccataattttatgtatatgatgttaaccacatgaaatcgtatagctcaaatatgtgaccatgcaaaacatctacttcgtgtagctaaggataaaataatatacttgggatgtatgatcatacattctctgatacttagtgtagttagaaatattttttccttagatttatttgttcaattgtgactataacaattagaagatattttctattatatatattgaaaaacgaccacgtttaatcgtatcgtcgatatgttttcaattaattatctaatttttaattaaaaatgtactaaacacagtgacaagcaaaataataataaaacagttaaaaatatgaaaatatgaatgagtctatggtgcagttttgagaaaaaagttttgataatacttttcttttagaaattatataaaaaacattaatgtaagaaattattatgattcctatagacaatttttttgcctccaccactagcacctctatgagtctcttactaatataactattagtgtttttaatgtaattaaatgttttaattaaattcgaaactataaaaaaatttaaccaatcataagaggaaaaatgtaatttagaatttttagagtttgttatttaagagagtcttcctactctccctccttactttttataattttccatactcttattgatgagtctctaattaagaagaccatcaataaaatacactttaactgtcatagtataatttataaactaaaattagtgaaactcttctataaaaatactatttggtttctttatattttgaaaaagtgggtgattggttcgtctatatcggtagatttattgcaatagaaacgttgttctaggtgtgatgattggttgtagaaataaaatttgggtttataatgtattttaaaacaaaacatataattggtaaataatagttatgtgttatataatattattctcaaatatcaattttataaattatgatatacataacatatatatatgatgtatttaagaaacaatgtaaattatatatatatatatatatatataacccaataaaaagagttatatatatatatatatatatatttcataaagtagttattttaaagattacttatatccacaaaaataattttttcataatatatatggatgaaaactataatattttttttttttaaataaaaaaaaaaaaaagtggaaagaggaaaaaaaattgtacatcccacctaaataccataaaatcgtactctaaaaaattgtacttaaaattattattttggctgtgagaaaaaataagaaagctacaataggggttgtagcttttttgttggctttatacatcttctaatgccctaccaattatacccaaaacattttttttttaaatgttaaatacattgctcaacaaaaaatattatatacaatagaaaaatgaaatttgcaagattatccataacatgggacatgaaaaatatcatggatctgagtttcgatacaattccggaaataggtgttcaaagcttatggatccaaattcagatatttaaatattttatatgatattttctgttagtctttttatttattgaaataatagttaatattattttaaaattttcatctattttttgcagatatgggtagttgcatatattggtggatccagatcttgatatttgttttatggatctaacggatccagatccagataggtggtttacggatccagcagatccggatagctgtttcacggatcatgcggttctagatctgggtatcccaaaatttcacagaaactaatttcatgttcatctttctatctacaaccggagaaacaaaaacaacatgagaaattgaaggagttcgatgatatgagattattacctttttgagtaaagcacggaatatctcgtctcgagattactaaggactttctttgaaccttgtcgtcatgtgctttggttgttttgaaaagtaagggaaaaaataggaggcggagcaaatagattatgttatagaattcagagagatgcatatttatataagaggagcaatattttgtgaattctagggttttcagaagatttatttcctaaatgtaatacgtttttagtaaagatatttgtttgataaaacttggaaaaataataataatgacgaccaactatattgttaacaatatcttactgaaaaaattgagataatcgcctataagatgtttaaagtaaaatatttcaaataaagttccatagaaatattgtaaaaatatgttactatataaatttctaaaataaatatcagttcaattaaactaaaataaactttctctaactttgacacatcaacctttttatgtgatgagaagctgacacatccttaaaacaagaaaccaatcaaaacattacaaatactacacatcaaattaatatctgccacatcagattaaatggatgatttcagcttgttggaaatgaaaacaaaataaaaagcttgaaaaacttgtcaattcctctttgatctttccgtctttactttctaattctcgtgtatctattttgaatagttgtaatacttgtatcagtttttaaatttaattttaggttaggttttgtaattaagttcgttaaagaaaaattaggaattagcagaggggaagatatg

SEQ ID NO: 24010 - DNA, 415 bp, Unknown; identical to SEQ ID NO: 2426
  misc_feature (1)..( 415): 2750-1469P.txt file - cDNA_ID_2161867; gDNA_ID_1620534; Annot_ID_159833

SEQ ID NO: 24011 - DNA, 3003 bp, Unknown
  misc_feature (1)..( 3003): 2750-1469P.txt file - cDNA_ID_2161877; gDNA_ID_2214699; Annot_ID_189602
ctatcgatatttcttttctaagtatgcgagacattcgttggaaaccatgtatatggtgtaaacagtgaagtacaataggttaatttaggagttttattcaaaaaagcttagaatgttcaaatttctacttattatttcgatttgagaaaattcagctttattcttcaccaatacgatttttatttaattgattaaataagctttttttttatataatcaatgtcatattctttttggtctatgctcggaagacgtcaacaaggatattggttccctaaagaagaaacctcctcttttattgaaaaaatatctctcacgtattgattgatatgtaaaaagatgtcctacatgtgaatttctatgattgtgaaaaaagaattattttttacttttagataacaatgtatactctatggtaacattgcatcaattatgaatggattggccaagtataaaatttaattatgattatacctcaaattcacactacttaaccatctattttcaggctattccattaattagtttttattaacacagtaatttatttgagaacagatttgaaaatattttgctaaactacttaaccttagactaactggaaaacaatatttaactaagtgtctgctaattaagaaaattaaagtatcgttcaccttctagacacactatgtcgattactgttttgagtgcaactagtgtattcgaaataatacttgggtgaattaagtttaagctttgagtaactaaaaattatatataaggatccataagttttgttgaaatagaataatcggaacttttacattcaaaaactttttcatatatatacagaaattcaacccccaataaacaaatgactaatgagtgatagtctgataggtgttaatgactgtcttaatatgagatacataagaaattttgaatggaattatttaataaatgtgaattatgtgggtgacttgactattcagtgttcactgaacacaaaaaggtaccaaaaaaattattccaatcagtgagagatcttcaaaggaaagattctcattcgcgccaatatttttgctgggaaaaggtaaaactttttagattattctataaattattttgctgatgttcccttacgaaaaaaacagtattcagtaccaaaatgtctggcacatataatcgtatagacgataagtagttgtcgaaattttatagggcaatggctcaagcaagtgaaacattgacacctagcccattcacatctatgtcactatatatgtgggttcacaaaggtgacgttttccttatgtgaatcatgtaaatgctataaagttttgtagtacatgagcgattatatattattacgaaactcctgaaatatatgatatataatcagatgggttgaggtagtgacaatagtttgtaagtgcaccaaaatacgttttgagctattaagtccgaagtttaggtccttttaagttatcgaaggtatgcttaaaaaaatttactaccttttagtttttttttgcatgatcgttattcgagaaacatgctgacgcacagattgatcagacgctgtggtaatccaagtgatagcaacaacacaaaatcatgtggagaatgatgatgatgatgcacatatggatttgcataaattttgtaatctccgaaatattgtggagaatgaaggaggagaaacataacattttaaaaatggataaagaaaaagaaagtgatggaaaaataagtatgtggtagaaaaatagggttccttcttctcatttgtctctttcaagctttatgatgcaaagcgacccttctttttcttccctttattttcttttattgttatcgttagtgtcactttctttttattaatttcataaagtcgtatgatcgtatccattgtttttattttgctccgacaggaccgacactgatctttctatatctttcggtaattaatgttataggattcctttttcagatcacatcatttgtattttatgttattttcgtttaacataatacactaataaaatgacttcataaaagatatggtttaggttggggaataaaagatatggtcgagccatacttctaatccttaatttaggttgatagaacatctaccgtcactaacaagtaatgaagtcagattaaaacttgatcgtgacaaaaattgtcccatatattttaaatgaacatgataacatattaattgaaaaatgttttagtgacttagttgtattgaatagcaaaggcaagtaagtagttatatacaatgactttcctatactcgagaagaccgtatccaagtaaatcaagaagatcgatatatatctagccggatctttggattgtcaagtgtcaacaatcttaattagatcaaaacagtctgttttaaaacatatgccaagttgtcaaacagaaaccaagcttttcatcactcaaaggagaatcacaaattctgcatggcgtgggggatagatatatatcatcgggagccactgagtccaagaaattgaatctattgacttcctattgctaatctatttcaaaataaccacgtcagagagatacgagtacatgtaatatcaatgagatattttcttaggagtaatttgaagatatttaatttgcggttgtaataatcccttttgaaaataatttgacttgtacacacggcaacaaaagaatgatctaaaggcaagtaacaagaatctgagtatccaccacctcttcctgttcctgttcttgttcctgttcgattccaaactctcactttctctgcccccctcgtgtctggctcccaccttttgtgtccactcaaccaacaacaacagtgtatctcttctcctccgttaaataactttatatttccccgttacatttccttattgtaacaaccaaaaaataattcacctgagactcacattctttaaggttttcgcatttaatatttcactttcttgaaatctcctatatttttgttatatatggtcgtcggcgatg

SEQ ID NO: 24012 - DNA, 3003 bp, Unknown; identical to SEQ ID NO: 24011
  misc_feature (1)..( 3003): 2750-1469P.txt file - cDNA_ID_2161877; gDNA_ID_1620849; Annot_ID_170272

SEQ ID NO: 24013 - DNA, 3003 bp, Unknown
  misc_feature (1)..( 3003): 2750-1469P.txt file - cDNA_ID_2161894; gDNA_ID_2214699; Annot_ID_136830
gcggtttggtttaatttgtgtttggtttacttatttttgaatgtgtgtagggtggttatgttgactgctgcaacggcgtttggagaattcaagggacattagcagtctcacgaggaattggagaccggtacctcaaggagtgggtgatagctgaaccggaaaccagaacattacggattaaaccggagttcgaattcttgatcttagcatctgatggcctgtgggacaaggtaagcataacaagaaatgcatgatttcaaaaatttgattttcatttttggtctttggatttaatgttgaagctggtttgtcctataggtaacgaaccaagaggccgtcgatgtcgttcgaccgtactgcgtaggcgtagagaatccaatgacactttctgcttgcaagaaactggctgagctatcggttaagagaggctctttggatgatataagtctaattataattcagctacaaaactttcttccatgatatattaacacatagtacattagctaaacttaattaatttcattaggtcgtagttattaataaattttgttcggtattttacatgtaaatacataaaggtttggaaaataattaatttattgttattgttcttagagataagctccaaaatatttttggtttacgatataaacactacataatacatgaaattgcactatctaaccatttatcatcctttttatcctcaacttttttattctcatgcattttgaaaaccacattctaatcatatttctgcttttatgtgtaaaaccaacaaagatgtacatggttgatatacacacgtagacataaccttgacaagcaacatcttcgtcgttactcattttacagatttctacccatctgccttcaataaaacaaacatcaaccatattagtaactgcatggtaaccaagcatacgtgagtttttgttgtaaggaccggtaaacactttgaacctataaacacctccgcctcttccaacaactcagaataatgaacaagatcacatgctaaggttttgtaatgcttcttacaaacaaaagtttatttaaaaagggaagggagagtttataaaatataaattagcattgacattggtgtgaggttcttcacataatcatatcattctgaccaaaatattagtcggaaaatggttagaaacacaccaatatgagttgttttcttgtagttctgagaaaacatagatgaaccaatatatcaacgtaagtaactaagataaattgtgaatcatgagaatgcaagaaatattttctcatgattacatgagatgaaatactaccttacaattcatcaaactttttgtagaaaaaggtattgaagaaatgaaaattggatgtagacaaaaaaataaaaaattcttgctgcaagatcctggacaaagacaataatcacattaagaacaatgtaaattttttaaaattagtaaaaactctctataaattaataattcacaccatttaaattttagaggaggtgatgaaaggacattatcatcaattttggtagttaacccccaattatttaactaatcaagatacaaggggtacaactgtaatatattcatagtttggtgtgttttctacaatattcagaaacacgatttaagacgattgaaactaaaaataaaaagtgtcggacttgtaaattttcgctcagcgatctgcttccaatggcgatctacttcattctctatacacttctcacgatcatcttcgccgtatctctgagtttatttctttccgtgatcaatgcaagaaagagcagaaaacgtgcggtaggattcttccatccgtacacgaacgacggtggcggcggcgagagagtgctctggtgcgccgttaaagccattcaagaggaaaatcccgatcttgactgtgtcatcttcaccggagatcatgactcttcttctgatagcttagctcgtcgcgccgttgatcgattcggtgttcaccttcagtctcctcctaaggtcccattactcctaaagtttaaatttttatcaatttgaattggttctaataacacagaacctctcagatttgagggcaagtttcaattttgcaatttgggttagttttgatgcaagttttgtgcttttgttggttgttgttgtgtggctttaggtgattcatctaaacaaaaggaaatggattgaagagagtacttacccacattttacaatgataggtcagagtcttggttcggtttacttagcgtgggaagcattacgcatgttcactcctttgtatttccttgacactagtggatatgcgtttacatatcctcttgctcggatctttggttgcaaagttgtttgctatactcattatccaactattagtttggatatgatttctcgtgttcgtcagaggaactctatgtataacaatgatgcttccattgctaagaggttttggttatctccttgcttatttggtgtttttcaaaagtgaaaagtttctatttctttgtttagtgtaatgatgtttgttgctttttttgtgtagcaattggttatctacttgcaaattagtctattacagagcttttagctggatgtatgggatggttgggtcatgtactcatttagctatggttaactcttcgtggactaagtcccatatcgaagtgctttggagaattccagaacggattacacgggtctacccgccctgtgatacttcaggacttcaggtgataaccttcagacagctcgaatcttatgatttttgtctgttttctggttacatctcagtatttgctgacatcttgggcttattgcaggcgtttcctcttgaacgatcatctgatcctcctaaaatcatatcagttgctcaatttcgtcctgagaaggtgagggatccagtatttgacttatgagaatagggtactatagttttgagggctcacactccaaagttcaaaagagtcgtccagcttactcaattacagtcttgtaacaggctcatatg

SEQ ID NO: 24014 - DNA, 3003 bp, Unknown; identical to SEQ ID NO: 20955
  misc_feature (1)..( 3003): 2750-1469P.txt file - cDNA_ID_2161894; gDNA_ID_2214699; Annot_ID_189609

SEQ ID NO: 24015 - DNA, 3003 bp, Unknown; identical to SEQ ID NO: 20955
  misc_feature (1)..( 3003): 2750-1469P.txt file - cDNA_ID_2161894; gDNA_ID_1620849; Annot_ID_170279

SEQ ID NO: 24016 - DNA, 3003 bp, Unknown
  misc_feature (1)..( 3003): 2750-1469P.txt file - cDNA_ID_2161950; gDNA_ID_1620535; Annot_ID_159844
tatacaagcttgacacccgtgaaagttataagcacgattgcgaaacattgatttcctttgaagtggccaagagagatcgtcgtttaacgattattggtttataattaagtaccttttaatcaaaatataaaaggactagtcatatcttgatttttgcatctcccaacaatttatttataataaacatatttagctttttcttgagagcttgtatcaatttaaaagtttcttatagaacacatgttgaatttgtgtaaagaataaattgtgatgatactatatatggatatcacatcatatcaaaatcttaaatgtattataaatataataattaaaatccagagaaaatcaattttcttaattgaatgtttgtatatagtaatataataatttcatatgtaaatattccatttaatttggattatagttttatagaaagaaagtattttgatacctttttaaattttatctcaaataaatttgttttttaataaatatattgtgatttcagtggataagttttatctttcatcacttttagtttgttaataataaatatgaatccagttagatctcctctgatcactggctttcatctagaaaccaactaagagttttgcttctcattgcattggaatggtggtaatctacaattatgggctgactcaatttaatttgcaatgtcaccaccactgctcctcttctatctagcaaacaaatacttaattgcatttcgaaaaatcaactagtctgtctccattatcatatacataaatacaaattaacatcagaaaaaatatacatacaatctttgcacagagtcacattttcttaaaatgtataagttatttcatccggttcttatagtgaataccatatgtatatccatgtatataaattgatatttcaattaacattaaggaatcacaagcatgcatattctctcgctcccacgcaaacaaaaagtgcatgcagcctaacgtgatctctatcgttaggtagctcacaaatgacgaacctaaaccctcttcaccataaatcaaatcctcctccgctctatataaacaacaaaaaaaacactaaacacttaaataaatcaaacaaacactccacattctcaaaatcatattttcatataacttataaaagataaaagaaagaagaagatggcagcttcgtccaagtactcttccatgtcattcatgaaggtggcaatgatggtggcgctggtcttggtggtggcagccactgtggtggatggacaaagctgcaatgcgcagctgagtacactgaacgtgtgtggtgagtttgtggttcccggagctgacaggaccaacccaagtgccgaatgttgcaatgctcttgaggcagtgccaaacgaatgcctttgcaacacgtttcgcattgcctctaggcttccctctcgctgcaacattcctacactttcatgcagttgatatggatcctcatattaattctagacgctatatctttgtaagaacatacaatataacgtttcaaatacatccatatatagtttcatatgtttaataaatgtatctaaaagcttttttttttggtatttaacaggagaagcatgtatgggaagtaaaggagatggatatctaagaataaaaactcaaagtttgagttttttttttttttttttttttggtttttgttcttcactgcaaaaccaatgggtttcgaataataatgaataacaccgaattgaaattataaatggtttgagttatattatcaatttataatttgtatacatgcaaatatatcttatatcacgcctttcaaagtagtatgcatgtttaattaattggttattggtgtgaccaaacgaaccttttggttcttatacattcgtttgataattcaaaaattagggcctaggggtaacgtactgtaaaattcgcattataaattccccacacatcagatttgaaagaatttcgtccaaacacacaactgaagaaacatgtagtatctaaatttttaacatgtcgaattagagaaatcaaggtgatgttttgccatctcaaatattctccaagaattttgcttaaatgccaagaaaatttgtaaaaaaaaaatatatatatgaagaccagagccagcggtaaattgaccaaaacatccctagtagtctacctcaaagcgtgtggaggttgaaacgctcggcggatatcacgagctcgggccacacgctcatctctagtctcttttacattggctttacaaattttaaaatgaaacacgaattttatcgatctacaaaagttttgttttatattctatggtacagttacctataatgaaaaaattaaaataatataaattggtgaagagtcaaaatgtagatcttttaggctttttagctcaaggcttgtttttctctgttagaaaaagttgctgttattgttttattgtttctccctaattagtcaaaatcttgagggaaaatgacaaaagaagaaacccatgtggtcaaaatcgaagcttttttgtgttttggtccgagtaaactagggtttcgtttgtcttttttaacctttctaaaataattattcgaaaaatttggcttaaaaggtcaaaggtacaacttgagattttggggccatttgagttattaaaaaaaaaaaaaaggggagaggacaaaaacagagtattgaacaaaaaggggacaagtcatatgatataacaaaggaaagatctttctctttcatttgctgatctcactcgtactatagactaaggaaagatctcatttggtcgtcagtaaattttctgatttgattgaaaggtatgaaacttgatgaacaagcaacgtaaacactgagaaaatagtaaaagcagtgacaatacaaatatatgttgtcttgcattatgttcttctctccattgttggttttgtctttcttgttttttttttgtttctctataacttagattattgactatttaatttggttgcagagagggaaaatg

SEQ ID NO: 24017 - DNA, 3003 bp, Unknown
  misc_feature (1)..( 3003): 2750-1469P.txt file - cDNA_ID_2161987; gDNA_ID_1620535; Annot_ID_159856
ccgtagagttgacgaatcatgccacttaatgtgttacaggctcaaatatccaacctatatgagcccagcccacttatttataacaaagaccttaggccaagagtccgtccaaataacaaaaacgacaaacaaaaataggcgtcaagtaaattaagaatctttcaacattattgagagcctcattttttatttatattttttatattattaagaagcactacataattgaaaaaacgaaaatcttttaactaatttttgcttttctaaaataggacaaatggatttttaagttacatattttctaaatctactatttagcttcgagtatggtgtaatcgacaaacgtttatttatccaacaattaccatttgttgaaataattattttattttgaacacaaaaacaaaaacaaagtcaaaattagagatgatatattctttttttaattaaatttctctgatatgatattttaaagttttcaattactaatacaaccatcttttacgatataatactcgaaattaaacacaaaaatcaaatattctatattagacaaactatttagattgcacttagaaacacaattatgtaaatagcacttggcagatttactcacatttggcaagcagaataccagtcaggttagaaccgcatgcttcaaaaaatttgacatcaaaataatcatcaatgttttcaacttctgcaactaaaatgtatttgaagttttaaacaccttcttctgtagtctcagttaaagatccaactccattgttaaacactaagttttaaacggttaaaagaatattagaagtgaaatttttttagaaactatgttatgatatattcatgtggaagagagagagcacatatttatattggtcaagaatttgtatttggttatttaatgagagatttcataagttgattttggaagccttcaatgtcaaggcctcttagagtggatccataggtattttgataagaatcatcggcacatgttatgtcagtatagatgtgagtacagagcactatgagagaactaatattttcaaatacttgttcatccgaatactttatacctaaattattccaaattattcgaaaatactttaaaaaatctaaatttatttgaataaaaaagataagtaaaaatttatcatataatatttgggttggttactttgtaccgaaatcactacattaatcatctaactataagttagaggggtataaaatttattagatgggcttcaaatatattttaacattcgttccgttctcgtgtaatatccgatctaaaccgatatccgaaatacttaaaaaagattcagacaaatgggtaaaatattattttaacctactataataatcttgtctaatcggtaaatgttatttattcaacaatcgccattactataatcaattacttatgatagtaatgacgattaaaaactactatatacttattatagtaaagtcattattcatttggatcaatcaacaaaataatatggatgattagaaaataattaggattatttgggattttttcttttgaggagtaaatttgactatttgagtaactttctcttaaaacattaaacaaatcttacattaatataccagcttaacaaaattatcagaacgcctagcaacttagtggcccaagaaaaatatgtcttttagtgaaccagatttcttcatagataaaaagtttagtcataatccccaaaaatttatgaccaaattatggagagagtagctgagtaggggatatagaaaacttgttagacaaaaaattaagagatgagatgtctaaataacatttaaaataaaaataaaaatttaggagacaaagaagatgagtgcatttaagagagggacagcacatgttttcatgtgcttccaatacttacgccatttttttatccgtatgattcagcttctaatcattttataatcagctataaacaattttaatactttgtcattattagaaaatcaaaatcattaattctgatgagttggtttggtttaaagtatttcaggaaaatagtttaagattgcgaaaaaaatgaagagaaatgttgaaattatcaaaccaataatatctactgatactagaaaatagtgtatataaaattctgaaataaatgtgttatcattaatataacacacgcaacatacatatattctatggtgtgtacagctgtatgtacataaacataatgcatgatggatcatgacgactatgtggcatgcagataaaggcatttctggtttttcttgggtccaccaatactatcaataatggtgttatgtgcgatgtgtttcattcaagtacaataaaaacaaaatataacttattcccttcaaatttaatttcacaactagaaggtagaagccactaaacctcttcacactcactcatgtaactattaatttaaattaatttgaataaaccctacaaaaaagaaaaagcgtaacctactactctttaacctgacaaaaaatggaagctaattttccatacaaagttcactttatattatacaagtttaattacatacaatcttagacttttttgtaagtcacaccaagcaataaaaagggaggttggggtgtctattaaatttaaggacccataaaatcaaccacatttatatgccttactgcaataaaaagaaaagcacttttcaattcaattaataaactattaaaagttaatttcctactcaatcaaacccattaaagcagtaagaaaaaaaagggtttagatggaatctactaataactcactgattaagttttaatattaaaaaagttgtacgaatcaacctttatattgtacaaggaaagtgatcatcgcagactgtaaatcaggttttgttgttttgttttagtttcctcctacattctttggaagaaactaatacaaatcagagaatttgagaatccaaattttgggttgaagaagtttttgtttctgtagagaaaacaatg

SEQ ID NO: 24018 - DNA, 3003 bp, Unknown
  misc_feature (1)..( 3003): 2750-1469P.txt file - cDNA_ID_2162054; gDNA_ID_1620536; Annot_ID_159878
tgcagaggcgcttgaggcacgtatcactggaaacatctcaccgcctgtttctaatccgtttccttcaagcacgacatcgatggtggacattttgaaagcgtacaagctgtttgttcatacttgtcccatctatgtaactgattacttcgctgcgaacaaatcgatttacgaacttgctatgaaagcaactaagcttcacatagttgattttggagttctctacggctttcaatggccttgtttgttacgagctctgtctaaacgaccgggcggaccaccaatgcttcgggtgactggaatcgagctgccacaagcgggttttcgtccttcagaccgcgttgaagagactggtcgaagactgaaaaggttctgcgatcagtttaatgttccttttgagttcaacttcatagccaaaaaatgggaaaccatcactcttgatgaacttatgatcaatccaggagagacaacggtcgtcaactgcattcatcggttacaatacactcctgatgaaactgtgtcattagactctccaagagacacggttctgaagctattcagagatatcaatcctgacctctttgtgtttgcagagattaacggaatgtacaactctcctttcttcatgacgaggttccgagaagcgctttttcattactcttcactctttgacatgtttgacaccacaatacacgcagaggatgagtacaaaaacaggtcactgttggagagagagttacttgtgagagacgcgatgagcgtgatttcctgcgagggtgcagagcggtttgcgaggcctgaaacctacaagcaatggcgagttaggattttgagagccgggtttaagccagcaactattagcaaacagatcatgaaggaggctaaggaaattgtgaggaaacgttaccatagagattttgtgatcgatagcgataacaattggatgcttcaaggatggaaaggaagagtcatctatgctttttcttgctggaaacctgctgagaagttcacaaacaataatttaaacatctgaaaaatgttacttctcaattacatcatttttgtttcccaatggttttgtagaatatgtttgatcccgtgagtggatgcaactcttttttcctgcaagtacatattgtattcaaatccttgtggaaatgataaattgtttaatcaaagatccgaagacaacacgagcacttttaacccaaacaaattcaaaacttttggctataatttatccaacgggttgcaacaccacgggaatgacgatacagacagagcaacaaacgatctactagaacatatgaaccgatgtaactaatagcatatagattgctgtagttagctaatttaaaccctatttggtttgaggttttggtggcctcaaaacgctccagtccaccttcttgctcttgggtttcttaaaaccattgccctttttattgctcggtgatggtttgtcaaagctccttggggacttgttaggacggttttgttcctcggagactacctcagactgttttcttttcaagtcaccatctgtttccccacttggctcaacctttgaactctccggttcactgaaagaggatgcattttgactagttaccgtttacaactttaacgagaagcaaaatcagaaatgaactaaacgataagtaggtgataaatctatttgcaaattgctatcagtaacgacttcatttgtctcaaaattagatgatcagtaagacaatagatctccagcgttgttctgttgtatgcacactctctggaaataacaaagaaaggaatataaaagcaagagtacagacctaaaagacttttttcctccattactgctagagcttgagggatttccaccgtttattgcctcttcatgtaatttctaaggagaggacagttttatttagaaagctgaaagatcacaaagtatttcaggccacagcgtcacagatactaacctcgatagagggattgaaagactgaaaagacatgcgtcctaacaatgctcctggctgaggatcccaatctgttatgaccacactgcatcgaaaatcacacattagtaaacactacaaaacacataacaaaagggtagacaatagatacacaatgtccttgtttacagtaatctgatgaaagcaaaacataaacatcaagtaagaagaaataacggtaccacttctttgcaacagtcctaagggaaggaaaactcccattaggctcttcttcatcagccttcttcttctctactttcagagaagacctttgcataaactatagacagagagtattatcaatcattattaacacgtatctttttgtctctcacccaaaaccagattatcaactaagagctacatgattgatataacacaattcttcagtgaaaaattgcaactttagtcccaaaccaatgtttataattggtgctaagctcagtgctacccccaaggtgaaatcaacctcgaaggggattatcaatttgtccaagaatcaaaacccagcttaatagagaaaagactaaattttcaagctcgaattcaattcaatttcagtaatttccttgagtttcaaatctaaggtcatgtaacatgaataaagctacttctacagagaaagaaaaaagacagtacctttagatttctcagagtgctactaatctctctcttcgccattatagctttccaaaattacaataactacgatattcccgttaccgtagaggaggaacaacaactccgcgtgtgttttcgtttttctaggtttagaagattttccgatttgaagctccgtccaaaaaaacacacttaggtttaactggtctacacctaaccgattcaaaccgtgccaaattgatttttttattaccaaaccaaagattctattggtttaattttttggtatttatttgatcatgtctgaagaatccaaccaaatccaatctgaaaaacagctgaacataaaaagtcaaggaagcaacttgaggagaaaacaatg

SEQ ID NO: 24019 - DNA, 3000 bp, Unknown; identical to SEQ ID NO: 2444
  misc_feature (1)..( 3000): 2750-1469P.txt file - cDNA_ID_2162062; gDNA_ID_1620536; Annot_ID_159880

SEQ ID NO: 24020 - DNA, 3000 bp, Unknown; identical to SEQ ID NO: 2441
  misc_feature (1)..( 3000): 2750-1469P.txt file - cDNA_ID_2162072; gDNA_ID_1620536; Annot_ID_159884

SEQ ID NO: 24021 - DNA, 1071 bp, Unknown; identical to SEQ ID NO: 2438
  misc_feature (1)..( 1071): 2750-1469P.txt file - cDNA_ID_2162090; gDNA_ID_1620536; Annot_ID_159892

SEQ ID NO: 24022 - DNA, 17 bp, Unknown
  misc_feature (1)..( 17): 2750-1469P.txt file - cDNA_ID_2162132; gDNA_ID_1620537; Annot_ID_159914
gaattcaatacgagatg

SEQ ID NO: 24023 - DNA, 1198 bp, Unknown; identical to SEQ ID NO: 2448
  misc_feature (1)..( 1198): 2750-1469P.txt file - cDNA_ID_2162180; gDNA_ID_1620537; Annot_ID_159930

SEQ ID NO: 24024 - DNA, 3 bp, Unknown
  misc_feature (1)..( 3): 2750-1469P.txt file - cDNA_ID_2162191; gDNA_ID_1620540; Annot_ID_160015
cct

SEQ ID NO: 24025 - DNA, 3003 bp, Unknown
  misc_feature (1)..( 3003): 2750-1469P.txt file - cDNA_ID_2162211; gDNA_ID_1620540; Annot_ID_160020
cactgaaaaaaatagatatagagaggtaaaatccgattaaatatgaaagttgctatgtaggcaattgtatagtttacctaagattataaaataatcctacgctttgaatcgttgaaaatgttttgacacatatatggtctcgtctcgtctttctaaagctccaaaataattttattaaaagcgtgtgacttttagtcaatatttacatttattggattgagtcatattggtctataagtacaatattaaaattgattaatacgaaagtaggtcaataattcagacggtcaaccacaacaacataattttaatgattccaaatcaaccctttaaacttccttcacaaattgaaatctttgataaattttaatggatacttttttaaatgataaatgactaaatcagacactgagaaaagaaacaaaataaaaaagtttacagaaggtagaaaaatacatgttcaagtttaacaaactcattaaaagattttcgtgttttttttctttctaaccatgcttttgctttcttctaatgtgtatgtacctgaagacaaatagagacatgaatgctctcttcaccattcgtgtgattacagtgcgttttattttccgtttctgttcacacacgtctcttcttttctcagttccattccaacgccatgatcttgatccttgggttttgtcgtcaaacttccttcacggtttgtgtaatttgaacccaaacactctttgaacatagttttgtgttgccttcgctggcttgagatgcccataagtcatcaggaacagatgtggaaacgttgtcccaaagtaagctccatcaatgtctgttcattcttttaaggaaaaccgcaaaaaaaggtaacaccaaagatcactagaaactcaaaagaaaaatcatttcttcatgcaataagaatcaaacatcaaagtttttcagaactgcatttatataactctatatcagcagaagtgaaactgtagaaaaaaggatactgccttgatactttgatcgtgggtaataaatgtcttcgcatttcgggcaatatatcttcacagtgctagatcgcggtaagtctgattgaccaaccggaagacaaggttggccacagcaataaactcttggacatcttccaaagtcatagtttttgtatttgtctaactgcaaataaacagaatcaatctgtgaatcttttatagaatgtgaaagacatgcaaatgagtgtttaaggattttgtttaccattgctgccaatcctttgctagtcaatatgtaacgagcatgaatcagtccatacaacatctcagctgctgactcgatcaattcattctgttcctctgtaaacatctctcctgttaccgaccaatccaaatcaaacattcaagagacacaatcgtaaaagcgaacccatatcggtttccctactatccctaaatgcagatgctgtgcctgtacctagctaaaccgcaaaaactaataaaaggataacaacttaccttgagaagattcaacatccaaaatcaaatcaagagcgtactcgtagtagggaactagactgctgagtccacacaagttgaagtcatcttgaatgtaatcatcatcaacttcacaaaagaactcgtttcctcttagattacaaaaccaagatatccatgaagtgtcctctccatcagaaccactcacatctgattcttcactatctgtgtctgattcatctattcacatcaaaaattccataggctaataaaggaatttgcttaattcagctcatggagataagatactaaacataaagatcaaaacttgattcccaaatcaggaaactctagggttaagtatctgtttctaaatgtagattcgatttcaatagagcaagagagactaaccatcagaaaccgtattgttcttcgagagagaagcagaacgagaatctctatggttgatgttattcgactgctgcttcccaatcaagttcgccgtcgtcgtcgccgccgtaacggttcctttgcctttgccgttaacttgacgagaggttgaaggagaaggacgttcaagagcgtcgttgatccgtttacgatccacaacttcaggtctcgaattcaccgttcctctgtctctatacatgattctaaaaatacctgataaatctctctcttacagcagctattgtacaactttcatcggcatgtaatcgccggtgagagattgagaaatcgacggcgattaccttgagctctagggttttgcttcttcttttattttatttttagcttttgtcgaatcttgttctttcgcgtttcgcaactagtctgtttcgtacagagaaagattattattttattttttggtcaccgtttaatttttgatttgaaaaaaaattataggggtaaaatgggaaatagagaaataaagagctcccggagacgagggagtgaatcggtagctaagctagccactagagagaaagtagtgggagagatgggtcgaatcgaactaaccactaacttctggttcaacacgtagcatttcactgcacagcaacgaccgctcttgtttctttaattgccattttgccaatgttgcccacatttgtttttagaaatatgctcacttaacaagatagacataaattacttacataaaagaataaaaaattttgtattatttcttttgtctttttaataacatagttggcacatacattattacaatattttaagatttttttttacagtttactaatgataatctttcatgtcacgtatattattagatttttttttgataatctttcagtttttcttgctgtaatttgttttaaaaatgaccgatttgtcttttaaccaattcatcatccaaaacatcaattagtggtttaaatggcccaagaaagcccaacaggtgatgaacaccggcaaagtcttgtcacgtgaccagcacatgaacgagacgatttacatctttctttagtcagtcggtcgagtccgagagaggagaacaatg

SEQ ID NO: 24026 - DNA, 3003 bp, Unknown
  misc_feature (1)..( 3003): 2750-1469P.txt file - cDNA_ID_2162338; gDNA_ID_1620539; Annot_ID_160005
gaaatagaaagaatacaaaacgtacggatgttgttaacctaaacacgattactaccgagactaaagatgtctaagtttaatactaagaaaagtaaaacaatttttcgagcagatatatgaatagtgattttttgggtcaacacataatccacccaacgttgatttttgtttgtcgtttacaatctctaaaacgtttattttctaagaaatatacgtgtgggctcattttaatgcccttcgtgcgtctacccgacgactttgtttactcgaaactatatcacacactacaccacatatttcaacatcacactgtatacacacatttatatatacatgcagaccgattattataataatattttctccggtccctaaaacatatatatcattcattcccacatgagatataatattatgtaaaacatacttttgactatgttgccaataatcaaaaagacatctctctctctctctctcacatcctattttccaagaagctcaccaatgcttttgaattctcccacatgtcttttgacaattttagtataaatactcaaaccccttagtcagtcattctcatgttcatcaacagcatttgatctcaagctcataggaatttgatctccacattatatcttgatcatcaccacaagaaaaacatttcaacttcttttatcagcaatcacaaatcaaagagatgggaagagctccatgctgtgagaagatggggttgaagagaggaccatggacacctgaagaagatcaaatcttggtctcttttatcctcaaccatggacatagtaactggcgagccctccctaagcaagctggtatgtaaaaattataatatcaaatttcttaattttgatcaaatttcttacattaattattggtaattattatttacaggtcttttgagatgtggaaaaagctgtagacttaggtggatgaactatttaaagcctgatattaaacgtggcaatttcaccaaagaagaggaagatgctatcatcagcttacaccaaatacttggcaataggtattttacttcacatataagtatataaccgacacacaagttttattttgttttcttactatatataaatcaccaaaagaaagtaactttatacacacgtctaggtcgcactactattcttttaactacacaatgatcggctctttaattacttttgtattgatgttcttcgttttccttttggtatcatctttagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtggctggtttagttgagatacaacaagagtttcaaaacttgggctccgctaataatgagatgatttttgacagtgagatggacttctggttcgatgtattggctagaaccggcggggaacaagatctcttagccgggctctagttaacatgtttgaggagtaaagtgaaatggtgcaaattagttaaggctaagaaattcaaaagcttttgtttaccgagaaaaaaacacactctaactcttgatgtgatgtagttagtgtattaattagaggctgcgttttcaaaaaattgaattcatttgtttctccaaaattgagtagtttagcttgtacgagtaattaataatcaatgacaagtaatcaaagagtctacgtatattaatattgccttgttgatgaaataattatccaacaaacattggatgccactataacaacaacagcaattaaaataatataagtactagattaattcactgttataatcattttctaatgaggttttgaaagttcaactatggcggaaaaggtaaagttacgtagttttataataaataacttgagaaaaaggagcttaatgatcataaacatttttaattaaaatctcaaatctctaaacatttgtagtttatgtgttaacgacgtctatgcgtcatcatccaaatttaagccccatattgatgacaaaaaatatttaaattataattatacaaaacatataaaactattgattacgttttttttggtaaggaaaactattgattactcttaaactagatgttgtcctttaagataatagcccaccaaaaacaaaatcgagataataataatctaattatttttaaaaatttagacactgctttgtattgtaatttttgaatatctaattcataacataattaaggtagcttaaaagaaaagaaaagaaaaaattgtgccctttatttgagaaaggtataattgtgtgaagttaaacgatgacgtttctttggtaccttaaatattaatttgtgtttgataatttattgtctatagattgaatgctttgttacataaatgggtttgaatcaatggataatggattaaagaaatggatgtttacattaaacaaccacacaagtataccgaaccgaaattgtttgatggctttgttatagaccgaaccaggtttccaattcggaaccaataattattaacctgaaccaaatcgaaatttgccgtctccgaattcaaccgaaccgaagttttttttccggtttaggagcttcgttttattgttgatgcttcaatttccctttggcctttgatacaaaatg

SEQ ID NO: 24027 - DNA, 3003 bp, Unknown
  misc_feature (1)..( 3003): 2750-1469P.txt file - cDNA_ID_2162345; gDNA_ID_1620539; Annot_ID_160007
gctctatcgaaaactgggagttttgctaagaagcactctgctaatgcaacaaaggagcctctgattatcatgttgaaggattctagggtttacttagcaagtgtcaatctccatggagttcacaacaacgttgctcaatcttttgagttaggatctcgattgtaccttaaagatccgcacatttctaacgtctttcactgtgatggcttgttattgctctgctccattaaggagaatacactcgaggtttggaatccatgttcaggagaagccaagttaattaaacctagacacagctactacaaggaatcagacttttatgctcttggttatgacaacaaatcctcctgcaagaaatacaaagtcttgagggtgattagtcaagtccatgttcaaggtgacttcaagattgagtacgaaatctatgacttcaccaatgattcttggagggttcatggtgcgactaccgaactgtctataagacaaaagcatcccgtgtctgtgaaaggaagtacttattgggttgttcgtaataggtattttccatataaatacttcctaagttttgatttttcaaccgagagatttcaaagtctgtctcttcctcagccgtttccttatctggttacggatttatcagtggttagagaagagcaactctgtctgtttggttattataattggtcaacaacttcagaagacttaaatgtatgggtgacaactagtctcggatcagtcgtgtcatggagcaagttcttaacaatacaaatcattaagccgagagtggatatgtttgattatgggatgagtttcttggtcgacgagcaaaacaaatctttagtgtgttggatctcccaaaaagtcttacacattgtgggagaaatttatcacatacaagatttggatgatcatggtagagattctgcgttaagatcatcatgctcagttcttatgaattatgttccaagtttagcccaaatccaataaagatttggcctgatctcttggaggaggcaaacacaaaggactttgtatgaattctgttccaattttgacttgtaattctcgcaccaatctagccaagtccctttttctttttttcctttaggaactttaatattgatcaggtttaaggttttctctggttccatgaacttaaaaataatcaactttgcttacatgtgttatcgcttgagttattttatggattatatacattcaaatactcaagcatataaatggtgaatcagcttgtagctagaaactgaaaaccattcgtttgacctaaaaacgaataaactttacagtgagcagaagaatcaactggcaattagtaacctatttatccacttttacatataaaatgttttattcaatctaaaactgggaaatagtaccaatttatacaagagaggattgatatatttttgtcaacacaagagtgacttgaaaagctttcttgaaaagaataaagaaaagacaatcaagcagtgtacaaacgaatcaattgtcaatcctcaatcttttttttggtcagcatcaatcttattttgtagaaatacaaacaaaaagacgcacaagtaggagaaacaaagacaggaagaagaataaatagatcaatagaacttcgaatgaacctttcttggaactcaagaaaagatctctctttgcagatttgccagatagtgctctcatcactatgccttctaaaatacctttccttggaaaaaggacgagacaagtactcgagaaaccgagaacgttgcctcgagcttgtattttgaagataccttgctttgaaatgaacgataagacagtgcgacatgacatgaaggagacgagaaatcaaaaatctctaaccgatgtagcaatctcgaggtctctaactttcgatctgagcttgttaataaagctcctccttgccagtttcaccacatttttcttcttgccaaactgcaaaagagccatcagcaactctttttttttttttttttttttttttgcaaagaatgatgtgttggaagaaatcacaatggttatcaaggaaaaattagtcttagatactttacttgaaggtcataaataattgaacctcattgtcttataaattactagtatcatgtttcaatgattgaaatgcaatttgtgtgtattgcttatccatatatgttatcgtttttgttcacatttgataacggtcggtcttctcaatttcccttattagttaccttcccgtttttgtgatttaataacaacaatggttgtaagtacttccctagcctcatcattgcagtaaaagattaacgaagatttatacaaagatgaacaacatataaaaatgttaaaaatcacactgttactctaaaattctaattggaagtttatgttgtattgtacgaactacaagctactaaattctatgatgctgtttctttttgcgtggaacacaattttcaattctagttctatttcaatatttgtagatcaagggtagattgaaattgatcatggtcgtaaaacatgtttagtgttccattgaattggtctaatcttatttcttcctcacaacgtcacgtaacaaccatcaactaaatgtctattttaagctaaatgttaatcataaagtattaaattaaaaataaaaagacagaaaaacgtggtaagaaagaaggaagagcgccaaagtctgagctaaatctatggtggtttcaagcattcctaaaatggcaatcttctcacaaaaaaatattatctcaccactgaaccattcttacaattcctcatatcattattccaaactgaaaaacttcccaagattttttgtgtgtagatatgttttgatagattgaagataagtttaaatgattttggatgagacttgaagcggatcaagctagagaaaggaatcgacgacaaatgaatctatgaagacaggtgaattacaacacttgatgcttcttgagtttatccgacgttcttctttcgggtttctcagatggaatg

SEQ ID NO: 24028 - DNA, 3003 bp, Unknown
  misc_feature (1)..( 3003): 2750-1469P.txt file - cDNA_ID_2162422; gDNA_ID_1620542; Annot_ID_160056
gttgaaattctttatgaatgttattttcatttttctgaatatctaagagatttcggatcctagggacatacattcctttggaccgaaactagcatttcaaggaaacacgacttttcattcatttggcgggatcatacgttactggaccaagtgctactcggtgaatgataatgtttataagtacttcacgttgatttatgggtcctttaatttggtactcaacacatcttccttatatgtatatagttattatttatttattttaataactttttcactttaagactcctttttcgttggtaaacaacttgaattagacatttagactcctttatatcatcgacctataactatgccagactattgataaaaagttaaatttttagttcagtaaaatttctcatatattgtttgagtgaaaattgttcatgaatagttttgtgtaaattcgattgtatttatatatagtttacgcgtctctcaacattatatacatatcatggttgtttagtttagatttttttttattttttttttgaaaatgatgtgctcatagtttgtttcgtgaaaaaccatgtacttttttgataagctaaaacaatttcgattattaattcataagtttgagattgttactagattaatattaatattttttcgttatactttaccgtcgataaaaacttttatttcctttcataattcaatatgcatttctttattacaatgattcaatatgcatgcatttgccgtaaaacttttgttttataagtaatttttatgatatatttatttgaaaagttatctgtctaattaacaacttctgactatctccaaaatatatgcggtatataaaatcaactactttattttacttatttaacaccacattacccgccaagtttaataatatgtaaacttatttaaaattaatagctaagttacgaacgtataattaataattgtaatatgtaagctatatgaaataacttatataaaaaaataatcatatactattgaactcaagaaaatccaaaagacattatcggaatcagtaatgtttgtttcctcgggtctagatttggactgcctctgctggttttcacgtgcttgctgctgcaaatccgattatagaggatacacaaacacaaccataccgttttttccctcattattttaaaagttatatattgattattaattatatctcataacaggtcggtatattatataaattactcatgaatcatgattccccaccggccaacaccatctagtttattattctttgtattatttagcgagatcgagagaattaacaatgatgatattattggaatatatctcattttaaaataaaaagtcatcgaaagaatacctactttttgtttatgtgcctctcatccccggccaatccaaatcattagccttcgacttaaattataaaatgttctaatttttgttttcttaatctttttgttgttttatagagaaaaaatgcgtcttcttctctacgtttgaagttacaaacttacaatgttccttcttctttttgtcgtcaaagaaggtaaattcattagataagtatttacaaagtttgttccaagatactacggattacattgagtataagctctttttgttaaggtatatggatgctattgactaagtttacacttctagtgagatagaggaagttaaaatcatgcattaactacatctaaaagatgtcacatacatatgttgagaggtaatgatgtcaacattcttctttgtagtcgctgctttttctactttgtatcatttcatatagtataaaattaggttgtagagccccaacataatgttacttgagtatatcctaggctccgaagttggtgcactaccattcttaagcttagagtttagctttcaatggggagtgaatcggttccacttgcatcatatatatactttaaaaagatgtgttcacttcctcctatgaagcgacaaaccgatgccaacattttgatctggagatttccaggatgcgtcaacaaatcagacaataaaactaattactcattagagcttatagctagccctagagacgccattaaaatgttagcgggtgcaaattgctagaacaagaaatcaaacttggtacctcatggattattagggtgtatgtcaaaccattttgccactttgaatactttggctagtgtaaaacagtatttatattactaggtgcaagtgcccccacattactcaaaagtgggtctagtccacccataaataacagattatagtatgttttagatttttttttgttcataatatctgatgtttcgaaaaaacaattcaagtttctatgcaaaaatattaaattaaacagctatatgattgtttatattctgcaataaattatatcattggtcaaaatatttttaatagatattaatttatgttttaatgttaaaaaactcaaaataattattttcttaaactttgtgccttaatctaaaacatctatatttttgaaacagagtagtctttttagaattggagttcttttgagataacttggtttctgatggtatctaatatactaattcactaacaaacaataagtattcccctttctgcctaagttcggctacattatagctttttcttttcatcaaatcctgatccttagcttcttaccaaaacaaatcctgattcttagctacacacaatacaatactctaattccatccactaatttgatacatgaatttttatatattattttgttaccctttatatcaaaagccataaagggacaattcttaatcagttttaagacgttaaaaaaaaaaagtaatataaaatagatttttagtcaaaagtcctatgccacaaatgtcttatataatttgattccttgctggtgagagtcacaaaacccaacagacttcacactttcactttcattcgctttttcttctctattactgcaatcacttgttcacgataatg

SEQ ID NO: 24029 - DNA, 3000 bp, Unknown; identical to SEQ ID NO: 2468
  misc_feature (1)..( 3000): 2750-1469P.txt file - cDNA_ID_2162432; gDNA_ID_1620542; Annot_ID_160058

SEQ ID NO: 24030 - DNA, 3003 bp, Unknown
  misc_feature (1)..( 3003): 2750-1469P.txt file - cDNA_ID_2162488; gDNA_ID_1620545; Annot_ID_160143
gaatccatgagacaatttttaaaaaactgaagttgtaacccctattaaaacagcatattaataatattttaaaattttataaatattgattcaaatacatccaccatataatccaattccaaaataaaacctgttgtataatttctttacccgtcccgtgatttttttttaaaaaagtaatttttaaaatttaagaattatttttatatataaaagttttgcaaattatatcattctctaatacatttatattttatagtttaattttatatatagtaacattatacatactacataatattttcggttttatataatcttttctaaattaggatgatttgatatgtttaatattagtggtcttaaaaaataataaattaaatatttaaccagtattgaaacggtggattaattatattttacttttttattaatgttgattcaaaaacccgtcactccaaatctgtcttgccaaaaagccatttattttattaatattaattttattaatgatatgactctgaattataatctaaacattttagctaataaataggagtacaccatatttatttaataggggaatgtaccatatgacccgaatgcacttttacccaaatccaccaaaaaagtcttgcaaaaatactatagagataagaaacgatagtcggttttgataggtaaaagattagcaaatatattagttagcttaaattagttaaagaatacaaattgaaaaggtatattacactttattcgaatatagtatcaaaacttatataacacagagatttgataattttttaattgttgaatacttttttttgtgctaatttttatgtgattaagatttaattgattatatatataaaatattaaattgttttacgaacttatttgtttataatttggtaacagatagatatttgagtattcagtatattttgcttcagtttaggaaatctttgatgacccgtctttagatccaataaaccttataatctagatattaacctgcagtataccgcaggtaggcttatattttagttaaactaaaaacttttattgtaaagatgatttaaaaatatatgatattattttatttgattttaaatgtatagtaaactgtgagttgtatatgttttgttgatattatgtatattgtttagtgtttataattagacacttgtagtttaattgttaatttaagagtttcacatgtagtataccatcttgtattaatatcgatctaaacccgtcaattctaggattttccagcttgtattaaaaattgaatcacatcatacacataaaaaaatctaatatgttattaattattatagtatataagattataaattttcaatataatatgtatgaaattgaatataaatatttcaaattatgacccgttactcagtagaaagttttcttaaatctatttttcaccctttataatattttttcatgtattgaacagtttatatttgtttttaaaaatttaaattatggcatatgcgaaaaaactctaattttttttttataatgatgatattattttttcgcaaaaatagaatcatataaagatgagaagtgaactataataattaataaaaaattaatatgataatttagatataaaatctaatttgttgattttaataggttacttttttggaaattaataatgtatttttttaaatttaattaaattaattaaaatttaaatatcaaatcttatatgttgatcttgattggttattatttttgaaaattaataatgtatttcgttttttaattaaatttaattaattaaattagtatttgactttttaatccttaaagagataaattaatttactctttaaaattttatttctaatgatatacctatgtaattacttaaaaaattaatgttatatttaaaatgtactttccaaataatatagtaggatatgtaaaagaaagtataatattttaatgtttgggtatctttatatttaagacacaatgtctcaaatgtctttatagagacattttggagagagatgtctcaaatttaaagacccttttatatttaattattcatatcttataattataatttttttaatatagctaaagaccctctccttttatatgcaatggagatgctccttcatcattagtatattttgttttgaattcaagatttctaaatatagaatttcctaaaataaatacatggtaaactcgtgggggttattgacttgatttgatacaaaaaatgagaggatatagttgtgatcgcatttgattaatttaggctgatgagcaatatgtatgcaatatgcatggatggtgtagaagcgaagacaactatcaccatacttaagattaaaatcaccacaattttaatataatttaacaatatgattttatgcataattaattggacttaattattactaagacattatcagtttgcaaccatccaatttcatgtagaacaagaagtctttagattaaccctcacaaaagactttccgtttttcggggttttttcttgactaaacaaataatcttggagacattaatgatgttatgagtcatgtgaccaatacagttatttagacatcaaagttatctgcaaattcattagagacgaacggtaatagtcacacatgacaataagaatgaagatgtcacttagataaaaattaaaccaactcatgtatttgcctaaataaatcactatttaccaaatttagcaaacaaatcgtaactaaccaatcaacatcacacaatctcaaccctttaataatctcacattctctcgcttcttcttctcggattcctaaatattatcattcattcatcatcctcccaactcattggctctcttctctcctctcctttgcctattttctaaaatcttctccggccacccaccggccaccttatgatctttttggtggcggcgattacaccatcaatttgttagtttatttatatattaatatg

SEQ ID NO: 24031 - DNA, 3003 bp, Unknown
  misc_feature (1)..( 3003): 2750-1469P.txt file - cDNA_ID_2162493; gDNA_ID_1620545; Annot_ID_160145
gacattatcagtttgcaaccatccaatttcatgtagaacaagaagtctttagattaaccctcacaaaagactttccgtttttcggggttttttcttgactaaacaaataatcttggagacattaatgatgttatgagtcatgtgaccaatacagttatttagacatcaaagttatctgcaaattcattagagacgaacggtaatagtcacacatgacaataagaatgaagatgtcacttagataaaaattaaaccaactcatgtatttgcctaaataaatcactatttaccaaatttagcaaacaaatcgtaactaaccaatcaacatcacacaatctcaaccctttaataatctcacattctctcgcttcttcttctcggattcctaaatattatcattcattcatcatcctcccaactcattggctctcttctctcctctcctttgcctattttctaaaatcttctccggccacccaccggccaccttatgatctttttggtggcggcgattacaccatcaatttgttagtttatttatatattaatatgggttgcggtggctcgaggcttggaggtgtggcgacgacaagggcggaagaaggcggggttgtgccacttccagcgggaatacgtccccttctccggcgaaggttagaggagatgaagaaacggagccatgcaggcgtcttgaaagggagccagacgttgtctaagaaagagcttcttaggcataactcttccgaggacggagaagatacggaggagaacgacggtagcttgaaggcgtccgctaaggttgctccggcgcctgatcataatgtagaagagaagaaagaggttatttatgaaaagattccatccaaagatgatgttaaagaggtgaaggaagaagtagttgtgaacaaacaagaagaggacaatcatcatcaagatgttgtggagaaacaagaggaggaaaataaagaggttgtgaagaagcaagaggaggaaaatcatgatgatgatgtggtcgtcatcaatgttaagaaggaaggagatgatggtaagaatcatgatgttgatgaagggagtatcaacaactttgatgagagaatgattggtcctggatctccaagctttagggtttattgcgtcgatgttccttctgatgatgatgatgaaggtaaatcatatgttcttatacaaacacacatatatacatgtataaatcatttactatttgtatttgtatatggatgcatgcattgttagagacatatatatgtttatatatgaaatgcttgttatattatgtagtttcgttattgaaacaatttatccattcactattgcagaaaaagatgtagaagacgcgagaaagtcgatggaaaccgaaagcgtcacgacagagataaaagaggtggtcaatcacattaattcacattattgattatttgatctatgaggatctctaacaatgatatatttgtatttctataggacggaagcattgtcaaaaaggagaaaaaagaaagaagaggaaagaggttcggaatcgcattgccgaggaagtatttagcaaatgtgactgcgccgtgctatgcaggtggaggatgcatgggaaacactcattctcgtttggtgcaagagaaatcgagccagtgatcgatcaaaatatgtttgccatctttgcattgactgatttgttgaagtaagaatggtgtggtgtacgtacgggatcacgatgaataatcaaaaccaccttacgattttagacctttgatttgttttaagagacgcttgtttcagaatttgtacaacctcttcttcttcacctttgctttctttgatcaggataattaagttagtgtttgacgaatttacttttttccacgtggaaagatgtaattaattgaacttgtgcaataaaaaaagtgttgtctaaatgtcaaatttattgttacattaaccaatgaaaataaaattagagtaacatataggaaactgcaattatagaagaaaaaacacactaaaaggtgtaagtaattgaactttgtgaattccgtttgttttcggaatgcacaagtgttagtcataataggaaagataaaaatcttaattacaaatcctaaaatacaatttttaatttattttttagagtttatattaatatgtcgtcaaaaacggtatattattcagaacaaaattatcgttgaccattagttaattaataaccaagttcaaatttgataatttgaaagtttatttagacaaaattaattagttgaaagttttatcaatgatggcctcttaaatttttaacttttttttgttgagttttataaaaaagaaaaaatggttttcaaactaaatttgtttatgatcatgtttatccgagttaagcccaatttgagatctttgtcagtaatgactaagagtacctcccgcatatagaattcatgtagtttctaaaacatatatatatttttttaacttttaaatatatatatttttttaattgtatgagtttctactaaaaaattactattgaagttggtctaagttgcgagaccaaatttttatatgctttcggttcgaattgacatttctctgtgtaaacgaagcatcaataagaatttatcaaacttgaatgtaacaccatttctttagttgatcatttccaaacatttattaatcaaataaaattgaatttcaaagtcacgtgataatgatgatactcaaatttaaaaaaccaataacactttatttcaacatttctatgaagaaatcaattattaacacttaaagttattaattgaataacaacgaacaacatttaatttagtcaaaattagattttttttttcttttttttggttttattgttaagattttataccaaataaaattttacaaacgaatctaaaagaaagaacaaatttaaacttacctatcagaattgttgtaagatatttgggttttcttcgtattaggtttcatcagatccagactcaaaaaatg

SEQ ID NO: 24032 - DNA, 3000 bp, Unknown
  misc_feature (1)..( 3000): 2750-1469P.txt file - cDNA_ID_2162541; gDNA_ID_1620546; Annot_ID_160165
tgctgttctccttggcatcggtttccacggtactgaaactgcctcctggagaaataagaccagttaatagattgaatttctattacttttcatgcgaaagtatgttccaggaaagtaagaagttaagtttgttgtacctcaaaacttggaaatgttagttcacattccactgtttcatcaagctttttctatgaagccaaaattgacaatagagaaagaaagttaacacattatatgccaaaagaaaggcatgtgatatacaaccgtcaaaagaaaaaaacgagatgagtacctttgtgtacttataattctgaaggtcgacaaatatttcgccacatgagcctctacaatcaactgtatagaacgctacatcttttgctaggttcctacacttttcattaactgctttctgcataacaaagcacattatttcaagtgatcaatctacatggcaacaaaagacaaaaacaactggaacaactaaaagaaggaggtatcaacagtaccttagtagcacgagaactgtagccgataaccacaacatcaaacttctcgaaaaaatcaacaccaagtgttgacaaatcacctgaaattgaagacatagactcgatgttactaaaatcatttgtttctactaaaattagagagaaatgaagaaaggaggagtaacctttctctattgaaacatgaaccatagggttaaaatccttaagtgaatcacaacaaatctcagctacggttttgcctacataagcattttcatcaggaagaatcaagaagtttgcgttgaagacttccgttgtaaccaatcgatcatccaacagagtcacactacctactcctgccaacacaatgttcttacaaaactgcaacaccaaatggaggaaaccaagtaagatgccaacactcactctactgcaacatagctaatagagagtcacaaaataaagtaagaggtacctcagcaacagtgcccttaattccagataccaaaacatgagatttactcaatctgcaagcaaaaacacaaaacaaaattcagagaagccctaatcaaaatttcaacagctaaattagcttaaaacccagaaagagataaactttcaccgagtatagcccaacaagaagagtttattagtactcaaacggaaaatcaataacttgttgttgcttgaagccatagaagttagattcaatgtgaagtaccttctttgagcaccagctccccataccctaatttgacggtcataaagagcagtttcctgctcggtgagctcatctccgtccattctcgtagtgaaaccctagaaccgacctcgaagagatgatcaaacccgtcacgaatctactacaagaggttttcggtgactcactcactgagtttgagattttttgttaaccggaaaattgctttctttttatttattcaaattacatggtttgttttggtttggtccggttcgtcaactacaaatttttaaattcaaaacaactgtgcattcaataaataaccaatttgttattttttaggacaatttatgggccgaaacaaatgaaacatgggctttggaccccaaatcttttaaatccatctgcaaaacttttaaagacatggaagacttttatacgattctccctgataattgacaacttgtgtgacccgtaactatgaaagtcaaagaaaataacgcgtatcggtggaaagagagaagaaaaaaaacagaagaagatgttgtgtaatgcgaagcacaacattcacatgctatgttttttgccgtaaacaactaagcatcctatacctctttctttagtatcactttccaatttattgtttcattttcatcatcatcatagttataaaaaagaaaaaaccacatctattttatatcacaatttgaaaactaatatattttggataagggtcagtaaaaagatacaagatttatgagtaatttgaaattttcaaaagtatactctgttcattcataaaaatcggatgctcagagttcagaattgatgaatggcagagaaaaatataaacaaagaaaagttgaaaaagtaagcaaaagaacaatcaacaacagctgtcactttcctccattcttttcttcactttttcttactcaaagtttttaaaaaatgatatcaataaaaccctaaatcaggaaagtaaagttacaattaaagtaagtaaatcatttcttaacttagtaatagctattatcatcaatttctctctctctttcctctttctcttatttgcattattgaagtagcagccacacttgttgtctccactttctcttgctaaactccatcatcttctctttcttttttttcacttgtcccatttttttatattttcatctttctcttttggagtttcttcttctactgactctactggtaggtgtatggatttggtaagatttctcaaccttcaaacaacaaacttttcttattctatagttttttttaatgtaataacatgtttataatcttactttaatctttcatttttattgcatttttttaattcttgcttggaattgagtagacagaaaaaaagttttttgtttttttttttgttttcctttcttcccattttgtgggatctgttctagtttctatgtttctgcacttctcatttcgttttttcagtacaattagtttgccttttttgggattttttttttgtttttttttcaatatcaaaatagatcattttgttagagcttcaactacaatttcagagtactctttataattgtgtttttgctttttgcttatgcttttttattttccttcatatgtattgaagttgaagtttaattgagttaaagattcatgggttttatgtttactagttgtttttgctgtttgttcttaaatttagagtaccaatatcaaaaaggacaaatcttgatattgctttgattgctgttgtgtatgtatgtgtttttatagtgagagaagaaaaaaaagcacaatctttgaatg

SEQ ID NO: 24033 - DNA, 3000 bp, Unknown; identical to SEQ ID NO: 24032
  misc_feature (1)..( 3000): 2750-1469P.txt file - cDNA_ID_2162541; gDNA_ID_1620513; Annot_ID_159175

SEQ ID NO: 24034 - DNA, 3000 bp, Unknown; identical to SEQ ID NO: 2470
  misc_feature (1)..( 3000): 2750-1469P.txt file - cDNA_ID_2162553; gDNA_ID_1620543; Annot_ID_160070

SEQ ID NO: 24035 - DNA, 3003 bp, Unknown
  misc_feature (1)..( 3003): 2750-1469P.txt file - cDNA_ID_2162573; gDNA_ID_1620543; Annot_ID_160078
ttcttatcaccggttaccggcggaagaagagcaaaaacactcggcggggacaggggaaagagagggacaatctccgccggtctctggtggcggtgaagagtcaggacagatggcgggaagtggaggagagtcgtgtggggtatcaatgtacagttgccacatgggtggctctgatgttatttgggcccctacagccagagctccaccgccatactaaccaatccttctttcacaaatctctttctttctttttttgtttttttttgttttgtgttaggatgaatcaagaaactagggttttttttttttgcttttgatcatgaagaatcgtttgcttttttatctacttagattttatttttgtatcagaattgacatatctttccacggtgtaatctctctcaaaccttgggtttatggttttctttagcttgttgcggaattaatttgatttgactcatataaatatgcttccaagtgtcttcaatcatattctggagaaatttaaatatttatctctaatgattgttttcattttaatactcttattgtacaattatgcttctttattggatcttcaaagtgtggtataattaatacgtagcaattagctataacgtttaagaaagctggctattcttgtcttccacaccacatatttgactgcttctcaagaaagcgggctactttatcctctactacaccatcaaccttacaattttggcggcattgaccatatactttttgttcccataacagttaaatacaaaaagtaaaaaatgtacgaatcgttcgtcatatcacaggtttgcacaattgcttttctttccaattactcgtatgtatttattaaaaaaatgtcatagacttaaccaaaaggataaacatgttaataagatgcaagtatgactactccgtgagagagcgcgaatttgtttttgtgtttataagttcaaaaaaagacaataactatccagatacgtggtcaaaaaaagacaataactatgcatatacgtggtcgtgaagcattgatgggatactgtttggctttgtctgaatgtgtcttgatgtttggattcatgtccctggtctctctcatatatccagaagtttcaagactatacaactgcaatgtctgcaaaaacacacatatctatatatataaacacattcaatacccacttgtcttttcagtgccctctcgctttttttacatgggggtttgggtttgaaacttcaggaaaggagaaagaaacgtgaactaaattcgacaaccttttctttttggatgtccattttcctttccttttttgacatcagccatataaaataataataagtatatattttaatttgactctatcaagtatctactaaatatgtttcaattagaatagcaccaaaaatgattaattccgattatcccaaccggggggaacatagtccacgaaggtaaatttatgaaaacgaagtctagtactatcatcagatatataattaaaccttagagattaaaactactggaatgtaaaaaaagcgcaaaagagtggaataaaatatcaatgataactcttctaaataagtcgaggatgcaagatagtcgttcggataaatgctcttgttatcgaaaattgttggatgagtgttacaaataagaattcaacccctattcatatcaaaatgaatccgaaacgaatggtaagaagaattcaatcaaatggtaattcagaatgaaaatctaaagtaaactaaatgatcaaaattaaataaggatgacttaatacgtgtaatccataatgatcaaattgattggggaatattaatgaatataatcatagttggtccttcaaaaaaaaaatccaaaaattcacctcaagcctccaaagttccaaacccatgtagatgtctctcaacaaacccaacccacgaaacaaaaagataaaaatctcaaagcccgacccaatttattcgataagacaagaaaacaagtgttattatttcttctgctttctcaattatggtctctgtccaaaaagattatactatagtaatagttttgtgaagctttttttaatagcatagcaattcgtagaagaaagaacaaccaaatgtcaaaaatcttgttttaaaaaccaattagtttcacgtcacagctcacacataataaaacaaaactccattttttttttataacgtgaaaaacaaaacaaaacaaaacaaaggaagagaatttgcgcgacaacaacgatcgatcagtcgtcgtcttctcagatcttgttcttcaaaggattctatgccgcaagagcttcgattgtatcctctctgaggattgggtaatacccaataccatggataacaatagcgagcgcaaaggaaaacgaatcgataaggataatattcgtgtcaagcggaaaactttgcaagctttgctcaatgattgccagagagccctcgagttattaaacttagccgaagtcagttctgaagacgatgaagatgataaaagcaccggcgagggaagtgggtcacaagagagcaggggagaagtttcttcttccgatcgagaagatcctgaagctgatgaagtaagtatatgcatctctctgaagaggaattgtgaggaaaatttgcttcaagctttaaagttcggaactttttgtttatcaaataagtgtgcgttgaattttggtgaatgtgtatacatcaacattttataatgatgcgtcatatgtttgtaatgatacaataatgtcatgactttcttcttccttgtttcagttatatgatctcatcaaatccagggttgaatgtgatgacttccttgaaaagattgagtcagcccaggtttcagcgccgcaacatcttgctggtgaggactataatgttttttttaagcctgtttgctcattggttgtatagatgattgtgatttctggtgttttagaagatagtagctcttgggatgtagttagtgaagatgatctttgggatgatgaaaccatg

SEQ ID NO: 24036 - DNA, 3000 bp, Unknown; identical to SEQ ID NO: 2482
  misc_feature (1)..( 3000): 2750-1469P.txt file - cDNA_ID_2162663; gDNA_ID_1620544; Annot_ID_160113

SEQ ID NO: 24037 - DNA, 3003 bp, Unknown
  misc_feature (1)..( 3003): 2750-1469P.txt file - cDNA_ID_2162693; gDNA_ID_1620544; Annot_ID_160119
ttaacatgtagaaccgacgaaaatcaaaaaggaaggtgaatgttaatatgtaagagttggaccaaagaaaaattgtcaaaatgagttggaatctatcgtaaaggtcactcaagaaattgaaataaatgcgtatcagatattagtggatgtgatagtgatactgtaacattatagatttttttccccctttctttttatatagaaagtatttatcatatactcctatggagacatgatttgcaatagcatttacattcataaattatgagggtttgagtgtttgagacagacaatatagagcttaataaataatattatccggataataaagttagaatctaaatgcaatattttttggtccaagttttactgcacacaatttatttaagaagacatatttattgtatgtctggttacttttacttttgttttcttaatttgttagaaattggagcaacattgtattcggagcagaagaagtggtgaagaacggttgggacttttcataaaactgtagatgtgtcattggacaaaaatgggtacagctgtttagagagaaaaccaatatatatatataaccagacatacatttaaaaagtatactccatccatttttaatacatgatgttgaaggtttttgaacacaaatttttattattattattattattatactaaaactttatttattatctatttaaatacgatccaaccagtaataaaataatatgtaaaatataaatcttcaaaaccaataaaaattaattaattttgtattgaaagttgaaaacatcatataatttagaacataatttttcacttaaaacatcaagtataaaaaagtgtctatataaaaacatagaaacccaaaaaagaaagcacacaaaaacttcatctgctaaaaaatataatataattgcatttcattccataagaggattttaattacaatttttatgtaataaatctacattagaaaaaatttcatacacaattcttatgatatatattattttacatcgtagctagagaatatctatcttatccaaaatcaaaattaataaaagtatgagatagaattatgcttaagatttgatacatatagctgaaagaataaacttatgtttaagatttctatttaggtgtgcaacaatttaaatatatatatatatatatatatatatttaatatattgtttattcagttgaaaaatgtaaaaagcattatataacacaatgagtaatagtcacaacttgcacaatatgtatatagtttgctgatgcttttgttggatatatattaattctgaaagtttgtaaaatgattgaattacgtctgcgttatataatcaattctaagtcataaaattaagctgtagcgttatgtattaatttgagattgaaaatacaaatacataaataatacatccatccgtctttgaaataaaaaatttaggtttcttataattgtttccataaaaattgattccttagattttctatataatttaaatgaatttatgttaatattttgtagactttaaaaaatataatgaattactattggttcgtaaaaatggaaaaatgttttagtgtaggaaatgaggcatgttttaagagttacatgcatgtttcttaattgtgtgataactttatacgtaatttataatttaaatttaaattttgtgaaaattataaaaaatacacttatattaaacaaaggaagtatcagtaaaattatttcttcctatcgacgagtgtgtttacaagagtgttttactatccaatttcaattgttcttttttttttttttttgaaaaagggttcctctaatttccattgttgcacttcaattattttctctctttgttttttttgagcaaaagttttgcatgtatattgaaaattttattgttttctaaaataatattaaatattttcaatattttcaaatcttgcaaagaaagtacacttgtactataacatcgttacttagtgatctgtcatgtgtgacatcagtctttcgatctcgaacgcgagagatatgtccatgcatgcatgcatgtgatcagtggatctgtactctttaaaaacataaccagtttcgtaacgacaaattattacagaaacaaaacaaaattgtaataaatactgatttcaaacaaccaaatgacacatgtgcaaatactctcttggaatgatagatgtatatatatatatatattataatatacaaatggtagaagatataattgccaggttttgaaactggcttctaaaatggttacaattaacatgagtacttgttacttgtatacatatcattgtttagaagaacaaaaagttgcttaaagatatctctagaaggggatgtaacaaaaattgttttgtatttggaataaacttctaataaacttttctaattgttgttcgaattgtcatgttattttgttattcgacttcttgagtacttggacccaacattgaataaattgtaatcaaattatgttaagccaactttaatatctacattttatcgcaatatgtaaggacaaaactcttcttactacataaattaaaattagagaatttcaaatgacaaaatctaatggaagttgaattaggttcatgaagatttatgccgctatatcatattagggcttaagaactctttttgtcaaattgctttcattaatttaaaggtttagaatacaaagatggagatggttttctcatgactccaaatttcatataaacgaacttgacaacactaaaggttacaacataatagggcataactatagaggttatgtataaatagggtataattgtaattagtattaccctagtctctcttgtaactagcctatatatattgtaattacaatctctaataatattaaggcattacactatatggtatcagagcctctcgactcttaagacctaaatttctcgtgctttacgcagccttctctttcatctcttctcatctttcacgatg

SEQ ID NO: 24038 - DNA, 3003 bp, Unknown
  misc_feature (1)..( 3003): 2750-1469P.txt file - cDNA_ID_2162750; gDNA_ID_1620547; Annot_ID_160180
cgcaatctccttccccacttgatcatccctcccgatttcagctcagacgagcactttccctccggtgaagcagcgcgacagagacgagtattgtacgccggttgagaaaccacctcccttcttggaaatttgttcctgcgagaagaactagaaacccagaaaccccaggaatttctattcatagaaagttcatgaggtgcgattcttctgtaaagcaagtctccagctagctccgaagccatcacatgactctcgtcgaaaacaggaagaagaccaccaccactcctcttcttcatcggtttattccggttcatcctactgtaatcgaaatgcgatcggagtgaaaacatgcttgggtaccggagagacacgtcactcgccgtgattttgctcacctgcatcaataaaccttaaaaaatcactcgaaaacccagacgaacaacaaaaaacgagatctgtctataataaaaggtgaaaaaagcagagaatcgagtgaataccatgacgactctaatcgatttaagattttccggcgatctctgaggaagaatcgaagcatcgatttcgtaataagatccagctcttatatgcgcgactgcaactgtaagaacaaacccaaaccaaaaattcagaaattagaagagaagcgagaaaatcaacaaaaacgaagaaactatagcttcagtagtttaccattcaaagtcggtgacgacggcgaagagattttcccggcggtggtttctctaatcggattccgtttcacgaacatcgtactctgtagaacaagagaaaaactaagagagatattttttttctggagaatcaaaaattgttataaggaataatgaaaaaatcggtttgttgttgttgctgctgcctggagagaatatatttgaaaaaacctgactctgcgagtataacaagaaacacacacgcgctttctggtacgcgcgtgggagacactaaggaaacagaatcaagcggtgatgagttttatttttctcatcatgagactgatagtgactgagccatttatatcacagcgaaaaaaaataaaatctgagagcgagagagatcttacactcatgatttttgctctcgataatcttcgttcctccttttcactggattaaaaaaatcaaaatcagcaacggagaaaaaaaaacatggacgcggatggagaaattaaagcatttctgagaaatagagagaaaacataaacccagaaatatttgaagaattttgttttataccagaaaatctttttaatcagcagagagcttatggggaagacagcaaaaagaaaagttttgaaatgtcgcatttaatgaatctgggaggtggctttatatatgaggttagagagagagagagagtggtgtgagtgtgtgagtcttatatgcgtgtgcacggcacgtgactatattgctttcgcagcaagttggcgtatattgacagatttgccctcaaactgtatctaaactgtaaacgttcgcggaaattggtgtacgaaatcatctacaatgaaagattgaaagcagacgtagtgatattacggattgatgccacgtgtgtcattttgaaaatttaacggtgataagacctgaaggttaatgtaattggccgtagcgaataaatttcgtgttacacgtgcggagaaggcatcattaagctactgctactagagtggggaccgactacacacgtgaggaattgttttttttttttgtcacagtgattattcttacatatgattattttcggataatgatatgtgatttatgatgttttattcacattaaattgtttatgatgtaaggattaatgtctctaatgtatcgaccaattttatactccaatgataactgaatctgtttttctttattgagctgaagcttttttaaaatcaaaaagcttaatttacgtaataacatgatataattgatattttttttataaagtatttaaaccaatcaaaacaaataataagcttgaggacttatgaccatgattatttgcccaatacatttaagttatatttttttgttgagtcaacaatatttttaataatttaaaaatatttttttcttaattatcaaaaacagtcaacaatacatttaagttatatttttttgttgagtcaaatatgtataatgtaagatgttaaaaagataattaagaaaaaagtaaaaaactgtaaacgggcctaaatgggccaatctaagctgaatttttttggggatccgactatgagatggatcaaaataaacgggtctggataccttcataacgggtcgggtctgatgaggaaagagagtgattttttcgatcgccgagagatgaaaggtcagtgctttgtcgtcttctaccgtctccggaccaaagagctcaagtcacgcagctaacaaagtacagatttttcccttgtttcgattgcaaaagcgcataagcttcgtacttgccaaatctgaagtcaaaccaaatacactggtcaaacaaaaagtcgacgagccccagattccgatagcaaaaccagtcggacccaggatttcgatgagccacactggttagcttccgacccaattcacgtcctaggtcaccgagaacgtggtatgtgttttctaaggctttcgaaagggtttaggttatagtttagctttagctaagggattgggttttgttgtgcgtacttattgttcgatgaaacttctgaaagagttttggtcaattgataatgaacaaagtagaaaactttatctccttaaaagtagtgacatgggagctaattctcctgtttgtgtttcgcagaaactgtgtgagcatttgcagtttctctcttgtggttgagctaaataaaaatcattgtacattttcaagagctaattatttctgatcattgttatgtgatactttcttttgcagacttctttgcatgttttggttttgttgagtcggatgagttttatttttggcttctctctcgaccagtagcagaaagctatg

SEQ ID NO: 24039 - DNA, 3000 bp, Unknown; identical to SEQ ID NO: 2494
  misc_feature (1)..( 3000): 2750-1469P.txt file - cDNA_ID_2162779; gDNA_ID_1620547; Annot_ID_160190

SEQ ID NO: 24040 - DNA, 3000 bp, Unknown; identical to SEQ ID NO: 2491
  misc_feature (1)..( 3000): 2750-1469P.txt file - cDNA_ID_2162791; gDNA_ID_1620547; Annot_ID_160193

SEQ ID NO: 24041 - DNA, 3003 bp, Unknown
  misc_feature (1)..( 3003): 2750-1469P.txt file - cDNA_ID_2162798; gDNA_ID_1620547; Annot_ID_160195
gatcgccactagcaaatacatcctcaaccgtcgagcttaactgagttaaccctgcagcatcctgtacatataccaaaaagaagagaatcaattgcagatctacccccaagtgtccacataatggatcacaaaatcactatgaatactaacctgtagtgttttgtaggcagcctccattctctgtttgacattgtccactctagcaagcgcagctatacaatctgctgaagaaccctctgcctgcagagtaccgaattcgataagagcacaagtttcaggaatttgatataatctaattttcgagaagagatccaaacaaaatctcaggaatcagcacaaatgcgtaccttcttgagcttctggaggattccagcaacagaaccacgcagagacacagcatcatcacggagacgcaacacgtctcgtgtggcacgaggaacacggaggagagcaccaccgctctgctcttcaagagaagctccgatctcctcggaggcaatctgaagcttcatttccagatccacaagatgtttctcgagtgaatcctgtgggtgacgcgcctggcacgacgagttaacccatcgcttcgcatcgaacttctcatctgagaatggacctagatccagcatcatccttgatccgatcacccgatttaccttagattctcttcagcttcgacgatgatgatgttgaagagaagaagatcctctgatttcgcagatacactgaagaagaaactaaaccaaatcgatctaaaccgactttcaaattcgactttaaaaccaaaccaaagtaaacggaagataaatttacaaatctgggccccaaagtgatgggccgtcacggaaaaagttttcttctttctttttctttatttttctttattttacttggagaccacgcagttctagaaccatccttaagcgactctctagcctctagcagcttcttctactctctgttctatataaacctttctctaacagcttttttttcgttcaaagagtataaaaaatatctcatcgagcttgaaaataattaatcacttgctaattctaagcttcttctctttccaaaaatggcgtcatcatcggctttagctctcaggagacttctctcttcttccaccgtcgccgtccctcgcgccttaagagccgttcgtccggtggctgcttcatctcgcctcttcaataccaacgccgccagaaactatgaagacggtgtcgataggaaccatcactcaaaccgacatgtttctcgccacggcggcgatttcttctcacgtaaatccatggttcctccgtccaatttcgctatagattttcccaatttgatacatgtttagtgatttatgtatagagtacatctaactttgttttggagatctgttgaatctgaaaatttggttgttttttcaaacagatatactcgatccgtttactccaacgagaagcttgagccagatgctgaatttcatggaccaggtaagcgaaatccctttggtatcagctactcgtggaatgggagcttctggagttagacgtggttggaacgtgaaagagaaagacgacgcgttgcatctaaggatagatatgccgggactaagcagagaggatgtgaaattggctttggaacagaacacattggtgattagaggagaaggggaaacagaggagggagaagatgtttctggagatggacggaggtttacgagtaggattgagttaccggagaaagtatacaagactgatgagattaaggcggaaatgaagaatggtgtgttgaaagtggtgattccaaagattaaagaggatgagcgtaacaatattcgtcacataaacgttgactagagtgttttattttggattgtttgagatggaatggaagtaagtgagtgaatttgtgaactttaaggtgtcctttggtgaatcaaggagaatgacatttcccacggtcctatgtgttcgggattttgacttttttcgttacatcaatgatctatgtacgtttgactactttcatatcataggttcggattttgtttcccaaattcttgatatcggattctggatatgaatatcgtagcaactatgatatagttgaagttatttggatattatttatggagaaaaagagtctgctaggacgattttctatcattatacctatggactatggtggtgttatcaaacatgctggacagagccatgatcaacgatacattcgatgctcattctcgatgttcaaactcggttttataaggggatgatacatcaaattgataccaagtaactgattttgaatgtgctggaaatgttgatataggtctcagcaaccagaagaaggttgtgggacaagactattagagaattttgctaccgtttttttttcacctctgtttggcaaagcgcgctctttatagctttacttctttggaaccacttcggtgaccatagaactcgttcgtgtcggcatcgtcaaatttaagtaactttttatttaccgcatggtttattattttgagtttttttcttccgcattttatattcttcatttttccttgtccatcgagaaagagagacaaaaagaggacgcaattgccggtgctgaggagaattttccaatcgcgaactcaggttttgatccatttcgctctctgcagaatccaccattatcttcatattttcttctattgacctcaatctttcagctcatctctctcctttggttaattgaatttcccagtttcttcaattttacttatttaatacatatctctctcaattgcagtatcctatgaacttcgtgatcatggttttgaattttacttgcttcgattggcctacgttataaaaaaattgaaactttttaactcaattctctaacttacataagcttttggtttgcttagcttatgcaaaatcatgttgatgcaggggacgtcatgctaaatgagaatctgtgggttaattcggagtgagaaggctataatagtttctaatg

SEQ ID NO: 24042 - DNA, 3000 bp, Unknown; identical to SEQ ID NO: 2526
  misc_feature (1)..( 3000): 2750-1469P.txt file - cDNA_ID_2162876; gDNA_ID_1620551; Annot_ID_160298

SEQ ID NO: 24043 - DNA, 3003 bp, Unknown
  misc_feature (1)..( 3003): 2750-1469P.txt file - cDNA_ID_2162951; gDNA_ID_1620552; Annot_ID_160321
agagggaagacaagaataagtagagttggcataggaaacttgagaaacagtaaagattgagatctaagagaaacaagagaatctttaagatcacctgtctacttgaggtagcttcctagaaggttcagtggaacaaagttgactaaatatcaaaactttcagctctcaaccaccctaagaaaatctatcacaagcaaagtattcagcacataaacgcattctggatccaaagtaagacagcaatacaagttacctcttctgaaagcttgatctggctctttaacacctcctagagaaacttgttatacaagctcatgaagcctatatacaacaagtaaagctaactttagttataatctcaccctaagaatctaagttaaagtcggtagatactgactattcacaaatcatgaaagccaccaataggaaagcagagaaatattctctctatcataaggagaaacagaattgagacagaaaagacaagcgcgggcccaattcaaccaacaatactcattcacttgatcacacaaagtgcaatcttaaacactgatagaaaattctcagtcttgtccttagggctcacattaaagatgaatcgagttaatgattgctgcaggtttataatatctgcctgaatatgaaaatcttcatatacggcattagaaaatgaaagtaggccacacatttctttctgaaaaagatgatgagacatcaaaacttataaaacaccaattcaaaaaaataatcgaaacttcacctaagaaactaaacccaagtaagaacccattttcgcaaaagagaaggaggagatattgtaagaactctttaaagcaaaaacagagcattgtaatagaaacaatcaaaccaagtaaaaacagaattttacatgagagatcatcacattacattcccgtcagatgtaagatcacacacatacatacacacacaagacagagaaaacgttgatgatcacgaattatgaagacccattagacaaaacaggacaaaaaactcgcatttacagggataatcataaggggaaaattgagaaaaaccttctctttattctcgggaagtgcagaggaaaacaaaattaccttgtggaagcaacaccgattaaagaaattggggaacatgggaatggaatggatccaaagagaagaaaacgaaacaagagatcccaaaaatggaatcggaaaacgaaaggattcaacgccttcttctgggaaatcaaagacacgcagtaactctggcagagagagagagaaagaaagagaccggagtttttccatttcggttcggattggtaataatgggctcagcaaaaataaaacatcttgggcccttatggaccctcttaccctattttaccataggctctacttttttttaccacctttgttttagtttcacttaaaattttagttaaggaaaaaaaagttaccgattatgtacactctactgttatttattagacacaacaaaactttcaaatatgatggattttccatcctattttatttataaaagaaaatatttatatttctaacatcaacaaactctacccaaatcagattatccttctgaaactatgcaatttgtattgtttttcaggaaactagtgattttttgaataattgtaatacttttcattcatcaaaaaaacatattatatctttcctttttttccatcaaaaacatattatatctaaatatctcattttgggttgttttttgataattaacacttaagcccatataaaagagtctagttcaaactgagcccagctacaccaaagaatctagtgggggacatgtggcaggtagtaatttgagcgttgaccaagaaaggacattattatacatccacctggttagagcatgcttataggtgatattctcaaagtatcattaaaaaaattttagtattatttataatgtttgtttaatagataaatattttttttcttacttttaataaatgctaccaatcaggagatgtcacgtagatgatactgatatcaagaaaatcactggaatgatactaatcaaactcattctaattgtttggttaataaaaaaataatttttacactgatgatattctaaaaatatcactcatgtacatggtcttaaccgttgaaatgttggtcgcggcctatatatagaagaacataactctaaaaatagctaaacccaaccacttcccttggattggaatctctcataaacagtttgttggtctggtccgctccagtccatactcataaggtggtagatgtttacttagggtacatcatacatgcacaacgttagtagttgcaggcatagacgtgtttgccctttattacgcgaaaaccactactcccttcgctagtctactttcgtcaattgaaccactaaacccaatgaaacctaatattttagtgtgctcaataatttatcatcatcccaattcccaagcgtaccaagattataatctaacttaacgcgcaatgtcatgacaaaacctatatacaatgaaaaagatttttcatgacaaacaaagaaaaaataaacacgagaaatgagttctcgtaataaagttggtgtgaactggtttttgaacgtgaagatgaccccttcatatttttatttcttggtttttgcttgagagggttaaagactcttaaggaagaaatacattacacgtcaaacctttttgggaaaacaatgaacgcttcatttataatgtttctattttttactcttaggtaaaacattgcaattgatagatgaacaagaacaaaagcagaggattaaaagaaagattaaactatgaaaaaaggacacgtgtgaagagaattagagattctgtattaagacagattaactaacaaaccaaaccctacttgttccactttctattcatacttaatctcattctcctctcttccccttcatacttaaatcttatcattcatccatcttttaatcattactcgagattctgtttccatg

SEQ ID NO: 24044 - DNA, 3000 bp, Unknown; identical to SEQ ID NO: 2537
  misc_feature (1)..( 3000): 2750-1469P.txt file - cDNA_ID_2162975; gDNA_ID_1620552; Annot_ID_160327

SEQ ID NO: 24045 - DNA, 3000 bp, Unknown; identical to SEQ ID NO: 2533
  misc_feature (1)..( 3000): 2750-1469P.txt file - cDNA_ID_2162979; gDNA_ID_1620552; Annot_ID_160328

SEQ ID NO: 24046 - DNA, 663 bp, Unknown; identical to SEQ ID NO: 2541
  misc_feature (1)..( 663): 2750-1469P.txt file - cDNA_ID_2163072; gDNA_ID_1620553; Annot_ID_160359

SEQ ID NO: 24047 - DNA, 3003 bp, Unknown
  misc_feature (1)..( 3003): 2750-1469P.txt file - cDNA_ID_2163093; gDNA_ID_1620553; Annot_ID_160366
atacttatgactgaatttgactaaagagatagcacaggcttagtaaatataaaaggcatggatgattttctcagaataataaccagcaaaatgaagcagaaaattgccattcagaatcagcaaacatttttagtgaatataataatccgtctaatccatcaggacatgtgatacagaatttcttaattggatatcagatcatttccattggccaagtaaaagtactgccaaatgtgatgtgagggggaatattaaacaacttcaaacttatgtaacaaatgagattgatgtcatattaccaattaatcgtgctgcaagggttttgttaatattcacaaattcattttgaagaaactgcagaagggtctttttggaagtgtctgtaataaggcgcttgataagcagcaagtcaactgacgatggatggtgctttgtctcgataggaatagggggcatcacatccgttcttcgagtaaacttaatagtgacatttttcctacatgaaaagaagatttaaaaacccgataatgctgcacataaagagctatgtgacagagcagcaaaaaaacagaaagatagtgatcttactctggtgtctctgatataaatctaaacagaaactgcgcataaggagtaatgacagccatttggcgcatatagtgcaagatctttgactggatacaacaaaaaaataaaatgtgttaaacaagtttgcgtgcatatatgtctaatgaacacttaagaaataatatacagcagaaggacgagctagaccacgtactctgtatgttgtccagtttccttcgataaccacctgtatttcagccccatgccatttctctttgttgcccttcttttcgtgcagatgaatatgaggaatgttcctgaaaattttaaccatttgaagacaattatacggcgtggaaaatccgaaggattcatagctattatgtcaaatgcccaaacataaaaaattagattgatatccgctttcgagaagctgctcatgtattcagatgggtacctgtgaatatcaatatccagtctgcagaaagtaacatagttttggctcttcatagatgacgagatctctatggggagacctgtactcattttggaccagattaaggcctgcacgccaggaaaatttagagaaactagaagggttaaacaagttctctggaaaaaatatcgatatgaagggaaacatagatatgttatgaatatgaatacaaaaacaaaagaccagctgcaaatcaaagccaatgattaaatcctcctaaagcaacatatacaacatatattccttttgtaaacctaggaacgagccatctaaaggctgcaaatttgaaactgataaaccacttcagcatttcatgcagttttacaggctaatctcagatatcaaacttgataagaatagattattaccatctttgcacccagaccaaactttccacgtgtttgcttcagtccatacttcgtcccggataaaactgtaagaagaacaatttgtaaacttagcctcaatataaaggtttattataaggttgatatgccaggctaaatcaatagaggaagtgagggtggtcattagctattttacctctcccaaacatatttggaatgtcatcatgtggcatccccttaccattatcctacattatgatcaactcaattcataactcaaaaaatgtttaagaaaacaattaggatctccatatatttatacatatacttaaaattgcatatataaatttctgttgaatcaaacaaatattattcaaactctcaccttacatgtcactttgtaatatgaggcttccccacgggcctttaaaaccttcgatactccaggctctttgtttttctttcccgatgccaaatttttagcttgtatctcactggctcgagcttcctttgctaaccttttctacataacaggaaacaacaacaaatattagaatcacaaggattacagaacagtgaaacttcttgaacactaaaaagtagcttcttaaaagcacaaggatttgatcagaacgaagaagagagtaataaacacagaattcacgcaccccacgggccttttctgtctcataatcatcatacagctgtgtgtcaacacgttcccgatcgataagaccaatcatggagttgaacttagattttacaatctcttcgcttcaaaaatataaacaagacagtcagtgaactaaacccctacacagtttctcctaccagaactaacatctcgaatcagcacgaagtaaggaacgtacatagttacttcaacctcagggagctctgaaatagactctgcagaatcaagagcattttcaacaagctctctaactgtagtataaagcgacttccctggctgatgagatccacaattcaaaattcgtgtgatacagaattgaaattacaaagatgcatcgtttgaattgaaaccaacaaattggggactcacattatcaaatccagcaatgttcttgttctccgcgaaaaactcagctggagattctgcaaattcacgaattcaaaaaagagagtcaattgagcttaatctcaattgaaatcaattgtgcagcaaatgatacatagagcattactttgcttgagcttgctctcgttgctgtccttagagttcttcgagcttcccttcttcgtttcaactaaatcatcacccgccattgaaacaacaacaaattgtgaaaatttgagtcagatcaaaccaaatgtctcagagtacaacactacaagtttccaatcaaaattcaaagcaggatctagggttttatggagggaagttaaggaaactcgatcaaagagattggttgctggggttatatcggtcattttactaaattatagcgtttgcgattggacttagtgtttcatgagttgtgtggtgtgactataagcagcaacagttgtaagttaacttgattctgtttggatccaatagagaaaaccattacacgagaaaggaaaaaaatg

SEQ ID NO: 24048 - DNA, 3000 bp, Unknown; identical to SEQ ID NO: 2544
  misc_feature (1)..( 3000): 2750-1469P.txt file - cDNA_ID_2163126; gDNA_ID_1620553; Annot_ID_160378

SEQ ID NO: 24049 - DNA, 3003 bp, Unknown
  misc_feature (1)..( 3003): 2750-1469P.txt file - cDNA_ID_2163192; gDNA_ID_1620555; Annot_ID_160424
agttcccctacaaaatccttgttcccttcctgcatttctccagattttaagtcttctgaaacaggcccaacagcttttcccttctggaaatccaagacaattttctttgggcgtacaaataatcgaggcaaatcttctgtcagtagtttggtcaagaacctgaaagagatgaagcaaaggaaggaggaaagaaactgatttatcaatacgtcggaagagagtaaacaatcaacagagagaagaagctaaaacgaatacattgaggagacttacattgataaaacaggaattcctgatgttgtcatccaaagcattcatgcaaaaagaagaaaatgattaaagctattactaatgtacatgattataaaaatcaaaggagataatgagaaagcaacagacaattatgattaactaatacccattagattaaacaatcggaatggtgcaagctcaaatttgatctttggaagtgaaacaaacgcccatgatgctgctccaacccaaggcgctgacggaatcaatcttaatttaacccatagttcaccgtcaatgtcaaaatcccgaataccaactggcacaactactgggatgataccaaattttaaagagagcattaacaacatccgagcaccaccagtataccgaagaccaatctggtacctataagaagaaaaataagagtataagcaactttcaactgagccgtgaacagactgtttggagtacccaagctccaaacgaatcaacagagaaaatttctaagatgcagtgaccattggtgtgttgaatccgtggatcatgtcagaacaatcccatccgtaaaaaccaagtaagaacaatcccagcatttgatccaccaacacaatgcattagctacctaacatataagtaacgtaggcaatcgcaccaaggtataaacttactgcaagtcattaacacggcgagatgtcctcctctcaacatttctaacagacaaaggctcatccccaagagagaattgcttaatttcaactctctgcacataatcaggcttcttcaaatcatcaatcacaggctgcaacaatccaacaagccaattctcaatcccacctctataaactttccagagcttaaccaacaccatgttcacccactccaccgactctttcctttgcaaatccttctcaagggacagcgagaaactggtgggaacctgtgcccatggcccggctcctctttggcctccatcaccagccatttgtctccgcctctttctccaagtccatagcttatcacaaataacaccaacaaagaagaagaatgcgaatagaccaattgcattacgactaatcggtggagacgggattgggtggattacacctagctgagtcctgagcttatccactataggatcttctctaaagttagtgaaattgtttctatcaccttgaattgcagactcctgtgaagatgaagatgcttcttcatcctcaaattcattcgaaaaccgagtaaccacaagacttctggcagctcttctcgccgaatccgctaatccaatgttcttggaatccgtacgaattccgctggaaacaaacctagaattcgaattcgccgcatgaactcgacggagaattctccgcctctttgtgaatccatcggagaacacaatcagaccgtgctcattggagcaaggacagagcagacgacgtgacacaaaagaagggaaatcgaaactagaacaagaagaagaagactgtagaatcatttatcatcaatcgaattcaccggaaactccacgcaggtgaacctaattgacgcatatcttcgccgttacaacagcagacagaatacagagaaacagaggaatagcgaatgtattagtcagtgttcacggtaggtcggtagctgagaaacttaggtctgtcttccgtagggtttcggataagaaattggaatcgagaaggttcgaaagtagtagcgacaagggatgcgcagaagatgggagaatgtgaatcggcaagtaagtgatcggtggagagtctatcgtcgtgaccttttgttgtacctatgcgaccaaagaatatgcgactgactataaggacccctcaaacttaagccatttatgttttttttgtggaacgcgttaggcgcgttactatatatggttggtcattatttcatttgaactatcagatcagtttaatttctaacgttgttatactatcgttatttaaatgaaagaaccgaatacaagaaaagaaaagcttctgtatcgtcttgctactcttgggaggtcggcgacccaacttgttagtagttcgttcgtaatcctttgctttttggactcttccacttatgggtcggccacccttttatgtccatcaagttaaaaataaaataatagtggtggatgaattatggtcaacaggttgctgttaaattagatagttcattggttactaattttagttttgtgcaaccatgtttattgtgtgttgttttctttttgtcggatgtcaataactaatgtcactaaattgattattttcagtcaactttcaattttcatatgtttgagttagcttcttatatactttttgaatctaaaaacactatccacgtgcgtataacataatgtcttcttttcgatcgattagggggttttcacgaaagaaattgacttaggaggtgaccaaatcacgataaagaaaatactgggttatttcataaattaactttaaaatataaggtcttctcggtaataatttaaaatatctcctttcttccttttcccccggaacgtaatctcagccgtccatcctttctatcatcctacgatctatctaaaccgtcggctgaacttcgttctcctgaatcgcgcgacatcgacatcttctgattcttcctcactagttttttcctaaaccctaacttcttcgttcgcgtcgacgaagctgctggcaatttctcgtcggaaactattactcgataccaccacctgtttagtctttaaaggtaatg

SEQ ID NO: 24050 - DNA, 3003 bp, Unknown
  misc_feature (1)..( 3003): 2750-1469P.txt file - cDNA_ID_2163206; gDNA_ID_1620555; Annot_ID_160428
ctgttatggtggaattggatactaaaatatgtctaagagtgggactgcaatatgaccttcttagtttattcgatgttttggttgcagaagaggaggtcatggacgtttctgctagaaagtcacaaaaagctgggcgcgaaaagttgaggagggaaaaactgaatgagcattttgttgaactgggaaatgtactcggtatagactcaatggttatgtggatttttctaaacagcagatgatctcactttgatcctcacatagctcttctgtttgcagatccagagagacccaagaatgacaaagccacgattctgactgatactgttcagttgttgaaagagctcacatctgaagtcaacaaactgaaatctgagtacaccgcattgacagatgagtcccgcgaggttcgtaccttatcccttacgctccaggcttttcctaacagaaaaaattagcagtctacatgacgtaaagatatcgatagggatcccaatatagataactcattgtctttttgcttttacgatatggtgactacacctatttcgtaagatgcaaactcagacgggctatataatgtaactgcttataggacttgttgttatcatcaatagcaacacttacaaatttactggtacttgtataacaacggttctttctgtagttgacacaggagaaaaacgacctgagagaagaaaagacatcgctgaaatcagatatagagaatctcaatcttcaataccagcagagattaaggtcaatgtctccatggggagctgcgatggatcacacagtcatgatggctccaccaccctcctttccataccctatgcctattgctatgcctcccgggtcaatcccaatgcatccatcaatgccatcttacacatactttgggaaccagaaccctagcatgatcccagctccatgtcctacatacatgccctacatgcctcctaatacagtcgttgagcaacaatccgtgcacattccacagaaccccggtaaccgttctcgggaacctagagcaaaggtttcaagagagagcagatctgagaaagcagaggactccaacgaagttgcaacacaactcgaattaaaaacccctggatctacttctgataaggtagagagacttaaaactagaagctagagatctccaatttttttcggatttattatcttcacagttattcgcgaaattgtattttgaaggatacattgcaaaggccagagaagacaaagagatgtaagagaaacaacaacaacaactcaatagaagaaagctctcattctagcaagtgttcatcttctccgagcgtacgagaccacagttcttccagtagcgtagctggtggccaaaaacctgatgatgcaaaatgattcgaaagaatctgatgttgatcatctcaagtatccaagtatcgtttcgatgagtactgtatatagtgcgagtacaaaatgcacttagctgtttaaagcagtgttttgatgcaccgtggcattcgttttcctcggatagtcatttctcagatgattttcatccttaataggtctgctttagttctaaaactcggatgatttgtaatttccagtgtccaaatctactaattttattaatcctataaattaaacaaacttatatcttgatttttttttaaaaatcatagattatttatactattgtacaaaaagaattacatttaaatcggtaaatatagtttcaccataaatatatggtttcattaatatcataaattagtaatgatatagatatatcaacaatatatatttatatatatattatatgtaagaaatttctttgaaatatatttttaatatttagttctcatttgtacttatttgaatttagttctaatattttactgtatcaaaaaaaatttggtgttattttttagacatgagaattattttttacttataattagttataaaaaaaatattttttataatgaaagaaatcttatagtaaaaaattactatgaaaaatttctttataaattaataaaattttagaatcccaacattattaatttgtaaaggttttactgtagttaagttcaagttcaatttaagctggtgctaaacgttagctacgtgttcgtatgatgtcaactgtctagatacaggaaaatttctccgaatatacagcgactacacatcaaccatagagaacagtatgaagtaaatataccctctatccatcgcatatgtagtttgtgggagtgctctgttggtttcgctttcctctgatgttgtataccctgtattgtcaaatatgactgcgacacggttcccactcatctcatagaccgctagataatagtctgcatgtatataaaataattgttaaagacaaaacatagggcatacccaatatcctttgtgcatagtatttagtatgtcatggaagttaactaggtctttgagagttcgaacgccatgaagagcaaaagaaagagaggaaatacggaagagaaagacaaaacaaactaaaaaccaaaagacatttgacctatcgtttctgtttcacaggacgaccataagatgtaaaagtcttgcccatccattccacaacccattatcgattcacaaggcaacataagaagaagtttacatttcgatgagctagagcaattctctagcgcagatcacaaacaaccaactccaacctctggttatactatccaagatttttacaggatggtgcctgaggctgccaggtttcgaaggaataaagagttttggtgtagcaagaaaaattaagttacaagacactaattatattgtagatagagacagaattgaaataaaatatggaacataaataaataattagataaatgagtcagcagcttcggtgaattgttctgtatctcggagtattactgccggcgacgaggatagtcttatcttctcctctctaatgactttgattcattttcctcttcagattcaaatcctagattcaatcggagaatg

SEQ ID NO: 24051 - DNA, 3003 bp, Unknown
  misc_feature (1)..( 3003): 2750-1469P.txt file - cDNA_ID_2163229; gDNA_ID_1620555; Annot_ID_160436
cttccccatgaactcctacattaatcacatctaagaactatgatttatatttttagcttctaaagcgacaaatctttccacattgataaaataaagctcacaccaaaaatctcaaaatgaaaaggaaaatgatcaactgaatttcgtaaaagctgattctgtattcatgcaatgaaatgaagatgattggaggtcttaacttctttctacgatacagaatcacaaacacacttgaatacagaagggcataccttcttgatgagttgaacatcataagattttccatacttctgtctgatgagggttgcaagatctaagccgttaaatgcagaatcatctgacccaaccattctttcaagattagcccgattcatatcattcgcttgctaaagaaaaagaaaaaaaaagtaattctaaatgattagatgatatcaagcaaccaataaatttaaacaaaacgcttgtttacttgctgtgtcactaagccatgacagagatggacaaacatttagacatcaaaaggactcaagaaatcaaattagttacgcactttttccaggatcaagcaggagtagatcaacattctaagtaatctcacgaactagagagtttgaggctttcatgtacaacaaggattaaaaccacattgactgtttaatataattctagtgtataaagcacagggaaaccaagtctcagttcttaaaggtcaagtcatgacttcaccttagaggacagcaaaaaatggccggagtttacaaagcttatagatttctcatacatacccttttagttttatcatcgagtgattccttttcctcgtcatccgaattatctagattcccctcatcatccacaatactgcaaattcttgaaaactttctcctatcagttttcccataagtagtcttcaagcagaggctatgagagaaagccagtcgtccagagaaacacggaccgcaatatctcgaacaagaaaccttagatattgttcctataccgctacgttcgtgtataacagattgttgacagtgatgatgacttgatacaatgctcatcatatcctgtaaaccagtgaaattccaaaccatgaagcaatttgcagaatctaatagaggatgaatctaatcctcaaaccaacagtgaacacagtgatacagaatctaagtagagaaccaaagcaaaagttcctgataaagtgatttcacagacaattgcgtagtaattgttaagaatatgaatctcgtagcatcataatcaatctcactccttttatattctaagagattcatccagaaatcgctgttctgctaactaagcagcaattatctgaggattcatcgagaagcgactaaacatgaacaagtgagggagataaccagtgaagcagagactcaatttaagaatttagcaagaagtagagggagagcgtaatcttaccgccggaagaggtggggaagtgcacggcgacgatgcggaggaggagattaatagatgggggacaaagagatatcacacatatcagtgaatgaacggtgaaggaggaaacaaaaataaaactcttaaaactttgcgtatagttttcattttcgctatatcaatgatatcataagatttgctaaaaattatagtagaacaaaaaaaaaagatagcatgcacaaaaacgtcttaaattaaaatacatgacttataaaaagacaaaaaaaaacacatatttatccaaattagtttagataaatatgatatttaattttaaaattgctatgatataaaaaaaatatataaatttggattaaatagtcaacaattatgatgaattaattttcgagataaaagtaaataattaaatattggataggttatcagaataaacaaaagtaagccaaagtttttttccattaaagtcaaggttttgtaacttgcacgcttcagcgaagaaacggtggcgtctcggcccttccacacattgacacataatatctacttggtcttttgctcgtctcattatctgaatttttttcttgcagcatcgacacatgagatttcaagctaaaccatcttacatatctttttgtttttgttttaattaaataaaataccaaattgattcgacattccaatatgtaaaccaacatacctgaatacccaaaactcttttgactcaaaatcgaagttttctttcatttttctcaacaagcagaacttatttaaatctcatacgtttataagatataaactgccttgattaataatatagatctactatatcttgttagcttgtgaaagaaatatttggatgcacaaagattaaggtcttgaatggttgttgaagccattccaaatctgaccaaagttagaccaatctttttttcttctaccatttaaactgatctacacaggacgaatacaatgtagatgagtacacaaatcacaaagaacaactattacataccaaaatatcactatctatattttaatttcttttactttaaaattaaaacgtactccaatatagagtttagcataccataatatcggtatggttggtgtagtatataccacataaccattcaaagtctatataaattttcggttatgtaggggttttaaataggccgatagtgaaaagcatcgatcaaaaatgaatatactcctaatcatgatttttggattaacacatactacctagtgatgacttttggattaacacatactacctattgacattataaacggaaaggtggaggtgtaaatgataataaatatatattagtcggtgagtttagaaagaaacaaaaattaaaggggtgtgatttcgaagaaaatgttgcatagttttcaaaatttgaaaatctcagctaaagagagaaagagaagcaccatttttctttctcgtcgtgtcatcgttttctcagattcctgaataatcattcccttccgattccaaaatccccaaacctcatccactcctccatctcccggattcggattcccagaatcatg

SEQ ID NO: 24052 - DNA, 3000 bp, Unknown; identical to SEQ ID NO: 2560
  misc_feature (1)..( 3000): 2750-1469P.txt file - cDNA_ID_2163233; gDNA_ID_1620555; Annot_ID_160437

SEQ ID NO: 24053 - DNA, 3000 bp, Unknown
  misc_feature (1)..( 3000): 2750-1469P.txt file - cDNA_ID_2163371; gDNA_ID_1620557; Annot_ID_160478
gcagtggtggtcgtgggtttcccagctacacctctactgctggctagggcacgtatttgcatctccgcatctcattcaagagaagatcttataagagccctcaaggtaaaatattgcattctacccacttgtgtttttttcttattacaaataagcgctattccacagaagtcccaaagcacaaaactgctaaaatagatctatatgcttcgatagagctcggtttcaatgcaagacaagttttgaatcaatgtgtgtggttttgtgttggacaggttataagcaaagtaggtgaccttagcggaatcaaatatttcccggcagagccgaagaaaatagaacagtcgaaaaacgacatcaagctggattgaagaattaaccaatgaaatagagatgcatccaggaaaacgcaagcaaatgctgtgttatgtgttaacttctccatatctctctgatgtgacacaaatctgatttctcaggggtccagccatttcctctctaagtaaaacacaaacccagagttagtccacctttcctcaagtcttgtttaccatggtgctactgcatttatgtgattcttcatccatgtttttccaagagtttaaatgtatagtaatatcgttgaatgatgtcagagttcttttattactccggacaacaactgttttctatgtttggattatttgtatcaaaaggttttggataaattggtcaattaagttcccaaccatcaaaaaccacaaggtacaacaatcacaaataagttaatccttcttcatcttcctctaccattacaacaaactaactaaaatgttacattcaaaccaaaaaaacatcaaaagagagaattaagtttcagacattgccaatggctggtcacaaaaaacaaaactcttccaccatttttcacgagaactccctcccaagcttctgaattgcacaatacatcttcctcctagacccaacagcattaatccccatatctttaagatcctccaatgtcaacaatggtaacacttgttcatcaacttcatgcatctcaaacattggccaatatctccctaaccctaactcttgtaaccatatcttcactccttcttttcctcttcctccactttgccaatctcctaacaattcaacctctctattctcgtaccgtcttcgttctttcatcggactctccgaatcttctctgctgaaatccctaaacccttcttctcctcccaattcttcatcctcttcctcttcttcttcctctccactgaatttctcatctccttgctctacaccatcgtttctcgtcgcccaattcgacctaactcgcttcgccgaagctgtattcgtcgtcgtcgtcgccgccgtctctccaccggatgatttgacccatttcttaacccgccaactcccaatcgaaaccggatcttcatctagggttccagtattctcatacccaccggagctcaaattcgtcatagttcgagtcctcgaagacgacgtcgtcttcccactctgattattcggctccttcctgttaccaccaccaccaccaccaccaccactaggtctccatttcggccgtcggacttgcggagaatcgtacgccgcaaccacgtgttggtggtactggtcaccgccgatgtctcctaacctaacgctaggtcttctcaatcgtttcgatccgactgaaactccggctgcggcggatgtttccggtgcttcgattgagtttattatcgccggcgggataaaaccgccgttaatctggtgaccttctactaactgtaactcggccatggaaaacgagagagagacggagaaattgaaggagagaaaagcgtttttttttgtttggtcttcagtttactctggaaccatatcttgctaacatgcgcagaaagggattttatttaggttttatctggagaaattggattgtgagagagagagaagacgaagagagagtagcgttcaaatagtggacacgtgtttctggagctcttgtctcttgtcatatttcttttttttgttttctttcccaaacaaacaaatccttaattgcattgtttatctttgtcattaaaatttcggatttgtttctatatatatcttgctttgtatagatttgtaaacaatcataagttgttgtatattaatcatcctttatagatttgtttccacacatatttccatttttttttataaattaggtaatggggtttaatttgttttcccttttttggcttagccaatttcattggacaacagtccacctgctttataatccaacaccaatttaattttttgttgtgcgactaatttaataaaaattgaggataattcatctatataatttcttcaatatatgcttcaactttatttttttcactttataaaattttgacatattcacccaatatcctcctttacaaatgaatgtatttgatgtaagaaattgtatttgaagacttttacaccatgaccttatatactagtatctatcttcttaaccacaaattagtgattatctgtcaaattaaagcttggtaagtttgtgattatgcattaaaattgatagtctttcataacttttgcatttactcgagtacacaaactttcacatgtttaaataaaaattattttatagggtttagtatttttttgcaaatgtaaacgcaaaactcaagcacgaacatagagtactcattgatttattgttggcgtttacatttacaattattaaaataaaagtggtcaacataattaaagttgttagatcagtcattaaaacggcaagatgttctaaagagtaacattgaaacaacaatagtttcaagtatcaattagtcccgcggcgtgtggcgatggcgcgtggtatccgccaaaaacccttcccggaactagaaccctaacttctctgcaagtctctctgttctagtcacaattcactgaattaaagtttgaaaacccatgatgaaatgttgaacctttccaatttccatg

SEQ ID NO: 24054 - DNA, 3003 bp, Unknown
  misc_feature (1)..( 3003): 2750-1469P.txt file - cDNA_ID_2163400; gDNA_ID_1620557; Annot_ID_160488
ctctagattaattatgatcaatttactactgcgcatcttatcacagtctttgcttcattcactataccactcatgcatcgtctgatatgcatcagatgttattgggcaatttttcaaaagctttgcattacctttacttgatgttaaggaatcaatatttgagaattatatttgtacaggaaaccttgaaggagttggtgacatggaaagccaaagcggagcagcagctgatggaattatcaaacgctgtccttgctcttaagggacagaatcaacccaactggcgttacccgtgaagactaggcacagattgatcaatgattttgctttaactagtcgattccacctgcatagaatcccttagagacatgtacagggtttctgataaaactaaaccaaaaaaaaaaaaaaaaagaacaaagagaggaggctagagaggagtcgcatctgaaaagcttaggaacaggtaggacttaagtaagtcatatagaagaagtttgaagtgaaaatttgaaggtagagatgctttaatggtaattgttttgctgtatattctctctcggatctcttattcaacaatgaagcttacttttgagtaatctcttttctttatcccttttgccatattgttaagttgatgtcatattaccacctcccacattgattcagtctttgcttcaatatcactaccacacatggctgcatcttctgatacaggaaaccttgaaggagttagtgacttggaaaaccaaagcaaagcagcagccaacggaaatatcaaacgctgcctttgctcttcagtgacagtaattccgctctagctaatcgattcacagacaaagaatcctttagagacatagttttttcttataaaatctaactaaaaaaccaaggatactagagataactcgtcatcttgaaaagtgcaggaacaggtaagacttaactaatatcacacagaagaagttaataagtgatcatcatctacatcatagtgaaaatttggaggtataattggttttgttgttctagtggttttgcttttatattctctctaatgactcttttttctctttcaaactaagaatatgtattattaagtttaaaatgttaagaggtacaaaaaaccattcgccatacaaaatgccttaagagaagaacaacaccatggcccaagtactcttcttcttcttcttcttcttgttcatgtccctaactttcgctttgtttctgtttagagagatgtcttgtgatagaatgtaggataattctgtgaatattggcatgatgttgaattatatgaatcagaaaggtatggattgccgatcaggccaagactcgatcttctggaagtaatcgacaggcaagacaccaacaatgccttgagtcaaaatcactttgttgtctgaaatgtagaacgcaatcccatcttcaagagctttcttgatgtggaggaagatgataacatttacatttcttctcacgccactaatcacttcaccatctgtaggtaatccacaagagaagtgaacatgcattctattcatacgctttaagcccgatgctaagatggattctaaattcttcctataagttccatgtacacacactggagcttcttctggtgacaatattggtttaagtaacttctctgactcaaccgtcgtgattgagtggccttgattagcgcgaatcaagagctctccatcctcatcgatgaggctaaaccgttttttattgtcccttgtcacagcctctctaatttcatcaatcgtgtgtgaatttaactgaatatttgcacaagttttcaaattcaggttgagtaaatcttcaactttaacaaaaccatcacctctcatgttcaatctcagctcagtagccatatgtcgcaatattctcgtcaagattcgtccaagggcatcgattctatccacaaagatcattgcatattaaggaaaagcagcagctagattcacccgtttcactgcacgtatcgtcctcaagtgctcctgaatttgccagaagagagctttcccagaggaaggcgtgtagtttttttcatcattcaaaacctgagagagaagtttgttgattgttagattctagaaaccgcgttgctagggtttcgaatcacccaaattgaaatgaaaaaaaaaaaattgtgttcttgcttgtctgtttattttggtttatttacaattcattccggttcaatgttaggctttcattaaccgatttaattattcttccggtttaatcaaaaacaattattcttcttctttcacaatctctcctgtgttatttacgccgactcaaagaacccaaagctcttggaggaggtgatcttctcttctcagatcatcttctactcttgagtatacccttcctttgaagataattcctagtttgggacttatccttacttctccgggatttcactttaatccaccgaagagttttgacatctgaattgtattgttttgggtgtgatcccgatagaattcgagggtaggaatcggaaaggtacgttatgaaatttgataattgtgatttctgtgactcgttattgatttttaagtaaaagaacgaagctttgtatatgatattcggagttctaggtttaattgaattgttgtcgttgatgttttgatggggtttaactttttgaactaattgctctgaaattgcttaaccaaatcaagggttcctatcaactgtgtcaaaagttttctctttgtgaattccctgtttgatggctagggttaatagcaagtgagaccatgaattgctttttatggttactatgttcattctgttattctgaagccgatattatatgttgccaagtttgtgtgtcacttgaattatctgttattgtacagttggatttgtgaagcatttatctgtttctgtgttttcgaatttgctaaagctttttagagtactaacttcttcttggttttgctgcagtagggtgatttggtttagaagaagaaagaaatg

SEQ ID NO: 24055 - DNA, 3003 bp, Unknown
  misc_feature (1)..( 3003): 2750-1469P.txt file - cDNA_ID_2163406; gDNA_ID_1620557; Annot_ID_160489
cgagggtaggaatcggaaaggtacgttatgaaatttgataattgtgatttctgtgactcgttattgatttttaagtaaaagaacgaagctttgtatatgatattcggagttctaggtttaattgaattgttgtcgttgatgttttgatggggtttaactttttgaactaattgctctgaaattgcttaaccaaatcaagggttcctatcaactgtgtcaaaagttttctctttgtgaattccctgtttgatggctagggttaatagcaagtgagaccatgaattgctttttatggttactatgttcattctgttattctgaagccgatattatatgttgccaagtttgtgtgtcacttgaattatctgttattgtacagttggatttgtgaagcatttatctgtttctgtgttttcgaatttgctaaagctttttagagtactaacttcttcttggttttgctgcagtagggtgatttggtttagaagaagaaagaaatggagggttttgtcgatcactacattgttctaggtttagcttctggagaggaagctctgaagcttaccgagaaggagattgcaaaagcatacaagttgaaagctttggacttgcatcctgataaacgccctgatgatcctgatgcccatgagaaatttcagaggcttaagacatcttacgaggttctcaaagacgagaaagcccggaagctgtttgatgatcttcttagaatccagcgtgagaaacaacataagaaatcgcaagtagattccaagaggcgtaagatgatgtcagatctggaggaaagggagcgttctgctttttctcctaatccttccgctagagcttatgatgaagaagagagaatcgctaggaagcttaaggaggagatagataggatacgtgcaagacatgcgaagaagaaaagtggtttccaaactccagagagtaatgtagatgaaaagagaaaagaagaaagaagtggtgctggagctagtgttcaactcgataaagagagaatgttgaaggtttcttgggaaaaaagtggtgaagggtatacagctggaaggctaagagaagtgttttctgagtttggtgaggttgaagatgttgttattaggagtaccaagaagaaatgttctgctcttattgtaatggctacaaaggatggagctgtgagtactattttactaagttggtttctctctttttctttatacatcaagaagttaaattgattcaatttgttttttgtcttataggttgcagcgacgaggacattgtgtggcaatctttctaatccattgttggttgtacctcttcagaaagcagcccaaactgattttctgacggctaagaaatctgcagaagcagaaccgcagagtaacatagtaggtgccggtcttcaagcttatgaagatgccgtcatgcaaagactgctacaggtatttttctacgctcctcaggttcttgctgattcattcgtttgtgtttttttttctcaagaactctcatattttactctcttcaacaggcggctatggaccagaaaaagcgaggggtttaagccacatgatcaagaacaaagctccttcaagaccaaagtgataaagaataaagctctgcttcatgattaagaattaagctccttatacattgtttgtgtacatccaatctcatatcagttgttgttgtagaatttaaaattctaactcttctcgaaaaaaaaaatgcttcgtatcatcttcaggagagctttcaatttgtaccggaagtctttttcaaacaagtttttgttttgaagaaaattttggatttgtataatattcctttatctagtttcatttggaattctgttgtagatttcatgtgtttgtccatgatttcaccaaatatctcatttatttgataattcaatcactacaatagtataaaaatgtgatgtttagaagatatatggatttaaaatgtaattaagcacagggttgatggttactaaataaataaagtggacactgacagaaagttagaaaccaaacgagaggaggcaaagacacaaactagaatgcgtatgaaagagaatgaaattttccttttaattttcttttctaaaatgattcgatgtcttcatcatattagcagaaaatacatgtgacaaaaatagtttcttgaataaaagtaatttaggtttaggaaaaaaaggctataatttaaaacgagctacagtttcttcgtatgtaagcgaaggagacgtttttgcctttatttagtgccctaagtactgtacgtagtgtagatacatatcttcattaagtagaaaattttattcataaaaactcaattaactttttttttttcctttttattgcagttttaagttgtaaattacattgtttttttttgcaaaaagtatgcaataaagtattaaattaattaacactatcgctacaactacttctttaattagtctatactattagatatcatataattttatttcttaaaagttaaaagaggcaatattgtacattttgaatgcattgtgccttattaaacaattaaatttatttaactttaataaagttaaaaataaaaataaaaatttggactctggtagtatattacctgattaatatatttgagtatttgaccaaatttatatatttagaaaatataaaaatatcaactaattaataattcaactatcaatgaatttttttccttcattcagttaaaagcattcatggaatttgttttacttcccattttttcatttgatgtggacaaaaaatctgaaatggaaagctattattagctaatcaatcattgtccaaaacttggttttatttctctcctaactcttgacttccctctctctctctctctctctctctctctcttcaatgccttctccaagtcagtttctttcctcattcaacagtttctcttcttcttcctctgcttaaacgaaaccctcaaagaaataaaaaaaagctctcaagaatg

SEQ ID NO: 24056 - DNA, 3000 bp, Unknown
  misc_feature (1)..( 3000): 2750-1469P.txt file - cDNA_ID_2163426; gDNA_ID_1620557; Annot_ID_160493
tcaatctcattcaattcttctctatgttagattcaacagtggtcatgggtaaatttgtaaaaacaaactttgaatgattacagcggtccaaacagacaaaaccgtttatagaccggaccgctttttatttaccattcataaattataatccgtaatagtacatacttaaaaaaaatagaagacaaccgcatcggactaactgcggacagtctttaaactaagtccgcatcggtttgttgtccgacccaaaaatggtatggactaaaccgctacggattagtccgcactaactacaacatccattcaaagcaaaaagcaaaacaagaacgaatttacaccatcatgatttagatacacgatataatccaggcatatttaatcccgtagttaccttccaagttcaaaccatataaaaatgtgaacttctaacacatcggaatacaaaaaatttggtctctaataatacatcaacagtgcatctctagtaaagaaaagaaaacagagcatatatcgtctcatcccaattaattaaaatcgttaatacctaattagttagtgacttataatttttttggccaaattgcgaatgcggtgtcgttttaatgtttgaagacatgagaggttttagggtttatcttttttacactcacaatcaaaatactgacgacttcttcgccaccgtggttaacgctgcctgcaccgtcggcggaaaacaaaaaagcttcaactccattggtttcctcttcctcgatctctcgattaattctcagaggcaagcttcttctattagaccaaacttgttttcgcatcctaattgtcaatttcggcgatatcatttctaatcatcaattttctcccttttcgaattagatcggaattatgtataaattttttggttgcgtatctttgacgtgaaaaaaccctaatttaggtggctttccgcagttgaaaaccctcgaaattggccctgccattttcaatttctttgatttggattcttcatgctttccgtttctcgttgttttttttgttagaagaaagacgtgaatttgttgtgatgtaatttttaggattattctcaaagagagtagcagctatgggctggaaagctgctgagaaactcatcagacactggaagatacttcgaggagacaatgtgagtacaccactcatgttcttcttgtggtgttcattagtttggtttcatttttgatctgttgtttctggggtatgattttatgtgcaggtaatgataattcgtgggaaagataagggtgagactggaaccataaagcgtgtcattcgatcccaaaatcgtgtcatcgttgaagggaagaatctggtgagatagtcttgttctggatatcttttgttcgctctgtctcatgcatttagagaatgaatgtacaagttcattttttgatttttttgttcttgatttggtttgtagagtatgaactagtactgaatcaatatcatatcactagctcaacaccaaccatagagttatcaattttcatttgattctcatttttttaatccaagcatcaagtagacggttactaaatcacaaagcgactctagttccatggatttcgctacacaattcttttgaattgtttatcttgaaactgttatcgttttggatgttctaccttgctgctgggatagtctttgtctactcactgaagcttgtatatgtttttcgctgatgctttttttttcctgtgttctcagatcaagaaacatataaagggaggccctgatcacgaaggtggaattttcactgtagaggctcctcttcacgcctcaaatgtccaagttgttgatcctgtcactgggtatgatttcactctgcactactgtctccaattactcttttgctcaagcgagagatcacttattaatctattatcttttctaccacaggaggccttgtaaggttggtgtaaaatacctagaagatggaacaaaagtaagagtagccagaggcactggcacatctggttccataattccccgaccagagattctaaagataagggcaacgccgcgacccacaactggtacatagaagctcaatatctctttaaacgttggattttggaaatatatagtggaagtctgttagctatctgagaaaaaaacataatcatagatcggctataagataaacatagaatcaacataattcgtttgctatcaacataatcaacaaacttgatagtagcggttttcttatagaaggattcatacttttctctttgcagctggccctaaggacacaccaatggagtttgtctgggagcagacatatgatgctaaaactggaaagggcatgcctgatctttgagttgaaacctctctacagtttcgtttggaaaatgttgcctgctctcaaaaaggattcttctttttcccatccattagagtttgatttcggtctagagctgtgaggttttgttggagaacctttgatcatgactgaaacggagtcgttttccttttttctttcattgatcttgtgaactttcaaggtgccaaataaaatccgtctggaaaacagttcaatatttacatgtttagttattgtatatacactagccagaagtctaaacataaaacgaaaactataagctctaagtaaagtagatttatattatgcaaccgaattaacaatattaacacaatgacatgatttgcattgtaatgaaatttaaaattttgacaaaaaaaatatggaaattcaaattggttattaacttttatttttggggatgatttggaaatttggtgaattattggttacaataaataaaaggaaatattgaaggacttatatgtaattagtgtcgcctaatcgagtaattcgatccatcttcgtctgtcttgttaacaaagaaaactgagaaaggttttcttataagatcccattcttgtagcaaaaacccagaagaacaaactttcgaagaagacgactaatcaattcatctgattatg

SEQ ID NO: 24057 - DNA, 3003 bp, Unknown
  misc_feature (1)..( 3003): 2750-1469P.txt file - cDNA_ID_2163438; gDNA_ID_1620557; Annot_ID_160496
catgaccgataacgctcaacgtcctgacggaactatcaaccgccgtttcctccgcctcttcgatttccgtgctcctcccaatcctaaacccgtcaacatcgtctccacctccgatttcgtcgtggatcaatcccgtgatctctggttccgattgtacactccacatgtctccggcgataaaatccccgtcgttgttttcttccacggcggtggtttcgctttcctcagtcctaatgcgtatccttacgataatgtatgccggagattcgctaggaaattacctgcttatgtcatctccgttaactaccgtctcgctccggagcatcgttatcctgctcaatacgacgacggtttcgatgctttgaagtacatcgaggagaatcacggttcgattcttccggcgaacgctgatctctcgagatgcttcttcgccggagacagtgcaggtggaaacatcgcgcacaacgtcgcgattcgaatttgtcgcgagccgcggtcatctttcaccgccgtgaaactcatcggacttatctcgattcaacctttcttcggcggagaagagagaacggaagcggagaaacaactcgtcggagctcctttggtttcaccggaccgaacagattggtgctggaaagcgatgggattaaaccgggatcatgaagcggttaacgtcggcggaccaaacgcggttgatatatcgggtctggattatccggagacgatggtggtagtagctgggtttgatccgttaaaagattggcagagaagttactacgagtggttaaagttatgcggtaaaaaagcaacgttaatcgaatatccaaacatgtttcatgcgttttacattttccctgaattgcctgaggcgggtcagttaattatgcggattaaggattttgttgatgagcgcgtggcttcgctctccgcttaatcaccttcgctaatgatggatatttaaattagctcaatgaataataatgtattaagctctatgcttgtgtcttgtttagtgttttaaaaatggtgtaggtcgatctattttcattattaatcaagtgttcaactttaagtgaatgtttgggttggttattaaacttgttttaaagcttgtgagacgtggggtttttgtacttgtagtaaaataccaatgttggtttcattatagactatagtcaggtttgttgtacttattatacgagtggggatacaaaacaatggaattgattatttgtacggtgagattcaacaataccggtaggtgagtgactatgtctatcccttaagtttggtgaaaagtgagccacatttaatgcatttctagcaaaagatttaacgcccatacgactcttatttattactatgagactatccaaagctcttatttaatgtataatgtaaaggaaatgtattataagcttgttgaattgtgtaatctatatttgaaaaagttacattaacattgaaagaaacatgtttgttaagtgtgaatttaaacaaaatttctttgtaaattgtaaatgtaaatgctaaacccaatcggaaaggaaacctttttgtttgtgtttgcgtttgacgtgtacgttttcacataaataaaccatttctccgataagtatacactgaacattacatattttatctgattaaaataacctagcattattgatcgttgaaagcctagctcgtattttcacaccttattggcttattggttaactactaatgagtgatgtgacaacgtttaatatatgtgttacaagtatttaaatgatttcttacgtaagaagaaatggttaagtgactcattggatcgtccgtcttttgtcgaccaatacatcattcgtgtttttcgtagtcttaaatatgtgagaagacttatgtttttaacccatacctttcactaattaggtgaactgttcgtctcttggagatactgacaattaattttaaaaggaggaacgaattaatatggttagaaatgcaactatagtcacgtgtccaatctcataaaagatatggttttttttcttcttctttctaatatcattactaggtttgcacgtttagaagttaatcaaattgtgttttgttcttgattactttcgaaacttttttttctctacctttgtatttttcttcttctaatacttaggttatgcattgattcacaaatgatatgatttcactattcttgtaaagattattagtgaaaactgttatacatgaatgtttgtaaaacctcggaggccgatttatgatcgaattttcattgttggtggagcttaaggatgatttaatgagttaagttggttttatgtaactctaactatagcgtaaaccctaaaggcttaaagctaaagaaaaacaaactgtgttctgcttttaaatcactaatatgggccgttaaggcccactaagagtacgtatgaatccaataatggatggttgaccaatgaccagtcatacaaagaaaattaaaaaggtcaaaatttaccaaaatctcgacaaagggcaatttcgcaattaaatgcaaatctgcagcgtctctttctctctctccgccggcgaatttctattgcttccttctccgtcaattttatcaccgaccgtctgtactctccgaccacatatacaccgtgactgctcgaaccattggccttaggttagtcaaccctctttagcttataaagtcaatttcttttttccgtcaaattttgggtttagaattaaaggatttgaattaaaaaatttccaaacagtgcttttgtgttatgttgaattgcagaaatgggttgatttgtcttgtctgggtttaatttgaatgtagaatcgaactccgtttggaactggtttgttgaatgttgttcattgagaaatggttgtgtgtgtttgtttttatgttttgaagctcctgagccacccttaagtaccttaaagactgaaactttgaagtatcactttgatggggaagtgagagatgatcactagttcggtataaagatg

SEQ ID NO: 24058 - DNA, 3003 bp, Unknown
  misc_feature (1)..( 3003): 2750-1469P.txt file - cDNA_ID_2163474; gDNA_ID_1620560; Annot_ID_160580
cgtaaatttttgtgcaacctaagcctatgcgttctgattgcgtaatcttaaagcgagaacaattaaattttgagaaaaaaacaaagtaatcacacaaagaaaaaaaaaatcatgtgaacgacaaacaaaccccacataaaatggtgtattcgccactcgttaattggctatgttccgcgtcgctcagcaaatggatcgtgagtgtatcagttacaagtgaagccgaaaagaggaaaagaaaaaaagaataataattgtagattttatcaataatttataccatttcgtttgaaattattgaaagaatttttttaacatcatatttatatatagattttactgtaatgcaagttatggttttcagtaatacaaatttctaacaccgagcccgccattaaggtttatgtagtttctagtagattttacattatgttaaaaacgtaaaatttgaacgatctacatattattatgtatttttctaatatattttttagttgaaacaaccaattttgtaaatagctgtggtatgatcgaatcaagttgaagtgcaacccaaacattaatcgggtctacgtacataaaatctctaatcacgttgaccaagcgctccagctcgatctgctagtaaaaacagaagcaatatattttttatttttttttatgtacttagttagtggtatatatatagttgtaaattgggtatttccaaagaaccaaagtaatgtaaactatacataagcgaaaatttaaacgtttttctattctatagtcttgaaaattaaaacaatatttactaggaaaaagaataatataagggcaccgacagtttctataagaacatgtggcacgagggcttggagaagacagtacacagcattcaatcaatcatgaaaacgacatttgatgtggtaacctactaaagttcgatctttttttatgaaagtttcttaatatttctttaatttccggactatatctatcaacaagtcaaaagattaaaaaaaatcaacaagcaaaatactgttaaaatattgttttatatataccacgaactatttgtcggcaaatgtatacatatagtatagacatcatacatgggcaaatcgcatatatttgtgtgatgtgataccatagtctcaataatttgaacatttttctcttatttaagcacggaggaaaaattagctatatggcgacttggcgagtggagccaagattaaaaaaaaaaaaagcatgttatttaaaaatatggtagacataacatacaaaaaaatatagtaaaataaacagaactgattgaacaaaagagagtgatcaaagttgaaaaataatttaactataaaaactaaaaagaaaattatcagaggatggagatattaaactaataaaaatgtaattaaataagtaaactataaattaaataagtaaaaaattaaacgtaattagaaggaacaaaaaaaactagaaaagtaaaaacataagagaggaaggagggaagcaaaagtgaaaaccaatgcagtcaacagtcaaaaaccatgatacagtccatgcgtagaacataattaacttaagcaataaatttaataagtaaaaaattaaacgtaattagaaggaacaaaaaaaaagtatataaaaaattagaaggaacaaaaaaaaaaactagaaaataggatcttggacacgatgcttacagattgttttttgtctgggaagtaaatgcccatatctgtttctcgacattttgaagtctctctaacaaaataattagaggaattaagaacttgattgtgtaactttttttttaatcttaaattaagataatactatttcattacaactattattttcttgcacatgttgcaagaacgtgagagtgtacgcagacaaataattaaaacgaaaataaaattataatgattatatacaatctcggctatcaattgattaatagagaaaattgactaaccactctgaattggctcaaaatgtagttattaattcaaaccgagtttcacttcatttatattattttcattttttaactttaaaatatatatatttaataaaccaaatatgatctaaactaaatctaaaaggctccatccaaagtagatttgattttactatatatttaaaacatgtatggtaggaaaatttaaccgaaaccaaattaaacacattttagggtgaagaaaatcacccaaaaaaaaaaggtgacttttttttgtaacaaaacaaaagacctaaagtttagagacaaaataaaatgttagggtgattcaatgcatcacataatacagtattgttaataattaatggctaataataatgtgtgtttggaagtttttactaatctcttctttacaacaacaagtggagtggaagagagagatacacacaaggtttaatgggtcccacattcttttacttctcaaaatttaattactaattttatctaattttggtgctctttttcctcatctacataattgcctttaattatctcacaccatttaactaatcactgattctcttcttccttacgcgtttgtacttaacccccttttatcatcatttcgcaggcttgcgtctgtctctctctctctctccaccattgactctctctctctctctcgctctggaatcatcctttatttctgtgactgtgtgcactttcagagaggagagagaggcccaaaaccaaaagaaaagaaaaggttgtggcttgcagctgaatcaataccatctccatatatacaatacaccttcactattcccccttttgtatttttattatatttttcccatcaaagtctgtttttttagactccggtttgccgctttgtgtgtgtgtgagagagagaaagagagctatctatcctctgatttatggtctctggatctctgacaatcgagttgagttaattacaacacattcctctctttctcaatcgatctgtgaaatccaagattgttagctgtgtctgttttcagacaaatatg

SEQ ID NO: 24059 - DNA, 3000 bp, Unknown; identical to SEQ ID NO: 2579
  misc_feature (1)..( 3000): 2750-1469P.txt file - cDNA_ID_2163488; gDNA_ID_1620560; Annot_ID_160585

SEQ ID NO: 24060 - DNA, 3000 bp, Unknown; identical to SEQ ID NO: 2571
  misc_feature (1)..( 3000): 2750-1469P.txt file - cDNA_ID_2163518; gDNA_ID_1620558; Annot_ID_160513

SEQ ID NO: 24061 - DNA, 3 bp, Unknown
  misc_feature (1)..( 3): 2750-1469P.txt file - cDNA_ID_2163635; gDNA_ID_1620563; Annot_ID_160660
ctg

SEQ ID NO: 24062 - DNA, 3003 bp, Unknown
  misc_feature (1)..( 3003): 2750-1469P.txt file - cDNA_ID_2163645; gDNA_ID_1620563; Annot_ID_160662
atccacctccggtttctattaaaccgtcttcgttactcttccttctgtatacagcttcctgttgttgttgttgttcttgatccctaatatgcatcctctgaaattcctgcatttgtctttgaatttccatcggatttacgacgtgatccggttgaatcacacgcggatcgttaaacaaaggcggttctaacgccacaggaaccggtaatttcacctcagccggtggtggcggcggcggagctgcaactttctccgatccaaacaaaaaatccgcattattcggaggagcagttacggatttctccgattcagatagcctaggaacagtgttcaacgcctcgacgaagcgatctcgatccgattgagtcgaactttgagaaccaaatccagaagaagccgggaagagaaacaaacgcatcctcgctggcttagacgacaaacgaagcaagcgatcgtactcgtgcatcatatgctccagatcatcatcgttcgtaaccgagatcaaagcgtctaagtcttctcccggaagctgatacttaaacgtaacttctcctccgccgccatcaccgccgccgcatacggtggagagtttggaagctaaaacagggaatctaatcccgcgatcaacggaaagaatcttcgtttctccgtttacgtaagtgagctgattatcgtgaggccgtggctgaatcttgccgccatagctgcacataaacttcaccttgtagctatgttgctgctggttctggttctgatcatcccatggaggcggcgggttatcgaattcgatctcacgagatctcggtgacgagtcggttgaatctggataagagttgtacgagaatttctccatctctccgcgaaaattaaatgattttttttgttggtttggcttaattcatgaagagaagaaattagaaagaaatgaagaagactgttgtgatgaaatggtttttattatgtatcggtgatggtggtgttggaaaatgagtacgtgaacttattgctcatttacacgtggcctgtcagattttatgagttttaaggcggtgatgagattatgtgacggttctgtgacgttagctgaatctctccatggattaatatgacttttggggacactgtgaatgggcccaacactagtgttttgatacttcgacgttgaaagaggccagcttttagccttttacatgttttttcttaatattttgttaaatcaacattagtgaagcaatatttttaaggttaagtgataaataaatagttaagaaaaagggaaaaacaaaagtcgttgtcgtcgatctttcgcctgatcaggcttagatatgttttatgattgtgttattggatttcttttgtgtataacaaatatttgaatgtttgaatcatcatcattcatcaactgtattacacatccgaatagtctttgggttagttctagaagatagatgttttttagtctgtcaacatgcagaagaaaactgtaaaagggtcaacaaaaaaaaattgttatgttaaattaacatcaagaatataagataatttaaatttgacaccggtgagtgtatactcactttctcgattgtttgctattattatataccttagattattgccaacttgcaccttattataaacggtgaaattgttgtaattattcaaacttataatagacgtatttcactagcatgccgaaggtgcaatcatggtcgtacaagaacaatatttatattgtcaaattcacgtaacaatttttgttgttttccttgtttgtcgaagacatgtgcattgattagtatttcttccaatattattttgtgttagaacttagaaatgttcattattttctcatcctcttaaataatccatatatatatggactaatcggcccgccgtcccggtacgatgttgctcgatcagtcataaatcaagtcgtgtctcgtggttgtttgtacttggcagagcaagtcaatcaaccgaattttggtaaagatgcatcttagccaaaacttttgatttcactagatatactagaatttagcattatacgaatgtcgaccatactttttgattacttaagagcctcttatatagttagtcctattattgatagttttcttgtagtaatatttgaatattataacgaatcaaatttttcgaatctaataagcacaaaagaaaaatggaatcgaatattattttaaatgaaactatgtactaacataaatccaattatgttcaaatgaaaccaaatcaaataaatgaagtattcctagctttgaattagtaagtatcatatgaaatggctccatatggaaaccaaaaaatccaactgaatgcaaatgaaagtgttttcactacttcatcgtaaatataaagaaattgttaggtgtgataatgaaaaacattagttaacgggccaaaattatatatttacataataaaggggtagtttcataaatttgagaacatggttggaacatttcaacaaatgagacgagttcaatgtacacttgaattatgtacaaatcagtacaagaagcttaagatttgaagctaacatataacattcaagttcccaacaacttcaccgctcatctccgcacggctttcttcatttagtaatccttcgccggatcggatcatcgtttctcagattcctctttttaagtttcttctttcaggttcgcaatccgaatcttccacaaccattgttcgtttcgcctgtgattctggtttctgaaatttctgccttggcgtggtttccttgaatctgattacttggattctccgattctcatagttcttaccagtttttgttttttatttcacttaatttgttctgattctggataacagattcttatgataaggtgaaagatactagagattcatcggttttgttttgttttggcaattttctcaagtgtttgacttatagaacagtgacgtgtgtgatctatgatatcaattccaaacttaatgatgttttgtttgtagatg

SEQ ID NO: 24063 - DNA, 3003 bp, Unknown
  misc_feature (1)..( 3003): 2750-1469P.txt file - cDNA_ID_2163655; gDNA_ID_1620563; Annot_ID_160665
caaacaatcacggttgcaaagtaatctgaacatttcagtacttctctctcaatctacggatacaatgtttcagctacaatctctctctattgttttcatttcaggtggtggagatagtggttcctgaactggaagagatgcgtgcagcccatgttatttcgattgggtctccaacactgtcttctcttactccctactgtgaagctgggtatgtctctagctctatcatctatgaaccaaattagaactttggtttaagaactcccacatttgtcttgtatttcaggaaaaattcaaaactaagttatgacactcgtaccagctttgcaattttccgttcattctctgcttcagactatatcgctgctcaatgtcttaggtaagcggcaatagaataatgcactgtatgcgcagctttcacttttgcttctaaagtcacaagagtaaaccaatattgatagaatttttgttgcaggcgaagattgatggagtatcacttgaatatcttcaaagacgttgatgtcattgtgacccctacaactgggtacgtaatataatttcataccttatcaaaccatctagcaaattgaagatccctatattacttgcaatgtcttcggatatagttacttgtatattacttactgcttaaactcctctcactttacaaacagaatgacagctccagtgatacctcctgatgctctcaaaaatggagaaaccaatattcaagtgacaagtttgtcaagcaaaactctaacttcttacttttggtgcaatctaatacatagcacatttacatcagagttctgatattcaaattgcttcttttctagctgatttaatgcgcttcgttctagctgcaaatctcctcggcttccctgccatatcagtcccggtaagacattttttttatcagtctctaaccaaggcttagacaatcatgttacttatttcattcttgcaatataatcgtatcttctttctgattaatcactctctttttctaacttattggcaaacaaaaatcaacgcaggttggttatgataaagaggggcttcctataggattacaaataatgggaagaccttgggccgaagctaccgtccttggtttagctgccgcagtcgaggtactctctctttttctctctctgatacgttttcaaaagatcaagtagaaactagtgcggtaagaggcggtaaatagtaagagcggactctgtaacttgaatcgattttggtatttcaggaactggctccagttaccaagaaacctgcaatcttttatgatattctcaatacaaactgaattcataaggatcttccacagaactgaaaaggcaaggattgtctctggctgcggaatattatttatgtttacattatataaggttaatatgtcaattgatctacaaatcgacgattattgtgctataaaccgtgttggaatttcttacgtcgactatgattaattttaaaagatgtgaattagtcttgagcatacttgtaaacttttaaaatgcattttgaaaaaaagtttagaaacctgaatgctaagtaaatctacataacaatgcaaaaacgagttgaatttgtggaatcactaatgacaaatgctagatccaaaatccggttagtttcacatcgtcttgcaaatttatttatccaaatttctattatttaaaaagctttaaaacattgttttaaattccatagaaaaaaataaaaatcttatataaaatcattagaagcttgaatgttaaatctacataacgatgcgaaaacaagttgaatttgtggaatcgctaacgacaaatgctggatccaaaatccggttagtttcacatcgtcttgtaaatttattatccaaatttctattatttaaaaaacttttaaaaaattgttttattgaaaaaccttcaaagttttaatagtaatataaaaatataagtttaaaaatattatttaataaatgaaaaataagtgttaaaaatctaaattaagtgtaaaccatattgaatctagagtacctcttaggggtttggatgatgtatccaattagtttacacaaaacagaaaaatttaacaattaataaaaaaccttaaaattttaactataatataaaatatacatttaaaaacattttttaataagaaacaagtcgaaaactaaaattttattatagaaaagtttaaaaatctgtaagaagttttactaaaatccgtaaactttaaaactttagcgaataagaagttttagttttatcattaaaagaaaattaaagagaagggatgaaattgaccttggttttatgggccgaaattgtttcttgtttgggctttgcacaaagatctctagttttgacaaccgtcaacggctaactaatcccgatctatccaccttctcaagcttgcttctctttgatcatctccgtcgacgatgtagcccccaccgcgtcagaattctccgtagaagagagatcgcacacacatacatatgatctcgcttctagttattgtaaacaaagggctcatcttccatcacgctctcgtttcttgttggcgaaaagcaacggcaacaaatcaaaagatataaaatagaagaagtaaaggaagcaggaatcgaagaagatcatgctataaaatcagactttgtatttgcaattctcgctctataactctgtctttctctgatttgtgaattgtgatgatgagactatattttgtagacccatcttctgtgtaatttcctttctttcaactcaagtttccttttctcttgttactcttctgttgtttccttttttaccctttcgtttggaaaattccggagtaaaaggttcggtgaataaggacgaatgggcctaattaatatctgcaaggcccagcccaataagatatactatctaagaacagatttaaacccctaataaataaagttttcacgcgtgatctgtacgtctttaatttacttgtcctaacgcgtgatcggaaaccatg

SEQ ID NO: 24064 - DNA, 3000 bp, Unknown; identical to SEQ ID NO: 2602
  misc_feature (1)..( 3000): 2750-1469P.txt file - cDNA_ID_2163658; gDNA_ID_1620563; Annot_ID_160666

SEQ ID NO: 24065 - DNA, 3003 bp, Unknown
  misc_feature (1)..( 3003): 2750-1469P.txt file - cDNA_ID_2163662; gDNA_ID_1620563; Annot_ID_160667
tgttatcatctacaacagcatcacttggaagatcaatcccctttggaatctttcctggataatcagtcaccgaactgtccgatcccaacatactgtgaatacatgaatgaaaagcattagactatacatggttactacatcgtcaaagctcatggaaagaaaaatgaaatgaagaaacttcataccttctatcgacgatgaccattgaacgtagctcacaattagcaaagctgcaaatcaaatgaaaattatgaacctaatagattaaaaattcataactaagagtgtggaagcttactggccgcaaatttccttcttaacatctggatgacactcgttttgtagtgcattcaatgtgtgaaacaagaaaccactgtgtgtcacaatagctatctctttttctttccgtgtccatagcctacaaatccaaaaccagccatcatacaaagttctgttccatcaacattttcgataaatcaacaagactaatggagattacttaatttctacatggaacattaaaagggtcttcttcaatcagaggttgatcctatttgatgccaacttctacttatcaagctaagaatatcgaggaagctaagaggatgtttctctaagtttcaagttctgcacaatctattaaaaagaactaatttctagagtttagatataaaagagaaaataccagttcaggaacttttttcctctagctgcaagttcttcaatcgtttctctaacatcagccttccataacttgtcttcctcgctttctatctgaacgcaaatttaaatgtgaggagtcctttgaagcacatataagttgtttggcgtagctgtatgctgttaatagtcaactgggcaaccagaagattataagtaataatcaatgccaggcacatctaagactctcaatattacttgccagtgaaaagtcaactgcagggaaaagaaactgatagtcgctgatacttctcctctgatcacatggatgcactccctgtgtccacaaaaatggaatacaaaagtgaaaacttgtcgcagctaagcataattatttcgtgactagatctaagcttttgaataggacagcattgcgagtaggagtgaaaaatactgcaaaacttgtgtttgtttcatggtcactttaagttttgtgataattgtgaagatagataaacgcaattctgtccagttttagtttgtctctaggctatatgtattacactgaaaaggcataccaaatgctctctgcaggactcctctgtaataactggtgggcagtttaaactcgatatagctgcacggctgctatttcctgcatttgctaccattagaggtagtacatcactcatatccgtgtagccctctccaccaaaaacaccaacagcagtttgcaaggttctacgagcaaagcaaatccacaaaaatcaacactgtcaaaggtttatcaaagtggagtgcatgcatcaatgtgatcggtctcacacaatctattacactggtaacctataatctgtcacacaatataagaagttaaatattacactggtaaccaataaatctatcagttttcctaaccaagaagaccaattagactaagaaccagttatactaagatttcaatcacagatgtctagagtacctcatcagtggagacgaaatgaccagttcgatcttcttgtgaagtccactggaatgaacatgcttacgcaaactatctacctgtcaccaagagaatctatattaattttttttggataaagagatgcaagtgaagttatttttctctatagacctgtttccagccaagctgggtcaactcagcatcaaagtagtcatgagacatgtaagccttataattcttctccccatccacattgtgaatcccctgagcatgtctcacctgaacaaaaagtagtcaatatcagccccaaattctgatacgcaaacattagagcatttttgaaaccttcaaaagatatagatttcagctcaaagagatattataacaccactcactaggtaaatggttttgcagcgatgcaaagggtacaaacctataccagcaccagtctccatttctgcaaacactgatttaaaaaaaccatcaactaggatatgataaatagatgcaaaaaaaattgatagcagctaaaaaaactcacaagcaaattgcacactgtaacaaaaactaaagtttcgttttttaagacaaaatccgaatcggagacatataaatcaggacaccaagatcgaattaaaaagaagggaaatacatacaccaatcgaattcagaagaatcgctcaaaatcaaaagccaatggtttcactattacacaaaaaacaaaatgtagagattaaaatgatactttcactgtttcacagagctaatcattcacgtagatgaatacaataaaaacgtaaatataatatatatacacattggtttaaccttacacaggagattcgaagaagtaacccaaaggaggaagaggaaagaagatgtgaatgaagtaggcgaagaagcagaaagtgattagattagttggatgattaggctttgtttttctttttaattacttttataaattaattatccatgcagtggaccaatgaaaacgatttttttaaaaagctttctacaaaaataataaaatggtgagagccgtcaataatactaaccacgtatacgaaccatttgggtccgctcgtacgaaccaagccaaaaccataactctaaagaaaccaaaattgtgttttacattttgaaccatccaatattattatccttatctttatccattttattttctttttcagtttaagtatatcagactctgaggtttgcagtagataaccaaatgaattatcttctaaatcaaaatcgatttaaaccgaatactatagaatttaaaccgtataaaattaaaccgaaccggaataaattaccggctcaaccgcgagattatagtgtcattctctccagtttcagacgaatcgatg

SEQ ID NO: 24066 - DNA, 3000 bp, Unknown; identical to SEQ ID NO: 2580
  misc_feature (1)..( 3000): 2750-1469P.txt file - cDNA_ID_2163683; gDNA_ID_1620561; Annot_ID_160594

SEQ ID NO: 24067 - DNA, 3000 bp, Unknown; identical to SEQ ID NO: 2584
  misc_feature (1)..( 3000): 2750-1469P.txt file - cDNA_ID_2163695; gDNA_ID_1620561; Annot_ID_160597

SEQ ID NO: 24068 - DNA, 2562 bp, Unknown; identical to SEQ ID NO: 15116
  misc_feature (1)..( 2562): 2750-1469P.txt file - cDNA_ID_2163704; gDNA_ID_2926039; Annot_ID_196072

SEQ ID NO: 24069 - DNA, 2562 bp, Unknown; identical to SEQ ID NO: 15116
  misc_feature (1)..( 2562): 2750-1469P.txt file - cDNA_ID_2163704; gDNA_ID_2926039; Annot_ID_138186

SEQ ID NO: 24070 - DNA, 3003 bp, Unknown
  misc_feature (1)..( 3003): 2750-1469P.txt file - cDNA_ID_2163704; gDNA_ID_1620561; Annot_ID_160601
ctccttgtaaatcattttatgccaattacttatgctttaaaaacgattgtaaatcatgttttacccttttataagcttttaaaatcccttgtaaatcattcattgccacttacttatgcttaaaaaacgattgtaaaccatgctaaccctttttaaatcccttgtaaatcattgtatgtcacttacttatgctttaaaaacgattgtaaatcatgttttacctttttataagtttttaaaatcccttgtaaatcatttaatgccacttacttatgcttaaaaaacgattgtaaatcttgtaaaactattataaaaagctttaaaaagatttacaaaggttttaaaaggggttttaaagtatttacctatgtttttaaagactttataaaaattttaagagtttttaaaatgatttacaatggtttttagcaactaccaaaacttttaaaaaatttacaaagatttttaaaagcatttttttggctgggaaaaaaattttacgagaaaacatttttggcgggaaattttttttttggcgggaaaaaaagtttggcggaaattttttgtttggcgggaaaaataaattttggtacatgttattattaaatgagggtaatttggtcattctgttcaatagaagggatatttttaaaaataaacaatataaaatggtattgttacaaaagggtagtaaaaaaagggtagttttgcaaatctccctcgagaatttgcaatttctctctcatagcataacatgtcttttttttagtaaatttcaagatgacaaaaagaaaaaaaaaacataaagaaacaaattgaaagcaacatctatttttctgacttgtaaaaatgtggtgttactagcaaatatcaaatttttgtatctataaactagattttaacccgcggtatactaggagaacgatttattttttaaagttaatatatatacaagtttacaaattgaatatatttataaaaaaaataaattttttagtttacaattattattaggtaacatcccgccaaatctgttccatcaaaaagcttattaattttattaatgttaaccttagttatgatatgattctaaatcattgtctagatattttagccaatgttaggacgttgaacccacatagttttcgtcaattgaataatatatgttcgttttataaatttcgaatcacaatttatgcagaaaatgttttgaaatttttcttaactttacatattatacaataaaaaatcaaacaaagatgataggaaattcatagttttaaatcttaatcaaatcttctaaatatcaatattgttaaatatagaagtaatgagtataagagttgggttttatttgaaccaacccaactaagatttaatgaacatcataaactaatgggtctggtatcaaatgtaatcagatgcattttaacccacaatcaaaaggtgactgcaaaaatactatataagattcatagaagtagatcgtctatataggcctgaaaaatatcagttttaaattaaattatttagagatcttattttgttgggcttaaatactggagaataagactactttagtaatcaaaatatttgggccatgtaactaatgcaaaccaaaatcattattgacaaaagtcattgcatcaaatgattttcttaccaaaatgtctttaaaatatatatatatatatatatatatatatgtaccttcgtacggtacggttgcttttatataaaaaggtgttgtacggttgcattgacttttgatcgtaaatactatatagtccggagactcaaatgcaaaccactttctctatttttttggacggaagttatgttaacctaaattatctaaaatattacacaaataatttttaaacagtttaaaatggcatataattatgttaatagaaatttgacttttagtacggagatacattagctgagaagtttgacctcaccttatttagtgggaaccttgttacttttgaattagtttgaacaatatatctctaattcatataaagtattttgaaatataaagctttataaatataacatattttttggtgggtaatgcttctttttttctgtggcttataactacgtggagatcttatcttctgtccgcttatattagtatttcaccatagtgattttaataaaaatcagattaaacaatatataacagctattttagtttacaggtttaaacttttattttagttctttgattttttttttctttcagaaaatggtggacatcttctaaagtttgttttattaatctaggtagaaactttcaaacaaaagacgaaaacagaaaagttgactttagtacggaaatacatgatatgagataactgataagataacttgttagatggtttccactctcataaacaatataaaaaaattattaacgatagtgaactcgatttttagtaactctatgaaaatcttcttgtgagatcataacattttagaagactaggcttttcgtgtaatatgatctgtagaccattccaatgttatcatatgcagaacagcaacacaatgaaataaattaagagatggaaaataaattaagatcaaataaaatgtggatatacccttaagattccggagacaatacttctccagttctcctctcgtctataaatttctgccgtctcagccaacataatcacaaccaccacctctctcaataattctctctcttgtccttcacaacctgttactacttaggtgaatatcatctacatgtttattttgtcttaatccaaattcacatttaattttgttttcactctttttatcatgtatacttttttaattagctagccgagattatatatgttaaaactacctctatttctaacacacccaagcaatatatcatctttccaatatttacgaaagaagaaatttctatacaaatattaacctttactttgtgcaaaataggagagaagaaaaacaaaaagactgactgagatg

SEQ ID NO: 24071 - DNA, 3003 bp, Unknown
  misc_feature (1)..( 3003): 2750-1469P.txt file - cDNA_ID_2163708; gDNA_ID_2926039; Annot_ID_196074
ctagtaactttcccattattataatgataaattgttgagaaaatttactttattttagtgttactttgttctagagtaaaatcgaagaatacttagggagggacatagggtcagtgccggcttaacatggagaggagggagtgcaacaacgagtggcccataaagcaaaagggacacatacaattctttccttttgtaaacataaaaagaaaaagaaaaaaatatgtgcaaatataacagaaaattgcaaatttttactaaaaagctcatatatatttgcattccttttaaatataaggtaaaaaaaaattctaaatttattgggcccaaattatatgttgatatattttaatccaacaactctaatacaaatattgatttattgggccaaatctcttttgtaaaatgagattgttgttttattttattttaaatgatgtttactaagtgttttacttttgtacgaaaacaatttccaatatattaagggtccaattttttttttgccctaggacctagaataagcttgagccggcactgcagagggtcctaggatttttgtattttttactttgtaagtgaatgccatagcaagccaaggactgaagaagaacaacggaaaatatagagaatatgaatttgtgtgatgcgaagacgaaaagaaattatagaaaatcaactgaaattgatgacgtcgaatttgattgaggagaaaaaatagctacaaaataagaggaagaaaaaggaaaataaagaaaagaacgaagagaatgagaaggagaagccgaaaagggtctagagaagaggggtgttttttcatgaagacaagatactacgaaagaaggaagatgaagggctagttataagtagatgtagatctctgaatatatatatatatatatatatataaagtgtctccctaaaccggaaaaaacgatgggttttgatatgctgaacgggggacaaaacccgagaaccgaaatcaatttaaaagttcaccgatcactatacaactctgcacttattgaaaccgaaaaccaaaattctccgtttagacggttttggttcaatacggttcttattgaacgtcaatcactctatctactactatacttgaaaaacaaaattaaattttttgccttgacttgatccagagagatgttacgcggcggcgatgcattaatcgataaaatcaaacaacatgccacgcattgacttttgcaagaagccagcaactttatataaaacaatcgatgataattgtgatcgttacaactatgtaataatgcatatatataagctatgtattaactgtaaacttgatttaaataatactgatggggagtatataccttgatgcatagaataaaaatgtaaaatacgtatgaattactagcttagtggtagccttgttacttggattagtttagcaagcaaatatctagctctaattcacaagctaaccctaaaagttggttggacatatacatcgtcaaatatatcgaagctatatatatatatttaacatatttgtttttgttacattaaaacaaacaaaacaaaagaaaaaagttttttttgtgctcctcctttttaatatcttttatgaaaatggctgactgttatggaaaatgatgtttttattaatctaagtagtgcctttcaccaaagaaaaaaaaaaaccaaatatagtagactttagtacggagatacgtgaacataacttgttagattggttttcaacaaaagagtatagaatggaaaatcgttacatactgactctcatgaacaaacatattttgcttaatgaaaagtcaactcgatctttattatttatgaggataaaaatcaaataggctctgtcgacaaaacgaaacaatcagactaccctttagaatatatttaaaattaccaaaaatattaatcttttaggaaattacacatgatgatattttagcatatggcggatatttacctccaactccaaatgaggatattttagcatatggcggtctttattcgtacgtactattttgcaaatcattttatatgattgtatataccatagattataatcactactcttagtcccataatttgtaaataatagtaattcgtagacatagatgatcaaagttctttgtaatcttactacatacacaaaaagtaataaaacacaacatttttgttgtattaaatgtgcttgtccgttgacaaaaaagataaaagaatagctttgtttgtcctttctcgacaagtttgtattataatcgtctcacgttcatttcaagattacatgcagaatttgtcaaatgaagtctaaatcatcaaaagtaatttttccttatttgttctcacttgaatataaattaacgaaatatgattcaccataaattacacgaactataggatacgggtacttatttattcccttgcggtaatacgaataggtccaagattggaaatctcagagttgtcatgaatactaagttaaaatatgtgcagaccatacaaaacatagacgagcatagaaagagaagttgatcaagtgatggaaaaagattaaaataaaatataaatatggatatacccttaagattccggagactatgcttctccgatctcgtctataaatttcagccgtctcagccaacacaatcacaaccaccacctccctccctctctctctcttaatctttctgcccccaccattagcgcacaacggtgagattcgttagatgtttattatctatgcatccaaattcacatatagatagatagtacatatatagttgtttatatcaatagaaacttttgtttctaaattgtaatcgcttaaattatttgatttatgtataggtttaattataaatgttattctgttggttgtattggtactaaactaaaataatttagtagcatctttccaatattattataaaattatagttaagatatttatttttacttcatgaagcaggaaagacaagagaggcttagatg

SEQ ID NO: 24072 - DNA, 3003 bp, Unknown; identical to SEQ ID NO: 24071
  misc_feature (1)..( 3003): 2750-1469P.txt file - cDNA_ID_2163708; gDNA_ID_2926039; Annot_ID_138187

SEQ ID NO: 24073 - DNA, 3003 bp, Unknown; identical to SEQ ID NO: 24071
  misc_feature (1)..( 3003): 2750-1469P.txt file - cDNA_ID_2163708; gDNA_ID_1620561; Annot_ID_160603

SEQ ID NO: 24074 - DNA, 3003 bp, Unknown
  misc_feature (1)..( 3003): 2750-1469P.txt file - cDNA_ID_2163750; gDNA_ID_1620561; Annot_ID_160615
caatatttccatgcgtgattttgtattttatgtgataacattcttgctagccgatttggctagcttttggactaatgtcattgtctacttctgactcttacggctcaaaaactaagcttttgtagtttgaaaaagataacttatagtttgacttgttagctacaagcctagaatgctgttttaagcatgaagtagaaaacattttttcttattggtacaatggttgaggaactctatagcgggtacaaagaaaatgtagcgtaacatatgcaaaacgcacaaatatatattttgcactcggacaagtattttcttcatatcatgtaattagtcaaatacgacttttcatcaaaaatgctcgcaagaaatcctgcagtgtactctggtatggtgatatctttgtacttagcagggttttcatcagacaaaagatctttaatcggtccataaaccgtggaatttggagaaagactcgagctaaagaagcacgcaactgaaatccgcggtctatctttgttcggtcgtaccctatgctccacgctcaagaacttatcgttcgttatcagctgcaaaacaaaatgtctcaaattaattggtaaagaatctgtttttttagttaaaagaatgcatcaactggacttgcctgcatgaaatcaccaatgttgacaacaagagctccaggtacaggagggacatcgacccaataatcttcatgaagaacttgaagaccaccgatttggtcttgaagaagaagcgtgaggaaagagttgtcggtgtgtttacttatacctaaagttaggtcaggttgtgggcaaggtggatagtaatggcagagcataaacaaacccttaagacaatcaatcctcttaagtgtctcagagtctaaacctaaagcttctgagagaagttggaagagcacagctcctaattccattacatgcttcgtgtattcgatcaccgcactcctaaaatcatcatattaagaattaaaacactagaaaaggaaattgtttacttgaattaaaattgagataataaaatcgtggaatcatttgaactaagtaaatttatgttaaacaatcacataatgctaaaaagttttttttttggttatatatgaaaccaaattgtttagaaatagcataaacacaacaaatagtataatactattaatcactatatataacatgtacctgcaagctagtgggatttcctctggattcggaggatctggagcaatataacaagtgaaagagtctctccaattcaaaggagaagaatgatagagatcgaaatcattgttataaacaaatctcttgttgttatcggtaggaagatattggttcttgacaactggatcttgttcatgaaaccttcgaacactctctttgatctcttcaagaacagttaaaggaacatcatgattgatcacttggaaaaatccccaattctcagctgcgtctttgatcttcgaaatgacaacgtttcttgaagatgtgttacgatctccgaggtcgatgattgggacggtgaggtttaagccggagatatcagaaggtctgttgtttgataaaatagaagaagggacatgaaacatgctaggaacttcggttatttcggcatcgacgagtcctttcactcctgtcttcgtcgagataaaagtcgtgagatcgtttaaacgatcgattttttcagaattctctgtcatgtttttttctttttttctttctttcaagattctgttttttgttgttgttctgaagactcaagaagaagaggaagattcaatttaagacggaactaaagataagtgtcgaagtttgtggtgtctgtgattgagagcgacgtgttgtgttgtgcaaggaattcaaagtattaaaattgacttttaagatattccgacagaaacaaaaacagaattgataagagggagattcagtttaagacagaactaaagataagtgtccaagtttgtggtgtctgtgattgatagcgacgtgttgtgttgtgcaaggaattcaaagtatcaaaattgagtgttgtgcaaggaatttaaagtatttaaattgacttttaagagattccgacagaaacaaaaacagaattgaagactagaagattgaaaataaattaaaagaaaaagaaccttaaaaagaaaacaataaaagtggagatgcggggtatcgatccccgtgcctctcgcatgctaagcgagcgctctaccatctgagctacatccccatgaattgaacgagtagcaattatataatatctaacgcgttttgtaaagtatagtagatcaatttttcatgtatcttatattcttattcagtaccgcctttgccttgttggttgtaccaagtaaccaacatttgtatggatctttaaatacttaatgattaaaagatgtttaattattattattttgttatatagcttagtgctctaaaatgttcatgaaaaccaacttgaaaaatattatgatagctagtttgtattcaatttaatttgtgtttgtaaattatttttcattttctttactattaattttgttttatttaccattttattttacgggaccaaatccgactacctacgaatgttagtaaatccggttccgacaaaattacacatatataaactttttttttctgaaatatggttctcatatttaaaccaagattctcaagttaaaaatattgtcctaatatttaatccaagattcccaagctaaaaatatggttcttttgtcgaaagtaaaaaagtacatattcttctcggagaaatgaatcgatcgtgtaaaatatagtttctcgttgggagttaaaatttaataaatttgataatgtttttttttcttttttttgaaatgttaataaataaacctaaaccaatagaaccgcagtttttcctcctcgccgaaacgaagaagattctccttctctccgtcagacaaatctacgaacaagcgagcctgagcttaagaccaaactcatagagatg

SEQ ID NO: 24075 - DNA, 3000 bp, Unknown; identical to SEQ ID NO: 2587
  misc_feature (1)..( 3000): 2750-1469P.txt file - cDNA_ID_2163821; gDNA_ID_1620562; Annot_ID_160628

SEQ ID NO: 24076 - DNA, 3003 bp, Unknown
  misc_feature (1)..( 3003): 2750-1469P.txt file - cDNA_ID_2163825; gDNA_ID_1620562; Annot_ID_160629
ccaataaattttctaagttctatggattaagaaaaatgttgaagagatacaaaaagaacatggatgttggagttaccgtaagcctgggatcttagagaaccaatatcctaaggcaaatgctacggcatggaatgtaacaattggaacaatcaatccaagaccttcagctgacagaatctgactgcgattaatcgaaagtgggcttccaatgcacaacgaagtgcataccatagcaacaaacggcatcacaggttgaagaagagtgaccacaggcttcgcataagtatttaacacaaggccaagagtgattggaacaagtaccacctacagatagtaaatcattggacgtcaagaacgatgaatcaacaggaactaccgatcctatgctaaatcttgttacctgaagtatagacttcgacatggcaactgcatcaacaggaactactgatccaattagaagaccactaagcaaaggtgtaaagattacagaagcaatagttgtagaactagtgagaagaatgctcatggccacatcagctttactcagagaactcgcgtaactagacaactgagccccagccacacaacacgtgagtataaaaccagcgtagaaggtcctcggcatcccaaatgcattagcaactaaaaccccgagaagcggtttcaaaacgtactgagcaacaaacccaacagataacggcactggtctgcaaccaaacaatgttctcacaaacgttagaaaaccagcttaactaaactgatcataaaacttataagagaatgctccaagtaccttttgaatgcaagagcaaaatcgtcaactgaaagctgaattccaatagataacataatccctccaagagcaggagcatagaggtctttagataccctgaaaacatttcatctgataatcatcttaaaaccccattcaaaatcttagtttctctaaacagaagatgacaaaacagagtcaactaagtaaaagccatagactttatcgttgattctcctgataagattcatatatatacaccaattttgtaaagatataaactttggcattacagagatagatagagagagtttgtgtgcaaaccaagtgaaactaggtgggtaagagagagcagcaacggcagtgagagcaacaacaaatggaagcaaagcagaccaaaactgagacgaatcagctttctctgtaacatcagttccaccacaaaacgataacagagacatattcccatctctccaatgtaatccaactctgcccataaacggcgtcgttgaacacgccaccactggaaccaatccgctgtttctccgccttagtctaaaatctagaaagttactaagcgatgaagaatggagagaagataaaggtgaactagaagaccggaattgacaattgaaggattgagatttagcgggaagattatgaaattcagaaagtgattgtctttgtatagctggtggtgggagagacagagaagcgattaaagtcatttctatattggtctggattttgtaaagattggatttttaggagagtaggtgacggagagaggtgaagcgccaccgtgaaatgacgccgtggaccggcgaaggagggaaattgagagggtgaggtttggagttgaagaagcaggaggaggaagaagcgataatatagaaaattggaatttggaaatatataaaggggaaagatttgttaaggtttgtttaggcatgattgacaagtgatgtgcaagaaaattgaacggctgagattggttggcgacgtgatcgtcgatgactctttctagcattgttggttttgtgtaggccttagttttgtgtgagtgaatttggatgaatttgggtgaaagattgttgttttgtttggtacatgttggcatcttttttttccccgtcaaacatacttactttagcatccttatattaatacttaaaaaaccaatacatggtttctaagcatccaccaatggtcttaacaaaggtgatgaccaacattctaatcaagcaaagtacaaaccacaagaggagacaaatttttgcaatagcatctgcacacagtgctagttcaatggatccggagtcccaatacatatatttaaaaatggactcttttatactaattgtctttttttacaaaatcatatacctacatatatatataatataaaactttgggtccttttaacaacatagttagaaaaagagagtatatgagctaattaacaacatacttacaaaaaaaaaaattggcccggaaagtatcttgccacttcttaacatcttctactgcctttaaaattactctttgcgcctcttcatggtcatttatgaagaatatctcattttttacatgttggcatttatatatacatttttgttagcgttttagccaaaaatccttaatctattttttaattacagtttcaatctttatgaaacctatctaacaaagatattattctacccaagttttgcaaataaatcttaactacattcgatatatgtaattctgaatataatatattgtataaattaaatatctatatgttaaaatgtacaatataattttacttaaaaatataatgtagaaaaatatgaaatgtcttacaataatattatagaaatatttttatatttgaaaagataacatagtaatttttttgtatttataatcattttattttaatttaacaatgcaaatttaagatctttaaatgtattatgtcattcaaaataatgtatatacaactggatcatattctttacaggtaataacattttctctattatagtagtaagaataaaaatttattctttccatgtttctttttaagtatgattttcattttaagtctagattggattttaccatacaaatttcaatagattcccaagatttgtttccgtatctatttttgttaaacattaccaaaattcttataataataagagtttgctagtaattgtagctcaacgttcttcatcaaaatg

SEQ ID NO: 24077 - DNA, 3003 bp, Unknown
  misc_feature (1)..( 3003): 2750-1469P.txt file - cDNA_ID_2163829; gDNA_ID_1620562; Annot_ID_160630
ccaggttgctctagcatggatggatttgtctacgagcacggtaagctttatataccttttcttgtgtcgagaaaaggattcatatataactcgaaatagggtctcatacaatgctcttttatgttggcaattgtatataagcaaagataatctaaacatatgatactgttcaatactgttgcaggtccattcaatttcgaaccaaaaaagaagaactcacatcttttgcatctcaatccttatagttggtccaaggttgaaaagaaaaacaacattgacttattttcaaacattttcttcaaaagaaattgatctataacttttaagaatgtgttttgttttcaggtgtccaacatcatataccttgactctccagttggtgtgggattctcttactcaaatgacaacgccgattatacaactgatgatacaaaaaccgcgtctgatactcacacattccttctcgaggtgaaataagaatgtaaaagtttttaaaaaagatttccttgtgttgtgtgtgattcaagacactaactattacatccacatcagtggtttaaaatgtttccggagtttcagtcaaatccgttctttatatcaggagaatcatatgctggtatctatgtgccaactcttgcggccgaggttgtcaaaggtcagtattatctctctcaacatcatctttagctccttttcatatattggcagaattagaaaataacgttatctccaatttttctcatcgttttcttgttatgttgtaggaaataaaaatgcaatgagaacaaacaaaacaagcaagaatgtgacaaagccggttatcaacttcaaggtacgactaatgtttgaggctatgtttcggattcaaagtcttatggttttggtgttaaataaataccattaagactaagggtactaatgtagttacctaattgtctctttgtatatgtgagagaaagagaaaccttcttcctatacttgaatgttaaaattggacttatatgtggtatagggatatttggtgggtaatggtgttaccgatgaggtgtttgatggtaatgctcttgttcccttcactcatggcatgggactcatctctgatgaactctatgaggtttgattttgttggtgaatttttcataattcttgctttattcctcaatttttattttttctaatgtgtaacaaaatatggcaggaaactaaattagtgtgcaacggaacatactataccggcggccagtcaggagtgagtaaagaatgtgctggcaaacttaaaacagtgtcagatactgtgaacttattgaacttatataacattctagaaccgtgctaccacggaacatctctatccgccttagatatcgagtttctgcctaagagtctccttactctaggcaaaacagaaaagccaatggcggtgagaaagagaatgtttggtcgtgcatggcctctaggtgccgttgtgcgtccaggcattgtacctagttggtctcaactcctcgctggctttggtgttccttgcattgtaagtagtaaaccacatcatgcatctttcctcttatagtatttgctaagtattaccgtgcatgattgccactttgaaaactaattatcactaggttacactcgaatttacatatctacatttggatacattgtatattaggatcatatatatacataaatagtttaaaaagttgtaagaacaagggtatttaattttcatcattagacacaaatagttcatttgatcaaattaaatgtatagtaccaattgtaatacatttgatgattctccacaattttagaaactgaaaacttgtaatggatgcaggacgatacagttgcgaccaaatggctaaacgatccagctgtaaggaaagcggttcatgctaaagaggtctctattcaattcatcatatttctctcaatcagtatttgtaataagttgatgatggacattggacaccattttaacatcttggaccttttttcgaaacgtcgatataggaaaaagcgattggaaattgggagttatgttcaagcaacctcgaatataggcacgacaccggtagcatgatcgaataccatagaaacctcactcttagtggctttcgagctctcattttcaggtgcacatatatagaaataaatcaaaggtaactaaaagtaaaacgaatgaaaatataaaatataacaaaagttaaattttttgcagtggagatcatgatatgtgtgtaccatatactggctctgaagcatggactaaggcaatgggatacaaagtggttgatgaatggaggccatggatgtcaaataaccaagtcgccgggtaatttttttgttataactatctttcggtcagtttttttcccaactcattgtttctacaattttgtgttgtaggtttacacaagggtatgccaataatctcacatttctaaccatcaaggtacaaacatcacacattttcttcatattctatttctacaaatgaaaacgatttgtgttttagtttaagtttgaatgtttttttttgcatgcagggtgcaggacataccgttccagaatacaaaccgcgtgaatctttggacttctatagtcgtttcctagcaggagaaaagatatagaattctcaagttccatgcatgttcattaataaaaatatttataacaataaaattccattttttcttcaataaaaacttcaaattttgtaatgtaatttacaaaaatgtgaaggattctatttcgtgtactaaaacaagtttttctccacacaaaaaaaaacatatactgttctgtattttttcaagggaaatttaaattgaaaagttaatactgtatatatttgactataattcaaaccaaaccaattaaaccaaaaatttagaaaaccaaaaaagttgaaccggaattgaaccgatatctagattgaaaccacgggatttattgaaatcgtcttccttctcactattccggtgtagctgctcaaaaatg

SEQ ID NO: 24078 - DNA, 3003 bp, Unknown
  misc_feature (1)..( 3003): 2750-1469P.txt file - cDNA_ID_2163857; gDNA_ID_1620562; Annot_ID_160637
tccaacgacaattattctttgagaaaaatggcggtggcatgttgatagagcgactctcgggggcagggtcatcaaacattgatttcaaaatctttacggaggaagacatgaaggaagcaactaatggttatgatgtgagcagaatcttgggtcaaggaggccaatggacagtctacaaagggatattgcctgacaactccatcgttgctataaagaaaactcggctaggagacaacaaccaagtagagcagttcatcaacgaagtgctcgtgctttcacaaattaaccacaggaacgttgtcaagctcttgggttgctgtctagagactgaagttcccttgttggtctatgaattcattaccggtggctcccttttcgatcacttgcacggttccatgtttgtttcttctcttacatgggaacaccgcctggagatagcaatagaagttgctggagctatagcgtatcttcactccggtgcttctattccaatcatccatcgcgatatcaaaactgaaaatattctcttggatgaaaacttaactgcaaaagtagctgactttggcgcttcaaagttgaagccaatggataaagaacagctcaccactatggtgcaaggcactctcggatatttagacccagaatactataccacatggcttctgaacgaaaagagcgatgtttatagctttggggtagtcctcatggaactgatatcaggtcaaaaggcattgtgctttgaaaggccagagacttcaaaacatttggtgagttactttgttttggccacgaaagagaataggttgcatgagattattgacgaccaagtgttgaacgaggaaaaccagagggaaatccatgaagctgcaagagttgctgttgaatgtacaagactaaagggagaggaaaggccaaggatgatagaagtagctgcagagctagaaacgttgagagccaaaacgaccaaacataattggttggatcagtatcctgaagagaatgtacacttgcttggtagtaacatcgtgtcagcacaaggccataccagtagccgtggttatgacaacaacaagaatgtagcaaggtttgacattgaagctggccgctgataaagacgaagaagaagattgttttcgtccaacgagtccaggaagaggttgtggcatcattggattcactggaacaggaaacttatgagcagaactaaccattgttctttcgtttatcatccctacttctttgcagactctgtctactactccaaggaagtctctaaccaccaagaatattctaaacggatgcgcttcttctttagccgagtttccatggaaatactctgtgatttcttttacaagtgataacgctacgctctcttgagcttgtactctgatgatctcttcctcagctcttttcagaaacgtttccatcgattccgaaaacctctgactgttgctttcttctgtgattgttgattggacttggtcacttgaggcatggtcagaaagagtattttcatcatttacggagagtatacagaggagctatgagaatttgatgtaatcagacacccatatggattgccaaaatagatggcatttagttagtgagaaactatgaaccacgaggaatataattggtttaaataacgtctggtctttcttcttcgtagaactaattatttacaaagtttgtttcctatgtatattgtatcaatcttttaaataagaccacactattcccctcatatagcaatttgtttattcaatagacatatctacaatcatatgttcttttttagagattaagtcaagttctctctaatttagcacttgtacgtagtactagttcatatgcaaatcaataaaacactacaattattcatattaggaaagttcctattgattctggatagaaacagagtgttaaaaacagaatacaataaaaaaaaaaattggtgctgacagaatacaagaaatttaagggagtgaattaaaattacggtagccaataattggaggattaacaacacaccggtttacaaaacaaaccggaaatcacactaaacagggtaattgactaataataagagtcatattaattaaacaaatagatcatttttacccatgtgattcgaacgcaatatgtaacttgtaatttgaatttttgtttaaacagactaaagttttcaaattagggggaaaaattccaatttcaaatctaaatgggtctaacgaaataagccggggtatttgagtattttcgtatcaactagccttaaccactaaactacaaatagaatttttctggtttcattcatttcataaccgactcaaaaaaacacttcgtctctacgattcaaatgatcaaattcaacagaatcaacctgtttcggctctaaacggtgatgaatttggcgatgagaacacaattggggaggaaatccttgtcaccgccgtcaaaagaagcatgtgattgaatcgggaaaaaacctccgattacgcaaacaatcaggaatgtaataaacccaggtctgatcgatttcaagtttgtttttgattcatcgattgttgcctttacttcataattctcttccgatttttcagaacagaatcgtgtaattgaatcttgattacaaatccttgtaattacgcaaaataaggttaggaatcacaaacccctttctgtgtatttctttgttgctccgtttatagtaatcaatctcttattgatttagaagaatcagtgaacttcgtagtagtgtgatgatgctgatgatgatcatcttcattttgtgtccgttgattgctagtttttctctggtttcaattcaatcatgtaggttattgaaaaacgttggttacacgtgttttgattaagaaaatctatccatttagaacttcttgtgatgatttttctctgtttagtgattcatttctttggctctagtgttttagttacatgactcttaaagttctttcatcatttgataggttgatagtcatg

SEQ ID NO: 24079 - DNA, 3000 bp, Unknown; identical to SEQ ID NO: 2592
  misc_feature (1)..( 3000): 2750-1469P.txt file - cDNA_ID_2163880; gDNA_ID_1620562; Annot_ID_160645

SEQ ID NO: 24080 - DNA, 3000 bp, Unknown; identical to SEQ ID NO: 5519
  misc_feature (1)..( 3000): 2750-1469P.txt file - cDNA_ID_2164214; gDNA_ID_1620797; Annot_ID_168507

SEQ ID NO: 24081 - DNA, 3003 bp, Unknown
  misc_feature (1)..( 3003): 2750-1469P.txt file - cDNA_ID_2164222; gDNA_ID_1620797; Annot_ID_168510
gcgtgtgtagcacggtgcaggctttcgaggaggccgaggctgtgtcacagagcgtgcgggacttgctgctacaggtgcaactgtgtgcctccgggtacgtacggaaactacgacaagtgccagtgctacgctagcctcaccacccacggtggacgccgcaagtgcccataagaagaaacaaagctcttaattgctgcggataatgggacgatgtcgttttgttagtatttactttggcgtatatatgtggatcgaataataaacgagaacgtacgttgtcgttgtgagtgtgagtactgtattattaatggttctatttgtttttacttgcaagttttcttgttttgaatttgtttttttcatatttgtatatcgattcgtgcattattgtattatttcaatttgtaataagattatgttacctttgagtggttgtttatcatactttttttctatggtaagaggttttggaaaagtatcgagaatgatatataaagtaattttgatatcgacgcaagatgataactactagactagctgagtataagaatattgatgtatatatttgcggacaattttgaatttattataccattatttaatcacgaccatataaaaataattcttgtttgcgttataatttgtgttaatacgatagagtagacaaatgaagaccgagaacataaataatcatgatcattacggatagaattttggtataagatatttgttaacatcgatatttatttgacagccatataccttattccaaaatttggtccacacatcgaacctattacctatgaatagcatatagcttatataggttcgtgtctaaatgaaaataaaacaaaaatatgactttagcgtatatgaattgatgatagtaaagtttccttaaatctagcaagaggaagtaaactgatttggtaaatcccttgtgaaaactgaaaagttcgttttgttaaaatcatcgttgattcattttggtatttttcaaaaaggaaaaaataaagaactgaaagcccccggcgaggatcgaactcgcggcctttcgcttacgaagcgaacgcaataccactatgctacggaggcttttcgataatctctgacaatcttggcatatttaataaaaagcttatgagaaatgttggggactcgcaagttttgtagcatagtcattgcattttcagaagccaatgttaacagaaggccttttctcacgtttatacgtttaattcgtctactttctaaggttatatctttcttgggccattgttcgttatatgggccttagttgtcacatgagtgggttcttaatttactcaactcgtatttatgagaaaattgtccaagtgaactgataatgaaatttgcacgaaggagagagtccatgcaaaaactgaaaaaagtttgacaaaaactcgaaaaagtgaagccaacataaaaatctttggttagacactaaaacacagtagatgagtagacgtttggcgaaattcacctgacttgtcgatttcaatttgatgacgtggtcaaatgatttaacttacaacaactaataatagccgtcgattttaataaatctccactagttatgagcattcagaaagccatgccgtttcttgagactagaggattaattaaaaaaaacgccgtgacattctctcgtagttattgaagacagccagacgtttgagtagaaagggacccgcccgacccggttaacgaagttgatcataattggtttataaatatggttgcggaaaagtacataagaaattcatcaataattctagtgctcaatatttgaatatatatcactgaagtagatgatgcgttcagaaatattggatgtttagtcttaattaaacgtatatgggtaaaaattgattttaacaaaaaatttaatttggttagccgtttagtcattaaattatttggtgatagattaatttgttcattttattaaacattcgtaagtgaaacattatatactaaaaaatcggaaatgaaaaataaaaataatgcaaagtcgtagtacggattcaaatcatcgtcataggaaacccatgtcgtcctagtacaatttttttcagctctagcttgctgacgtgtctgacacattgattttctaaggaattacgtggcacaaacacttaaaaataatcagacggttctcgtatctccttgattacacaccgttggatcgatgactgaggaagataaaacgaaacagagagagaataagcgttttgttttgtcatattttgtgttttgtcatattttgtgtgacatttacaaaaagcgatcgagtgagtgaagcgacagcttcggattatccgtcttatcggaatgtggaaactttgagaaaatacaagaacaactcatagagagacacacaagagacgtttttttttttatctcttttctctatttgaaatctctgaatagcttctgtgtttttcgatgatttgtactgtgtacgtttttttatcttcttctacttcttcttcttgtgtcagttacatatcaatgtttgatttgattgaagaacagtgactccattaatgaagctttccttatagtaaatgcttttttcgaaaaaaatcaacgatctacattttttttttttgtattcacgggttgaatgtacaaacattaataataataaaaaataatttcttctttaagtcttcttttttttcttttggctttatttgtctcatctcttttatttcacgaagaacctgattcttcgagacacgagaaacgattttataacttttctctcttttttcttttcctcttctttaacgtctttttacttttctctcttttctcttcttcttttgtgtatctatctaacaatcaaagtgtgtgaaaatcgtaagagacctttttttgttttgcagagagatgttgaagaagtgagtttttttttgttcttctctattagtccttcttcacctcttgcttgagtggtgagaaaaaaagaagatg

SEQ ID NO: 24082 - DNA, 3003 bp, Unknown
  misc_feature (1)..( 3003): 2750-1469P.txt file - cDNA_ID_2164296; gDNA_ID_2936565; Annot_ID_194590
gatttttgtttttgtttttattttttgtcctacaaacgcatttcaataatgatttttctttgacatctaatattgtctgaaaactataaattgttttctttttgatatttttacgtattgtttccgatgcatatcgtttttgataaccatattttatggagcgaacccaaattaatggttgatgatataggtgattggcaaagtgaacacaaaaacatgtaaagactttgaaacaaattgaatactttaaatttaaattcacatttgagtgatttgagagagttaaaaatctctaagaactattccaagaaaactcacattgccttcattttgtacgtttgtttctctaaatccaataagtatgccttttttataaagcgacaaaaatacttcacagccaagattttaaagtacttgcttggttcataaagaagcatttgctcaccaaaaacaattaaatacgcaaatccttacaacatgcataactcattttttttttttttttgtcaatcgcacatctcatcttcaaggattagctagtaatataggtaagagactttatcttgagaaattggttgtgtattaattggctcgtcgataccgaagatttgatcaaatctagctatgagaattggagaagtaaaatcttactctcgtgacctgcttattatgaatatgcatgagaagtcgtcaacgattggcaatacaaggtggaatagactcgtaaattttgaaataaatataattcacaagttaaatttgagatcatgcgatggcaaaaattaggatatgaaaattggtaatcagttttgaagtaatgcgagtgttattaagagtttaaggtatgtgggttggtcgtcgattacaaatatgaaatatctttaaatatttttcaaactttgaatagaccatatacttatatactgtacatgcacaacatttaggataaagaaaaggcgaaccatcagagatataaactttaaaattaaataccaaatgcgcctaattatgattataaaatgcaaattgcgccgctaattcccgcgattccacgtgatcaaagaaactagagtgggtctgcctgcttcggctctaatgagggtacaaggtatgactgaataagtaaatcctttagtgatttaaattttaaattcgcagatttatgtacgaccaattacgtgatagtataaaatatttaattagttggtataattaatagtagctagtttaagataaaccactaacggtttttatgtactcttaactattctcatgtttatgcaattatgtgtgtgtacatatttatagttttaatttgtaaaacgagcaaaataagctaaataaccctcatatcccgtttagttatatatttttccaaaatttgaaactatatagtactgtattaacgtgaaagctaagttttctacttcgattggaataagctaaaaacctttaaaaaaaaaaaaaaaaaaaaaaaaaaaaaaaagctaaaaacctgaatacagaaataatacattatattcatgtattagtttgggtaaagatggaagacgatcacatcccttcgtcggctaataataatgactcgtgacctagaactagactagggatcgctgtccagcaaaaatcccttaaaacaaaccacatagttttttttttgtttttttttcacacaccacatagttttcttatagttcatattcaaaaagtgtttaagtttctacgatcgccctcttcatgtcgattcaatgttaataccacgtatttctgattagacgaataaataacaaaattatcaaaaaaggaaaaattaacgcacgaaggcgtcgttgaaaaagttatgtcattgaaagtctaatcgccgtgattaagcggtaaacctcacgatgagaccgtccgtgacgataaaatgtcaaaggaatgtgacgttagactatccttttcattttttctcagatttcattttttttttcctttttctttatttcagacttttatctttgccttttttgttttctcaaacttcccatatataatttcatcacaaaatagataaaccgaagtaaaaagataaacggtggggagggttttgcgggggagggacgagtggagaaaaactccctgttctaacacgtggcactctattcaccattgataaaaattaacactatgagcttaaaaagcgagctattttctattttctagtttagttttaaaagaaacaacattttcgctaagaaatttcttttaattaacacatcttaaatttttaaaatctactaaaacgaaaacgagtcattattaaattcgatacgttggttcggcgtaatatattttatactccttcatgcatattgttttgaatcctaaaaccatcgattagatatataatttgcatctgtggacaaaaaaatgacttcctacatagtaaagaaaacaacgcgtcatttaatttttatcatcttacatgtattaattagattgtaataagggattatgaaaatacctatgaaaaatgtagagaataagcatatatacatattaatggaatggaatgattactctaacaaaattacttaaaaaatgtcacctatctatttatccatattcctttttttttctttttttttcaacaatagtttgagtgatatttatgtgatggggattcactcaaactggaagataactgtagtgaagtgcccaaagcaaaagatcttcatgggactctctatgtcttaaaaactttttttctctctctctctctcttaatccaccgagtaaatccagcaaacttccactttcagagatcaaacttgagttatcttaagtgatgaagaaagactaattccatggcggcgtttgcagtttcttaagcttcctcatcatctaccgtcaatctttatagcaaagaaaaggaaatcaaatcaagatttacccttttctttgatttctctttgtggtgtgttgggtgtgtgatgttgattaccactggggaaagaaatg

SEQ ID NO: 24083 - DNA, 3003 bp, Unknown; identical to SEQ ID NO: 24082
  misc_feature (1)..( 3003): 2750-1469P.txt file - cDNA_ID_2164296; gDNA_ID_1620797; Annot_ID_168535

SEQ ID NO: 24084 - DNA, 3003 bp, Unknown
  misc_feature (1)..( 3003): 2750-1469P.txt file - cDNA_ID_2164314; gDNA_ID_1620797; Annot_ID_168542
ggaatcgcgtttgcggttcagatttggtgtattgacagagggggtccagtcttcgttgctgtttaccagcctgttcagactcttgtcgttgcgatcatggcttctattgcgttaggcgaagaattttatttgggcgggtatgaaactataataatattagtggtttatataaatacttgataaaatccaaggtcctaaacaagaataattttaaaatttgttgtgccacatgtcatatttctaatggcaggattattggagcggtcttgatcatagcgggactttacttcgtattgtacggtaagagcgaagagaggaaatttgcagcgcttgagaaggcagcgatccagtcctccgcggagcatggtattgaacgtgcacctgtttctcgcaactccatcaagtcgtccatcacaacaccactactccatcagtcaacggacaatgtttgactactttggacaaatcactctccagctaataattacaaatgccattacccaattaaaagggaacaatggtgtgccgttgtgttttatgacttttgtgtctgctttttttcttagtgttttctcttcttttttttttctaaaaaattattaattacctaagaaaggtttttgaagaaaggaaaaaaaatggtggatgagacatcattgttcatgaggatgatgatgatgatgatagtgatgaagaagactatgtgggagctttggattgagacttttctatatataatatctggctgatatattagtgccattttttcttacatttcttgtggggtttttctttcctttatcatcaatagaatgttataatttgcatttatgatctttagtaattatcactgtcggggatgtttaaaatggattagatcaaacgctttgttctgaactgaagtaaaaaaagatctttagtatttgattaaaatgatctcttaaagaaacagtttttttttacaaatttagtttattatcaaatatccaataaaaattcttaaccgaatgaacaagttaaaaataaaccaacatttaatatatataatataatatggaccaactaagttatagtatggaccaattcttgagttgaaagtccatagattttaacatggtattaaagtttagctaacttgagaaagatgtgttgttcgatatataatttttggtccaatattagaattttgtttgaaatagacggataaaagcattattttaaggagaacgtgttaaaaatttcacatatacacttcaatgctctacattatctttcttggttttctcggatcagcttacacgtcagctttttacatataaaatatcatcttttaatttgatgtaaacaagaagttcattaacagaatttcatatcttatttaccttatacaaataaatttcattaacaaaagaaattcatatacataaggaaaaacacagtgcataagcgactttgtctcataatcgttatctggcataggttagtctaccatgtggattcaagatttcgtatttgaatccattagttaaatcatatatagcccgttattggagactggagaccatatataagccgagatataatgatgttgggccggaataaacgggccaggtttgttataaaccacgccatatagtctatcaagactcgcgaggattacacgttagtacaaagagaagctaagaagaagatgcaaagaaaaccaagagaatagtcaaagacttaaaagcccatagaaacagagacatataatagttacacattgaccgttacacacaacgtaacatcccgttttctttatacagatacattgcacttgatttaatagttttccccatgacacatttttagcttcgagacaaacaactgtcgtttttatgttttttttgatatggtaagaatctgctttcacactatacagacaaaccacatatatagatgtgcacatatataagtacatgtaactggtgtttatttacatatatatcctagttcacggtgactatatttgtatatatatgtagtttgtatatgataacttaacaattaaagagagtctagtgacacctcaaagtggggaatgaaaggaatcccaattagaatagccaccggaaatacaagtatcaaaccgagaaatatcattatctccttcatgaacccatggaaatcctaacgacattgtagcttcttcccatattgaagaatcatccattaccggcaaatccacgtttatatgctcccatgatatctcctctgtcactcttccacatgatgacatctcgttggatgaacacggcgactcagagtcgctgctgctttttccaccggtgttgctgcttggtgtagtctgggacgccggagacgacgccgttttagggtaacttcttaaggactcagggaggttgagatgagcctcaggcccatagagcttacgagctgcggagtcataagccaaggcagcttcacgggaggtgtcgaaggtaccgagccaaagacgagctcctcggttaggctcgcggatctcagcgacccatttgccccaagtgcgttgtctaacacctttgtaagtgcaagacgcgttatcgggtccaccttttcctctcatacaacctttcctcgaactagcttggacggttcgttgtttcttattagcaccaaccatcattacttttggctctatggatgacatgtacggatgttgataactcgaaagtgatattatgtgacgacttttggtgagtgataaggcaaagacatgaggtaatggttaggtgtgtatatatactagaagagagtgatgaaacgtggcgaggagaagatatagctggcgcagacatgacggagggtcgtgtcgagaggaggaagctggtgttgtgtttgtaatcctaacacttgtctcgagagacccttctttttttggcaacagtaatcgtaaaaccagcagagagattgatgagtttgagatttttccaaaaaaaaaaagaaaagagagagagagatatg

SEQ ID NO: 24085 - DNA, 3000 bp, Unknown; identical to SEQ ID NO: 17134
  misc_feature (1)..( 3000): 2750-1469P.txt file - cDNA_ID_2164546; gDNA_ID_1620681; Annot_ID_164433

SEQ ID NO: 24086 - DNA, 3003 bp, Unknown; identical to SEQ ID NO: 19301
  misc_feature (1)..( 3003): 2750-1469P.txt file - cDNA_ID_2164556; gDNA_ID_1620681; Annot_ID_164439

SEQ ID NO: 24087 - DNA, 3000 bp, Unknown; identical to SEQ ID NO: 3596
  misc_feature (1)..( 3000): 2750-1469P.txt file - cDNA_ID_2164556; gDNA_ID_1620653; Annot_ID_163525

SEQ ID NO: 24088 - DNA, 3003 bp, Unknown; identical to SEQ ID NO: 19301
  misc_feature (1)..( 3003): 2750-1469P.txt file - cDNA_ID_2164556; gDNA_ID_2926186; Annot_ID_200624

SEQ ID NO: 24089 - DNA, 3003 bp, Unknown; identical to SEQ ID NO: 19667
  misc_feature (1)..( 3003): 2750-1469P.txt file - cDNA_ID_2164560; gDNA_ID_1620681; Annot_ID_164440

SEQ ID NO: 24090 - DNA, 3003 bp, Unknown; identical to SEQ ID NO: 19667
  misc_feature (1)..( 3003): 2750-1469P.txt file - cDNA_ID_2164560; gDNA_ID_2926186; Annot_ID_200625

SEQ ID NO: 24091 - DNA, 3000 bp, Unknown; identical to SEQ ID NO: 4055
  misc_feature (1)..( 3000): 2750-1469P.txt file - cDNA_ID_2164564; gDNA_ID_1620681; Annot_ID_164442

SEQ ID NO: 24092 - DNA, 3000 bp, Unknown; identical to SEQ ID NO: 4055
  misc_feature (1)..( 3000): 2750-1469P.txt file - cDNA_ID_2164564; gDNA_ID_2926186; Annot_ID_200627

SEQ ID NO: 24093 - DNA, 3000 bp, Unknown; identical to SEQ ID NO: 3167
  misc_feature (1)..( 3000): 2750-1469P.txt file - cDNA_ID_2164629; gDNA_ID_1620629; Annot_ID_162617

SEQ ID NO: 24094 - DNA, 3003 bp, Unknown; identical to SEQ ID NO: 18880
  misc_feature (1)..( 3003): 2750-1469P.txt file - cDNA_ID_2164633; gDNA_ID_1620629; Annot_ID_162620

SEQ ID NO: 24095 - DNA, 3003 bp, Unknown
  misc_feature (1)..( 3003): 2750-1469P.txt file - cDNA_ID_2164645; gDNA_ID_2096296; Annot_ID_195572
catctacagtttctattttttattctttgttaaaaagatagatatatccagtaacatttagtagagtcgcttgatatttgatgggaatgtatttgcatggtatatgtatttgctctggagtcttttgtttcacgcagaaaatttatataaaatacacagagacaagttgtagatgttatattggtaaagggctgcttactagctttctgttttagttagtgttgttcaatttgattgggtttgtaagaagctaatagcattaaaattataagttatggagtactgttttaatgcttctctagctttctgctctttctcttattattagtgttttcctaattgattgggtcatcaggaaactaataatgataaaaatgatgcagtattattcagaaagttatcctcagggatgttcggacaccaagaatggtggtatagagacacagaagtttttcttaaactgtttatgccttttgttgggccgctttgagggaaagaaatttgagagcatactatcagagtatggaatgaagctcgtgcctattcttctacatcaggtatctttcgctattgtttattgaataggggagtgatgacacactttacctgaagttctcttgtagttatattggttgttctgctagttatgctagaattcatttcttatattggcttttatgacttcctgctcaactcataattttgttctgctcaattgattttatgattctaacatatcgtgagaaaattaatcttgaagggttatatatatacacccatgtgatcatcttagtgcttacattcttcctttgtattcgaagcttcgcagtaacaatgaagagatatcagaaggcgttgtggctatatttaaggcagtcttctttaaattacaatctcagtccggagacagcttctctgatacaatgtgcatggacgttgtgataccatcactgcttcaccttcttgatgaaagggatggcgcggccaaagctgttagtgtcctgctggcagactattgttccaagtatgtctattctctttccttttggtactaaatcatgttagtagctttctagttaccagtgacggtacctagtttgtctctgacttaaagaaacattcaccagaaatgcaggtaatagctgtctcagtgaaattctacaacgccttgcttctggaactactgtgcaaaggctgaattctttggatgtgatatcagaagtaatccttatgtcaaaagattcatttccttctcatataccctggtatgcaatcatttatgtttttcgtcccaattttctatttctagcttttctgtatcttctttatttgcattctcatcccctcagaagtcagaatcattttctgctcttatttcaggaaagagattgcggactgcttgttaaagtgccttgatgacgaggaaacatgtatctgtaaacaaacttcagagttgctgaagtcaatcggttggtcttcttttagcctttatccgctattcatttggaagcttttgtttgtggccattattaatttctggtattggcagtcttatgtctcttatgacctctaaatatggcctttcttcatttgataagatgaattttgctgataataatcagtgttttgttaaaaggaggatttctgttaattattcattattcagatgagaaaaacttataaagatccaatttatggggtccaaaacttgttattccatattgcaatggcagttatagttcatattggataacatttattttctgctttcctatataatgaagccaatcaactgaatgatttttgttatcgttttttcttccagagccatcatttgtgctaccgaatttagtaaacctcatttatgcacccaatggaaaagtacaatcatcagctacagaaaccttgcttggggtcctgaaacaccataaggaggattttgatgttatatgtatgttgctgaccagtcttaggtatcgtgctctgtctctttttctcctttccccattgtatacatagttgtttgtttattcccatttaccctaagtgagatgtgagaatacactggattcttaggtcaagtttgtaaaagtaaacttacgaatgctcatacgtgaaaatattgacctgactacctggtttggtttttaattttggttttgcattgtatcaagctaatattgaaaaaggctttctgcttttgatctccacttttctcttgtagtaatatccaagctttggatactgcagaaagtaatggacattccactgaaggtatttggcttcttatttcattaccataggctacatgcgatacagaatctgtgttaaaatttgtcttatatatgtacaatccgaacgtattatataaaattattacaacacttcaaatttaagctggataagaaataaaattactggaatgtgaaacttaaacgatgtgaaatatgaactagtctggctgaattacatagcggacactatcaagttattcttggtcaaggcatgctcatcatcttcttgtactgttacaggtttaacttttgacagtgatcgagtgctaaagctgatcccagagtgggctagaagtgtaagtacaagaatacgtcatgcttgctttgctatctttgaaatcaatccatttttgtttctaaagtgcatgtataggcaccatttacgaactgttggtgcactactgaatagaaaatggtaactgaactattaactctgaaccttcaacacaaactttttcaggcattggttgtcccttttttcccttccagtactatttccttttatctaattgttttcttgtgtatgtgctgggaaactcttcgcatgggaatgaccaaagtgaccaaagcttgtgccagctataattaggcaattagaatatatttctgcctgttgactgaaatcaaattcttacaggtacaaaactggaactcactgatcggacctttgcttgacaagatgttcttggagccatccaatgccatcatg

SEQ ID NO: 24096 - DNA, 1804 bp, Unknown; identical to SEQ ID NO: 3166
  misc_feature (1)..( 1804): 2750-1469P.txt file - cDNA_ID_2164645; gDNA_ID_1620629; Annot_ID_162627

SEQ ID NO: 24097 - DNA, 3003 bp, Unknown
  misc_feature (1)..( 3003): 2750-1469P.txt file - cDNA_ID_2164714; gDNA_ID_1620622; Annot_ID_162342
atttcctggtctaacgctttccctctgcgtgccccgttccttccctcgcggttactcttccgttttatgtttttttttctgagatggtcaattttcccgtcgtctctgaattttccctttttctcttcttcactccaccgccttccccgaatcacttcctctgcctgatctaattcaatctccttcctagctcaaagaagtcaatttacacgagcagatctctgcactcaaaactcctggatcttcatttctgggcttcaatttagagtttttttatattaaatgggttggagatacaaagctggtctgttcttgattggcactgttgttatcatatgggtcacctccgctgaagttactcaggtattcattcattgtctcttcaattttgtttaaagctttcatcttttgaggttatggatgtttcatttggatcttattccattaggcttgttttcaatcatgttcttcgagctttgaattagcggtttgagtttgatgaatcaaatggcaaatgcaaattcagatctctgtttaaatggtttgataatttattgaatggtttgacttcaattttgaccaggatatctttacagcctataagcagccatttgcagtcacatatcttggagcttctcttatgattgtttaccttcccgttgcattcctcaaagactggctttgtcgatatttagatcgacgctcttccaaatccaataaaattcccgctttgaccgatgattcctcggttgagctcggttctcctttgaggcataaaatcattgaaatgggacttcaagggactataactaagaaagatagtgaggaacacctttcatcccatgaagaagaagatgagagacccttgatcggtaaagttagagaagaagtgcagactctgaaacagaggaaagagatcacgactaagcagattgcaatgtacggcctttacctcgcaccaatttggtttgtaacagaggtgaattttctttgatatgctcgttgtattgttttgatggtggtgcctgaaagtgtcctcttttaaaccttggtattgatatttgtttgctgtttttgatgatacagtatctgtccaatgctgctcttgctcgtacaagtgtggcaagtactactgtattgtcttcaacctcgggactgtttactctgttcattggtgtatttttgggccaagataccttgaacctgtcgaaagtagtggctgtatttgtcagcatggctggtgtggtcatgacgacgctagggaaaacttgggcttctgatgagtcgcaattaaattcttcactgtaagtttttcatcctaattcgttcaccatgcatctttttcttatatgtattcaaaagctcaccctgggctgcgttttaaattgatagctcaatttgtctcattctcatagcatttcttgattccatgagttttccagtttcatcaaccatatttttttaacgtacagttgatatttgtgtttagcaacggggaacgatcccttatgggagatctttttgggcttctctctgcggtctcttatggactttttacaggttagaaatgattaatctttaaaggtttagagtattagtgtgttggggaggataacctcattgatggcttgtacccttctgatattgacaacacagtgcttcttaagaagtttgccggtgaagaaggagaaggggttgatgtccaaaagctgtttggatacataggattatttacacttgttgctctctggtggcttggtatactaatatcttccattcatttttacaagtgtatcatccgagaaacataacatatgagacatggaaaagttgactcttattcaaaaagtttgttttttggttgtatgtttcagtgtggccattgacagcattagggatcgaaccaaagtttaccataccacactctgtgaaagttgatgaagttgtcttagccaacggtttcatcggaagtgtcctctctgactatttttggtatgttttaatgatttcagctattacaagataaagtggacccaacaagcaatgttgagtttagctacaagtgtcttgtttattgctaggctagatcctataaagaggtgtgtaattacttgtttagaaaataacttggctgttttggtgcttttgcaaccaaagggcactttctgtggtgtggacaactccgctggtagcgacactgggcatgtctctcacaattccgcttgcgatggttgctgacatgatgatccatggtcgtcattattcagccatttacattcttggctctactcaggtaactaaaacttatattccatcaacaacagagaatgaataatttttcctgatgctcaagaattagcatttggtttattttgcaggtgtttgctggattcgtaatagctaacatatcggatttgttctcaaagaagcttggattgtagcacatatgattctttttttttggttgttttgtggtatttctgggtagaaaatgtatcctagaagattcttggttggaattgaaagctaaaagggaattttccctgtttaatggatgaaagataagaatgtgattaccaacgtttttgattcccatgtgcacgtctttggaaaaagaaagtgcaaaccagagagagttgttgtctgttgagcaaagatgagtgaaagaaaaaatcaaattcatgtttgaactagctcgtatacatgaaaccgaactaataaccttgttggcatagataaaatatttttttgatctttaaaactccatcaaccaataaccttacgttgacagatatgaaaaaaattctatgttaatgttgttttattattctaaattaaaagccagtaattgataattacgattattggttcagaacgaaccttctttctgagccagaaagtttagttcgccttgttctgtctgtgtttcttcctcttcccctgaaatcgaacgatttataaaatcgtcgtctggctttcgacgatctgctgacgaagaccatg

SEQ ID NO: 24098 - DNA, 3000 bp, Unknown
  misc_feature (1)..( 3000): 2750-1469P.txt file - cDNA_ID_2164714; gDNA_ID_2926201; Annot_ID_201867
tcctggtctaacgctttccctctgcgtgccccgttccttccctcgcggttactcttccgttttatgtttttttttctgagatggtcaattttcccgtcgtctctgaattttccctttttctcttcttcactccaccgccttccccgaatcacttcctctgcctgatctaattcaatctccttcctagctcaaagaagtcaatttacacgagcagatctctgcactcaaaactcctggatcttcatttctgggcttcaatttagagtttttttatattaaatgggttggagatacaaagctggtctgttcttgattggcactgttgttatcatatgggtcacctccgctgaagttactcaggtattcattcattgtctcttcaattttgtttaaagctttcatcttttgaggttatggatgtttcatttggatcttattccattaggcttgttttcaatcatgttcttcgagctttgaattagcggtttgagtttgatgaatcaaatggcaaatgcaaattcagatctctgtttaaatggtttgataatttattgaatggtttgacttcaattttgaccaggatatctttacagcctataagcagccatttgcagtcacatatcttggagcttctcttatgattgtttaccttcccgttgcattcctcaaagactggctttgtcgatatttagatcgacgctcttccaaatccaataaaattcccgctttgaccgatgattcctcggttgagctcggttctcctttgaggcataaaatcattgaaatgggacttcaagggactataactaagaaagatagtgaggaacacctttcatcccatgaagaagaagatgagagacccttgatcggtaaagttagagaagaagtgcagactctgaaacagaggaaagagatcacgactaagcagattgcaatgtacggcctttacctcgcaccaatttggtttgtaacagaggtgaattttctttgatatgctcgttgtattgttttgatggtggtgcctgaaagtgtcctcttttaaaccttggtattgatatttgtttgctgtttttgatgatacagtatctgtccaatgctgctcttgctcgtacaagtgtggcaagtactactgtattgtcttcaacctcgggactgtttactctgttcattggtgtatttttgggccaagataccttgaacctgtcgaaagtagtggctgtatttgtcagcatggctggtgtggtcatgacgacgctagggaaaacttgggcttctgatgagtcgcaattaaattcttcactgtaagtttttcatcctaattcgttcaccatgcatctttttcttatatgtattcaaaagctcaccctgggctgcgttttaaattgatagctcaatttgtctcattctcatagcatttcttgattccatgagttttccagtttcatcaaccatatttttttaacgtacagttgatatttgtgtttagcaacggggaacgatcccttatgggagatctttttgggcttctctctgcggtctcttatggactttttacaggttagaaatgattaatctttaaaggtttagagtattagtgtgttggggaggataacctcattgatggcttgtacccttctgatattgacaacacagtgcttcttaagaagtttgccggtgaagaaggagaaggggttgatgtccaaaagctgtttggatacataggattatttacacttgttgctctctggtggcttggtatactaatatcttccattcatttttacaagtgtatcatccgagaaacataacatatgagacatggaaaagttgactcttattcaaaaagtttgttttttggttgtatgtttcagtgtggccattgacagcattagggatcgaaccaaagtttaccataccacactctgtgaaagttgatgaagttgtcttagccaacggtttcatcggaagtgtcctctctgactatttttggtatgttttaatgatttcagctattacaagataaagtggacccaacaagcaatgttgagtttagctacaagtgtcttgtttattgctaggctagatcctataaagaggtgtgtaattacttgtttagaaaataacttggctgttttggtgcttttgcaaccaaagggcactttctgtggtgtggacaactccgctggtagcgacactgggcatgtctctcacaattccgcttgcgatggttgctgacatgatgatccatggtcgtcattattcagccatttacattcttggctctactcaggtaactaaaacttatattccatcaacaacagagaatgaataatttttcctgatgctcaagaattagcatttggtttattttgcaggtgtttgctggattcgtaatagctaacatatcggatttgttctcaaagaagcttggattgtagcacatatgattctttttttttggttgttttgtggtatttctgggtagaaaatgtatcctagaagattcttggttggaattgaaagctaaaagggaattttccctgtttaatggatgaaagataagaatgtgattaccaacgtttttgattcccatgtgcacgtctttggaaaaagaaagtgcaaaccagagagagttgttgtctgttgagcaaagatgagtgaaagaaaaaatcaaattcatgtttgaactagctcgtatacatgaaaccgaactaataaccttgttggcatagataaaatatttttttgatctttaaaactccatcaaccaataaccttacgttgacagatatgaaaaaaattctatgttaatgttgttttattattctaaattaaaagccagtaattgataattacgattattggttcagaacgaaccttctttctgagccagaaagtttagttcgccttgttctgtctgtgtttcttcctcttcccctgaaatcgaacgatttataaaatcgtcgtctggctttcgacgatctgctgacgaagaccatg

SEQ ID NO: 24099 - DNA, 3000 bp, Unknown; identical to SEQ ID NO: 3052
  misc_feature (1)..( 3000): 2750-1469P.txt file - cDNA_ID_2164733; gDNA_ID_1620622; Annot_ID_162352

SEQ ID NO: 24100 - DNA, 3003 bp, Unknown
  misc_feature (1)..( 3003): 2750-1469P.txt file - cDNA_ID_2164733; gDNA_ID_2926201; Annot_ID_201858
cgtttttaaatgcccaataaatttgagaaaaaattgccaacttgtttatgagcttattttctttttcatggatcccaagtcttttgtgtatagagattaaaaaaaaatgacattccttcatgtaaaaaagaaaaaaatatctgggttttaaaaatatctacaatgagtttaatggtaaatatacttatcataatttggagaataaagacctaaagaagaaaattacactctagaacagaagttttgtaagcaaatcattgctcacaaaacttgtgaattacagaattacaggctcttgtaggttgagttattttatgcttcattttggttacaggctttatgttgacattaaaacaaagagattgaagtagagtccaaaaaaaaaaaaaatatatataaatataaaattcaagattaattaaaaaatattggtcttcagagagataaataactaggggaaagagaaaacagtcttctcttctccgatcccaaaaacgcaggaaaacaatgtcgtttaacagctcccacctccttcctccacaagaagaccttcctctccgacacttcaccgatcaatcacagcaacctccgccgcagcgtcacttctctgaaacaccttcgcttgtcaccgccagtttcctcaacctccctaccacccttaccactgcggattccgatctcgctcctccgcaccgcaacggagacaattccgttgctgatacaaacccacgctggctctcctttcattcggagatgcaaaatactggagaagtacgttctgaagttatcgacggagtcaacgccgatggtgaaacgatactcggcgttgtaggaggtgaagattggcggagtgctagctataaggcggcgattttaagacatccgatgtacgagcagcttcttgcggctcacgtggcttgccttagggttgcgactcccgttgaccagattccgaggatcgatgctcagctcagtcagttgcataccgtcgccgcgaaatactccactcttggtgtggttgttgacaacaaggaacttgatcatttcatggtaagtttcactttctaattttgcaaaattttaatgttttgaactgtgaacgattcagccatttatttctctttgattatctgagtatagcaaattcacatttttgtgtggctcattgttcccgcttctcgagtcttgcaatcgatatgatctttgcttctacttttttggttagcttgtaattcgaattatgaactttgtctgactcaaataagttatatttgttgcataaagcttcttctttgatgactaatagtttgtctgattcttgctgaaaaggactttgcatgtccaagagaaagaaagcataatctattttttgtaacgttctgtttgtatgtcttatggattggaatcttacctttgattattatgttgatgcagtcacattatgttgtcttgttatgttcatttaaagaacaactccaacaccacgtttgtgtccatgcaatggaagccattacggcttgttgggagattgaacaatcactgcaatccctaactggtaacgtcccaaatcattttttttttttgttattgtcttcttgctttatgtgtgtcttggttttatcggtttttctttgttctggtttgtaggagtttctccaagtgaaagtaatggtaagacaatgtcggatgatgaagatgataatcaagtagagagcgaggtgaacatgtttgatggaagtttggacggttcagattgcttgatggggtttggtcctcttgttccaaccgagagagagagatctttgatggaacgtgtgaagaaagaactgaagcatgagcttaaacaggtaattgcttgatcaagctgcaatggtacatcaaactatacaaaacacattgttaaatcatgttgctcggtttcttttttcccctgtagggtttcaaagagaagattgtggacataagagaagagataatgaggaagagaagggcgggaaagttgccaggagatacgacttctgtactcaaagaatggtggcgaactcactcgaaatggccatacccaactgtaaacaccttggccgagaagttttgttaccacattgtcaaaagcaaggttttaattcgtgatttggttttggaattgcaggaggaagataaggcaaaactggttcaagaaaccggtttgcagttgaaacagatcaacaattggttcatcaaccagaggaaaagaaactggaacagcaactcttccacgtcatctactctcaccaagaacaaacgtaaacggtaaaacaagatccgttctctttttcaaattgcgcaatttcattaaaccaacccggtcaagatcttcttttgtaaccaaactcaggaccgggaagtcgtaggtgacatagcggctaactagaggatggttctttgccatgtgaattcttgggaaccgtatatgaaagaaacgaatccggttctatgctcgtacagagtgtgttatttgtatagtggataccggttagcctatgaaaccggattctggagtccaaattgttgtttgtaacgacttagtagtttttggaagtgatctgtttcgttggtttgcgtcttgtaacgaacgcttaagcaagtgtgggttttttcttgtaaagtgtcaatatgttcgtttgtaatgaatgtatcaagcaatatttatcataattaaactagcttgaaatgtagtattacgatgttgttgtgttcgtctgatttctctcaccggttgatgcatggttacgttcggctcggtttttatatggttcaatttttaatatatcgataattttaaatgatttcacttgtattattaacaaagcccattggtatttggcccaaaatctgaatgccgacttaatgacttgtttcttcttccttcagcttctccaacgaacggcttttgttttagttttttttgcttacctttctctcgacttggtctacttttgttactctttgagttgggtgattatg

SEQ ID NO: 24101 - DNA, 3000 bp, Unknown; identical to SEQ ID NO: 8129
  misc_feature (1)..( 3000): 2750-1469P.txt file - cDNA_ID_2164995; gDNA_ID_1621194; Annot_ID_174672

SEQ ID NO: 24102 - DNA, 3000 bp, Unknown
  misc_feature (1)..( 3000): 2750-1469P.txt file - cDNA_ID_2165483; gDNA_ID_1621136; Annot_ID_172663
tcctgaagacactaaccaaatgcatcaaaaacaataaggaaaaataaagatatgtacaaagatagacatgggattccctcccaagtgagcctcttttatgtctctaagcttgacttctcatactcattaggctcaaggtggattggagagaggaaatgaggtctcctctccttcttgagtagagtgatcatcatactcattaggatttcttgacaagtctgcaattgggtactcagtggccatgtcctcatagtaagcttctttttttattaagatagtcttctcctctataccattccgatgtgaattcacatccttctttgctgaccagaatagtggctccattgtcaggggcgtccttgatgttgagtggtacttggttgagttttctattgagctccttgatttgatccttcagctctttcacaatatgtgttggcctttgtatggctttgtcctaccatttagatctccccttgagttctaaccaatcatctgacgtctgaatgcttgccttgagttgtttggtcgagcatgagctttcaggacaagttggaggcttctttgagttgttggtggaatcatttggtcgagcatgtgttgaacttacttcattagcttttataatcttcgtgtcagactccatcaagcccttgtaaacctgtgagccaactgctgccttgtgtgactctaatgacttctcagaactcaaagtttcactagggagatacccaggtttaccactcttagtcaaaacagttttttaattatttgcttctttaagttccacttgcagttcaccagctagccgatccacttccttaactaagaaggtctgttcttctattgtcggcttcttcatagcatcattgatatcaaacttcatttcaaaattcttccccagattaagatcaatctttccttgcttaacatctatgattactccaactgtagctaaaaacggccttcctaatatcaagggatcttttggttcttcatccatgtttagcactacaaagtctgtaggcacctccacatttctaatcttgataggcaaatcttctaataacccatgaggtagtctaacagacctatcagccaagatcaaggagatattgcagtttttatacttgttgaaaccaacctcttagctactgagagtggcatgagatttactgatggtcctaggtcacaaaggcatttattgaaagtcaatgaacctagggagcatggtagagtgaatgaaccagggtctcctagcttttctgagacatcgttctcctgtatgatggcactgcactcatggctcaaaactgttgttttctgaacctcttgaattctctccatgatcaagtctttgaggaacttttgggaatccgggatatgcgtgagagcatcagcaagaggtatccttaattcgactttcttgatattcttggcaaacatagctctatacttatcttctacctctttcttgtgtcgaccaggaaatggaagtggaggcttgtaaggaggaggaatgaatgctatctcattgtttttagcagcaactagttttagagcagcggatgatgttaatggattggttggtcgagtatcacggtcgagtatgggctcgagtacttcagttggtttgtcaacttgatcttcattgagactaaaatcctccccatcttgatatgcactatcctcagtgactgacttgggtctctctctagtggataactccttatggtgatagcatgaacattaacatactccttgggattctgaattgacttccctggaagtcccgtaactttgggagaagaggtagatgcggattctccttccaagtatctgactttagaattcaacgcctcaacttttgcattcaggtcattgtagctgcagtctagcttttggtgcaattcagatatctttttagcaatctcaatggagctagatacttgtccctgataagtgtgtattttgcaagttttgagcatccatttgtcatcactttagcatcatatcatcactgttttataccatttctcatcatttgtcatcactttaattacatgtttaggatagatttgcatgcatattgcatatttgcgttgatttcatgtgatttggagctgttgacgagctatctggaagaagcggacctgatcatgtcaaaccactcgaccccgaggtcgagtaggagcttcaagatctcaacagatcactcgaccccctggtcgagtagaggacatcactacttcaccacatcactcgaccccgaggtcgagtgtcttcatcccatcacctgaccatcactcgaccccgaggtcgagtgtcttcaccttcattgccagaccactactcgatctcgccactctaccttgaagtcgagtatctccatcaccaccactcgactacatactcgatggcaagcttcagagttttcttcatcccgcactcaaccagacactcgagcacaaggaagaaaagaagctattcactcgacctcccactcgactacgtgggttgagtacagttcttaatccgtcccaatacttcgtcgttttaagtattagggtttcggaatatttggctataagtagcatgtacttcacattttcgcagacaagtttttatctagttttattccgcagaccttgtgttctagaccttttgtaatccggatttttctttatctattcagtattcagtatttagtttctgttcttgatttcgtttactgttgttcattctgttatcatcctgctgttacacagttgttatcatgttttcaagttgttcaacgtttatgctttctgttatgatgtctgagtagtgaataggtttctgaggatgggttagagtagtgtagaattctcagtatgctaggtggttgagtattgattgatagatcccttctggattagttgttcttaatgcctattgctttctgatcaactggaatttgagcccagacatttccgcgcccaataggtgttcgatgaaatg

SEQ ID NO: 24103 - DNA, 3000 bp, Unknown; identical to SEQ ID NO: 15442
  misc_feature (1)..( 3000): 2750-1469P.txt file - cDNA_ID_2165774; gDNA_ID_2926134; Annot_ID_197117

SEQ ID NO: 24104 - DNA, 3003 bp, Unknown; identical to SEQ ID NO: 21608
  misc_feature (1)..( 3003): 2750-1469P.txt file - cDNA_ID_2165774; gDNA_ID_1621172; Annot_ID_174023

SEQ ID NO: 24105 - DNA, 3000 bp, Unknown
  misc_feature (1)..( 3000): 2750-1469P.txt file - cDNA_ID_2165926; gDNA_ID_2926137; Annot_ID_197252
ggagctgatagaaagggacgcatttatcggtacacctggatatgaacctgttgagggcggcgatacggccggttagacgttggacctcccgtgccgtttttggcgatggcatgtcgatgaaggctgcaatctgcttaggattggccttgatgcctctttcagttactaggtatccgaggaattctccttagggaactctgaaagagcatttctcggggtttagcttcatttcaaatttgtttaggattttgaagcattctcttaattgctggacgtgttctttttcgcgagctgacttgaccagcatgtcgtcgatatagacctctatcgttttacctagctggtcggcgaacattctgttcaccaatctttggtaagtagctccagcgttttttaaaccaaagggcattactttataacagtaggcttattcctcggaagttcgcacttgaccaggcgaagctgtctttattttctttgagaaaggttatgagatcctctcgtatcgctgggtcgaggtcttgacctatcccaaagcatcgtttgggatctgattcgtctatgtagacctgtgttatcaacggttttcgaggtctgctctaagaagggtcagaggatctgactattttcattttcgtgagtttgtcttctatcattagtactacggggtcaacttttttgataagctcgtagctgcccatatagcactttcgggagctacgttggctgtcgtatacgactgctatccccttgtccgaggggaatttaacgcattggtggtaggttgatgggacggctttcatggcgtgtagccatggtcttcccagtattgcgttgaaaggagctttcttatcgactacgaggaaactcgtgagtcgcctcactcctcgtgcgacggttgggagctggatggttcctagagaaaatgtcgtatctccagcaaacccggtaagtggcgtttttctgccttgcagctcggaatcgaggtgccccatttttttgaaggcctcgtaaaagagtacgtcaactgagcttcccgtcttgatcattatacggaaagttcatagttgcctacatcgattcgaataacgagagcgtcatcgtaaggtttatcgaggtcggtggtttcgctttcccagaatgtgatctggtggtcaggtcccatcatcgggctcttgccttttgtgtaagaatctgctttcctctgatgagttttgatcgaattgattgagtcgttgcagagctgagaccctccaatgatgaaatcgatgcgtttcggggagaggtgctcagttgcgcttctgcagaatttcgagaggcgtaatggaaacctcatgtttttcttatgcggggcggggggaggtgtggtgactgaccttcctgtcctgccacctagatcgagttttgcaaagactaggtctatgcgttctctcctagcaggtgggggagagtcacttccctccggtgttcgttcctgtttcttttgcttgggagtttgctcctcctcctgttcgtcgggaggaggggtttcaactttggggtttgaaccttttttagttttacccccagctgcgattaactttttaacggcgcgacactcctcggtggaatgtcctctttttttgtggtacttgcaatattttccgaggtcaagtttctggactctcgtcctcagctgcctcttctattgcgaataaggtatgctgcccctgcgtttagttttcctttttgaagggttttttaattgcaaggggagcgttttgcgttttagattctttgaatcgtaaggccagcacagcgagctcctcttcggctttggcgaagtggagagctttgtgaagggcattgtctaaagagaccggttatctaacagtgagttcctcacgaaacctagaggagaaccaccactacaacaaatatccacattaatagcacaagaggatagctcatttttcgttactgctatgaaaactaaatttttattttgattattttgtaatagcgtttgataaacgctatgatagaaaatcactaagcgggaagctaaaatcatctattccgccaatacttatgcgaaaaaattcacttaagcgccttatgtctcagatctaaaaatattaagcgacaaaacgctaaacacatcttaagaaaaaaaaatcccccaaattgattccttcaaaccctaaatttcttcttttgtccatctctaattccacttcacacatccaaaattctacattgttcttcacctttctctcctcctttctctcttctttcactcatcctctcacgtttcagttagagattgctttagttggaaaaggtttgttgatttgtctctcttttccctttgaatctatagcttctaatccttgtttgttggttgtgtctctcctctgttggttttgtctctcctctttctttgaatctgcagctcaaaagggtaacgtttttgaagtgtttttgtgcacacaagatgttcgacgaattgactgtgagacaaaaaccaagaaacgactcaacatctctttctctgggttcgtttctctcttctccaaggttgtggtctatctcaaatcactatgattcataaatctaattacaaatactttatctataacatcttaagtgttcttcctcatgttgaattatgttgtgtgtatggttcgacattgcattcagccgtggatattgtagtatcttaggtcattaagcaaggtctctttgttagcatatgtagcataaaaaggatttcgttttgttttttatgttgtttggtgcttacttggttaacttgtttcaggtaatacttgaagattatggctttatgtgagtatcaagattccttcctaagtttcttttcctctatacatattctttcttgcttcaatattgacaatatacttagcttcaattaagctactaggagactgagttttggttaagaccaaggagacagagaaaaagacttgactttcgaatatagagaattgagagatg

SEQ ID NO: 24106 - DNA, 3000 bp, Unknown; identical to SEQ ID NO: 24105
  misc_feature (1)..( 3000): 2750-1469P.txt file - cDNA_ID_2165926; gDNA_ID_1621186; Annot_ID_174451

SEQ ID NO: 24107 - DNA, 3003 bp, Unknown
  misc_feature (1)..( 3003): 2750-1469P.txt file - cDNA_ID_2166021; gDNA_ID_1620790; Annot_ID_168244
cttctggattaaacgtacaccacttgttgggtagatacggcacgttttgtgcaccaatcaagaacttactctgtccttgacctgaaagatctataggaaactttggttgcccgtcgaatttaaatattccccaatggcgttcgaacggtcccggtgctatactttttgcatcctcgtcgagtaatccgaacaagtatacctcaatgtaggttggtctcaatggagttcctttgtttgttccaagcctcggtaaaagcccgttgtagaatctgtaagcactgcctgtgaaaaaaccgttttcaaaatcaaaactaaaacacttcataaaggataaaaatccatctaaagaaggtcagatatcaacctgcattagcgtgtttgtcaccctctgttggccaaccaacttctccaacgattattggcatatctccgtgaccaacagctttcaaagacgacaccaaagtatcgaaattggcatcgaaaacgtttgtataatcaataccgttgtcgtttatcggttcagcaccatcgaagaaggcgtagttgagtgggaaatcatcattcccatagagacttaagaaagggtagatgttaattgtgatgggagcattgttcttgccaagaaagtcaacaatctgagtcatttgaccgatgatatcgggacggaatcttcctgcagatggaacgggattgcttgctggtgaatcgtatacatccgcgtttaaagggactgttgctttgacagagtttcctagtccggcttcatttaaagcgttttgaatgttcgcaagtgcagggaatgtgaggtttatgaacgatccattgtatgatttgaggaatggctcattcccaacagctacaaacctgaaacacatccacaagtgattagcttcactgagacatgtaaacacatttttctctaaacatgttctgcattttgacagtactgttaaaagatttgacttttatagatataaatacattttagtggaaacaggttctgcatttgacagtagtgttaaaagatatttgatttcataatcagacaacacagatttcaccagacattgaaaatcaaccctaaacatccaatcttcagaaacaaacatatatagctagacacattttgtctatagacataactcactcatggttatgcatttggcaatgtcataaactaaacaaccatgggtttatgaggtttcgacaaacaaacacaaagaatgttaattttgacgtttagacaaacactacaaccaatcaataacaataacattgagacagaacagagaggaagagagacaaactcacgtgatattgacaccaccatcgaagttataacgagtgacattcttacgaacccaatctttggctcggtcgtaactagtcataaccttaagctgatcattgggaatagcgaccatcacttcaagacccgatccagcgagtgcacccatggttgtctcgtccgcatcaaaaagcttaactttgttgatgttattgtctttaagcatctgaaccactgtctttggaggtagcttatgtgtagccattgttccccaattcacacccaacccatttaccaaaatacccaaatgaccaattacgattacgaatccgacgacgagagccaacagattcgacatcgattttcacctgagaaagatcgaaaaggtgagattttaacccaaaattgtaaaattaacagtttcataaatctaacatttgggaaatgagaaacttttagaggacccattacctctccttagatatggagactgataaaacgcgtacagagagagaagaagaaacgcgtggagactgtagagaaacctaaaaaggtaaactttttggttttggggaaactaaaagagagataaaagttggagatattttcggtgagtttcgttgctaaatgaatgatagtactatttaataatgatgtatcatgacgttgtgggtggatttataacggctctatttctccggagagaacatgtcatgggccaatgctcgttcagtctttgtcctcgtaacaactaataaacaaattagttcatgggacatatggttaccgacataaaaatttcaaaattttggtgcatctgtgatctaattccttgtgatgatttgatcccaacccaaaaccgaatcgaaacaaaattaatcagatcatattttggtttaatcggttaagtgtttctatattagaaaaacgaatttcgatagaaccttagacttacattttattaagagttttaaaccctttgaatcgagattacctttatatacaaaaactgaacctgaactaaactcatatgagatggtctgaactacattttgtttcactttcggtttaggggagtacattcttacattgtgaataatccattacgaccactttaaccgataaattatgaaataaaaatggtaagtgagttaacgaatgataaatttattagtaaaaacaaatagaaactaattacatacataatataaggtctattttgtcatgtatatatacaattgtcttctatttcaaaaaaaataatttaaaaaaaaaaaaaaaaaaaattgtcttctatttcaatttcaacgatgatagtaaaatatgataaagcaatgcatccgaggctccggaccatccgttttctataagtagtaagatgaatttattttctattttaaatattagttattcagaaaatttgaagaccaatcaaaaacaaaagattaaacaaaatcatggttacttattatgtggtgataacaataacataaggacgacccaagacaacttcttatgattataaaaaaaaagaaaaaaaaaatcttatgatcagaaaatgataatttgataagctcgtttataataaagcttgacaattctgattaactttcgttggtggctaagtccactacaaacttcatttgtcttatcttttcttctcctttctctccaccatttgtcttatcttttcctctccttactctccatcaatg

SEQ ID NO: 24108 - DNA, 3003 bp, Unknown
  misc_feature (1)..( 3003): 2750-1469P.txt file - cDNA_ID_2166029; gDNA_ID_1620790; Annot_ID_50460
tagggacataactaaatgtttagtgtaaattatggtttggtttggttcggtttgagttcagttaattcggttcagttcagtttggctaggtttggttcagtttggctaggttcggtcaaaatgcacatccctaatgaaaacatagagacgataagagtcaaaagtggtaaaaactgtgacatatctaaaccgctatgtcatagtctagacaattattgcagtcgctcgtagcacggttctcaattaagattttagcttgtacaacaggcttggttatgatttatgaagttaccttggtggtcgaccatgtgggtgtgtgctgaggtcaaccacagatgaggttagatgagggcgacccaaaatcaatcttttaggccaacttcttcctttgcacaagtttgccgccaaattgacatgtcttttatacttaagagatttgacattcaattatcaatgtttcaaaaaaaaaagatcattcaatttggtacttcaacaaatgtcaaatctcttaagtacatgtccaatgcgctgttttgcttcttctttttttgcattttccacgttctcgacatgtaaagacgtaagacacacgacaatactagaagtgaaactatatctttaggtcataaaaccgcataaaacgattaaattattataaaaaatgtatggcaattatgtgaatttcaagcatagaagttttcttcctttattgtcttttcatgattgaaactcacaatcgttatagtatacgacacaactcattattatttttaacaagggtttagaacaacataaattggttttaagatacttaattgtcatattaactaagaataatttgtgttctatttccatttagttatcataagtgaagatcagtgtttgaagggcagtgagtgaaattaaagaaactaaaaatagccatttgtttcttaatgtccacctcatccttgatatatatctcaatacgttttataatttgcttgtgtggttgggagagagagaaatgagaacgtaaaagaaggaaaacacgaaaacaacacaaaaggatttggttggtttgcttttaaaatgctaaatgacagatacatacgggtaagaaggcgtgactccctctcctcccctcccactttttcatcattggccatttataaatttaattctcaattcactccaaatctcatcatctcacgtttctttatcgatggagggttcgtctacaagccacaaacgcaagaaaaatgacgagcatactaagaagagcaagaaaagacaacatgtgagagccaacaatgtagaaaacaagatggaagagaagagaagtgggagtaatgaagagagtttgggagtttttgagttcccgtggatgaaggagagtatgatctcaacctcacttgattggagtctaccggaatctatgtttccggtcttagatgatggtaatgagatgtttgaagagattagtgatgtgagatggccagtgaaaagggttagtaattataggttggagtttgaggcttttgaatgcatttggacttctattttggattagattgaaatatttgttagccatgtacttcaaattgcattgagagtctaggaccaaacatttttcatttttgtttttgtgttgataataatgtgtttgttgagatgtaaaagagagtagaaggaacggagtagtgtttggttatttagatacgacggaaaagtaagggatagaggagcaacatttctttctgcaaagaaaataaaatgaattttgcattagtatacatgtcgacgttaacatttcctttacgattcaacttcgtcactcgccaagctttgtggcctccctccaggacatgacaaaactaagcaaaaacgtttcactgatggcatgcatgaagattccatgtttgatcatcgacacacaaccactgtttggaatcatatattttctgacctcaacttcaacacaagacccagtattaacaaagttcatgtaactgtttgataagaaaaattgatgttatcttatccataactggaacaatgtgctgtgaaaagttgaaaatcctgaatgttttgaccaattcaaggctaaaaacaaagattgttaacaaagtttggataaaagactgagccaaaaattaactcaagataatttaaaagctcatgccaaaattttggaaacaaataagtataaatcaacgatataacttaactaaattttggaagatttcacatttcacaagtttttcttttcttaacatgttattttctatatgaacatctaatttataaataaaacatattgaaggttgtaattttagatttaggatgataaattagttcacataaataaaagagaaatacatattacgggaaaaatattatgtttcgtaatatacaaatattgaaagaacaaaatcaaaatcaaaactaaaatttatttaaatctatttcaaaaggaatatgatcctaaattctattaaagttacgaccaaaaaaatataatctattaaagttattactttttaacttttacctaccatttgacaaattcgttcttatttagttatagaaaataatagttaatcgttaaattatattttggtgtcataaaaataataatatatatttttgttgttgtgcaaagcagcaaaggtgtcataataaaatccaactcacattaaaaccagcggacaaggagttaaattcaccgtactacacggtctgagctgattgcgtgttctcttaaaactccagttcaccgacgaacaacgaagtatcgtggaatccatttcatgggccgaagatttctcacttctcttcagtgtataacttctctagttctctgtgttcttgtatatatgcacaccccatgttcgatgaaattacgaaaccatgtaatcgttatcaaatcctcatctattttcttaaatgttgcaggaatctgggaaagtaatcgtttttggcttaattctgatttgggttcttacttatatagtcaacatg

SEQ ID NO: 24109 - DNA, 3003 bp, Unknown
  misc_feature (1)..( 3003): 2750-1469P.txt file - cDNA_ID_2166029; gDNA_ID_1620790; Annot_ID_168247
tgtttttgggcttcgatttaagtttggtttgttcattcgggcttttaaagtccatggataatggattcacttttaatgttggaatttgtgtgtgttttttggtgggaagaatttgtgtgttaaaaaaactagatctaagacaaaatataattaggggttttctcctgtcttctctctccccaaacctttcagagaggagacaccatcgttcatcctttttgattccggtttgtccggatttgtacatattctcgtctctgtgcgagataaataaagttccgactttagatcggatttccttaccggcaaagtctggtttagatctcttttacaactgcgatgtcgaagccctctgttttacttccaaatctcgtctgatctctctaatcttttgtggaattatatcttcgtcacttatttttgctcatgtcataggagcaaagaacagattacatcaattctcgatgtagtcagtggtggagcctccctggagatggtgatgttcagcgaatttcgaaacagtttggaattgggatccacagaaggaaagaggacgttcaccgcttcagagctgatcggtggtggctcatcggagtttttagcggtttccggcgaactaacggcggagcttgcatctgacgcgtggcaatgtgaagaccacgtatcatatacgtgtccaaccctaaatcaactatactttaattgtattttatttctctgtttgatttagttttgggcctggcctattaatttccatatgtaatcctctttggaccttctgtaatctgcccaatttgggctttatcaatcaaaatggccgacaaaaaataaataaaaaattgtgtgttaaaaatgataaattctaaacaaaaattagacaacaacactcacttaaatcacatcaaacaacatataaacggttataaatatgtatattattgagttaaaagttatagatttatgtctgtatagttagatattagaaaatacactaaaaatacactttcttaagatcacttaaaacggcttaaatccatttaataacacatgcatattaattttttacaaaaaaaaaacacaaaataatttttaaaccaatcatgcatacgtgtttgcggtccactatttttttctaagtaaatcccatcaatttttgcaatccatgttcgtttttgacgacatcgccgcttagaagctcctctatatgctttccataagatatgatgatattgaccttgtcttaaaagacacttccatattgttcttttgcttacatgctcgccgaaactaaattcatacttaccattgaataagacatcgtggacggatatagtgttgtctttagatgtgcaattaactttgagaatactattgggagcaagttcatttcgaaattctaatgtgttatccttgcaaccccatggtactactgtccaactttcatttaaaccaaaatatatggaaatgactattagaaaaacaatgagatggttcatttctcggattcataagttcttttgtagtaatatgaatctaagacatcaaagtgtagtatatggagacattatgaaggcattagctaaatttaaacacaaacatgaaccaataaacctttggctagagaaacatttatcatcgaaaaacaaggtggaccaataagttcaaaataaaataattaacttctaattctcaccactaaattaaacaaaccaaaaaagtcaaatatcttactaaattcttggaaatgttttattttgataatactagatgtcagttctcggtttgatcggtttaaatagggacataactaaatgtttagtgtaaattatggtttggtttggttcggtttgagttcagttaattcggttcagttcagtttggctaggtttggttcagtttggctaggttcggtcaaaatgcacatccctaatgaaaacatagagacgataagagtcaaaagtggtaaaaactgtgacatatctaaaccgctatgtcatagtctagacaattattgcagtcgctcgtagcacggttctcaattaagattttagcttgtacaacaggcttggttatgatttatgaagttaccttggtggtcgaccatgtgggtgtgtgctgaggtcaaccacagatgaggttagatgagggcgacccaaaatcaatcttttaggccaacttcttcctttgcacaagtttgccgccaaattgacatgtcttttatacttaagagatttgacattcaattatcaatgtttcaaaaaaaaaagatcattcaatttggtacttcaacaaatgtcaaatctcttaagtacatgtccaatgcgctgttttgcttcttctttttttgcattttccacgttctcgacatgtaaagacgtaagacacacgacaatactagaagtgaaactatatctttaggtcataaaaccgcataaaacgattaaattattataaaaaatgtatggcaattatgtgaatttcaagcatagaagttttcttcctttattgtcttttcatgattgaaactcacaatcgttatagtatacgacacaactcattattatttttaacaagggtttagaacaacataaattggttttaagatacttaattgtcatattaactaagaataatttgtgttctatttccatttagttatcataagtgaagatcagtgtttgaagggcagtgagtgaaattaaagaaactaaaaatagccatttgtttcttaatgtccacctcatccttgatatatatctcaatacgttttataatttgcttgtgtggttgggagagagagaaatgagaacgtaaaagaaggaaaacacgaaaacaacacaaaaggatttggttggtttgcttttaaaatgctaaatgacagatacatacgggtaagaaggcgtgactccctctcctcccctcccactttttcatcattggccatttataaatttaattctcaattcactccaaatctcatcatctcacgtttctttatcgatg

SEQ ID NO: 24110 - DNA, 3000 bp, Unknown; identical to SEQ ID NO: 5443
  misc_feature (1)..( 3000): 2750-1469P.txt file - cDNA_ID_2166050; gDNA_ID_1620790; Annot_ID_168266

SEQ ID NO: 24111 - DNA, 3000 bp, Unknown; identical to SEQ ID NO: 5457
  misc_feature (1)..( 3000): 2750-1469P.txt file - cDNA_ID_2166054; gDNA_ID_1620790; Annot_ID_168267

SEQ ID NO: 24112 - DNA, 3003 bp, Unknown
  misc_feature (1)..( 3003): 2750-1469P.txt file - cDNA_ID_2166060; gDNA_ID_1620790; Annot_ID_168268
caagaaaagtataaatagttagtcattttgagctttttctttgaagatatttttcagcaaggtaatgctatacactcttatcaagctctcattatcggtaatgctatacactcttatctagctctcattatctttcgttgcaaacaacatcataccctctaatctagatattcagtagtcagtattatcaatattggtgcatataacaatggataaatatgccatattcatctatacagaaattaaattaggtgtaacactggtaccaagcttagttcttaaagtttataattatcactactgcaagggataaatgaacttagaagaggaaaatgagtagcaactagcaagataacgatgcgatgctggaaggaaaggaatggttacagtagtttgaaataaatacctttatctgctgaaggcatagggaaatgaactcccatacgccagaatgcgtaaaggaatgctgacaagaataagaaagccccaacagaggcacgctcccttcttacacctgaaatgttattttaacttgaaaaaattacagacagttcacacaaaatgctgtaatatgcggcagcgaacaataaagtgatgctttctcaaattcatttatctccatctaattgaactcatgagtgtttataaaagaagcaacaaagccagagataaggatcaagatttttcaagatataagatcaaaatgatgggccaaagactgtttatacacagctgcacagaagtgttctcaaagaaatctcagttgagtagcaattatataacaaaaatagtttcaggagctcctaagaaacttgcaatgaattaaccaattatagtgattaccttctaaacaagaagtgataagagcaaagaaaattcacatatgaaataaggcttaccactattacgaagcatcaaatagcaatggtaatacggcaacatgaaaaccagaagaagtatcaaacaaaaaagatccaccttccagtttatcatccttgccctgcaaaatcatcaaaagatcggtccaaggcttaaaactctaaattaatattccaactaaacaattgctacataatgccatgaattccccctccaatataagtattacgtacaatgacaaacacctcaaaagctcaatgatataagcatctagtatcaagtatcaaatttccacatgacataaaggaataaacaagagaagctagctaccacacagtttatatactcgattacattacacatacaccaaaaaaattgtcaagtaaaaaaattcttaagacaataactccatcaatctacactcaatctcaaaatcattgccaattaggtaagaagtcaacaaaattaagcaattgcaaacaaaggaggaccaagtaagtaacacaatctagaagacaacaaataagtaaagtttccaaaaacctccaatgccagaaaacaccaaaactagctaaatatcaaaaactacagagtggattactcgagaaaagacttactctctagagagaacaggtatgatctcgaacaaaacgagctgcaatagattacaagagaaagcgaagacgacactgaaaatgatttgaaccaaagctcgtttctcttcatactctttgtataatctccgattaagaaaccataaacctgcccatcctaagagacttagtgaagctatcaccaccgtgccttcgtatatcgcccatccgtaactcatcgtcgccaaattccagatctctcttacttctcgagaaaaaacctcagatctgcaaaaacctcatggcgattcaacaccagagcttctgttgtacgattcgattcgaatttgatcatttatgaaacaattaaaaaaaaagtatttaagaataccttatttatttttggttagggtttatttggtttaaactctaatcaacaacaacctcatcaacttcatcatcaccaccaccaccatgcgactcaactcgaactcgcagagaggaaggcgttattaaacgctaaccaaccattgagctacggagtaatgtgaaagaaactgcacaacaatagtgtttctatcctttttttttgtttataggttttggcgtctagtctagtgttgatgataattttaactccattttccgacatgttttcttatctggtcgattgatttttttgtttttctttcacttttacatatatacacgaaaaatgatcgattcattaaaattgttgtttagaaggcttgtccaatcttacacgtgttaccatatataaatttgcgggaagtgggaagggaaagatcgggatatcgatagttcatgataaatcttataattacgggatcaagataaatattttttttatcattaataaaaaattaatatttgtgtacattttcttattgttagatagaaaatttaatattatcataaatgtaaagaacttgctaatcaagttatgatttttgtataaataatcctattagctaatgaataaatagagaaaacctgtattattgctaaagtttcctccaaacttatcagacaccaatcgatgatgtataatataccatttttcataacgtgattctattatttttaccattcacaatatttatcatacatttatatttgattttcatgtgtatgttatatttgatgcatgtggaaaaaataattcaaaattaaaaaaactacaaaacgtttttcttattatatcacaattatttaacaaaaaaaagttttgagctattttgtttataatgtttttatgcttttcaatcctacatttcactatcagaaaaatgaggccaagttataaaaataaaaataaaaactaaacccaataagcccattaaggcccataagtcaatacagcaaaaacagctcatctttgctaaaacgtagattactgatttaatctaccggaatcgaaaggcaataccaaacttccggtgaaccggaatcggatccatttgacttgccgtagaaattaggaaattgattacagtgttcttcgagaatg

SEQ ID NO: 24113 - DNA, 3000 bp, Unknown; identical to SEQ ID NO: 5436
  misc_feature (1)..( 3000): 2750-1469P.txt file - cDNA_ID_2166275; gDNA_ID_1620790; Annot_ID_50455

SEQ ID NO: 24114 - DNA, 3000 bp, Unknown; identical to SEQ ID NO: 5436
  misc_feature (1)..( 3000): 2750-1469P.txt file - cDNA_ID_2166275; gDNA_ID_1620790; Annot_ID_168242

SEQ ID NO: 24115 - DNA, 3003 bp, Unknown; identical to SEQ ID NO: 20192
  misc_feature (1)..( 3003): 2750-1469P.txt file - cDNA_ID_2166753; gDNA_ID_1620715; Annot_ID_165608

SEQ ID NO: 24116 - DNA, 3003 bp, Unknown; identical to SEQ ID NO: 20190
  misc_feature (1)..( 3003): 2750-1469P.txt file - cDNA_ID_2166760; gDNA_ID_1620715; Annot_ID_165611

SEQ ID NO: 24117 - DNA, 3000 bp, Unknown; identical to SEQ ID NO: 3310
  misc_feature (1)..( 3000): 2750-1469P.txt file - cDNA_ID_2166832; gDNA_ID_1620637; Annot_ID_162939

SEQ ID NO: 24118 - DNA, 3000 bp, Unknown; identical to SEQ ID NO: 3310
  misc_feature (1)..( 3000): 2750-1469P.txt file - cDNA_ID_2166832; gDNA_ID_2926156; Annot_ID_198444

SEQ ID NO: 24119 - DNA, 3003 bp, Unknown
  misc_feature (1)..( 3003): 2750-1469P.txt file - cDNA_ID_2166934; gDNA_ID_1620817; Annot_ID_169316
atcgtaatcaatagcaaagtaacaggaacagaaattcaacggactctggcactgcagcatacttccgatgcgcaggtaactaaaaagtctatgcctgtggaaactttgtctttagattgctcatgttcgaataagtatagacttattttgtgtactctttttgctaatagtaacagctacagaaattcttttctcatgattctgctttccaggaaatggagccagaaatgattgaaattgtcattgaatcaaagtcaatagcgcaagcaatggtggatgcagctataaaggtatttataatatatctagagacttcagagtcttctaaatacagagaagccaaattcatacaactctaacatcttttgtttaaatcgttgtcaaccgttttaggctgcatcgtcggggaagaacaatgaagactcagagaatatggttcaccaagctttaagctccattggcgaacatcagccattagacaactctatagtgcctggtatcaagcatcaagagtataccaatggcagcttggatcatcattccttaaacacagcagagccgatgagtaacggtttcatctcacaggaaggatcaggaaaaaacaaaacaccaatgccttcagagcttatcacctcttgtgttgcatcttggctcatgatgcaggtaaaggaaataattttgtcttggactaacgaaagtgtaatctaaatcaagaataccaaagttttcacttgatgcggttttgattagaactctttgtgtgttatttacctgcagatgatctcaaagaagcagtacccaccagcagatgtggctcagctaatggatacagtagtgaatgacttgcagccacggtgtccacagaatatgccgatatacagagaaattcaaacttgtatgggattgatcaagactcaaataatggctcttgtaagaacgtcatgaaacatttgtgtcctttgtaattaacctgacatcgaagataacacttggagatcagatttaattgtttggattgtagaggttagtttagtttatagttagttaataatttgaacagctccaaaggctgttgataattagttaccattgattctgtaacttttttttgtcatcattcattgtaactttggttaccttttactttggagctgttttttttttctttctttctcagtgattattttcttgggtcattttggatcctaatggctgaaataatttattcccaccttaatacaaaatctcaaatatatactattccttaactaaaattctagaacaatgccaaatggatatgtttgaaatacctttaataacaactaggatttaacctgtggtgtaccacggacaaatgttttattcatatataataatattaaattttacggtttttaatttagtatttaagttttataattttatattaatgttataactaaaacaaatggtgatgataaaataataaaataaatatttaacatgtgctatatcaatccaaactcgtcccactatatttcatatcaatccaaacccgtcccgctatatttctcatctcatgatatttttttataagtttaaataataataatgttttataaagttaaaatatatctataatatttaaaaataataattattttttacttaagttggaaagatttttggaaacgtttgttgagcgcaatataaagtatttaaattttcaaatctgaataattaataccaattatatatcttgaaagatctttggcaactattgttgaatataatatcttgtatttaattatcgacaggaaatatttaatgtcaatggcatgacattgtaaatacaagtacaaaatttatttgctaaaatggctgcaaaaatgtatatgtagatttacttctaattttaatgtttcaaaggacaaaactaggcatgaccataaaatccgaagcccgaaaaacctagttcgctttggttcgagtggatctaaagtgtttattttggggttttggtttggttcgtgtaggatctgaaacctgaacagatacctgaaatatcgaaactcaaacggatacatgtaactcgaaataatacgtatacataatttgtcggtaaattcaggttcaatatcaggtttcaattaaatttgagaaccagcccgaacccgaatagacctcaaccgatattttcagttcctaaatgtattttcaatctctttaccaaagtaacccaaaaacccaatctaaacagacccgaaaatccgaatgtccagacctaactaaaatcgtgagtcaaactcaaaaaatgattgattaacactatattatacttttacttagattctataaattggacacatgtatgggtgttattaagggttggaaacataaatttaagccatgaccttatttttggttggaaaattcttgttcttttttttgttagtaaagggctgttaataagggttttaatgggttagcgaacgacaccgtttataataaatatgtttgctaaacgacatcgtttgaccttagggtttattgtttaacatgaaagaacgtcgtttcaccaacgtttcttcttcctcgcaagtctcaaagccaggaacgatctcgccgtatgagcaacttccgacattaacactgtattgctctgccgtactctcctctttttcccttcatactcgtcttcacatctgaattccgacaagatattgcgtctgctctcctctcttccctcattctcgtcttctcattaccaaaaacatcttcttctcgtagctaactcaatccaattccaatctccattcaaatcgagcaccagataattttttctcctaaattctaatataagccctaaaattcaaaattgaaatatctatagaatctccttccgattcagacggataatcgccatcaacagcgtgtgaattcgatcaaaaatctgaactttccacaaagaaattcgaaagctcagatttttcgatttcgaaaattttgaaaactcagttaatg

SEQ ID NO: 24120 - DNA, 3003 bp, Unknown
  misc_feature (1)..( 3003): 2750-1469P.txt file - cDNA_ID_2166946; gDNA_ID_1620817; Annot_ID_169321
tccacaacattatctaccttcatggatttcttgtctattaggctgaaagtctcagtctcatagacagagatagtgtttttgctaagcttggcaaagtatttatcatcttttccaccagcccatctgtagaaaaagtttacaagatatcaacatatgtccataatagtggagaagatgataatattggctgtttatttttaggacattgacatgcagttgaaagaattacctgaaaacaggccaagaggcaccagcaacaccaccaggtcctccaattgaaaactcatcagcactacccttgaaatctctcatcatcctcccggttctcacatcaaaaaccttaatctcaactttctgaaagtttgacagaattcagcgtcacaaatagtaaaagttgaaaagaacagaagaaaagatgcactcacacttgcatctcgcgggttgcttggttcttggctatggtaagttacaagatatttctcacctggcgagaaatcaactagttttacctaaaacataatcaacaaaagatgcaattttcaggccaacagaggaaaaacggaagtaatatgtagcaattgaaaggaaattcaaaccatagaatgctgataacgcatgagacgcgtgaatgtatcagcaccaccccaaacagctgccccctgcttgtggagtgtcacaaggtatgtacctaaaggagaccactgcacataactctctgtccaatactgcataggaagagaacatcattaattcaaatgaaggtaacataacatataaaagtgctctaaacagtcaagtaaacaaataagggatattaattcaaatgaaggtaacataacatatacattgctctaaacagtcaagtaaacaaaagggatatacacacaggaagtaacttacaggacgcttatgaacaggttcaggcgccttctgcctagtatcattccagaaaacttcagtatcagggccagaacgaatgactagctggtctcgggctttttcatcagtaagccatttttgcaaattttcctgaaaaaacaaacaccatataagtaacgacaattagcaccacaaaaggctgcaatgaattaaaatatatacatgaaacaagagttatgaaattatagttattagttagtatacatcaattacgtaaaaagatcctaaccctaacgcagcaggcaaacacaaaataaatcagcgaattaccaaaataaagaagtgattacacagacacaatggaagttattcaaagaaaattattcaaggtacagggagtaacatgatgaaaactacacataccccagggacgtagggcctggcctgaggaggctcccactcctccttcacattcatcaacctgtcaaaatcatcgaacatgtttacagcaaagatgtgagacttgtccaacttgtagccatgagacttttccttagcgttttgtgcttcctgcaaagagccccagacattgagagaaactcttaggaaatactcaaccattaagaacaacctagtttgggctcctttctaacaagagaaataaagtattgaaacatatgacgccgacattattgcttcagaatccaacaaaacagagattaagctaatcaagtagataaataacctgaggagtgttgaactcaataaaacagtagcccaatgtcatcttggtatcgggatcaacaggcatccacagtccattttccttaatcacacctaactggttgtaaattttcttgacaacaccttcaagtttctcaaacttctccttgggaacaacagggaggtgatcgaccacgataatgttaccgaatccagtgtcgaattcagactggtcatcctggtaaacagcttcatcatcactacaaccatcacagaaaaaaaaagtgtataacgaatcagttccatttttcatacgttcatagataaaatgtataaatataataagctttgcaccatcaaggaaagagataaaccaattcgaaatacacaaaattttcatacatacaatagcaaaacctagaataaaatcatcccatcgtataaacacaagaagattagaaatagaagtgaccgtatatgaacaaccagagatctaaaggaaaatctcacctctcgatcccaaagtcttctccaggaggaagttggatggaatcaaaattaacctgagaccaatcaatccctaacttagcagctcgggcatcaatatcaacgacctccatgatttcaaaccttatatcaaaaatctgccaaagaaagccatatagagagagctatcagtctttaacacattccaactttaagtcgataaataaatgtgaaaaatctgagtctttagatctaaaagtaggttttttgttaaccctaaacaagtattaaaacaacaaactaccatggccaaatgttcaaagactaaaactttgaatcatcactcccactataatgtaaatctaaaaccatgcctatagaaattattaactatactctagttttatttaatctagaacccaacaacaggtgaaatggagaaaaatggcaaaattttcctgaaggctctcttatatctattgcatcgttctggatcctgtctcatagctacataagaaaagacaaaaaaaacaaatgaacactgaaatcgagataagaaacgtacccaatacagagatcagccgagagcaaaaaacaaagaagaagacggcgcttgaaggtgaggaagaaggagcgattgttttcaggtctttttggatcatacgacgtcggttccttaaacgggcttataaatatttatatgggccgggtaagcccaattcaatagtaatcagtagatctaatttattgtctttctctcgattagcttttttttttttttaacaataatccgtctctttcatttggtgtcctcgagaaccaaattcggataatctctcatcggaggatcgttgttgttgttgctagggttcttatcgatttgtaatgtacaaaactaaattaatcccggtgatg

SEQ ID NO: 24121 - DNA, 3003 bp, Unknown
  misc_feature (1)..( 3003): 2750-1469P.txt file - cDNA_ID_2167087; gDNA_ID_1620565; Annot_ID_160685
atctagtcttcccgagaaaataaattctttagctgcaccagctagtatacttggctgagtgtcacatgcttgcagctcaaagtcgcatatctcctcaggtttacaacccagtgcgtttgcaatgatctaagaaattaaaaagaggactacttggttactaaaccagaacaagatctaaaattcaagctaaaaccataaagcttatatatttcaactggacctccattagaagcggatgatgctttgatttagaactagtttcagcacacttctttccttcgtcatgttcaccactttcagctggcgttttattgagctccgccttcaaatatatcacacaatataaataaattgcaaaggaagtaagaattcaagtctgctacaaacttgacaacaatggtttcgacttcatagataaatctgccaaaagttaaggggttcacagagatgggttctgatctcaaatagtgggtgacatgcaaacaaatactttagccatactagatgaaacaaaatttagcagagacgctggacaacatagcaagcatagaaaaagcaccttaatagctgttgccagtactggaacgaggtgtgtctgagtgtttggcttaaaaccttcagtgttcacattcctgtccgcaaggcaaaacgaaacgtacataaagttcaatattaatttctctacataaagtaactgagaaataaataatgtttttttttatcgcaaacacgacaaaaaaagagtctaagaagtattccaatacaaagcaatgatttaaaggtaacctgtccaagtgaatggccaaggtaggaatcctcatgataggatcctcaatcctgacaaggcgatgagaatacgagacagaacctgctttctcttctttaagaatcacacgtcctgcaacagtcaagtcacgatcaaaccaggtgtaccacagtccacctccatatgtttgaacaccaacctccaagcatccacctttagttatctgtcaacacaatcctcactttctagtcaaaaaagatttaagtaaaaccgctggagaaaatgtcaaaaagatcccaaaatccaaaatcaccttggatacaggtttcaatttgaggcacggactatcagtatgagctccaataatatggaacccgtttccagctacgtatctgttcaaagttttccaaaagattagctctaacattgtagcaatagatggaaccattggtttcagaagaagaaggaaaagatggttacttgtgaccaatggcaaaagcaacaatagtggagtaatttctggtgaagaagtattttttgccggcttcgagtttccaatcatctctctctgaaatctgttcatacccagccttcaaaagccgtctctttgactcgtctacacataataaatagtagatcaatcaatcaatactagaactgaatcaacaacggaaaatcaatagttctcaaaaggaaaagagatgggtgatgattgacgataccgacggcatgaaaagcggtgggagaagcattgagaaaggagaggaaatcagagacgagggagctcttatccatggctggatctcttaacttgagttcttcgggtttttgtgaggcagcactccaatggatgttcggtttccgatcgtccctgtgtaagtcttgccggaggttccgtttccattttagtaacccgagaagttttattggcccattacaaagcccaattggttttttaaataaatagttatttattcatgagtacataaaaaaaatgttatttattcatataaacgttttatacttttatgtaaaaactttcaataaattattatacaaaaatttgtttcatttgaaattttgaattaacgcactatttaaaaatttgttcattttaaaaactttcaaataaattttgtagtcatatactataaatacccttccttatatgtggttggataattttggtaataacataagaattcccaaaactagaagattttatgtggttgggtaatttcggtagtaacacattcaaacaccattaaaccaatcaaaaccgaaccggactaagtggtaataaaattagaaatcgaagggtaataaattctagaaacccttttttttttttttttaacaagacagcaacgtggatctggcagacaaaatcatatatataaataatattaagagggttaaaaaaggccatcgcctcaaaaatcacagccatccattttctctttctctctctctctgtagctctctctcgttcgagcttccatttttcctcatcgcaatcttcatcttcaatctccagctatctcaaatcgatccttctcgaatcgtatgttttcttatcacctcttattgaatctccttcgttctcgttgagtttgaatctgctgaatctcaaaaccctaattctgtttcctccgaggttttttttattggcatcatcggtttattagtttggatcgagaaattgagattgaagattgagatttttggattaatctacatgtgtttatatttcctgtgattgatttataatgatttgttttcacttttgtccgttgacgcgtctttaattgaaccgtcgcggcgcatgcatagatcgatactgtgaagttcttcattgtagattcattttgttgtttgtaattatattgttagtattcgatctgaaatgttgaatatttagagtaaatttaagattttttaagttggcctatgataacgttgatgagatgagtgaacatagatgatttctaggattggatttcgaatgttatcatttagtttcttctgataattaatgaagttgccagcaaaaaaaaaaaaagttttttcattgcgtttggtttttacatgtgttttatctgatagctcatgaaataaaatttactttcttagcctgtggccttagctttgatgattaatgtgtcttatattctttctcttagaccatcatgagtgaccatggtgagaagacttgtccactttgtgctgaagagatg

SEQ ID NO: 24122 - DNA, 3000 bp, Unknown; identical to SEQ ID NO: 2611
  misc_feature (1)..( 3000): 2750-1469P.txt file - cDNA_ID_2167104; gDNA_ID_1620565; Annot_ID_160691

SEQ ID NO: 24123 - DNA, 3003 bp, Unknown
  misc_feature (1)..( 3003): 2750-1469P.txt file - cDNA_ID_2167116; gDNA_ID_1620565; Annot_ID_160693
aatcttcgcttacgtagttactgataaaggctcaggccggtttgtgatgaaccgtcggtatcttgattattatctcaatgattattccggttggttaaaggaccgtgtcacagataatggatattggagagatatcggatcgtgtgttagagattctggagtttgtaagaagattggaagagatttaaatggtgttccagaaactgctcatatgttttacttcagaaatctttctcctgttgaggtattattattttttttgtttaaaagaacatactagtgtactcttaagaaactattatgtcacttgttcttggaatctaacacggtgtgaacgttatatgatatgtatttgttttcaatctgtagtccggatgttgcaagccgccaacagattgtggctatacgtacgtgaacgagacagtgtggattccgggaggagaaatggtgggaccgaacccggactgtatgttgtggaacaatgaccagagactactctgttaccaatgcagctcttgtaaagccggtgttcttggtagcttgaaaaagagttggagaaaagtctcggtgatcaacatcgtggttgtgatcatacttgttatcttctatgtcatcgcgtgtgcggcttaccagaatgttaagaggatgtataatgacgaaccggtcggtgaggctaggatgaccaatctcatcctagtcattttcaaatttaaggagattttggtacagtttttcttcggaattgtgtttttattactctttaatggtttaatggtctgttgttgtaatgataaatttgcttttagtgttttcttctttggatatgttacatatgcatgatgatgattgttcttgcagattagttgaaagaaatgctactcatctttatatagagtagaaattaatttaaagttgatatgaaaaattcaaaccagacatgagttaccgagaatggttcctcaaagagtgttcaaattactcacgttgggaacatgttgttttgaatttgtggattgatcttcacgactgagttctgggctccatctacttatcgtttgttcttccactgtgaagttctccaaacatacaagtagattcacatcctctcctttgaagttaccattaacgtagagagtcaacaacgttttcgcaacacttccgcttaacctaacagcacaatggatatctgaccacactcttaaccgatcactgtcaccagactgaactaaaaccgagtattcagagtggacaagagatggatggtgacggtatgccacaaaatccacaccgtattgcaaccctgatctcaaaacccagttcttcgatcgtaaatgtgaataagctttgaaaaacattggaaagtttggtctttttgatttcatgtagagccatgtgtctacttcattctccaagcaacgaccttgaagtgagattttgatgcatttgagattgtaatgcaaaaagaaagcttcttcaaaagataactgaatccatttcttgattttctctgccgatagaacgagtctgccaaaacaacaacggtcaagaagctcagcttgctctggctcaaccgctagaagcacattgcaacttgagagggttcccgaggactctgtttcggctagagagagctggagctctgagactgattttgaaataggttctgcaagagcttttgcttcagctcctttccatttccatctaggcgccatggaattgagctgcatatatagcactaaaaatcaaaccttttgaccaaaagatgtaaaagcttttcttagtctattaccaactacaactcttataatctaggaaatcagataaacattgtcactacgacatagttgttaacgtttaaggtatcttgaagaaccaagtaggaattggaatgagcaaaaccaagagcttttgattcttttcccacttttgtattcaaaaatcaatcgtctatgaagcggaaactgtgacattcaaattcacaacaaaggtattttgaaatagtaaacacattttaattgaagaagcaatcacattcagacttgtcctcacatgacagtaaccatgaagagaagagatttggttaaaaacgaaacctggcgtattgatttatgaagaaaaaacagaggatatgaaggactcgggaagcagggtctacaatggagagagctatgcttcgaggatccaatggagagctatgcggtagtgaaaaacgtaatctcgtaaaaattattgttgatttcgattgcacagtgaaaatagaaaagaaatagccacgaagattcttcgaaatcgagaggaagagatcgagaattgaaacgagattcggatctctctctccctggggaagacagtcgcgcgactcgagcagcagagattgtggtgcctactgagtacctcgtgtgaagtctaaaaacagcgtcgttttcagctaaataaaattctacaaaaatgacgtcgtttggaataattttgtttgggctgcctatttatacatgtctaggcccgcgaattttaagtctacagtatttatttaaacatcatacacaaaatccgaaacagataattttgattcaaattggtaactatcggaagtatcggatgagaaggaggaaaaaaatgctttgcttatttcattaattactaccttgatactatctttaataacagatttaatttgatattatagattccactttttacttaactgattgataagatggagataatagtttacctttttatttactggttaaaatcgagaatttatggtccattgacttcttttgaccaagtttaacgaagaagcgtctcatgtaagctattcacaaatgacgttggtaccccttcccacacacgtatgatgtgattgacggttctctgtatatatattaatttaaaggacgacgtaaagcaaaaaacctattcgtcgtcactcgtctgtcgtcaccattcatcaacagagcataacagttgctgatttaagctctgcggagagcaagtatg

SEQ ID NO: 24124 - DNA, 3003 bp, Unknown
  misc_feature (1)..( 3003): 2750-1469P.txt file - cDNA_ID_2167120; gDNA_ID_1620565; Annot_ID_160694
gccaagagcttactgtctctttaccctaaatctggagttaggagatgtgttgaatgtcgtggcctcttctgtgtggactgtaaagttccgtggcatggaaatctgtcctgcactgagtataagaaattgcatcctgagcctccggcagatgatgtgaagctcaaatctcttgcaaataataagatgtggcgccagtgtggcaagtgccaacacatgattgaactttcacaaggatgcaatcacataacttgcaggtatctatctatttctctacacattgatcctcctataaaccttatcaaacaaggccatgtaagctaaagcacatgtgatggattgcaatctttttatctatgtttaactattctgacattccctttggtattctcattagatgcgggcatgagttttgctacaattgcggaggtggatggaacaagataatggggacttgtttaaatcgctgcccaacctggaacgaagaatacatcacacgacaagatccagcgcgtgccaatgtggcagctaacaactactttgatgatgaggatgatgatgatgttgatggtgattacgactatgatgacttcttccacccgcattttggacatgctatgaatgatcgtaatcctgaagagcccttcgaccccttcttcgacttgccagatggtaatgtgtccttccaaatctctctaaaactcttgaatcctatatatttcacaactgaaagcactctctgtttatctgtaggtgtgctctttaccccccagatgttgtcttccaagagtcgtcagcaattgtacttgccggattcagatgattcagatgataatgcgacaacacaaaatgctcctgctgcagatgagaattgcccatactttgggaagtatggaaagtacactataatgtacgactccgacggctatgaactcgaggatttcacgaaccctttccatcctgactatcctcacttctgaggtttggtttggaaccaaagttcgtatttttctttcttttttcaaggtccaaacccttttgctatatgctctttactctttaatcgttttttgaggttcatgtttctatgacgtattgttctatataagactgtttgggtaatctttgaatttgaagacacctcgggattaaagttttttttttttccaaaaggtgtctttgtatatataacatctaaacaacagcatcatccatcaatggagaatccatgttggagaggcaagtacaagatacaacaacaacatttacaaacaacgaaatacaagtaaagtacaacacattctgccacaaaagagaaagttgtcaaatggtagcttgttaagagcaacatcataactaatctcaataagaccaaacatcaaaactcaaaaggtttggagttgatcttatagcttccatcatatgcttgtagtatgattgctttgtgctcaccatcttaacatccgaacagggtgatatcttctactctgattataagaaaactaaacagataaaagcataaaactaaaacaatctagactagaagcttaaccatgattaaaaagccaaactaaaataaaaatcaaaagcgataagaaagagataaggatggcacaatcaaccaaggaaaaggtgagtcatcaaagtggccggagagataccggaccaacttctccggtaaactgaaaaagattacagaaccttcaaaaccaccatgcccaaactaattccaaggcagcaaaaacatccttaactgctaaaagaaacatcttcttctttattcaatatgtcacaaacgaagattgagatatggcttcaaaaaccttcgagaagaagcatcttacacaaaaaccggccatgacgtcgccgaatgagccaacacatgccggactcaaaccgtccatcgccataaaaaggaaacggtcgatgacgaaaatgatagccgacccaacacatcgaataataagccggtcgttgtcggactgaagccggttgcaacaactggacggccttgccggaattaaccggacggctttatcggaataatctgaacggcggaagaaatcaagtttttctctctagaagatttaagagagagaagagagaaaaactcatctccgttttccccgacgctcatgacttgggattaaagttagagcattgttttcgctatatttttcgtcgtttggttattggtttcggcttgctcatctttttatttcccttcaatgggattgatagcgaacaagtaaatatatttttgcattcctatataaacattcgtattaaacccattttatatagctcacccacccacttaccctttggcgaaatcaattctttgtttttttttgtctaactcaccgtctctgtctctgaattcccagctggagatatcagtcgccgtctttttgctcttggtgaagatagattcgagaatcccgaaggttctacgattaccacagagaaattcactatagtgagtaccccatctattggatttgcagcaatgcatacgtctcgcagtcaataagctgaggcggagtcacgtacatggactttttgcttgagctttctaccaaataacccacaggttcgtcatttcttagtatagtgtcatgttgaagaattttcggtcacatgaatgttcaagttaaatcgtatattgttctgtgatgagaaagattataatctgcttataaacactgttccttcatatacggttaataatctctaaacttttgttttaaaatgattatgttaaatcacatactcaacaacggaagatgaagaaatgtttggattcaactaagcattatattagttatgcgtaatctgtagctgtagagaacatgatcttattgaattttgtttcttttgttgatgttttaacttctaattaggaagattgtaatctggttatgatatttttccttaaattaagtgttttactcgtttcgagtttttgttttctgctgattatggccattacaagacgcaacaatg

SEQ ID NO: 24125 - DNA, 3003 bp, Unknown
  misc_feature (1)..( 3003): 2750-1469P.txt file - cDNA_ID_2167124; gDNA_ID_1620565; Annot_ID_160695
tttagacaggtgttggaagtcttattaagggaaaagtaatataccataaagataccaaagcagtcgtaatatttgactttgaagtcgtattcaatgggtctacagccagagagaaagagataattgtgaagcattgagagcaaatagagtatacaaaaacaaaagcgaaacgataactctctatttgtttcattaccaatgattcgaggattgcttttgggaatcatctggatgatattttgtgtttgttcatcatttcagcaagagacgccgtttgtttacaacaactttggtcacgtagatcatcttcaccttgacggtagtgcaagaatcattcccagtggtggtatcctgcaactgacaaatgcaaccaatagccaaataggtcatgttttctacgagaagccgattgagttcaaatcatctgaatcagtctcgttctcgacatattttgtgtgtgcactgctccctgctggtgatccgagtggccatggcatgaccttttttgtgtctcattccactgatttcaaaggcgcagaagcaactcgatacttcgggattttcaacagaaatggttctacttccacacgtgtgttggctgtagagcttgacacttctctagcttcagatgtgaaagacatcagcgataatcatgttgggattgatgtgaacagcgcagagtctattacatctgccaatgcttcttatttttcagacaaagaagggaagaagattgacataaaactcttgagtggtgatcctatccaggtttgggtggactatgaaggaacaacgctcaacgtttcattggctcctcttagaaacaagaaaccaagccgacctcttttgtcatcaacatccatcaatctaactgatattttgcaaggtagaagaatgtttgttgggttttctggctcaaccggatcaagcatgagttaccagtacatactcgggtggagtttcagcaaaagcatggcgtctctgccgaacattgacatctcaaaacttcccaaagttcctcactctagcactaaaaagaagtctacatctcctgtgctcagtgttctgcttggtttaatagctttcatagttttggggattcttgttgtagcttatttgtataggagaaacttgtactctgaagtaagagaggaatgggaaaaagagtatggtccaattaggtattcctacaaatctctatacaaagcaaccaaaggattcaataggagtgaatttcttgggagaggaggttttggtgaagtctacaaaggaactctccctcggagcagagaactgagagaagtagcagtgaagcgagtatcacatgatggtgagcacggtatgaagcaatttgttgctgagatcgtgagcatgaggagtttaaaacaccggagcttggttccacttcttgggtattgcaggagaaaacatgagttattactggtgtctgagtacatgccaaatggtagtcttgaccattacttgtttaatcatgatagattgtctcttccctggtggagaagacttgcgatccttagggacatcgcatcagctcttagttacttacatacagaagctgaccaagttgttatacacagagacatcaaagctgcaaatgttatgttggatgcagagttcaatggaaggttgggagattttggtatgtccaggttatatgacagaggggctgatccaagcacaacagctgcagtgggaactgttggttacatggcacctgagcttacaacaatgggagcttctactggaactgatgtgtacgcgtttggtgttttcttgcttgaagtaacttgtgggaggagacctgtggaacccggcttacctgaagcaaaacgttttctgatcaaatgggttagtgaatgctggaaaaggtcttctttgattgatgctagagatccaaggttgacagaattctcatcccaggaagtcgagaaggttctgaaactcggtttgctatgtgcaaaccttgctccagattcaagaccggccatggaacaagtggtgcaatacttaaatggaaacctagctttacccgagttttggcccaattctccagggattggagttctgtctccaatggcgctttccccagcaccactcgtgatcccttcactatcattttcgtcttcctcctccaacaactctatgtttattactcactcagtcctctacgggagtgggcgatgaaagtttctaacaacttccctcttctttggcctcttaatattgactgattttcagccatttctattcagattttgtttcattaatgtatatggtagcaccatgtccattctccatgaagcttagcttgtagaacgatttttaaaaaactgatttttcaggtaaattcttgcaattacttagttcattatttgtaaagcaagttgttgtcaccatttgagtacagtgataaattgttatgtattgagaaagctgatatagttatggatttgtttcttttaatggttatgctattttggaaaactgatagatatcaaaagacacaacagtttagtctgtaactaaccttattcatgccagatctcaggtacctgcaatatattattgcaaatcacgtatcctaggagatgcatgtttctgcacatttgagtaggctcttggcttttaaagagttaaaatactcggagatagtgacaattcaacattttatttcgtttaagacaagtaggacttggtatgacaatcaatgagaagcttgcctttcaaaactgtgaaactacaaggaaattttattatgtggaacttctgaattcttttatcaaagaagactaaaatgtgacagctatcatattgttgaagtcaactcttaccaattctcttggaaaatgcagaatgttcttcttcttgtgaagtaataatccgaccttgtttcgcagatggagaggatagttatttgccataccattgactcagagacaggatttttctcagaacagcaaacactttgttgcattaacaatg

SEQ ID NO: 24126 - DNA, 1414 bp, Unknown; identical to SEQ ID NO: 2643
  misc_feature (1)..( 1414): 2750-1469P.txt file - cDNA_ID_2167182; gDNA_ID_1620569; Annot_ID_160818

SEQ ID NO: 24127 - DNA, 3000 bp, Unknown; identical to SEQ ID NO: 2992
  misc_feature (1)..( 3000): 2750-1469P.txt file - cDNA_ID_2167214; gDNA_ID_1620620; Annot_ID_162255

SEQ ID NO: 24128 - DNA, 3000 bp, Unknown; identical to SEQ ID NO: 2992
  misc_feature (1)..( 3000): 2750-1469P.txt file - cDNA_ID_2167214; gDNA_ID_2926190; Annot_ID_200941

SEQ ID NO: 24129 - DNA, 3000 bp, Unknown; identical to SEQ ID NO: 3003
  misc_feature (1)..( 3000): 2750-1469P.txt file - cDNA_ID_2167226; gDNA_ID_1620620; Annot_ID_162264

SEQ ID NO: 24130 - DNA, 3000 bp, Unknown; identical to SEQ ID NO: 3003
  misc_feature (1)..( 3000): 2750-1469P.txt file - cDNA_ID_2167226; gDNA_ID_2926190; Annot_ID_200948

SEQ ID NO: 24131 - DNA, 3000 bp, Unknown; identical to SEQ ID NO: 3017
  misc_feature (1)..( 3000): 2750-1469P.txt file - cDNA_ID_2167241; gDNA_ID_1620620; Annot_ID_162271

SEQ ID NO: 24132 - DNA, 3000 bp, Unknown; identical to SEQ ID NO: 3017
  misc_feature (1)..( 3000): 2750-1469P.txt file - cDNA_ID_2167241; gDNA_ID_2926190; Annot_ID_200955

SEQ ID NO: 24133 - DNA, 3000 bp, Unknown; identical to SEQ ID NO: 3018
  misc_feature (1)..( 3000): 2750-1469P.txt file - cDNA_ID_2167245; gDNA_ID_1620620; Annot_ID_162272

SEQ ID NO: 24134 - DNA, 3000 bp, Unknown; identical to SEQ ID NO: 3018
  misc_feature (1)..( 3000): 2750-1469P.txt file - cDNA_ID_2167245; gDNA_ID_2926190; Annot_ID_200956

SEQ ID NO: 24135 - DNA, 3000 bp, Unknown; identical to SEQ ID NO: 2634
  misc_feature (1)..( 3000): 2750-1469P.txt file - cDNA_ID_2167272; gDNA_ID_1620568; Annot_ID_160782

SEQ ID NO: 24136 - DNA, 3003 bp, Unknown
  misc_feature (1)..( 3003): 2750-1469P.txt file - cDNA_ID_2167276; gDNA_ID_1620568; Annot_ID_160783
atcttcttctccatctctgcaacgaatcagaaggaagaattttgtttctaatttctcgatgcacataacgtaaaaataatataaatttagagttggtgttataccttcaacagccatagcttggagaaaaattacgtcgtctgggattcttcttcggaaaaatcccagtcaaaggttcatacaatattcacccagaaaacaaaaagaacacaaaagagggaagcagagtaacatctccggagaggagaagccgaaagctcagagccggagagaatccggagaaacagggaaacagaagttttgtgtttttgtgtgtttttctgttgtttgttgtctcgttaaaagatatctttagaaaatggttattcttagaagattttagagaaagaagaaagatgaggttttgatgactggtaatggattggtatctctgctatatttatacaactccaccatgcaaagtcaagttagctttataaaattatgaaacatttttttataagaagaagatgaaaagatatgatgccgtaactaacgccttccaacgaacagacacgccgacggttgaaatatccaaagaccaaagctagtcaatggcatttccgtaattatagagaatgataagacaaaacacccctctttgttttttatttattcgaaattacaatttcacttaatttgtactttcagcaatttaatattaaccatgtgaaatactgacatcttgttttttttttctttggttttggtccagcatttgtcttcattaatgtaaacctacacagaacttatttacgaaatgccgtcgaatgtgaatctttcgaggtaagaatatggcaatatgctatcttatttccggttatcgtgtcgctatcgtaacgagtgtgtaaacatatggcaaagaagcttgaccaccctagaacaagccaataagccattgttgttacttgacatcttaatataataaacatcaaatttatcacgttttataactaagtaagatagaaaacatttatgagattgttttggttcacgacacgacattcacgagtcatcatgaagctttgtaaaaaaaacatatattccaaaccacatcaggcgcaacatagtttattagagcatccacaacggtggagctctctcacttaaactcataattaaaatatttaaaaataatagaaagaaatcagggagagaagcaataggagagagttttatcaaataaactctctgtagagagattttgacacacatgagagaacctctactttacacatgttttaactttattggtgaataccaattaagtaatttaaatttaattacataataaaactctaataaaaataatattgttttattcattgcatacccattttagagagtccaccgttatggatggccttagtagttcatttggtcccaccacttaagctctcatttgtcattaataacttaggaattacgtgaaataaaacttagtttatgatttagcttacgtgaggcgatcgtgagtataaattagaaagaagtacgatatgcattgaagaaaaatccaacgaaaactataagtataaacatagatgtgtctaatttccactacatatatgtgggtttagtaaagttgagtcgttaactaacatgagttgtttttcttgggtcaaactgataattttcttagcttaaaccaaaggagaagaaacctccaagttacaagacttctccaacacaataaattttcctctaaaaaatgttagtagatttgatgattatttgttttggatttgtttttgagctttgttatgacaaaagcgattttctttacgtgtatttatttgttgtaatattatctagacaagaagatataaaaacaacaagtaagtgaagttgttgctggaaaaaattatcttttagccttttggtgaaatgagaaatgcttaacgtaatgaaatgattagttaattggtaatttcagtgagaaaggtgataaggagagaaaaagaggtttcttgtatagtgggtgaactaaaccccttaactaattttgactcctccaaatgtaatctctttcgctctctaaattgggccccaaagtccaaatcaaaatagccaccaaactcaccaatgtcaagttctgtcggagaagtcagtctaaccgatttcattctcacttaaacagtcataaacacactctcctgttcaatccgaaattcagttaggtttttagttgacttctggtttagttttttcatttactgatttagagcaattagtaatcaaagattcaaatatgtcaccgtgaaacacaattgcgttaaccgtaattttctgtgattgttctattgcattgccaaaagattaatagaaaatttgaaatgagttacgtgtaaacttatgaatcaaatgacaatctaagaggcgatcacttaatccaacaacggattagagaatattatttcgtaaaatacagacatgtctatagaaaatctaaccgaaccacaacgatagtggatgtgacatgaaagtgtttacgtctacatggaaaattgttatcgtcatcattcatgaattgaaaagacaaacaggttatttaataaccaagatatcgttttcatgtgatcaaatcaattatcttatcaaataaattaactaattaagtgatctctccatcaacgactcgggttgcctaaaactaatgactaacaaaaatattataattagttttgttgcatagcaagagatcaaataggcgcctgtagctcagtggatagagcgtctgtttcctaagcagaaggtcgtaggttcgacccctacctggcgcgcttcattttaaaattcaatatattttaattttgttttgactgggaaaattccatgagcattagtaacttaaagcccattagtgggcaaattaaatgggccttattagcctaagcccattatcaataaaaacaaaacagactcaggccaacaaaaattagacagaaattaagagtgacaatg

SEQ ID NO: 24137 - DNA, 3000 bp, Unknown; identical to SEQ ID NO: 2640
  misc_feature (1)..( 3000): 2750-1469P.txt file - cDNA_ID_2167302; gDNA_ID_1620568; Annot_ID_160789

SEQ ID NO: 24138 - DNA, 3000 bp, Unknown; identical to SEQ ID NO: 2645
  misc_feature (1)..( 3000): 2750-1469P.txt file - cDNA_ID_2167357; gDNA_ID_1620570; Annot_ID_160825

SEQ ID NO: 24139 - DNA, 3000 bp, Unknown; identical to SEQ ID NO: 2646
  misc_feature (1)..( 3000): 2750-1469P.txt file - cDNA_ID_2167433; gDNA_ID_1620571; Annot_ID_160843

SEQ ID NO: 24140 - DNA, 3000 bp, Unknown; identical to SEQ ID NO: 2653
  misc_feature (1)..( 3000): 2750-1469P.txt file - cDNA_ID_2167443; gDNA_ID_1620571; Annot_ID_160846

SEQ ID NO: 24141 - DNA, 3000 bp, Unknown; identical to SEQ ID NO: 2650
  misc_feature (1)..( 3000): 2750-1469P.txt file - cDNA_ID_2167449; gDNA_ID_1620571; Annot_ID_160849

SEQ ID NO: 24142 - DNA, 3000 bp, Unknown; identical to SEQ ID NO: 2662
  misc_feature (1)..( 3000): 2750-1469P.txt file - cDNA_ID_2167544; gDNA_ID_1620573; Annot_ID_160901

SEQ ID NO: 24143 - DNA, 3003 bp, Unknown
  misc_feature (1)..( 3003): 2750-1469P.txt file - cDNA_ID_2167562; gDNA_ID_2936568; Annot_ID_194692
aagcatgtattatatcctgtaagtttctaccgcgatagggctctaaagttttttgttttccctccttgttgggttggaaaatgacaaggttttggtctctgcaggttgccattgacaacattcctactgaaattaaggacaatgatgacatcctcgagagcgagttctttgatactaggcaagctttcctgagtctttgccaaggtaatcactatcagtacgacacactaagacgggcaaaacattcttccatgatgattctctatcatcttcacaacccaaccgtccctgcatttgcaatggcatgcgccatctgccagcaagaacttgaaactgctcaaggttggcgttgcgaagtttgccctgactatgatgtttgcaatgcttgctactcaaaaggcatcaaccatccacatagcatcattagccgtccatctgcgacagattctgttgtacagaacacacaaactaatcaaattcagaatgcccaggtattccttttctttcaattttttagctttgatcatagaattgatgtccatatgcatacataattattcacttgtcaaagctggaaagatagataggctcaactccttttaggatttttaccaaaattcctttcaaatattgtgtagctagataagtgtcggttagaaaattgagtttgcatctcttggcttctcttttccttattgctaactacggtttggcttgttggtactgcagttaagagaggtgctgctacacgtaatgacatgctgcactgcacagtgccagtatccaaggtgtcgcgtgattaagggtctcattaggcatggtcttgtctgcaagaccagaggttgcatcgcttgtaagaaaatgtggtccctcttccgattgcactcccgaaactgcagagatccccaatgcaaagtccccaaatgcaggtatgtaatctaactacttataaagcaaattttcaattatcagaatagatttgttcaagaaggtgatgtgtttaataatgatctgacaagtttattttttgcagagagttgagagctcattttagtagaaagcagcaacaggcagattcaagacgcagagcagcggtgatggagatggtgcggcagagagccgctgatacaacggcctccactcctgaatgattaacagacatgttatattctctgtctatggggtcaagggttcgtgcctgaagtaacgatccaaatggcaggcgaatcaagaaagaatgagatatttttggctgattaatttggagattcaagaagctagtttaggagagctcatgggaaaatgagcagatgggtctcttccacaactgctaatttaggttcacaacgaggtacatagatattttttcttacatgtattctaaagtatagacatgtgtataagggaattgtgattttgattcaatttttggtgattctgttcattgaatcctattgaattcgactactgaatttgatcttaatttacttactctttgattccttcgtattgtatatgtggtatttttggcaaagctataagctaataaattcttgattttcaatcattacatatactagactggaaatgcaagtttttactttatattcaactagaatactagagtttatccagttgaacgaaaccaagaccccgaagcattttggagtcattaggcaacgaacccattataatgtatatagaaatgatcttagtacggcgaaagccaatgaaattaacaaaaaatacactgccaaactaaagtagtagaattcacctactagacattccatggtgaaatggatcagacagtttgatgaaactctgggaagcttcataagagcattggtgatcgtcaggaaccttttcttaacatccttgccttcactcaattcgacattaacattgacagtttcaagacgttttaaatttgccaagaaatgcctcattcgtttcagctcttcctcttatccctcttaggggtgcaaacgcaggcgtcaccacgtttgtctgtaacttcatgcacaagaccgtgaaagcaaaaagaacaaggcataagcaaattcatgggaataataactttagcaaagaaacagaagtgcgtggtgatcgaacgaaatagatgataccttgatgacttaagtttctagatttggagagtagttaaggagaagtggctccacttaccagcctctttctttgttacactcaaaagataaagtaacgaggttgggaaacaccgggattgatttacagcacgagtaaaatacctgggatctattgtcacaaccaaaacaaacatatacacaaaatgagactttgctagctagcatgcacttcaaatagaatcaaccaatagaagaagaagacgtagcagagactgacctcaagagaaacagcggacaagtgaagggttttaacattgcttatccctgcaaccagattcgtaacataaccaacaatatcctctgtatcaccatccacataataattaatagtcatctggaagacgctcccatgagtgtagcttctacaagggaacccaaatcaacctcataatcttctgcgggataaccagaatagtcaagatagacaagactgggtgtatcaaacagacgaaaacccttgtgaccgttagggtaacggggccaatgataagagctggtcagtcgtttgataagagaaggactagacacggtccctccatcaaacaaatattattaaaaggaaaaaaaaagagataaatgaaaattggtccataagacaaatactgaaaagacgaggggttaaattgaaataaatccctcctcttctctgttcacaaaatcctcgcgccacaaaaccctagctgaacggaagaaggttagtggtttaatctccctctggggaaagctgcttatgttgattctctaggcttttttatattctgaaagttttgattttttgtatcttgttttgtttctcaatcatcaatttgtggtagtagctcactagcaaacaatg

SEQ ID NO: 24144 - DNA, 3003 bp, Unknown; identical to SEQ ID NO: 24143
  misc_feature (1)..( 3003): 2750-1469P.txt file - cDNA_ID_2167562; gDNA_ID_1620573; Annot_ID_160906

SEQ ID NO: 24145 - DNA, 3003 bp, Unknown; identical to SEQ ID NO: 24143
  misc_feature (1)..( 3003): 2750-1469P.txt file - cDNA_ID_2167562; gDNA_ID_2936568; Annot_ID_143738

SEQ ID NO: 24146 - DNA, 3000 bp, Unknown; identical to SEQ ID NO: 2665
  misc_feature (1)..( 3000): 2750-1469P.txt file - cDNA_ID_2167587; gDNA_ID_2936568; Annot_ID_194696

SEQ ID NO: 24147 - DNA, 3000 bp, Unknown; identical to SEQ ID NO: 2665
  misc_feature (1)..( 3000): 2750-1469P.txt file - cDNA_ID_2167587; gDNA_ID_1620573; Annot_ID_160911

SEQ ID NO: 24148 - DNA, 3000 bp, Unknown
  misc_feature (1)..( 3000): 2750-1469P.txt file - cDNA_ID_2167587; gDNA_ID_2936568; Annot_ID_143742
gcggcaacagatgaatgcaataaaaaacttggtcaagcttgctcttcttctttatctccagtccataactttctgaatgtccagccagaacaccggaaaactcctttcataaggtcacaatctccagattcacctggtcagctatggccaaagaatagttctcagagcaccttctctcggtcttccaccttttgcacaaacctctacttgtcatcatcttcaacctctgagactcagaaacatctaggaaacagtcttcctttcctccctgatccctcctcttacacccactcagcttctggtgtggagtctgcaagatctccatctattttcactgaggatttgggcaatcaatgtgatggaggcaactccgggtcgcttctcaaagacttccttaatctttctggagatgcttgttccgatggcgattttcatgattttggctgttcgaatgacagctattgcttatcagatcaaatggaattacagttcctgtctgatgaacttgagctggctatcacagaccgcgctgaaactcccaggcttgatgtaagttaatctcagtcttgtacagctcttatgagtttgcatcagttactttgcatggctatgacaaacattgacttatactttcactgcttatgactttcggtctttgctgttgatacatagagtgtgaaacgtcatttgctcctttaacacttagtttctgtttgattcaggagatctatgaaacgccattggcgtcaaatccagtgacgagattgagtccaagccaaagctgtgttcctggagcaatgtctgtagacgtagtttcatctcacccttctccgggatcagcagccaatcaaaagtcgagaatgagatggactcctgagctccacgagtcttttgtaaaggcggtgatcaaacttgaagggcctgaaagtgagttttagctttttgagatacgagtaggcacttataaagtagaactctagagctactcttgtgtttgccattggttagatatcctttgtttcttctcatctttctgctgataacgcttaacccggtttttgcattaaacatgtagaggccactccaaaggctgttaagaagctcatgaatgttgagggcttgacgatctatcatgtaaaaagccacttgcaggtactaaatcagtttgagtgtgataaatttataagtacatgataccaaattagctgaatatctctgaaattcacgaatgtgcagaagtatagactagccaagtatatgccagagaaaaaagaaggtaaagcctccaacttgttattgtgatttcacagattctctgtttctgcatgatcatcagccatgattttgatctatctgacagttcctttattatttttcgtttattccccagagaaaaggactgataactcagaagaaaagaaactggctttgagtaagagtgaagctgacgagaagaagaaagggtaaagcattgtgtttctctaattccatgttcaatccgcagacatttttcaacattatccctaaaatgactctctttttccatggacagggccatacaattaactgaagcactgcgtatgcagatggaagttcagaagcaattgcatgaacagctggaggtaaaaccgattacacttaacttggggaaaagaaatattgaagatttgctactataaccagtcccataattgatcaatgtgcaggtgcaacgggtgcttcagctacgaattgaagagcatgctaaatacttggaaaagatgttggaagaacaacgcaaaacaggaaggtggatttcttcttcttcgcagacagtgttatcacctagtgatgactctataccagattctcaaaacatgtccaaaaccaaagcatcttcgcctcagccgccattacctgcagagaacaaagcgtcggaaaccgaagacgataaatgtgaaagccctcagaaacgtcgcaggcttgagaacatagctgaatctgaagatcctaagaggtagtaagattcttcaagtatgtaaatatggtccgttttgtgtaatttagtgagagagagagtgtcactcaaaatatatgtttgtaatgtagatctttgtcagaaacgtgtaaacttattacggatattgaggatgtcactgccttcactgtgagaaaagaatctttaattctgtgtttgtgtgtgtataggtcactggttagtgagaaaactgaagagttcactttccaatgtttatatacaagtttgctaatatcaaacgtggaagtcactttccataagaagcctttatgcgtctgagagagagagtacgataagtaaatagaccttcatgcatacaattacttacgggaagcaaaacaacttgagcaaaattcttcactctcatcagtcatcactctctctctctcttggaaaagtcaaaatcaagggtttcgtcgtcgctttgactggcttggactcgcttggtggggttttctgtaaaaaagttgtttgctttgatcttctgtgttacaatggagaaaatttctctgaatgatgatgaatagtttcgataataatttatatgggtctaccatttcgtttgctagttgtttgagcattactatatagctggtttttcgtcatagtagagattaaagtttcgttttttcctctctttctccatcggcattaatgatttcaatctctgagatcaagttagtgaattctctgtcacattaaaggccattcaaaattcgattttgatgcttgttcctgatttttgtaacagctgattgagaagcgaaaaatgcttgaatcaggaatttgcaagtatgcgtgaacaaaggagcaagaaacaatgatctaaagaagatgaaggtgagcctatcactctctctctctatctctagacattcactcatcaatcatgcggtgtattataactcaagtagtaatcatgttgtacataattccctgtgattcaagttccacttactgttagagagacgtttcctaagatg

SEQ ID NO: 24149 - DNA, 3003 bp, Unknown
  misc_feature (1)..( 3003): 2750-1469P.txt file - cDNA_ID_2167593; gDNA_ID_2936568; Annot_ID_194697
atcaagcctgggagtttcagcgcggtctgtgatagccagctcaagttcatcagacaggaactgtaattccatttgatctgataagcaatagctgtcattcgaacagccaaaatcatgaaaatcgccatcggaacaagcatctccagaaagattaaggaagtctttgagaagcgacccggagttgcctccatcacattgattgcccaaatcctcagtgaaaatagatggagatcttgcagactccacaccagaagctgagtgggtgtaagaggagggatcagggaggaaaggaagactgtttcctagatgtttctgagtctcagaggttgaagatgatgacaagtagaggtttgtgcaaaaggtggaagaccgagagaaggtgctctgagaactattctttggccatagctgaccaggtgaatctggagattgtgaccttatgaaaggagttttccggtgttctggctggacattcagaaagttatggactggagataaagaagaagagcaagcttgaccaagttttttattgcattcatctgttgccgctgagagaagcctgtgtctgttcatgattgctttgatgtacatcaacaatcaaaactgtctcttgacaagatcccccattagtttgcagttagcatccaagccgctgagaaccaaacattttgatgattaggataagaatggtggggtcaataaacatgttagtgacaagaattgagtcagtttgtttagttaactttcagaacaaggcatacagaatcatccagtgatccatcttggctggatcttgacaagttaataagttccttgagaactaaaaagctaagtaattggagcaacaagagtacatccgagattgagatttaccatatatacagacacagagagatgcaacgattaaatatggtgttccaaaaaatgcaaaacgagttgccgacacatggaaactttaaaactcgaacagaggaatcaaatcaggttacgcaaagacacgattacaggaggacagaaacgcaaagagaaatgaggtattaaattctaaattcagaatgttgagactgacaagtagtagtacgaatcattcacagagaaaatcaaaagcaatttatttgattttatatttgattttatcaaagggcatgatagaatagaaacggacctgagaggatgataaagtcttcacctttttaatacttgctgcataacaaatgaagaaaaaactaacatttgagaaaacaagctgaatcccatcaaagagatgaagttaattcgaatgagaaagcaaaagaagaagaagaagagatggggttaaaggaaggagacggagatttcgctacgaaatcgccgtcgaagtgtgtactgttggctttgcttgattggtctccgtcttgctggacctctttcttgttccacccgctctttcctcgactgtaactcacggaccaattcaatccgttagttcatttgccacgtaggattcaagtgctcgtgcgttttgccacataaattttattttattttatcgacatcacgcttagctctctctcgtattctcttcctaatcacatttcatacctggtcaaccaaattattggttttaaaaaaactatactacttctttgggttatgagatttgaggatttttttaaaatcatttatcattgttgattcgaattatttatgtgatcgatactagtagtacttcgtaagctttgttttttcttttccaatggagtacatactattgtgaactattctctgcttttctttttcagttagtattgatatctttatgttgtaagaaaaatcgtgacacaattacgaattattgatataaaaacgaatgataatgattaatgaatatgaatgagaaaatggttgcccaaaaatgatagtgactgatctgtaatgcagtttagtagaattagtttcttttaatagcaaaactaatgatcattaatcttccaaaaggaaagacaaagtagcatcatccattaacttgtgggtcatatctaaagccttagccacacaaatccatccaattttttttgttttttttttgtctttagtcttttttaccacataagtaagataatgctaatttaatgctcatcatagagaatgagctcagcaaatgctttctacctgattatttattatcttcaaaatagtcaagtttgaggcatcaagtggtagaatgtctaaatccttacataatttatatttatttttggcaacatacataacataattcaacactgttctaagtaatacatggctagtgggttatataagattatatacttcactaaaggttgataaatcaattctcagtttgcattttgccaatatacctcaatttatcatctttagtcccacaaatgatggccacttttgtcgtactgtatgtttgttttcgacttgtttaagtgttgggtcccctcattgatcaattattgaaaaataaaatgggccttactaaaaacatatatttgggttaactagagagaaagcccaaatacaaaaagagaatcatcagcgattcaacagaggcttgaacgcgcgtcaaaaagcttagctcaaagattgaattttgattttcacatgtttttcttcataggccaaccattaatggcgttgactttgtcaattctctgacaattgtaatttcgttctcctgaaaccgtgggagaaaagaatctgcatttccttcaagttcaacgtcttccaggtttgattttgatttccttttcccaattccatgacttttttgatccgtatccagtaattgaccaccgtgattcgcgaatcatgattagggtttcgttgttaatgaatggcctttggatgatcaatggtggtgtttgagatttaattgggatttagttatgccctcttggaatttggtatcagcatgagtgtggagcatttagtatctgaatccgattgatgaaaggttgacacttttctcttttgttttttccagattttgaaatg

SEQ ID NO: 24150 - DNA, 3003 bp, Unknown; identical to SEQ ID NO: 24149
  misc_feature (1)..( 3003): 2750-1469P.txt file - cDNA_ID_2167593; gDNA_ID_1620573; Annot_ID_160913

SEQ ID NO: 24151 - DNA, 3003 bp, Unknown; identical to SEQ ID NO: 24149
  misc_feature (1)..( 3003): 2750-1469P.txt file - cDNA_ID_2167593; gDNA_ID_2936568; Annot_ID_143744

SEQ ID NO: 24152 - DNA, 196 bp, Unknown
  misc_feature (1)..( 196): 2750-1469P.txt file - cDNA_ID_2167607; gDNA_ID_1620574; Annot_ID_160923
aacatggagcaagtgtgctactctcctgagatattagaaacacaaacctattacaccatttcgaatcaaattctacaaccattactgattccggcggcgagcaaagccaattctgacggtgaagagaggcaaaatctgggcacgagcagccgcaaatttccaatcaaattattctcagccgatctcagacgccatg

SEQ ID NO: 24153 - DNA, 3000 bp, Unknown; identical to SEQ ID NO: 2672
  misc_feature (1)..( 3000): 2750-1469P.txt file - cDNA_ID_2167620; gDNA_ID_1620574; Annot_ID_160926

SEQ ID NO: 24154 - DNA, 3003 bp, Unknown
  misc_feature (1)..( 3003): 2750-1469P.txt file - cDNA_ID_2167626; gDNA_ID_1620574; Annot_ID_160928
ctagaacgagttcctgttggatggcagcagaatccaatggttcagatgttgtatccacctgcataatccaataaatagaattagaccttacaatgtcaaactgctattaatgagaatatcaataatgccagcgattaaagatagtggggaaacaccaaacgacttgtgacagtaaacagtacgtaatgaagtgattcatcaacccttatcagttagcaccataaaataagaacctgcctatgtcgcttgctgcaagcagaagaaagagcctggatcgcataagaatacagcctcctcacttctgatactttgaatctggagaactccccttgaacaacacataaaaactccctccataatttgtagcttgcggaattctgcataagtgccttttcccacctactgattagtacatcagcgttgtctctgcttcggtatgccttgagcagagcaagcaacagttcttcgctatctgggttcagctcaaaagccttctcaagtatactaatctttttctctaaagtctgcaggcgaactcctttctgagattgcatacttgaaaccttgtcttgaaaatcagcaaatgccagccatgcctttgcatcatggggacgttctctcgtcactctgttgaactcccgtgttttattcagcacttcatcctcccatgatgctccaatcattgagtcctttgataaaacatcttcttcgtcactttctggaacagtcacgtcttcctccagtggaatgaaattatcaaaggaagaatccacagcttcacttgcagcagataaacgaatacgcttgaaattcttgttgcgttccatggcagcatgttttgcataccagtatcgggtatcagactttgctctcccctccaaagaatcaatatcaatctctgtgtcaagcatagaactacgtcgattccgcaaataaaacctcagagaacctgaccctggaactctctgagaattgtcaagtttataacgaggaacattcatcctgtattatgcaaacagaagcaaaatttcaatatccctacactcttaaaacgccttgcacagaatacagaaaatgaaaccaaccataactagacaaattataagcaaagtacctgtaaatagagccataagccagattatctggatcaggacgagtgtccaagtaataatccttcacaggtttcgaatagtattcatcagatttacgagaacgagattcatccgaagcattatcactcttccgtttcttctttttctctcgcttcctctttaccttgtcgtcatcagactccaaagacccttcttcttcaaccaaattataaaccctagcctgattagctaaaccgatatttccatcagctcctccttcttcatcttcgtcgtctccagcctcgacctcggatgaggaaggagccgtcgaagcggcagcgttgatgacagagagatccgtagtgaagctagcgttgcgaagccattgaggagcattcgaaatagctgagatggagttcgccgaagtagggaagacggggaacaagccgcctgtagttacctgtgctccgtcgccgtcttctggtgtattcgacattacatccaccggaaaaaacaaaaccgattctgtattttttttgtgccgctatatatttctgccaaggatcgtgaatactgaataggcctaattattgggcctatataaataattaatgggctctattaacattgaaagaatttactcattgtttaatgttcaacaacattcgaatttgaattcgaaactacataaccggtaaatatttattgattaattattacgccatatttaattttactcgttaattcgttatgaaaaagtacagcaaaaagtataaaaaccacgtgcaatattgtaaagaataaactaaaatttgtgataaatttaggacagtctaataaaaattggcaaaagtgtcattttgcttttttatttcccaccaaaactaatgattttccatggatccaaaggtaaacacattttggagaaggtaaacacatttgttttggagaattccttcaggcgtaaatattgcttttagcggtaaaagaggctcaatcgtggcaggaagctcaattcgagctccatagtgaaagtcatggttctttgtctatagataatcgaattcgggtgagggatgtatcacaagatacaactttttctggctatcggtgttttattgatggatcttggaaagcaagtgaccagttctcaggaacaggatggttctgtctatcatctcttggagagtcgccaaccatgggagccgtcaacgttcgtagaagcctatctcctctacataccgaaatggaagctcttctttgggcgatgaagtgcatgattggagcagataaccagaacgtagctttctttacagactgttcatgtcacgtatgtaaacaatatcccggattgactcttttgagttttaatttatatcggttgaaaaaaaaaaaaaaaaaaagataaacacatttaataaaaataaacgaaaaaataaaataaaaattggcattattatttgcgcattggtggcgttgataatgggatgtccaaggaggagggaagcgccgggattgcagcataagcaaatttattaagacgaagaagaagaagctccattagattttgcagaacaaatcaaaagaacttcaacaaggaatattgcaagaaattgattgaagctgctcgaattagatctgtaagtgaaaatgattgctcgacttcgaattctgggttttttgttttgttttttatggggtaatattcatgagagaaggagaatatgcttttgttagggttctgtctaacgaattttcgtactagtcactaagttgcttaattttatctttctgggtttttgtttggagggaggaattatttgagattcgaagaaataaatcatggagtttctgtttgtgtaaatgtttctcaggttttgtgaaaatttgtttctagagatttggggaaatg

SEQ ID NO: 24155 - DNA, 3003 bp, Unknown
  misc_feature (1)..( 3003): 2750-1469P.txt file - cDNA_ID_2167630; gDNA_ID_1620574; Annot_ID_160929
tctacataccgaaatggaagctcttctttgggcgatgaagtgcatgattggagcagataaccagaacgtagctttctttacagactgttcatgtcacgtatgtaaacaatatcccggattgactcttttgagttttaatttatatcggttgaaaaaaaaaaaaaaaaaaagataaacacatttaataaaaataaacgaaaaaataaaataaaaattggcattattatttgcgcattggtggcgttgataatgggatgtccaaggaggagggaagcgccgggattgcagcataagcaaatttattaagacgaagaagaagaagctccattagattttgcagaacaaatcaaaagaacttcaacaaggaatattgcaagaaattgattgaagctgctcgaattagatctgtaagtgaaaatgattgctcgacttcgaattctgggttttttgttttgttttttatggggtaatattcatgagagaaggagaatatgcttttgttagggttctgtctaacgaattttcgtactagtcactaagttgcttaattttatctttctgggtttttgtttggagggaggaattatttgagattcgaagaaataaatcatggagtttctgtttgtgtaaatgtttctcaggttttgtgaaaatttgtttctagagatttggggaaatggaggattcgagctctatcgattcgattttggaatttttgcggaagaatcattttatgagagctgaagctgcgttgattagtgagctttctaagaaaccaagttcaaatgggtctcttcaaaagcttaactttgaggataattgtgtgagcaagttgttggataagaagaagcaaggcgggagtagccaagcattgggtcttcacaacgatagtcacatttctgatgaattggttgtgaaagagatacaatgtggagctgccaataacttacacgagagtaatcttatgaatgatgtttctgttcagacacaaagtggtaatgcagatttttgggaggagagattcacgtttgctgaaggatttgaggataccgagctcgatttacctccctggaaccatacctctactgatattgtagctgactctgaggaatacagtatcaatccaagtaaaagaggctttgtgaatccacggagttcaaagcaatcaagtcatgaaaaggttcctgaacctggtaaaagcaataaagtggttgtggaagacgtcttctcttcttttgagaagatacggactggaagctctagccaggtatctcagtatgaccatggcaaagcatgtcaatctctggaagttgataataaggttgggaactctgcaatacaagaaggattcgtcaccacgtcatggtcaagaagcgaagagaacattggtgcttcaccagaccattggaaggattgttctgttacaactgtttttccgttgtccaaaggaagcacgtcaacaaaagataatggtgtagccattttagataaatggcaaggaaagaaactggttggcgcgagtgattccaggattcttatcaaggagcaggaagatgatgtggcaacagcgctataccttgggaagtcacagtctggttatgaacataagattccaagcagcttagcattttcgctggctcatgatgctccgagggaagatttacctagactgccacatgtaaaaatcaagtcagaggataaactaatgaactttacttgggaagaaaaacacgagcgagacatattggacgagaagctgattaatactgataatgctttcctattaggctcttatctagatgttcctattggacaagaaataaattcatcaggttagttgacatgatgatggctaccatccaaatcttaaaactttatgttctgtatgagtaaattatgttaccattggctagcttttgcgtacaccttttcttttgttttttgcaacctataacttaccttttctattgtgatggtgtcataggtggcaaaatggctggtggaggaaactggttgtctgtaagtcacggaatagcagacgatgcatctgacttgatttttggctttggcgatggcttaggtgctctcaatgaacattcaaatgagtattgggactctgatgaatatgacgacgatgatgatgttggttacattaggcaaccaattgaggatgaggcatggtttttgggtcacgaagtcgactatcctagtgataatgagaaaggcacagagcacggaagtgttcctgatacgcaggataaaagtcaaaccaagaatgatgatgatcattcatttgccgaggaggattcttatttctccggtgagcaatatgtactcgctaaaggcattgagccagttactgcttccaatgatccgatgggtctctcaatgactgaaacatacagcacgaccaagcaagctgatttggttgctcgatatgacgggcaattgatggatgcagaggagctaagtttgatggacactgaacctgtgtggaagggatttgtcagccatgaaaatgatgtaattttgttgaagaaagggaaagtcgaggacaactctggtagaatctgtcggaaggatatccgcgcagaagatgatcgaaatgctgcagttaggtcaattggtgtaggaatgagcgatgatgttgatgacaatgggagtataatacctgaatactttcctggagaaggtagtgaatgggatctggagctccttccttatcgcggagttggagttgctggtgttaagcctccacctggtaaaggtgcgagtatgctgcttaaaaactttgcagatggtggattctcatttccctctccagtagctgatagacagaagtcccaggatgattctgcaaaccctgaatggtcaaaccattgcgatgctgttgtgagaaatgaaagtgatgaaccaaaggggctaatccagtccgatagcatgattgtctcttcgacaaaaagatgcagtggctcttcttctgaaagaaatttaagagacatg

SEQ ID NO: 24156 - DNA, 3000 bp, Unknown
  misc_feature (1)..( 3000): 2750-1469P.txt file - cDNA_ID_2167633; gDNA_ID_1620574; Annot_ID_160930
gtgtatttggttgttaggggagaacttagtttctccttttcgattttgcagtttgggaggcacacctttaatggaacttatgattgctgctggaaaagcagtccctaaactgcagttggaatttggacttgccgttgatagggtgtatacaggcttttttatgacttctcttgatatggcaggtgagtttctgtcgatttcttcatttagttaagtgttacatactcctgttatcattctgacgatgcttcttttcccaggattctcgatttcaatcatgaaggctgaccattcgattttagaccgattggatgctccaaccaaggctccaaattggccagttggcactgatggtctgtgagattgaacctgtttctgtttttccatgaattttttccttggaatatagtcttagatacaaaatttttgttgcattgcaggcaaccggccaccagcgaagattcctgttcctgttcctccttctcgatcaataaaaagcatggaggtatgcatcacaagtatgataaagataggttgtttagaggtatcaaggtttgttgataaatggttttggtaaatttcatgacaacttggcaataccagtctcaaagccgacctctagagctgagtaaagaaggtcaagttcttgaggcagctattcaagcagcagcaactgtgatcatcagccttaaggatagtttgaatgaatgggatggaaaagtaggcgatggtgattgtgggtcaacagtaagtcttgttttttagacgttgctacttgctactgtgcataattatattatgttcatttagtattattatcttacatgggtttgcatcaatattgtagatgtacagaggtgcaacagctattctggaggacatgaaaaactagtgagtccatttgatactctcacttccccatatacctctctttatgttgagttcttcagacttcacagagattcttgacaaaaaatttaaccatgtctctttttgtttctagttatccactcaatgatgctgcggaaacagtgaatgagattggtctatcaatcaaaagagccatggggggcacaagcggaataatgtaattcatgaaattattttacattttcttcgttatagacagctcatgctgttgggttttattggtaaagtgacattacgggctctcttgtgaaaacagttaccatctcctctgcaaggcagcatacgcggagctaaaagctaacgctcagtcagaagtcactcccaaaaattgtgagatcatgcttgcttgttgtggttagttagtattctaaaagggacatgctcgttttgacactcaacgttatattgaatcagggtctgaagcactcaagtcatcaatcgcttcagtcagcaaatatggtggagcaactgcgggctacagaacgatgctagatgcgctcatcccagcttcacaagttcttgaggaggtgacaaagagcaacttactttctttcacaatttagataattgcaacctgcgcaagtagtaatgagtttttgcttttgataagaacagaaactgagcgctggagaggatccaatatctgctttcattctatcaggcgaagcggcaactgccggagcggaatcaaccatacagatgcaagcacaggtgagtttagcataccattatttcggtctgccattgtttatgctataagtggttttcatattttgaaatgacggatgagattgtgtaaaacaggctgggagatcaagctatgtatctgcagagaatcttgcaacggttccagatccaggtgcaatggcagcagcgggatggtacaatgcggcagcaagagccgtaaaggagcagtatgagggctcgtcatgatcccttctccggagtttcttcttttatttcccggatagacgaattgggattctggtgtatgtacgtttaaaagatgtctgactttgtgagggcgctctccgtttatgcaatttttttggtggtgcgtaatactgtgagagtttagaacttcctagagagaacaagacttatattggtattttgaattcttaattttgtttattctgtagttctaaaagtaagggtgtcgctcaactaaactcagctcattagatgagctagatcagtttaccttatttgatcttctatatataaaccgagctaactcgcgagctatacaaaataaatataatagtaataataataatcacaaaaattcacatatttgttccatctttttaagaccctatcatctgtattctctgcatatgatttgttcaatttgcccaatcagcatgagacgtgtactacaagaaagctctgacgcacgttaaacgactctgacaaaagtgtttcctaagcattgtaccgctattttttttttgaaatattatttttgaaatttcggtacgtaaataacattagcatctttctatatattctgaaatatctaaatggatattagccaggagataaacatgaatctttgtagctccttatctctctcaatatatatcacaagacgtatataatctgttgtaatcgttcctcgtaattcaatacagtacgtagaaactttctgatccaaaggtattttattcacaagaccaactttatatgtctgtcgggtatttgagatatagtgagattaatattttataatttagatggtatttggtataatctggtctatgatcttgggaagaagagacagattgaccatcgatttgtgcatgtggtctcaaatcaggaaataaatatgcagtgattctgatattgttctctgtttaattgtttgaggacaataataagttgttgaaataatgtaccaaatccccaattcaaggggaagagagggtcaaggggggagttagttatatgaatgtcttaaattagtgttaagagagtttttgctttcttactttctttatatttgtgaaaagcttctgacatagtatatttttatgttcaacaattcagcataactcaaacacaatg

SEQ ID NO: 24157 - DNA, 3003 bp, Unknown
  misc_feature (1)..( 3003): 2750-1469P.txt file - cDNA_ID_2167652; gDNA_ID_1620576; Annot_ID_160986
gcttttaagtttttctgaaacagttatgttaaaatgtatgagaaatttgagcttcattatactctattttgaagacatttcttattgcctatttgagaattagctaaacattaatattgccttaacagtaatgttaacggtaatataaagtctaattagtctaagtgagaatcaacataaatagtcttaccttaagtaaatgttctcaaatttcagaaactggaaactagccgtttgattattggaaaagaaaggaaacgaaaaggaatacaaatagctaaatctttgtgtaagatttcacaatctcttcttttgtgttatttgtttatatttgtgtctgagaaaatctgagatgaatccaaaaagatgtgcagcttgcaagtatctgagaagaagatgtccaaaagattgcgtattctcaccatatttccctccaaacgatcctcaaaaatttgcatgtgtccacagaatctatggtgctggaaacgtttccaaaatgcttcaggtatatatatctatacacatctttgtgtatcttcttctaatatcctatttaagatcacactttatgcatatatataagtaagtgtattcatggttggattttggtgatctttttgacagcaacttcctgatcagacaagagctgaagcagtggaatctttgtgctttgaagcaaaatgcagagtagatgatcctgtttatggttgtgttggcattattcatttacttaaaactcagattcagaaaactcagaatgaattagccaaaactcaagctgagattgctgttgctcaaaccaaacttagccaaacccatatttctgattttatgtaatatctctcagtttcaacaataaattctcctctgcattttcgtttccgattgcttctacttataagatagtgatcttctttaactttaactatatcagactcataatcaagaggccattagctatactaaaaaagtgtttcataaaacacaaatgtaaacaagttcgaatcgagtttattattatcacaaatccataactaaagggtgacaattatacagtcttgagtctcttggccgatattttgagaatcataatgtaaaaagataaatgaatctgtttacaaaatacatgacactattacaaatcgaatttactattttccctgcttaagctcccattccttttacaagtacatgacattacactacttttgaaggagcttttcttgtatagttacaaagatgatcaatgaatctgtttaatagacgaaaatatatatgtcaagagacactgaaccttcaaaatcggcctgtatcccacttggtgaacataatttgatgttggctcggagtttcgttcgtttcattcattccatccgtgtattcattaccaaatgaagaattgaagtctggatcagaatccatggattcaaccaagtttgaagctttctccacctcaagggcttgctccaacaattggatcatacaagcattatgttctcgaataggtgagataccgtaaacttggatcatccgagtaaagtacctcaaaccatcctttacatttccagtattcgcacaagcggataagacaccaacgaaagtgatagcgtctggttctacgcttgcttcttcttccatctcttcaaacagagacaaagcctcttcaccacatccatgtacccctaagctagtgatcatcgagttccaagtcgctaaactcttaccctgcatcacgtcaaatactttccttgcgtcctgcaagcttccacatttgctatacatatcgatcaaagcggttccaaggaaacaatcaagcacaaaaccgtttttatgagcatagtcatgaacccatcttcccatagacaagcttcctaactgagtagaagcttgcaacaaattaacaatcgtaaactcattaggcttgacatcatcaacctgcattctcctaaagagctgaaacgcctcgtcgggtctacggttcttaacgtaagccgtaatcattgcagtccatgaaacaacgtttctcattggcatttgattgaatacaatctctgcagaatctaactgagaattggagacaagaccataaagcatagtagtccatgaaacaatacttctcccaggcattttatcaaacaccttacgtccactatctggtttcccacacttaaagtaaagatccatgagagtgttttggaagaagacatcattaaaaaacccagctttaatagctaaaccatgaacttgggtacctaaacgaatcgacgaagaagcgagacaagctttgataacaaaagggaaagtgaatttatcaaactgggattgatgagagatcatcataaggataaagagaagaagagcttcacgaggtttgtgattaacagagagagatcttatcataaggttccaggtaaaagtagaaggagattgaagttgattaaagacgagagaagcgtattgggtttctccgaaggaagaagaaacacttatgagctgacgaactagtaactgatcgttggtgagattgtgtttgatgattttggtgtgaatttgtttcaattgagagaaatttgaacaagttcggagaaagtaagaagcttcgggagatcggaatggtggaggagagaggaggtttggtggtgaagacggcgacggagccgccatggattaacgataaatcaccaaattctcacattcactctttcctcgattgatcgtgtgtggatgatgatgaagctgcatataaaccgaactaaaccgaagtttggctgatttggttcggattcggtttattgtgtagcaagaggaagcataaccagattgattcgactaggaaccactaaaccaaacgaaatacagaaatttcgaaccaaaccggatcgattctacgtgtattaaacgtcgtcgtttttgttagctaaaaagaagaaatagtaaatatccattagaagaagaagacgaagcagaggaatctagggtttatgctacattgaagcaaagatg

SEQ ID NO: 24158 - DNA, 3000 bp, Unknown; identical to SEQ ID NO: 2690
  misc_feature (1)..( 3000): 2750-1469P.txt file - cDNA_ID_2167656; gDNA_ID_1620617; Annot_ID_162075

SEQ ID NO: 24159 - DNA, 3000 bp, Unknown; identical to SEQ ID NO: 2690
  misc_feature (1)..( 3000): 2750-1469P.txt file - cDNA_ID_2167656; gDNA_ID_1620576; Annot_ID_160988

SEQ ID NO: 24160 - DNA, 3000 bp, Unknown; identical to SEQ ID NO: 2700
  misc_feature (1)..( 3000): 2750-1469P.txt file - cDNA_ID_2167701; gDNA_ID_1620577; Annot_ID_161010

SEQ ID NO: 24161 - DNA, 3003 bp, Unknown
  misc_feature (1)..( 3003): 2750-1469P.txt file - cDNA_ID_2167723; gDNA_ID_1620577; Annot_ID_161017
gattgaaatttggtttaagaaatatactaaattaaatatataaaaaagtgtgtggttattatttaaaattcaaatattatccgtaaaatgaagtatgtacaattaaagttcagtttattttgataaaatagatagttaaaagtatatagtaaatagaatgtgtaagattgaaaaacaatttaaaacaaaacttacaaaattaactattaagaaaagtgtgtgcattactatttactattcaaatttctaatttctaatttcattggtaaatttttctatttatatctatacccgcctatttaggcgggacttatctagattaataataaagatatttagaagatttggttctgatttaaatttatgattctcctttcatctttgtttgattattttttaaaatgctttgaataatcatatgatacataagtttaaaaatatctcaattttgttttctgcatatatggtgattcaaaaatttttaaaacagacatatattacctaactaatgaaaaaatatatgtttaacgttccatatcggctaaaatgtttagacaatgatttagagtcctattataaataagatcaaaatgaatcaaaattcgaatgaatatgaactttaacttaacaaacatccaaattttaaaaatatataagaggtaattctgttttttattaaactatttctttttaccacaaatattataattaatatatttgaaagcattagaaagtttataatattatgaacattagaacatataaaaataaaaagtaatatgggaatgattatattgaagaacaaggttttatggtgccacggcggaacgagttttgagtcaacattaataaaaaatataaatatcattaactcgctgctttaatacgggacggattaaaatcaataactattttgaaattttatgaacatttgagcatatttaaagaaaatagcatgggacgggttatatggcgggatggactatattaaaattgtattgaggatttaatgtcaatacaattgaatttatgtatactagagtctacataattctgttttatgctattttggttaattttggtttagctttagacttggtttagttaaagaactcttgtacagtccattcaattttgaaagaagatattttacgtttttgtttctctttcgacctcaatcttgagagaagctataattgtatcggcccaaatttcaaaattcataaaataagatacataccgacaagaaataaaacgtttatatatatctagtccaataaagaatgaaaattccaaaatgttgcataaattgtagcctcgggaaattagttaagatcatagctcgagtgaccggttattaaaaacaaagaatacttaagtcgaactccgatgactcaagatccataagagtttaaagatggcggagatagattcaatagcatcactattacttaggtagaaaaagaagatttagctagattcttatatgttgtctgcgttgatcgttttataaatacgttatgtagtgtcatatttgaaactcaattcgtatttgaatataccaatttgtggtttgatatatgagcattatgcatgacgttttaagttattaccaatatatcttcgatatcatccaaacatagatatgtttgggttaatgctatactttcgatttgtggacgtcaattcatttacggaataaccgaagagattgaaaacttatacgtagcacattcagcgatcacaagtcttggactcttggtggcacctaaaatttgcaaacctacaagaaatacacgatatatacaagaaaaatgggaccaagaaagaaaatgtgaggaacgttttacacttcatttgtcagtttttgcatgtgaaacagtgcgacgataatttagtgtacgatacaaaacagtcctcacgtgtatcgatccatcattataagatatataagaagaagaaaaattataaaccttacgcatgaaatagcactttcttcttttgtttactttgggtcacatgaagtacaatatttataatgttgcctcttgttactttgttcaataataaagatgccttacaacatttcaatggcaacattgcacaacatatcgattaattaatctctttttaaccaagaaatttcggatcaaagctcataatctcttcgacaagagaccagaccattttttcaagtcttcttctcgttgccgatcctcggattcaagacttcaagtactctaccctcttgtttgccaactagatactctggtttgttcatatctttccagtttttcaatggtcatatctataattgttccttataattcaacactttctaactaatgtcggtgacgtggcaaaggaggacaaaatagtgggattcactctgtgaactagaggcttccaccattgcttgcacgccttttatttttagagattgaaaacaacatttccttcgaagatgtatcactttccttttggaggaaaaaagcatgcaagaagaaacagtacacaaacaataatacgattgtgttatgttgtgtcatttcatagaatatcatgtcatggcgtacgattatacacgtgtcggttgtgaaagaaggttcacaaaacatgtcccaacaaattaaaaaagttgaaaaagttggagacccttctctagtctctacctcggccagagacttccgtatagccacacacaccttttagcttgagaacaacctttccttaattttgtaacgtcccatcttacgtacttattactatttcagacaccacacgtaaataaacttcgataaatgcatatctaacaacacattacgacagaagacggagaatgccaacaaaactgatcatgtactattctaaatactcaatcataagaatagatccttctagctcaaacttgacctagctactttatatctacaactatttatatagttataaaccacaaagagaattgaaaagaaaaaatagaagctgagagaagacaacatg

SEQ ID NO: 24162 - DNA, 3000 bp, Unknown
  misc_feature (1)..( 3000): 2750-1469P.txt file - cDNA_ID_2167750; gDNA_ID_1620577; Annot_ID_161027
agagaagaaatggtcctcaatggttggttggatctgtgagattttatcagaaactcttttacccaaataccccctcatcttttgaattatttacgttgttctgccattgccgtagcaaacacgcgtcattgcctcagtagacagtagctttcaattttgaaaattgaaggggatgattggttgaggtttttaagattttaaaatgattttagaagtcttcaaagttttttttgtgaatcaagatttttttactttaaaaatttttaaagctttcccatcctttttttatttactctttgttttcaaattttttttaagtcccgtattagtgactttagaaataaacaaaataaaagtttttattttttcttttcttctttcttatatgattctaaaattccataacatatacttattaattgctttttaaaaaaattcaattgatttagaattatttttaaaatttgttcttttaagattcagtttcttatatatttggtaattatttataatcataattatatagttacaattttattgttaccaatcatgttttaacagttaaagtctttaaaaacaaagtctctgcagtcaaagcttttacagtcaaagtcgtaactcccaaaacctctacaaccataaataacagtcgttacgaatcggtcctgaaagctcaactttggatccagttttctacgattgctgacttattcttcaccgtctgatatagttgaccaattagattttatctttaccatttttgaatatatttgtttttgtgacaaccattttttgatggtttgtttgttgaagatatttttcttcggacaaaatagattttttggtttttttgaccgtatatttattttatgtagatatttatttaggaaagataactcaattaatttaaaagagtttaatgacaaaattattaatagaattttaataatattttaaaatttgaactagttatatcccaaaataacaaactaaaatagtggaattgtttcttcacatttcagaagaaaaaaaagtgtcagacagaattgtttatccagtttcacttgaaaaatttataaacacacatttatagatctacataatagttttgatcattcaatcaaacaatgataagaaatttatcatatgttactatttggatgtatgttaaggctcaaatcccttatttcataggttgaaattttttattctaccagtcccaactgtaattatcattggatggaaggattgagttattattgatctaggtatagtcttttattttttccagatcgcatcaaattggactatgaattagtgtacgtagttatcactgaatttagttttatacccctcccaaattcaaagattgattttctagaattttagtattgtatcaaaagattgatattctagtatttttattttctaaatcattaatgcattttaactttacaatacataattaattgtaggcatttagaatgagaaggtcaaaagtcatactctagtgtatagtactctaactacttcttttgtttttgaggcggtaaatttaaattaaaattatgaaaacaatatatgattttaagtaaatggtgtaaatctatgtcaatatatataaaaaaattaatggaacttaattttactggtcttggttccattctaaaattttagtttttgaaaaacgtagttttggctcttaatttgaacttttaacaaaaataagtgactcatataactaaatttgtaaatttaaagagtatggttttagttttagaggaaatgtgaaagatctcaaaaatgatgcatttaatatgtggtgtaattagaattattggaaagcaacataattcgtagtacaaaagtaaattgattactgcatcattaattatttttcttaattttagtgaaaatattagaaaataaatccttaaaattacgaagggatgttatagaaatgatcccacaatataagatttactaaccaaattaactttgttgagatatgtcatgatcattactttttagaaatcatggatcacatgtgataatcgttataacaaaattaaattatatcacttttttataaaaaaggctttcttataaataagaaataaataaatttagaaacaaaatcaagatccggaaaaaaaaaaagtaagacaatttatgaaattgaaatgtctatgaagattatggtgccgactgagatacaaaattgaaagagttgtgtagcaaaatctgtttatagttgatcaaccatcattaattctgaacatacataacatgtacaattttttttatgtaataataaaagaagacatatatatttaaaataagatttgctttcgtatctaattctctaacttttttaaaaatccaactacatgcgtttatgttaaaaatatcagtttgattcgacatctttattataaactatacaatttggcttttgtttaattgtttcttcaaagaataacacacacaaaacaaaaagaacaacaataaaagggaacatcttaatcctctttcatgtgatgctacctttttgcaaacctcttatcttctttacaaatatttaataataaattattgtttcatatctgtgattttacatgtggcaggtgagattagtcacattgcaagctcacatatcacttgtgactaacattcattaatatatattcaaaactatagtgatttttagaataaaatctgataaatatatggaatataattttgtcatttgggtatggaactccaagttatatgtcaatctattaatggaaacaagccatttgaatggacttaccatcatgaaattaagacgttgggctttttacaaactaatacaagtaacataataggcccattgtaagcccactaaaaaaacgctgcgtttcattgcgccggtatctgatttttatctgtgccgaggtctgagagaagaaaagccaaaagttttgtacgaaagaagaaaagctttgagaagccatg

SEQ ID NO: 24163 - DNA, 3000 bp, Unknown
  misc_feature (1)..( 3000): 2750-1469P.txt file - cDNA_ID_2167811; gDNA_ID_1620572; Annot_ID_160874
gcacccaagtgcacatcacttatcagctggacatttttcggatcaaagagctctttcaggagatcaatacagatatgagtaaagcatatgatagggttgaatggaattttgttaaggagttattaaggaagatggaattttgcgaaaaattgatatcttggataatgtggtgtattactttagtccagtatagggaccttattaatagacaacctaaaagactaataataccagaacggggattaagacaaggagatccactttctccttacttattcatactctgcactgaggtgctaacaacaaatatccggaaagctgaacaaccaaaattgatcacgggtatctaagtagcaacaacgagcccttcagtttctcacttgttatttgcagatgataatcttttcttttgtaaaactgataaagaacagtgcggagtaatattgatatcttaaaacaatatgaagcggtttcgagacaaatgataaattgtacaaaatcatcgatgcagtttgggcataaagtagatgatgctataaagacagaaattaaattgaccctgggtatacataatattggaggcatgggttcttatctcggactaccggaaagtttagggggctctaagacaaagcttttttcctttgttagagatagattgcaaagtagaataaatggctagttggctatattcttatcgataggagagaaagaagtgatgatcaaatcggtagctgcagcattaccaacttatgtgatgtcttgctttaggctcttgaaaacaattacttctaaactaacaaatgcggtagcaaggtattggtggagctcgaatggtgactctagaggtatgcattggatggcttggaataaactgtgtaatagtaaattggaaggtggttaggtttttgggatgtagatgattttgattcggccttacttgcgaaacagttattgcggttaatttcgtcttcggactctcttttttaaggtttttaaagggagatattttaggaaatccaatcctttggaaaatataaaatcatgctctccgtcttatggctggagaagtatttgttaagctagatctctggttaataaaagacttattaaaagagtaggttcaaggacatccatctctgtttgggaggacccgtggatcctggctcaatttccgagaccaacaaaaagtaattgttcaactattgacctatctttaaaagttcaaaatctgatagttagtcatatattttactcattataatcttataacacatgtaataaattttatatataaagtatggttttcaaagttatgaactcgcgtgatcatgatacgtgtcaagtctatcgtttagatattgacatgtttcttatataaatagaaaaactaaaaaaaaaaacatatatatcaaaaatatttaacttttatttttttttaactaaaacggaaaactaaaaataagatggaatgtatatactaaaactatatttgtattacaaaatcgacttgtatttcaatttgaatacaatcgaattcaagtgtattgtattatgataaagtagatatttaaattgtattatgatacaatcgtgacacgtgtcaagtttatcgttcagatattgacatgtgtcaaaaaatatttacttttttcttaattaaataggaaaactaaaaaagaaacacatatatctaaaatatttaacttttaattttttaactacaaagaaaaactgaaaataagatgaaatgtataaaataaaactatatttgtattacaaaatcgacttatatttcaattttaatacaatcgaattaaagtgtattgtattatgataaagtagatattaaaattgtattgaaaattttaatttgtaagatttaaaatttggtttaagaaaataataaatttaatattttaaaaatgtatgagttaatatataaaattcaaatatcaactataagatggagcgaataaaaggtattttattatcctgaaatagatagttaaaatgtatagtaaaatcgaatgtgtttgatttatattttgtcacacatcgtatgatggagtgtcttacatcctttgatgtgttactatacctatgttttattctaaattttttaactcatgtaatcataagtgaaaatataatattttgagaaaaaataagatttaacttttcagttacttataatgagaatactttcatttattaattttaactcatttaatattaatttgcatgatgtaaaatcaacttacgagattacggcatatacaaaaaatatattttcaacaatgtttggtttctaaatatttttgtggatttctttattatttatttatttatgttttgttaattgttaattatttttaatactaactaggatataaatttgatatgttataaatataattttgatatgaaaatgttatcacttaaaagaaagagtgtaaaatttaaatagagtttattatgatgacatagatagttaaaccgtattacaaaattgaatatataaaatagaaatttgcgtttttttttctatatgctaaactaaatataaaataaggatcggttactatttagaattcaaatatcatatataagattaaatgtgtataattaaaataaaatacagaagactgaaaattttatttaaaacaataattattaaataaaatatcaaaaaatatattaattattatacaaaattcaaatactatcaagtttatttttctatcttacatccgcctaaataagtgggctttatctagtatcaatatattattttgttaaagtaaacttgtcataattaataggcccggccataatcttataaatacattttgggccgtcgagggggtaatgcttaaaagggtcattagtcgattcatagcttttgccgtcttttcaatcggaggccgattgtatataaatattaaatgtaattcttctgtagacaaaagaaaacctaaagacatctgcgttatcatg

SEQ ID NO: 24164 - DNA, 3000 bp, Unknown
  misc_feature (1)..( 3000): 2750-1469P.txt file - cDNA_ID_2167854; gDNA_ID_1620572; Annot_ID_160884
aaaaaatttcaaactcattaattaaaatatttctaagagatgccacacaatatttttctgaagatattagtcagaaatataagaaaaattaaatttatttatgcaaataaataaatatatatggaagaagatctaaattgaaatagaaaatattaatataaagtcaatagacatgatttcataatcaaaactttgaatgtttttattttttgaatcgaatcgaatcgtatttcggaatccggatattgatataacaattgattatgacaataaggttaagaaggtgttgcccaaaaaaaaaggttcagaaatcagaagaaggagggtagtctctcttggtaactgatgttttatattggaacatggttgagttattggtattgcaatattactattatctgaaaactcaaaaattttattattagtcaaccaaaaaaaaaacagaagtttgtttccggtgaaaaaaatagtgaaagaacctattaaaagtaaaaaatactagtcaacgagaaataaaaacatatggacaaaaattcattgggtatcattagtaaataaggaacaaaattgtttaacaaaactctttttcaagaaaaaatttcttgatggattctcaatattttcttgcattttccctttctcttctcttgattttctctcaaatttcatctttctcctttagtgttgatccaactagaatcactcaactctcttggactcctaggtatgtgttttgtgtatctgaattacgtaatcatgatctttgttctgttgtgttaaagaaagtgaatttcgtggtttcttcagggcatttttatacaaaggatttctctcagatgaggaatgtgatcatttgattaagttggtatagaatcaaacatgttattaagttttcttgttttcataaaattatatagattttgtgatcatataggactgtgttgtggatgtaaacattggttttaggcaaaaggaaagcttgagaagtcaatggtggtggctgatgttgattcaggtgagagtgaagacagtgaagtacgcacaagttctggaatgtttctgaccaaaagacaggtgagagcagtggaattttactatgtatttttattgtattcgactagcttaattcactaaatagacagactagttctctgtgtttttttttgtaaagaagtaaacgcttgagtcttgaccaagttactattggttttgtttacttcaacctttaggatgatatagtagctaatgtcgaggctaaacttgctgcatggacctttcttcctgagggtacttccgcgaggcatatacatttttctttttttttctaattctgtttcttactctcatcttatctttatgtgttgtggatcagaaaatggggaagccttacaaatactgcactatgagaatggtcaaaaatatgatccgcatttcgactatttttacgacaagaaagctctagagctaggtggtcatcggatcgccaccgtactaatgtacttgtccaatgtcacaaagggtggagaaacagtgtttcccaactggaaggtaaaacatatatcacttcttgttccataaatcatcacttgagtttttgaatttaaatcatcacttaatgtgatcattcattcttatagggtaaaacacctcagctgaaagacgatagctggtcgaaatgtgcaaaacaaggctatgcaggtaaaatatatacaagtttgatgtacacacttgtagttgtagcatggttctatgttttatgaaagatacaactatttcttcaaatggtatattacattatttgaataagtaatctttaattgtagtgaaaccgaggaaaggtgacgcattattgttcttcaatcttcatctaaatggaacaacggacccaaatagcttacatggaagttgtccggtgattgagggagagaaatggtcagcaactagatggattcatgttaggtcattcggtaagaagaaacttgtgtgtgtggacgatcatgagagctgccaagaatgggcagatgcaggggaatgcgagaagaatccaatgtacatggtgggttcggaaacttcccttggattttgtagaaagagctgcaaagcttgttgatcttaagaacaacaacaagtgactagattctttcacataacgaaaaacccggtgttttgtaatgaagcatgatgatatctatatttctaatgaagtgtaacaatcatacaacctactaggggtgggcaagaaaaccggaaccgattacccgaaccggaagcgacccgaaaaattggaccagaaaccgaactcgaactcgaagatttaccctattgggtccaaaattcctctacccaaaaaaccgaaaccgaacccgaaaatacccggatattttattcgaaaatctaaattttacctaaaacccgaaattttaccagaaaatttgggtatttacccgaaaaatctggatatacatccgaaaatttggtatcggttccaaaaaagagcccaaaactctatattcgaaccgaccggaacccgattagacccgaaccgacaccgaaccgatattttagatttaccctattggatcctaaacttttctacctgaagaacctgtactcgatagggttttatccgaatccgacccgcttatccgaatgtccacccctacgagtcgtgtttcaagaccgcggtcgtcggcggacaggtccatcgcggatcagaaaaaaatcgggcacaatgcaagtggtccgtttggatgcgggcaggcccgattgactacgacctacaaaagtaaactaagtcaacggtaattaaaagccaaagtcagagaaaaatacagtgggcgtcataaatactccaaaaggggacgaaacagtaaaatctcaaaactatgggaaacaaattgataagaagaaacattcttgggtcaattctgagtagagcattaatacaattcatcgtcttggtcttcttcgcaccaacaacaagtctttctcacgaaaatg

SEQ ID NO: 24165 - DNA, 3000 bp, Unknown; identical to SEQ ID NO: 2713
  misc_feature (1)..( 3000): 2750-1469P.txt file - cDNA_ID_2168015; gDNA_ID_1620580; Annot_ID_161131

SEQ ID NO: 24166 - DNA, 3003 bp, Unknown
  misc_feature (1)..( 3003): 2750-1469P.txt file - cDNA_ID_2168035; gDNA_ID_1620577; Annot_ID_161030
catgaaagaggattaagatgttcccttttattgttgttctttttgttttgtgtgtgttattctttgaagaaacaattaaacaaaagccaaattgtatagtttataataaagatgtcgaatcaaactgatatttttaacataaacgcatgtagttggatttttaaaaaagttagagaattagatacgaaagcaaatcttattttaaatatatatgtcttcttttattattacataaaaaaaattgtacatgttatgtatgttcagaattaatgatggttgatcaactataaacagattttgctacacaactctttcaattttgtatctcagtcggcaccataatcttcatagacatttcaatttcataaattgtcttactttttttttttccggatcttgattttgtttctaaatttatttatttcttatttataagaaagccttttttataaaaaagtgatataatttaattttgttataacgattatcacatgtgatccatgatttctaaaaagtaatgatcatgacatatctcaacaaagttaatttggttagtaaatcttatattgtgggatcatttctataacatcccttcgtaattttaaggatttattttctaatattttcactaaaattaagaaaaataattaatgatgcagtaatcaatttacttttgtactacgaattatgttgctttccaataattctaattacaccacatattaaatgcatcatttttgagatctttcacatttcctctaaaactaaaaccatactctttaaatttacaaatttagttatatgagtcacttatttttgttaaaagttcaaattaagagccaaaactacgtttttcaaaaactaaaattttagaatggaaccaagaccagtaaaattaagttccattaatttttttatatatattgacatagatttacaccatttacttaaaatcatatattgttttcataattttaatttaaatttaccgcctcaaaaacaaaagaagtagttagagtactatacactagagtatgacttttgaccttctcattctaaatgcctacaattaattatgtattgtaaagttaaaatgcattaatgatttagaaaataaaaatactagaatatcaatcttttgatacaatactaaaattctagaaaatcaatctttgaatttgggaggggtataaaactaaattcagtgataactacgtacactaattcatagtccaatttgatgcgatctggaaaaaataaaagactatacctagatcaataataactcaatccttccatccaatgataattacagttgggactggtagaataaaaaatttcaacctatgaaataagggatttgagccttaacatacatccaaatagtaacatatgataaatttcttatcattgtttgattgaatgatcaaaactattatgtagatctataaatgtgtgtttataaatttttcaagtgaaactggataaacaattctgtctgacacttttttttcttctgaaatgtgaagaaacaattccactattttagtttgttattttgggatataactagttcaaattttaaaatattattaaaattctattaataattttgtcattaaactcttttaaattaattgagttatctttcctaaataaatatctacataaaataaatatacggtcaaaaaaaccaaaaaatctattttgtccgaagaaaaatatcttcaacaaacaaaccatcaaaaaatggttgtcacaaaaacaaatatattcaaaaatggtaaagataaaatctaattggtcaactatatcagacggtgaagaataagtcagcaatcgtagaaaactggatccaaagttgagctttcaggaccgattcgtaacgactgttatttatggttgtagaggttttgggagttacgactttgactgtaaaagctttgactgcagagactttgtttttaaagactttaactgttaaaacatgattggtaacaataaaattgtaactatataattatgattataaataattaccaaatatataagaaactgaatcttaaaagaacaaattttaaaaataattctaaatcaattgaatttttttaaaaagcaattaataagtatatgttatggaattttagaatcatataagaaagaagaaaagaaaaaataaaaacttttattttgtttatttctaaagtcactaatacgggacttaaaaaaaatttgaaaacaaagagtaaataaaaaaaggatgggaaagctttaaaaatttttaaagtaaaaaaatcttgattcacaaaaaaaactttgaagacttctaaaatcattttaaaatcttaaaaacctcaaccaatcatccccttcaattttcaaaattgaaagctactgtctactgaggcaatgacgcgtgtttgctacggcaatggcagaacaacgtaaataattcaaaagatgagggggtatttgggtaaaagagtttctgataaaatctcacagatccaaccaaccattgaggaccatttcttctctctcattctctcttctgacgtgtttcccttcttcggtttctcatcctcacgtccgccggatttcgaggaaacgaagaagaagaagaacaacaacaacaaaaggtctctctcgagtttctatgtttatctttttctataatcccttagtctagtgttgtttagactttcaattctgctccaaaatctctggatttttgaatctaccgttcattttctagagattttggtttctctcagtctaagagtcgtcttttgaaatcttgaatgatgaatctgagagtttctatgaaatttgatggaattttgtgtgttcagttgttgattagggtttgggattcaataactttcaaatttggtttcgattaggttcgatttggttatttttacctgtgaattgatctcgattcgttgtattaacgtctctttgtgtttttttattctgtttatgctagccttttgagatatg

SEQ ID NO: 24167 - DNA, 3000 bp, Unknown; identical to SEQ ID NO: 2706
  misc_feature (1)..( 3000): 2750-1469P.txt file - cDNA_ID_2168052; gDNA_ID_1620579; Annot_ID_161086

SEQ ID NO: 24168 - DNA, 3000 bp, Unknown; identical to SEQ ID NO: 2710
  misc_feature (1)..( 3000): 2750-1469P.txt file - cDNA_ID_2168072; gDNA_ID_1620579; Annot_ID_161091

SEQ ID NO: 24169 - DNA, 3000 bp, Unknown; identical to SEQ ID NO: 2735
  misc_feature (1)..( 3000): 2750-1469P.txt file - cDNA_ID_2168193; gDNA_ID_1620583; Annot_ID_161223

SEQ ID NO: 24170 - DNA, 3003 bp, Unknown
  misc_feature (1)..( 3003): 2750-1469P.txt file - cDNA_ID_2168302; gDNA_ID_1620584; Annot_ID_161261
tttggagaatttcctcgaacatctggcgtgcgttttcgggacgacccatttcgcctaacagcctcgccattaagaacttccactctgtttcttctggttgtgcagctactagtctctctaatagcttaagagcttcttcatcttctcccttctctagcttctgctgcaggagtgatctcagcgtctcgacggcctcaggagtggaatccaaaagctcagataatggcgtgatctcagacagtttctcttctttcacttcctcgtaggtcttttcgatagtcgtaaccggagactcggctttaaccggtaaagttgaaaactttccggtcattgaaacagcagcaccgatgagaatcgctgatttggcaaaagatttaaacttttctggaaaacaataaccagaactattctgattcgagctagctctgatacgaatagaaagaagatcgcgacggggaatcagaggtccggtgaccggagtcgctttaacggcgacgaaagaagaaaccaatgaagaagaagctgagagagacgaaatcatgtcttcctcagagcttcagagagagtatcaaaggttgcagaagcacaatcaaaatcaaaagagatgatgaacaaacaaagcactaagccatggcgatatatcagacacgcgtagcttgtgtgaagtatatttgggcttggtttttatattatgggcctttaaataattgggtctttggccttttagttttcttaaggcagatctccggcgaaactttagactgagatacggaagaatcagatcaacgcatgcgaccaagtaaatcaaaatcgggttgaagaagaaagagataagctttcacatcagtaagttgataaattcatgttttggttttgaaatcagtatcatcttctctgaatcaactgtttatccgtattaatcattaaatttcctgagttagggatttcatcgataattaaatgggttgtgatgattcatcagatttttgaaggcgcgaaatggggaatacttcatcgatgctgactcagtacgacatcgaagaagttcagagtcattgtcatgatctatgtgagattttccgacaacttgtctctgtctttttttctatctgtttcaaattttaatgcttttgttttgtgtgtgttttgtttcagttgagcagcaggagattttatctctgtatcaacggttttgccagttagatcgaaacgcaaaaggatttatatctgctgatgagtttctctctgtgcctgagtttgcgatgaatccactctctcaggttttttacaatttctttaatcttaaatctatgcaatcttgttgaattgaattagctttgtattgattgtttgctggatattgataacagaggctgcttaagatggttgatggtttgaactttaaggattttgttgctttcttgtctgcgtttagtgccaaggctagtctaagacagaaagttcaatgtaagtaaatgagtttcctttaaatcgattttttagtggcaaatgttcactttcactttattgtatggaatgatgatcagacttctttgtttctcagtgatctttaaagtctatgattcggactgcaacgggaaggtctcttttaaagatatcatggaagtgttgcgtgacttatcgggatcattcatgtctgatgagcaaagagaggtatgatttatagaaagttggtgacttttaagtttttgaaaagtgattatggacatgttaacaactaactaaataatgaaacatcattaaactactaaaaccaacatatcggtgtgtaatgattgttgtgtgaaaattctattcaactaaaatgtttctgatattcgatcatctaactgttttggtgtgccattactcatctgacacattgttcaaactttgagataaatgctagagtttttccttttgttcttcccatgtgctccactcttatcatattggatgaaatctttgctttaacctctatggttatgatcatgagaagtgtataaagtcggtaaacaaatgaattcaccatgtgtcttgtgttttacttttgtggtatagcaagtactgagccaggttttgaaggaatcgggctacacgagtgactcattcttaactctggaggatttcataaaggtacaatttgtgcttattgtaattgttatcatcaaaattgcagtatttaacttgtcacattcctagaatctgaaactgcatctcctttcttgtttcttcaatctcacagatctttgggagtagtagaccggagatggacgttgaaattcctgtggattagactttatgatcatatatcatcaaacacaacactcaaatctcatcttgtattttgtccacactgtttctagaataatccttgttaattgatcacatcattgcaggctttttcagcacttgttaagtatttgtcaattgaaacttgttctactaaaggaaattacaattgtttcctctgcttagctttttgcattaccaataatggcatatgatagactttaaatcctaatctcaaaaagaattttttttttttctgtgaagaaaaagaaaaagaaaaagtggaatggaatgaataatcacgaaatctccgttttttaatttaaagttgattgtatttaatgaattgtcaaagaagagtcttaattacttgcatattattaaactatgggttaaagaaacaaaaatactaattatggtaattagattgacaaatggtatgtagacaagaagcttattaatgtgacgtaacgtaattaaagtaaagtaagcattcaattctacttaatattgtccacacaagtcattatataaaataaaaaaggaattaaaacgtcgtcattttgcttcataatagaccactttattcacctaactaaggtccaccaccacttcataacagtttcgtttcgcgtcagtcaaataaaaaatatcttcaccattcttttttcaaacaaagcttaattctctttgagaatccgtctagtaatg

SEQ ID NO: 24171 - DNA, 3003 bp, Unknown
  misc_feature (1)..( 3003): 2750-1469P.txt file - cDNA_ID_2168317; gDNA_ID_1620584; Annot_ID_161265
tcggctgactacctggtcgacccatatatatatagtattaatttcccggctagatttttgcaacacaaaacgtttgcttcttcgtttggtctttaagttttttgttataacgaatagctcttatcgttttttttgtgaaagttatggatgaaggttaggtttatataaactaaggtttgaattagtttaaactttcttgagatgctctacttttcttcgcatagttatttccatcttgtatataattaactaaattcatttgtatagttactactttgaaacactattccccaaaaattgtttggctgtcaccgttcttaaaaaaaaaacaaaaacaattgcgtatattgtaatcaaaatagttgaaatccgatatcataagtgattataatggaaattaaagtgtatatacacagattcagatgatcgattactgaatgtgggcataaccaaaaatatgattaatatacatatagtgactgcaaaatatgtgtgaatgagtgtgtacaacttaaacttcaaaacctttttgatatcacaaaacttgaaatggattaaatctttatatcatgtaaaatttgttttgggatattactggcttctatattgcttatatttgtggttaaccagctggtggtatttctaaatatatattctatatgtggaaacaaaaaataaaactgcaactaagttttgaaaattattgatgtaatgataaatgataatggtaaacatgatttatgcactaatgggtattgtttaatttgcttggtcaaaactcagaactcgaatgaccttgacttgtgcaattagttgacgtttttaggtacagattatttttgtaccaaagccagacaccaaatatatcgaataagggaaaaaataagccctcttggatgaaaaaatacgatcttccaattcttttattttcacatatcaaaataaacaatattgataaaatctgaaaaagaatttaaaataatatgctagctcaatataaaactacacttaaaagtgctgttttcgtgaaccacttatttaattcaaatcatattgcaaatcagaaatcttcttaatcaacccatcatctgctgactcataggaggagccatcgtccgttgcatatttccactccaccctatcacataaaaataataaagttacatcaaataattaatcaaacgtatgaaagacactaattatttcaatagaaagtgagtccacaaaacaatgcaatttaccaatagaggggtcaagaccacgggttttgagttcacggtgttcttggcaaagagcacaacattcacaaaagaagtgagtgacgcaatccgaagttggagactccggtaacccgaatttgcttcggatcttggtccggtaagtgcatgagaacaagcaaggtaagccgaccacacaacatattagcccgtaaaataccccacatctcccacaacctacgtacattatatatacgacgttacgtgaattcacacacacacacattgtttagatatgacatatgtgaatgtatggcttaccggtccttccttcgtcggaaatgtccgcgatccgtccgaaagtgacgcatgggcagaaacatgtgaggcaagcttatccagcacaaaccaaaaggaacaaatcattatacaatcctgacaatagatctatatatgtataaagattaaaggacaacttgattaaatttatatagaatttctaccagtttcactgtcttccatgcagctgaaaagaccagaagtccattgcttttccattgtaaagtagcttcaaccaaatcttgcgtcaggttttaaccagttttgtgttgatcgatcttttgataagcgagatcgtaaatcaattaattagggttttgaagatagatttttgttgttagatgctttaagaatggagggtgggtgggtatatatatggttgatggtggatcgcttcgagagatctacaaatgtttaatttttagtacattgcactttgggaaaaatcataaaagttgtaaaaaagagtaaaagacttttaaaactagtacgttgcactttttgttaaaaggaggaaggttttttgaaaattgatttttgtttaaggaaggtgagagattttactgattgtgagagattttaagctacttaaaagtaatatgtaaacgcgtttttgggattggtttaatccacacatatatacaagatacaaagaatttaatttaatgactaagaaaattaaagaaattatgaataaaaaagaaatatacatcctaaaaatgcgaaagtaaaataaaacaggctatgctaaattttaaaatattaaattcaacatttttctattcataaaatttctattaaaattatttgtagataagagataatatgttcaaacattattcctctatataaggaatcaaacttgcaaactttaaaataaaattttgaaaaatatatctaatgtaatattctggttttattagtaaagtaatattacttaatactaacaaattacaaagaaaagaactgaaggaaaaaaaataaacttttaaaattttctaaccagtgaaataaattagaatttaaacttaaaattttattaattaataatagtcataacaaaatttgacaaatgttttcaacttagatgtgcaataaacatgaatttattctactaaatcaatactgggcctatgaatggcgcaaggaatagcccattggttattctatatcttttggaccttacgtttttgaagcctgtttaggatcacactcataacaaaaaaataaataagaattacgcttctaccaccattaaactctaatgtatctgaactcagaagatccgatcggagtagtaaaaattcaacaaaacaacaataagaaaactcattaattcattcgtcggattcgaagaagaaatcacttcccagaaactttcttcgtatcgaagtattgcttgtgttcttcggagaaacgagatcgggatccgaatacgagtacaatg

SEQ ID NO: 24172 - DNA, 3003 bp, Unknown
  misc_feature (1)..( 3003): 2750-1469P.txt file - cDNA_ID_2168328; gDNA_ID_1620584; Annot_ID_161269
ctgagtccgacgtagtagaaagtgtcgatctttttgttacgtagaagcggcgccgtcgcgtctccgccaccgagttggaccgagttgaaatcaagacttgaggactttcccgagtcacggtcaacgaggcagtaagaaaacgacgtcgctttcatttgattggttatcgataaaacaccaccgcctaaaccgagtaaaccggctgctccggtaaagagaccttcgttgtcgtgaccacaacccaaagcgacgttgtttattttaccagagttaccaaacgtcaccgtatcggtagcgagttcaccgacggtgaaagatccgtctccgtaactaacttggtagagacatttgtttgaccgacaagcggaggtttcgagaagagagcactgtggagcagagcaagtgagagatttgtatgtggaagacgaagtcgggttaaaaaccgggtcggactgttggtaacagtcggcgcaaggttcacactggatccaatttacgtcgcttccggtgtcgagaaccaagtacatctctttcgccggagttccgacaccgattcttgagaaatactcgccgcttccttgagaggctccggagacgacaggtgtcgttagatcctcggtttggtatcgtgtatcttcgttgtaaacgggtttgagatcggatctatcgactccttcgacggcgaaacggatcttcgcgacgattccggcgactcgggatgagtcgcgctcgagtcgactgagtgttaagcttttgtagtctttgtgctgtgacgcgacgaaagtgtctcgagagtgaagctctagagatagtggtgaagatgaattgaagaaaaccgggtcggatagggattcgggtttggtggtggtgagtgaggaacgagtcgggtcgagtgagaggatagtttgtgtttgctggagagatgaaacgacgtcgagtacgttcgttttaggtggagtggatagagagcgagaggaagcatcagtggtggtgaggaaaagagagagagtgacgacggcgaggagagaaagaaatcgcgggaaagccattatttccggcgaaggttgatatgagttaagtggaagagagaaagagtaagtaatgtttttaatttatagagagaaaaataaatgctgcggagagagtcacgccagaattgctgcggttataaaagccacatcaattatttatcatcctgttaaaatatttggattcacattatcatcgatcggtaaaaaaactttatggttggatattatattttatatatacaaaaataaattaaataagaagtcttaatctggatttatcatatgattcccaacatagcgttacatttataccgaatcaaataaaaatttagacaaatgtaatttgagaattgtgtttatttgttattggcaccgaaagaagaatttgtactttgtagaattcaacacaaaactatagcatagtgtctgtagtctgtacggacgagagtagaaactgtagaagatagggatttgacctactaaatattttaatacaagtctacaagcgattatccaatattaagctcctagagatgtgtgactacagagtacttaagtgtttatttattgcaatgacctttggatacaaagtactcctatattgttaaccaattcacttttaattttttttacgtgaccaaagctaagatcttatctagaaaactaaaagctttctgtccttttgttatattcgggcttcaaaactttgtaccttcttcttaccatcgctgtcgagagaaaagtcagcagaagttttggaaactattagttatagggatcgaattatcttaatcatctacgatcatgtcattttgtgttggatatttgttaatgcttgtacatttctaaaaaaacatgtgttgtatattagctaatgtcaatatgtggtgcatatttgctaagttgccgtggaaataacaaaaacttaaaattttgctaagtactgtacttttttttttttgtgattgcaatttgcttaaggtgattgatgaacgaaggctatatgtaaaaactggaaaggagtgaatcaatgtgagaagtgggtgagttgttacttcgttagaagagagatttgggtttatttcgctttccctgaattaatggtaacgcacccttttggctttggttgttgcgtgtcatttatttctcttttgtttttaatcttgttatatccattttcttatacctactttactttttttccataaaatgagattatgcaattcaatcagtaatgttttaaatcgcatacacttttatatttaacaatatgccttcactaatttgtatttcaagattagttagtgatattttatagtaaagtttaaagaacattataatgtagacgcaatcatagagtttttctttgtcaaaggcaatattgcaacaaaaaaaaaggtagaaacgaagacatttttttttttgtgtgtgtaatcagtaatcgccttacacaaaaagacatatacttttttgtgtaaggttttttttttttgagctactatcactaaatttgaaatcaaataattgatactccaataaaagtagaaataatatcatagtatatgaaaaaacaaaaaaaaattacaaggacgatgaaagaaaaaacaaaatctcataactcaaaatcaaatatcatctccaagttcttaacatgataaaactagactaaaataaaaactgacatcctactaaaattagaaacaaaatgacataaattgaaatcaaactcacaaaaaaaaacaatagacattaaaacaaaaaatccgaataacaaaaaacaggatctcagctaaacaaggcctggtgtagtatactagtattggcccatggcccatggtttggtatttttttttctctgaccaaaggaagaaaaaaaaaaagatatttatccgtatggcgccaagaggtttgtgtggttttcgatttcatccaaatttctgaatttcgtctctaacatccacaaaatcgaatg

SEQ ID NO: 24173 - DNA, 3003 bp, Unknown
  misc_feature (1)..( 3003): 2750-1469P.txt file - cDNA_ID_2168375; gDNA_ID_1620582; Annot_ID_161189
cgtttcaccttcttccaccttattttgattgcagatagaacacctctaaaccacataaaacatatacacacaaagactcgacacataatcgaaattttatataacgaaaaaaaatgtagagctttaatttattattgaatttcaagttatcgtatgtctcacgtaattcgacatataattccatggggagaaataagtttatcacgtctctttgaaagttcaatggtcgtatcgtttatctttttgtcccaataagctatctaactaatctaagtgaattaagtctacttaagacaactcctacttagttctccccaatttcttcaattaattaattttcctaatcacatttccaacaatttatgcatgcgtataaaatacaattatatattaatatgtactaatacaaaattttatgatctagaacatgtataagttttcttttttttttagaatatctaaaagtttaaacccaaaaactcaaaaactttacgttttttagagacagaatctatactaaattaaatttatttctctaatagacgtcgaactcattatctctatatttgaaagatttaccactgaatcaacatcatattagtatttgtacaattatatagaacgatatacatttttgccaacttttgaaattatactaaatgtctaacctttaaaccagtttactgtacaaatacctatgtaaaaagaattctgtgtgatatataattgtaaatataatacgcaaagagatcgtcaattttgaaaaacactttaaatagtaaatattatatagaaatttatctccttaaattagatgtctatatgttcagaaaaaatattggtatattttaaaaattacaacatggcatctgacctgctcagaattaaaatattaactgtagaagatattttgatacaacataatcatatattattccactacctccaatagtccaaatatatagcaataattttctaaagatacgtatcaagaatggtttaatatgatatcattgttacatgcatatgcgtaatttttttcatagttaatatattctttgtaatatggagccgactgatgaatattggtgagttctagtgtgtgacaaagatgccattgttgactagcaaattctaaatctgaggagaataaaataattctagaaattgaacttttgtttttaacaccaaaatcaaaaccaatgggcccaattctttgctgacttggccaaatgagagccgtccatatgtcagtcgacaactgccaaacaatcttgacggtttgttagtttggctcaaaagccaccagtaatcactgatcagtttgggacttgagtaaatgacttatttacccttagttcaataatacggttttgtgtgatttaatttgctagttaagttaaaccatatttaaggatggtttaattacatttcaggtggaaaaaattgatgagagaatctagctagaaaaagatggacacgtatggaccgttgaaagtaggaatacaaattatttaaggaatacaatatttaatttcaacaccaagtgtcgaatagatacaacaataataatgatgaacaccaagatttattttatattctctattttgaatattgattactccaactttttcatgatttgtttttcagcacttgagattggaatagacacactgtgatatcgaccataaaatattttcttaggaatatatcgttgtgtataaagtataaagttaagtgtaatgctttaaacaagaaaaataaaagagttgagattgtaatcatagcaaaaggctattttatagaccttttagcggatggaaaaaaaaaaaaaaaaacaccttttagctacatgatgtagcctacatcatatataaaaaagataatagaattatttaagaaatgtaatgtgttataaattaataaccaacacatacacaataagattcatataagtttatgaaatcaaggttgtgatattgttgttattgagatccaaaacttaaaatccaaaatatcagaacttttggagcattggattatataaaatatatttttctcaatcaaatctttttttagttaacaactttaaattaatcgcaatagaattattcatgaaaaatgttatttacatataacccaatccaatgatttcaaaagagatattatagaattttgtaaagcattaaagatttaactacattttgttacatagacccataatcataaaacctttgattcatagtttcattcttataatggtctcttaagtatgaaggtgttgtagcggagactagaaatatatatgagggtaatgtttgtctgttgagacacatttttacaagctattaaaaaaaatgattccaacaatatttattgaaagtaaatgtattttattaggagattttaaaattaatgtcatattctaaaatgtacaatatatacattattttttgaagattttacaataaatttcaaagtgaaactgaaatgattttattaaatttatatacataactctttgtgtttttttgacagtcatatatataactcttaaacacaagcttttacagaacatctacagttattttaggtgaataaacactccaatttcaaacaatttaaataaataaatgataattatctgtcaacccataaactttacattgtaagaccattttattttatttattttgactatttatggatatgtgatattattgagaaaaaaaacactattactaattgacagaaaaaatacacttaatattttctcctaaattttctcaacgaattaattacaaaataatgtgtataccaagtaaaaagattctacttctcagtgacagcagaactaatttattcaagggtagtttcggaataataaaaaagcaataaatctctttttcctataaaagcaaagagacactcaccaaacaactcgtccctgaaacctctcttcagaaaactcaggcaccattttctccttccgccgccgccatg

SEQ ID NO: 24174 - DNA, 3000 bp, Unknown; identical to SEQ ID NO: 2729
  misc_feature (1)..( 3000): 2750-1469P.txt file - cDNA_ID_2168390; gDNA_ID_1620582; Annot_ID_161192

SEQ ID NO: 24175 - DNA, 3003 bp, Unknown
  misc_feature (1)..( 3003): 2750-1469P.txt file - cDNA_ID_2168397; gDNA_ID_1620582; Annot_ID_161194
tcaagtagctaaaaattagacatacggaatattaaaaaatggttttggctcaatttttgtacaatgctcttagatttttcatggatttatggtcaagttttgtatgagtgataacaaaaagtcagatctaatgtagtgtataataatttttgctctataaaattgattataaattgaaattaatggtaagtcttgaaatagaatatttgaaagaaaccgacaagtctacgttaaatatcaaagttttgggggtgcaataattaagagcgttttggtgcagtctgttcgtaatcgtagtgacggttgggaactatgatattaatatggtgtctattttttgtttagttaatttagatttcaaatcaaacacttgattaatagaatgtcaagaactcataacactctaatcactaaaggcaaatatagctaaaaacatgtcaatcttgccggttgaaccggataaaaaatcagtggtgggctttcaattcataggattacggccactcgtgaaagaatatgacactaattcacgaaaagatgtttcgtctaattttatggtggttagaagaattccagatgttttcaataatgaggctttttcccataatcattgttttccccccaaatgacatataactcttttgtataaaaaatacgtaattttatgaaaggtacaattatctccttcgttagcaaaatccaagtttctacaatatgtgtatgtgcacgtgtaactacagtttgagttcataaaaccacgtcccacttactgtaaaacgttagcgactacactgctaattagtaggattagacaaattatatgttccctgtgttttaattttgatattcgtttcggttcgtttagcaaaatagaactaatcataaatatttaagtttcaaaagcctcgattcttaagaaaactacataatttcacatattttcactcgattggttgcgcatcaaatgtatatataaaacggatcacaatttttttttttgatcaaaacggatcacaaaattaagtgtaaaaatacaggaactttcctcagtctcgtcagccatgatgcaatggcccttgatttcatctgtaaaaattacaagtcttttcacattacaaagaagcattaagttcattttttatgttgggaagaagaaaatcgatgtcagtcttcactcagtgtcctcactaagaacatgtacctagaccaattaatagattctctgtttatataccacaaatgtctatgcttattaatgagtagtactattcttttatttttaattttttagtaagacacatttaataaccaagatgatacagagaaaacgggagaccgtaaacaattaaaataatatacgtgacttgtatagttgtattgcttgacacaaactaattagaatgttgaccaaatttggttaacggaatttcaccgcccaattccacttgctttatatgcgatgaacagttgaccagaggagacaaagtgtaacaaataggctattaacaaaacatagaagtaattaatacattcatagtttatatatagacatgttgtgagaacttattcttttcttctttaacaaacaatctgaattcgtttcatactatataagtattatatactacctagttatatgctagctttgtattgactcatagagtcatagtacaaatgctaaaatactaaagctacacagagtggtagaaccagctgaaatatgtttaaaactacatgacctaacccaaccattacaaatttataaacaaactacatcctgaaactccagaatagacgatgtagctcactatgaactataatgtatgtttaatgtcagaaccaaataaatttaaaaaaaatgtcagaaccgtacgagaagaacaaacaaaactttttgtagtttgtttgtatatatttctaagtaaaaatgctgaacacaattatacaaccaatatatgtgatctaatgtgctatttaggaaaatttgtcgatgataagtactacgtcagagtcaaaagacccatattggtttagtccgactattagatacgaaaagtcaagcaaacattacatgtaaattttggtaagatgtgagagatatatatgtctttttttttattttttgataacaaagatgatgctaaaatacttttagatccaaacaccaattatgagattcggaaaaactaatgttagaattcgaaccatgatggccaatattacatgaactcaagtggcaaattttttcactcttttactattggagcaagatgacttggttatgtaagagatatgttgctctcaatattctcatagatcatctctttcttcaaattggtaagatatgagaaatatgtcccatctttttattatcataccaaagtcttttataaaatatatcatatatgtatatatatatattgtcaagaataacttgacttcatacatactatttgaattcggatagtatcacaaaacatcactaccacgtaactgttggaacttcaattttacaaagtatttccggctaacttttcggcgagtttttcagtgaagtttgtcacaaaaataagaatgatcatatttttggaatctttgtaatcgttttcaaagttttctctccggattttcgcggttctacaataattacattacatatcatgatcaatatgtgacctgatcctcgtagttaattaaaacataatttcccggtcaccattcaaaactttctagatggaagattaacaaaacaaaattatcttagcttaattttgtagtaacagagaagaaatgattaactaacatctaatcaagcccacgtgtcataaaccccaccaatgaagaaaaaagagcaaaagacatgcacatgcaattacacgaatacatacaccccaccaccatcctccctccttatattattattgccccttcctctcctttcttcttcccctcttaccttttcagagagagaaacaatatttctaatctattacaagtaacatg

SEQ ID NO: 24176 - DNA, 3003 bp, Unknown
  misc_feature (1)..( 3003): 2750-1469P.txt file - cDNA_ID_2168405; gDNA_ID_1620582; Annot_ID_161196
tgaccctctctaattattcatagttttaaaaccaaccctctctaaaaatacttaaaagcaaactcttccaaaatcaaaacctcttcttacacagattttttttttctctgagagagacagagagagcgaaacttgagagaccaaaatccaatcttttcaacaatcgattctctctgagaaaaccaacaataaagctagacacttttttttgtgggtttgtcttcttcttcgttcatgcaccatgttgtgttacgtgaacgaagaagctatataatcaataaatcttatcgatttgttgagtttgggaatcggagagaaagatgttaacaaaggtgcttagtaaggaggttaagccatgccttgcttgtccaatctgcactaatccgtttaaggatgccaccacaatctccgagtgtctccacacctgtaagtgtaacccttcgattgttttttcctttatctttgtgatttagattctgattttttgtttgtgactatctctctgtttattggttatattaattagtgtagactagagattatatcagattgattctgaaacttggaagttgaaaccgatgttttgtttagctttttggtgttgttgtgtgtgtttcaacatgtatctgtgtaaatattaaggtaagcagataaggactgtttttttttgtaagtggatgattcagtgtctgtttatgtctttgtgatttcaaagttgctgtttctttagcttgttatgtttctagtcctggctttaagtattggtatatcttgtgtctttatatgaattgggacttgtggaatttgtggtaacagtttgcaggagctgcattcgtaacaagttcataaatgagagagtgaacgcttgtccagtctgcaacgttaacctcggtgtttttcctctagagaaacttcggtatgaacttgtttgattcttagcatttgcatctatctttatgcttttatgtgatttgaggtatctatataagtgcaggtcggattgcacttggcaggatttgaagctgaaaatctaccgagcaatgatggaaagcttaaagaaggcaggacctaaaactgttgcagcgtctgtgaaatcttcgaaaaagaagagaaaatctcgaacttcactgcgggtctcttcatctagagtatcatcctcacctgatactccattggaaccagccaatgtggttgtggaaccacctaatgtggttgtggaggagaaacatagggagaccgttctagctcttcaaagcactagaaaaccgataatcacgttccagaaacgtgggagaaaagcttcactcccgaagaagattgattcgaaaccagaacccgaactgcctcctaaggagcctaaaattaagaatctatttgacctgaacaacgaacctgaagacaatggattggtaagtatgtatatgagtctttgtataactattgttctcctttgttaactatctgtttgcaactaatgtgtttatgcatcttaggacgaagctgaaggatcaacttttcaggaagtcgtaccaaaggagaaagatctttgtaaacctattttctctctctctgtcactctaaacatcaacgatactcctcctgatatcgttgagcctgagataagttcggatgacgacacagaggaatctgttgaacctattcagaacaagtgtgttgtgaatagagaaacaaaggaagttcctgttcaagtgaatcaaaacagtctccttattagctctgatagggatagagaggacaactctggtcagaaactgaagaccaatggtgctgctacctccagatcaaggaagaagaaaggtaagaaaccggtggaaaagagctattctttgagaccccgaataggcaggaggacggttaatccagcagctggtactactacaccagaagctccggtttccgtggaagaggagatgaaagttgaagaaggacgtaacaacaatccagtttggttttcactaaagccttccaagactcagtaaaactttttttctatcttcttttttcatgtctttaacttatgattctgtttatatttgaaggactcggtttcttcggttttcaggaacattgaaatgctacttccaccgatcaccgcttgctgcataagagtaaagtaagtactaattaaatttcaactataatctctgttgttgttgtagaatgtgtgatattgattctttgatttgtttttatgttcacagagatagcaacatgactgtctcatatctcaagaagtatctaatggtgaagctcggtctcgaaagcgaagaccaagtaaactaactcttctctctatctatgtctcactctctcttgtcttttaactctaatattttttgatgttcttttgcaggtggagatatggttaagggatgagccagtgtgttcgtcactgacactacataacttggtggattggtgggtccaaacaactccattgcctgagcgacaaagcgcgatggtcggaagctccgctgctgaattcatcatggatctctattacagcttcaaatctgacgcctctgactctggctctgcctctgaataattcttctcagaacttcaaactttactcttcttctaaactcatttcttgcagaataagtttcttttgaaagacttctagttttagcatctttctttatttaataattgctgagacctaaatatggaaaactctttatttatttgatttgcttgctttttgaggactcaaacggtatcgttttgtactaattaaatagaagctcattttagctagcttgagttatatttgataagatgcgccggttttgtgctctgtttggtttaaggtagggttaacgaaagatctgtatccaaacagtcttcttttttgcccgccatggataaacacagagccaggagcttagtgacgaactaaaggtgaaatttttattgaaagtttcaatttttatatggattggattacagaaacatttctatgtgaataaaccaacaatg

SEQ ID NO: 24177 - DNA, 3000 bp, Unknown; identical to SEQ ID NO: 2726
  misc_feature (1)..( 3000): 2750-1469P.txt file - cDNA_ID_2168409; gDNA_ID_1620582; Annot_ID_161197

SEQ ID NO: 24178 - DNA, 3000 bp, Unknown; identical to SEQ ID NO: 2742
  misc_feature (1)..( 3000): 2750-1469P.txt file - cDNA_ID_2168447; gDNA_ID_1620585; Annot_ID_161282

SEQ ID NO: 24179 - DNA, 3003 bp, Unknown
  misc_feature (1)..( 3003): 2750-1469P.txt file - cDNA_ID_2168459; gDNA_ID_1620585; Annot_ID_161285
acaaagatggttgaccacgtttttccactaatagtagaataattggttgggtggaaattggattttcagtggtccaattctcaaacttgttcatcgtctttttctaacaagttgatgctagctattgtcatcttttcttttgggaccgagagagaaagaaaactaaaaaatcttgagaacttgctcataatctgttaatggttttgtcaatttcgctcccatcagtcaacggaagttataatcaatttgtcaaaatctctatgacacgaaagcaccttatcttgtactagcattgtgtgaaatgggtcgagaatatatattgtcattattcattagtcttctgtcttgtgcgtacaaactgagttgatatcggctctatctaatcactaagcaatcataatagatcagtaacgtatctaatgattctgaggataaactagttgctaaattagattattactattatcagttttatgtatatttaccaataaaaagattcactgttttatgtaaaaataatcttacgagaacgagttaacgtttaacccattcgttgaatacatgcgtgcatgtagaacactcaaactaaaaattggttatgtcatatgtgtcttgaccgatgagatatatacgactatatagggggattggactacaatcatttaagttgatttcttttctattatatatagtgacacattacatgtgacgatatgatgtatataataaagatatttatttgtccgcaaacgcatgatatcaaatgtaatatacatatcaataacgcgtttatattaatctctaatacgtacaacatattacaatctctacaaatatcgacatgcttaaaaccaataacgcgttcagtagaacaatttaatgcacgttcaccaaccattttaacatcttatgttatttacactcgcgtagttcataacatttggttattacttattagtatatggaccggccctgccgattcagacctaatgcgacgatgtttgagacatcttaacaatatgactatgctatgatgtttgatcaccacctctattatataatgtagcaagatgatcaattatttgaatacagttttaatttgtttgaggacatacctaaaatgctcatatttttctcattgaaattacctttgagtcggtgttattcataaaaaaagaagaccatttattagctacatcattttcacatgacggctagaaaagtctcattcaagaatctggttgtgaaaagctaataaatatattaggcctatcgagccaaaagttgttacacatgatttcaaacatcaaataagtcatcggagtcaatattaaaaagttctacgtacattaaattcataagttttggcagttagagacatgtcaagttgacaagtttcatcagaacatgatcttttagtcttagagataattatgtaattaatatggcaatagagctagctggcaatagatcttaattatctaattaaagatgaatcacagtcaaaatcgttagagctggcaatagaaacgtaaaaatgaacctagacgacagtgcaatatctaaccatgcatggacttttaatttacaaaaatagaatatagaatcaaaacgcaacgatttaggaatctatttatagaaataaagaatctgtaataactgcgatggatatccaaatttttttatttttgttcttctcgtcctataaatatgccatcttcttggagtatttctttacaacattctctaagcttgtaatcgcgatttaaggcttgtccaccacattaccacgagtagaattgaccaagtaagtttccaacaaaacttaaaaccttttctttgttttacgacaaattcttgttattgtggtccataggttgtttctcactttcttgcaagtgatttttcatgatttttaagatttacgattcattaaattactttactaaaactcagatcgaattgagttcttccatctggactatcttatataattagttaggactttctaatccatttttaattcaattttgttgtattttaaaagtcggtctacaaaatattgtttaaacttaatagcatgatacagtacttcaatatggtgatgaattggcaacgaaaaatttaagttgaatatggaatacgcagataattgaacaagaaagccactaaacctaaatgctggttttagtaagtagatagataacctttttattctacttgttagtttatttttaacgaaatctgaattgttgaaatatagctgaaccaatgacccaattcagtcttcaaatatcactagcaaacgtaattgacatgaccatggcatgtttcaagcatattagatttcgatacgtcttaacttcttaattatcgggaccagctacatacatttttagtatatgtcatcattatctttacttcttttttgtatcatcacaattatttccattttatttttttgttcttcttcatgtgcaaaagaagaggtactttgataagattccagtctataggattcaattaagatactaattaaatacagtatatacagaatcttgagttgtccgctttcaagattccaatacagtttacaaaattctgaattagttattcttgttgagtcaatacttttgaaagaatgttgaccaaaaaaaaaaaaaccaaagaaaacggatccttatttaacggtctccttaaccttaataatagtaaaacggtaaaaaccaaaattcatgtggtgtaaattgtctaaagtctgtatttttttttattgacatccattttttttgtgtcgaaagtctatatatgaagtcaaattcatgaacaaatgcttctaggctaaaaacgttatcgtaatctttaatcttcaggcttcttttctaaaattccgactggttaccgagggctagaaaatccggtcaccgtcgccggagacaacctcggtttctaaacgaaaccatcgtgaaggacggaaaaaaggagcttgaagacaaaacaatg

SEQ ID NO: 24180 - DNA, 3000 bp, Unknown; identical to SEQ ID NO: 2746
  misc_feature (1)..( 3000): 2750-1469P.txt file - cDNA_ID_2168478; gDNA_ID_1620586; Annot_ID_161297

SEQ ID NO: 24181 - DNA, 3003 bp, Unknown
  misc_feature (1)..( 3003): 2750-1469P.txt file - cDNA_ID_2168501; gDNA_ID_1620586; Annot_ID_161304
cttatgaaagcaggacgagacgagatgagatgagaacgggacttcccaaaaaaacactaaactctaaatatcttcaaatataatgaacttccggtgataactcaacaaaaaccggtgacaactcgacgaaaactagaaaaagatttatcaaaaatttgacgaaacttatgatagttatatttcaatttctaactgcaatacactattcacttgctttattcgacggtttgagatatggtggttgtaatttatgtttgatttgtagcgtgcataccgatatacaaatgttaataatgttctatacatgtttacatatatacaaaatatacatgtttacacatatatatatatatatatatatatatatgttaataacgttctatatatgtgtttacatgcatacaaatattaataacgatatatgtgtttacatgtatacaaatattaataacattatctatatgtgtatttagatccaataatttaacactataattatttttagtgcttcatatatgtgtttacatgtgtacaaatgttaaaatcgtataatatatgccggaagtgttttaaaatttctcaaatttgagaaaacaataattaatgttaagtctcgccgttactagtcaactcgttctttctcactgcatgtacgccattcatctgtcgaacattaaatgcccgtcaacacgtttcttctctcaccaaagaaatcacatgaacatatttcacgggcaagatagaagcaaaatcttgttttatacacgtttcttttttcaccaaagaagtcacatgaacatatttcacgcgtaagacagaagcaaaagcttgttttatagtaactattttgaaacccaagtctgtatgtaacgtttatttttctttctttttcgacaaatctcctattgtcttttacctgaatacatatcctaattttgtttctaagcaaaacgttccaaaaaataactaaaactcttcgaatctaataaaagctaagtaacccaacaaaaccaaaagaacaattaaataaacaattaggctaaagaataccgctaaagaataccattgcttcattgcacgctcaaatttttaatgtaaactaacgatttttctatgaaatgatgacttcaattatatttttagaattttcaaaaacaaatgtatgtgatcgtgaaaacgattataatatatgtaaagttgcaaatatgggttatattgcgtattattttatacttcataggataattttgcattttttgaatgtggagagtaaaattgcaaaaataggcaactttaaaggtttttatttttttgcacaaaatcatattttcaaatttattaatttctggtgacaactcaacaaaaactaatcacaactcgacaaaattagtaaaaatccatcgaaaatttgacgaaccttatgataatgatatttcaatttctcactgcaatgcattgttcactagctctattcgacggtttgagatatagtggttgtaatttatgtttgatttgtagcatgcatacaaatatacaaatgttgataacgttctatatacatgtttacataataaagtgctatatacatgtttacattacatatatacaaatgctaataacgctcaatatatttacatatattatatatatccaaatgtaataactttctacatatctgtttatatacatacaaatgttaataaccctctatgtgtagttacatgtatacaaatcttaataatgttatctatatgtgtatatacatatatatatatatagtttaatgctttttatatgtgtttatatgtgtacaaatgttaaaatcgtgtagtatatgtcggaagtgtgttaaaaatttctcaaatttgagaaaacaataattaatgttaagtttcaccgttactaagtcaactcaatctttcttgctgtatgagcatcattcatttgtcgagcattaaatgcccgtcaacacgtttcttctctcacccatgaaatcacgtgaacatatttcacgcgcaagacagaagaaaaacttgttttatagtaactatttcgaaaccccaatctgtatgtaacgtctgtttttcttttttcttcgacaaatctcctattgtcttttacctgaatacatattgtaattttgtctcgaagcaaaacgttctaaaaaataactgaaacttttcaaatctaataaaagctaagtaacccaacaaaccaagtgaacaatcaaataatcaattaggctaaagagtactattgctttattgcaccctcaaaaattattaggatgatgagaatgtaatatatcctatatatgctaaatcaccaagtgcatgtttaagtttattaaacataatctactaatataaacttctattaagaataaaatatttagttgatcaaataataagtatctccatacaaattccagctgtaaaaaataaaattaggaaaacgaaatactaaaataataaagtttggagatatatagaagaaaaagaaaacagagcgccattatcggtgaaagctgtggttgttccttgaaatccgattctgattccttccttttggatccgattctatctccaccttcaagcacaatattcgactcggtactctctctttcttcttcttattgcaaaaagattctctttttatctgttttgtggatatagagattctggataaaaacaatcatcttttttctctcaaaaatctctgcttaagaactgggattcttcaaaagctcttctcttgtctgatttcttctgaatttcccctctaagtctctccaattcttctccattagctataaagtcgattcctttatcaccgttctgaagaatttggtcgaaagttttggcctttagtacccaattttcaatcctggcgataactgaattgaaaagggttccaaaagttacatcacctgaaaacaacagtgcttttgattgtgttggtggtttggagtgcttgataagtttaatcagggcccttgatatg

SEQ ID NO: 24182 - DNA, 3000 bp, Unknown; identical to SEQ ID NO: 2749
  misc_feature (1)..( 3000): 2750-1469P.txt file - cDNA_ID_2168505; gDNA_ID_1620586; Annot_ID_161305

SEQ ID NO: 24183 - DNA, 3000 bp, Unknown; identical to SEQ ID NO: 5753
  misc_feature (1)..( 3000): 2750-1469P.txt file - cDNA_ID_2168553; gDNA_ID_1620814; Annot_ID_169170

SEQ ID NO: 24184 - DNA, 3000 bp, Unknown; identical to SEQ ID NO: 5748
  misc_feature (1)..( 3000): 2750-1469P.txt file - cDNA_ID_2168563; gDNA_ID_1620814; Annot_ID_169173

SEQ ID NO: 24185 - DNA, 3003 bp, Unknown; identical to SEQ ID NO: 20829
  misc_feature (1)..( 3003): 2750-1469P.txt file - cDNA_ID_2168576; gDNA_ID_1620814; Annot_ID_169181

SEQ ID NO: 24186 - DNA, 3000 bp, Unknown; identical to SEQ ID NO: 7261
  misc_feature (1)..( 3000): 2750-1469P.txt file - cDNA_ID_2168742; gDNA_ID_1621135; Annot_ID_172642

SEQ ID NO: 24187 - DNA, 3003 bp, Unknown; identical to SEQ ID NO: 18377
  misc_feature (1)..( 3003): 2750-1469P.txt file - cDNA_ID_2168750; gDNA_ID_1621135; Annot_ID_172647

SEQ ID NO: 24188 - DNA, 3000 bp, Unknown; identical to SEQ ID NO: 7320
  misc_feature (1)..( 3000): 2750-1469P.txt file - cDNA_ID_2168803; gDNA_ID_1621140; Annot_ID_172796

SEQ ID NO: 24189 - DNA, 3003 bp, Unknown; identical to SEQ ID NO: 18415
  misc_feature (1)..( 3003): 2750-1469P.txt file - cDNA_ID_2168826; gDNA_ID_1621140; Annot_ID_172801

SEQ ID NO: 24190 - DNA, 3000 bp, Unknown; identical to SEQ ID NO: 7334
  misc_feature (1)..( 3000): 2750-1469P.txt file - cDNA_ID_2168836; gDNA_ID_1621140; Annot_ID_172806

SEQ ID NO: 24191 - DNA, 3000 bp, Unknown; identical to SEQ ID NO: 3316
  misc_feature (1)..( 3000): 2750-1469P.txt file - cDNA_ID_2169101; gDNA_ID_1620639; Annot_ID_162983

SEQ ID NO: 24192 - DNA, 3000 bp, Unknown; identical to SEQ ID NO: 9439
  misc_feature (1)..( 3000): 2750-1469P.txt file - cDNA_ID_2169255; gDNA_ID_1972120; Annot_ID_178946

SEQ ID NO: 24193 - DNA, 3003 bp, Unknown; identical to SEQ ID NO: 17490
  misc_feature (1)..( 3003): 2750-1469P.txt file - cDNA_ID_2169255; gDNA_ID_1621165; Annot_ID_173825

SEQ ID NO: 24194 - DNA, 3000 bp, Unknown; identical to SEQ ID NO: 9440
  misc_feature (1)..( 3000): 2750-1469P.txt file - cDNA_ID_2169259; gDNA_ID_1972120; Annot_ID_178944

SEQ ID NO: 24195 - DNA, 3003 bp, Unknown
  misc_feature (1)..( 3003): 2750-1469P.txt file - cDNA_ID_2169259; gDNA_ID_1621165; Annot_ID_173826
ctggagatgccattgagaaactctatggaactgcacaggacattgaaggtgtgatcagagacgggaagctctatgtcgtccagacacgaccacaagtgtgatcaaattctctgaccacttcttaatgtgtacgttacgttttctgtccagtaaactccttatttgctctataagcaaagagtataatacagcataagcatatagtggattacaaaatgtgtagtacaaagacatttggcattaccattaagatataaataaaaaaactgtttattggagttggaagtttctccagcttttgcttcttgaagttgagtgcaactgaaaactgcttgtcgtttcactggtcgagcgatatgactacttagtgtttggcttttgtgaattagtgactcaactgtattcccaattcaaattagggtctaaattgtaataaaatatagataatgtttccttttttcctgaataattttcttttaagctttgacacacgaccgcaattgaaggcgattctttttttgtttctagattaagttagctgccaaatgatacatgccatgccgcttcatccacctctttctttgatcttttctacatttcttcacaattttttagtttgtactaatttaatatttgtattggaatctcgcgaatggccttctctaaagccaaccaccaccacatcagtagttcagttaatagatatgcatatctacggacatttaaagctcacaaaatcaaatgtgtgtatgtttgtagatatcacaatgattcataaaaattacacaaccagtttgaccatatgatccaacaatgcaataatgcaaaatcacacaaccagcttgacctcaccatatgattcacaaccgatctcgtattcatagtatggcgtatatatgcatgcacaataaaaaattatcatatacgtgaaaaattgtgctatccacgataaatatatcgcaatgagtttgttttgacatttacgcaaaagtaaactaggattagaatgtataatcgattttggtgctcaatgcttaactaacaagtttaaggttgtttaattttttcttctctcttaagaatccactaatggtggaaatgtggaaggaagaatatggatttttttataatatgattaggatcttgaacctcacaagttatgcaacatatattatagatgctgaatctcaatttttgaaggtttacattgcatattatttacaagccatgacgacaagtatcaaatttatgtttgccacatattaaatttttaacatgcccatgtccaaatggttgtaactatgaagcagaaaacaatatacataccaataccatttgtaaatactagcatataactctgtacgtattcaaattacattatttctgttcttatcctgtataggttttaaatattgaaaaatataccatgcataatcaagggataggtaatgataattggtgggaataaattaaggatggcatgcatggatgggtccccaacataagcactcgagcatgcattgctaatactcagcctcgcgtgccaacactcccatgtccctaacacaaactacttagtaaattaaaatgatctaatctattatttacaattaattagtactaaactttgttatactcttccactaccacagttatactcttcacgtagttgttcatttatatgtatatttttcaagtagaagttaaaatcttatgaagatataatgctctcgaaaaaatgttgtaaaagaaaaagaaaaaagagagagagtagctgacagaaggaacatatagggaagagagtaaagagaaaaagcgaacttcaagaatcaacaataagaaaaagtaaattatttgcaaattcctctttttgtctcttaaaagatacaaaaaatgtttttttttttaaacacacagagaatgcaaactaacacaagataaaacaagaagaagaaacacagaattttgactgtcattatcataagaaacatagcaaccacaagactttcctttatatttggctatatacatttattcaaacaaacataatatgtttcaggctttgtattgctaattgggaacatttcccctcccccaactttttttttctcttttgaccaacttagcttatattaatttgatttcacttataactacatgttgcatacaatttttgcatattcttatctgctaataagtaaaactatgtgatagtcaagatagcatcaaacctacgggtccaaactaaggtttcaggtctaatattaggtatgggatccatctacactttttgttttttttactgagatagaatttacttattagcagatttcattttaggataaattccgataccaggtaaaatacaaacacaatttgaaaaggaatgattattgtttttaaagagattattcattaacacatgagacatttagactaaacaattactccacctctgttttagctagccatatctatataataggttctaataggtgatttaaggaggaagtgtgcatactcatattcttaagccatggaccaacaaagaaagagagaaaagcattgtagttagattttgcttagtcactttatgtcagtggtcttttatgattttgtcatttttatttcatttttggttcctctgtattcttggaggttaaaaaaaaaggaaaggcatgaatgatttcatcactatccaagccaagtacttataaaacacatataaacatttagactattactttaagacaccataattccataaaccccttttgaaactttctctcgtctctctctctctctttcttgttagcataaggccccaagaagacataagagtgttttcatgattctttatttgggttttgttatgaaaaaatttagcttctatagctttggaaatggtgagagcttgagaggattataaaaatcaagggtttttgtcttcttttgctcacttgctcattctttaatatcgagaaaacgttttgggctttgatg

SEQ ID NO: 24196 - DNA, 3000 bp, Unknown; identical to SEQ ID NO: 6153
  misc_feature (1)..( 3000): 2750-1469P.txt file - cDNA_ID_2169314; gDNA_ID_1620850; Annot_ID_170314

SEQ ID NO: 24197 - DNA, 3003 bp, Unknown
  misc_feature (1)..( 3003): 2750-1469P.txt file - cDNA_ID_2169438; gDNA_ID_1620654; Annot_ID_163600
tttaacaactcaacccatcaaattaaatgagttatgagttgacccaacccatttaacaaaatgagttgagttaacacataactcatttaactctaaactcatttgattatgagttgggttgagttgggttacccattttgacacctctaaatatgtgtctctagcctctactatttttaaaaactaaattttatataataaatttttttatcttaataataaccaagttgaacatattttagttctaaaattaactactcggtttaatattaaactttagaccaggacatgccggataacatggtcttagtgttgtcgtacgtcaccattagagtttcaatttgcataatacaaggtggttgacccaataaaagaaatttgattcaatttcgatataaacaggtttgttttggttcagttttacctattactttttattttgtccaatcccaaaactattatttcaaagacaaattggagaagaaacaaaaaaaaactaatggttggacaaaagattattatatatcaatttcaccacaaaaaacttagcattaaaatattcgaaatggacagcgacgaattcaaaccttcgtgttaattgtctccggcgactatgaattctaaaatcttccactttgcctaaaatatcaatacatcacattcatcctagccttatccactctttcttggaaattctggtctggtttcccttcagcaattcaattaacttcatcaaaccgaccggttcaaacaatcatctagaaattctattttattgttagactagatcatgaaattttgaccgagtcagcacacataaaatctggtacttgacgtggtttagttaacccaacaaagttgttttggttaaacggatttattgacaaacgtgtttcggttcactcactaaaaaacccggttaggtagatactacttcattgacaacaaacgaagcatcctttaatttcaaaaccgcgttttaatcagacttttccttttttattttcagttctaatgtttaaaactttccttttctttttctccatatttgactcgtcaatataaatacaattgtaacaaacagattttgatcaaaagattttacttttctcaattcctttcaactttcaaaatcgaagatctcttaagccatgaacgatcttctctccggctcgtttaaaacctccgtcgcggacggttcatcgccgccgcactcacacaacatcgagatgtcaaaagcgaaagtctccggcggaagttgccacggtggtaacaacctagacacgttcttcctcgacgtggaggttgtaaacgaagaccttaaagagctagatcgtctctgtcacaacctccgatcgagcaacgaacagagcaagacgcttcataacgctaacgcggtgaaggagctgaagaagaagatggacgctgacgtcactgctgcgcttaagacggcgaggcgcttgaaaggaaacctcgaggctttagatcgggctaatgaagtcaaccgaagtttaccggaaagtggaccgggttcgtcgtcggaccggcaaagaacttcggtggttaacgggttgaggaagaagctgaaggatgagatggaaaaatttagtcgagtgagagaaacgatcacgaatgagtacaaagagacggttgggagaatgtgcttcaccgtcaccggcgaatatcccgacgaagctaccctcgagcgtctcatctccacaggtaataattttttccaattctttcttaacaatttttttggtcaatttcaaaattcaaattctaaacgttaaagagcaagaaaatagcgcaagttgttaaacctttttaagaaattgttagtttataatttggttaaatcatgatattgatataaattggaattatattgtaggtgaaagtgaaacatttttgcagaaagcgattcaagaacaaggtcgtggtaggattttggacactattaacgagatacaggagaggcacgacgcagtgaaagatattgagaagagtttgaatgagttgcaccaagtgtttcttgatatggctgtgttggttgagcatcagggtgcacagcttgatgacattgaaggcaacgtcaaacgagctaactcgcttgttcggtctggtgcggaccggcttgttaaggcacggttttatcagaagaacacacggaagtggacttgctttgccattttgctattgctcattattgtggttttaattgtggtgtttactgttaagccttgggagagtaatggtgggggaggtggaggtgcacctcgtcaagctactccggttcaagctcagccaccgccacctccggctgtgaatcggcggctactacgctaaataattttttttttgaggttccctctgtctatgcatgagcatatctatgttttgaagattgttttttattttacagtattttgtctttaatgtttttgtaatgttttggttggttaaactctgtgtatatataatgcgatcaccacatttctttgttttattatggaacgatttgcttattttttacaatcgacttaagttaatttgaccgtctatgatattattattcggagagatctatcaaaatcgatggtcaaaatgaatttccagagaatatggaaattaaaaaaattgaaatatatatcaaatattatcatacttaagtatagattatttacagttatctctatagtattatttacatttatatttattttaaattatgaaacttagattaatttgttctctatataaataatttagacaattattcttatgggagtctttttttttttttcactgaaatgttgcctttcattgataccaaattcttatgggagtctaacagtaattattcataaatacttttatcttcgtactcccataatttatcgaaccatattgggccgtgggaaaagccgattagtcatacaaagcgtaagaaaaaaaaaagtttcattgtgttgtgccattgtttcactttctctcgcaatg

SEQ ID NO: 24198 - DNA, 3000 bp, Unknown; identical to SEQ ID NO: 7365
  misc_feature (1)..( 3000): 2750-1469P.txt file - cDNA_ID_2169559; gDNA_ID_1621142; Annot_ID_172868

SEQ ID NO: 24199 - DNA, 3000 bp, Unknown; identical to SEQ ID NO: 7366
  misc_feature (1)..( 3000): 2750-1469P.txt file - cDNA_ID_2169563; gDNA_ID_1621142; Annot_ID_172869

SEQ ID NO: 24200 - DNA, 3003 bp, Unknown
  misc_feature (1)..( 3003): 2750-1469P.txt file - cDNA_ID_2169576; gDNA_ID_1621142; Annot_ID_172877
aacaaccagtgcaacttgatcattattgaaacagatttattatagcgttttacagcatctattgattgtaattttgtacttatcttacaataagatatatataaatatatttttttcctcacaataagattcaatctaagaatatgaatttattgacgaagatgtaaaataaatgaaactggctttttttatgaagatgtatatcaagaaatgataataattcatagaagaaaaaatgataattataaagaagtagaccctaaaataaatagttaaccccaaagtggttgagtgggggatcacatgcagcaaattaacggcggtggggaagaaggtctgagaaattaaccaagagatggctcatcctcagccattcacttagccatcgagagatctcaaacccattaatcatttaacttactgaacatatctaataaatgtgtgtttatatatgtaatgagttagacgccaaaaataaattatagactagagacatgtcctgctagctggatcctagtcatcacggtctcacgagcagtattgcatccaattttcgatcacaatatttacaaaaaattcccaccactctaaagttgtagtttattctctatatatagagtaacataaattgattggacatgcaaatcaagtcaaacataaaagtaaacaaaaccctatctcttcctatatatggccgactcgactcggccgcttctctcagatttcaactcgtccgagtcaaatcttccgccaccaagatcccttgaggagacgatagagcgatgcattggagacttcgggtgggcacagtttctccaagccgctttagtctcattcgcttggttcttcgacgctcaacaaacattcatcaccgtcttcaccgactcacaacccatgtggcactgtgacaactcggaccgagtcgactcagtatgcaacacatcctcctccaacctctgcaccttacccaaccaaacctggtcttgggacttgaacccacacgtttcaatcatttccgagtgggggctacaatgcgccggctcgttcctcaagggatttcctgcaagctcattcttcctcggctgtctaatcggcggcttagctctctctacactcgccgactcatcgctcggtcgtaagaacatgctcttgttgtcgtgtctcataatgtctctctcttccatgttaacagctttctcaacgagcatttgggtttatgcgtttttgagattcttgaacgggtgtggccgagccacgatcgggacttgcgcgcttgttctatcaacggagttagtcggtaaaaaatggcgaggacaagttggagcgatgggtttcttttgcttcacgctagggtttttatcgcttccgatgttaggttacattaatgaagggaattcttggaggaatctgtatgtttggacatcgataccgactttaatctattgctgtttagttcggagtttcgtccgggaatctcctagatggcttatcgtaaagggtcgtaaagaagaagccgtctcaattctccaaagcattgcttctaatgcaatcactatgagcttcacaaacttatgttttgaagtagaaaatgatcaatccaagtcaaatcctgatgtttatgatgcgttaaagatcttggtgaggaaaagttggtcgtttagaagattattagcggcaatggtggttggattcggtatcggtatggtttattatggaatgccattagctttaacgaatctaaacttcaatctttacttaggggttgtgttcaacgccttgtctgagttcccagcttttctgataacgtttttcttcattgataaaatcaataggagagatgcgttgatcggatttacagctctaagtggaatctctagcgctctaatcgcggtgttaggacaacaactagggtcattacagattgtgttagagctcgtttcgtttttcagcgcatgcaccgcatttaacatgacgcttatttacacaattgaaatgtttccgacatgtgtgaggaactcggcgatttcgatggtgaggcaagcattggtgtttggcggcgtgtttagtccagtgatggttgctgctggtcgggaaaatcagttttggtcgtatgggttgtttggtttgatcataggattgtgtggattgtttgtgtttggattgccggagactagaggaagtgttttatgcgacactatggacgaggaggagtataagactttggcaaaaagacaatttattggttgatacttgatactgttgtcttttgttgtaatggttaaaaagtttgcaggcttaaaccagttcggtattgattcaaatcaattctgattttaatacttataaaccacgggttaactccttacattataagtgactgtctcatctgtaccggaccataaaccaaattcaaccaaccataatccccctttcaattttgatctattcaacaatgactcatgcatactttatttcccttatctcatttccatattcgaaatgtaagctctaaaatggtactcttaactgaaactaaaatatatataaaaaaaaaaaaatctacatttcttgaagaaacatttttaaaattaactatagttgctaaattactattttagattgacatatatatatatgtagaccaactaattaacccactgaaatgcaaagagatggtctgaaaatcaaaacagacatctaaacgtggttacctacccaagagctcaccagcctatagtatcccattccctttatattgaatcactttagattatcttttctctttcatctttccaattccactctatattaaagaaatattattttaagaataaacaggatcgtattttcatcatatgccaatatgttatttggatttaagattgttttcgaatctataaatactaattaacacaacaaacaatttccaaatatcgtagtgttcataacgaaacgagcacacaactcactaaacactcaaacaaaaatacaaacattaagatg

SEQ ID NO: 24201 - DNA, 3003 bp, Unknown; identical to SEQ ID NO: 18453
  misc_feature (1)..( 3003): 2750-1469P.txt file - cDNA_ID_2169600; gDNA_ID_1621142; Annot_ID_172893

SEQ ID NO: 24202 - DNA, 3003 bp, Unknown; identical to SEQ ID NO: 19877
  misc_feature (1)..( 3003): 2750-1469P.txt file - cDNA_ID_2170081; gDNA_ID_1620692; Annot_ID_164838

SEQ ID NO: 24203 - DNA, 3003 bp, Unknown; identical to SEQ ID NO: 19877
  misc_feature (1)..( 3003): 2750-1469P.txt file - cDNA_ID_2170081; gDNA_ID_2926202; Annot_ID_201934

SEQ ID NO: 24204 - DNA, 3003 bp, Unknown
  misc_feature (1)..( 3003): 2750-1469P.txt file - cDNA_ID_2170085; gDNA_ID_1620692; Annot_ID_164839
atgctacttaaggttggccttgtcttctttttttacaaatcttaagtggctggctttcatgtctttcaaaattttgcaactctgaataaactcttaagggtattgtttggtaaatttggaagaagatataataatctctgctctttttcaatggctgtgacgtttgccctaaatttttaataattgattatgctttgtagttaaagatggctctgttacagcagcagcagcaaaatcaacagcagggtggtgggaatccaccacagccacagccgcagccacaaccacttaatcagcttgcccttacaaatccgcaaccacagagttcaaatcacagtattcatcaacaagagaaattgggaggtggtggtagtattacgatggatggtagcatttcaaattcttttcgaggaaacgaacaggtctgtttataaattcctgtttcttttcctagttcatgtttcaatgatctgttgcatacgtttttagtttctggtgagtctgaggttggttcctaaacttgttttgcattttactgaaggtattgaagaatcagagtgggaggaaaagaaagcaaccggtttcgtcttctggaccagctaatagttcaggaacagctaacactgcgggaccatcaccaagctcagcaccttctacaccttcaactcatactcctggagatgtgatctctatgcctaatctgccgcacagtggtggttcctccaaatcaatgatgatgtttggcactgaaggaactgggactcttacatctccatcaaatcagttggtgggtttccttaaactgttgatgggaatgaataatggtttctgtaatcaatatgaattagtagcgttaattattggctattttgcaggctgatatggatcgatttgtggaagatggatcacttgacgacaatgttgagtcttttttatcccaggaggatggtgatcaacgggacgctgttacacggtgtatggatgttagtaaaggtgtgtgttttagtctcacttaacattattcgacaataacacggtgaacttttcttcagtaatccaacagtatttctcaatcactacaatgatggctctgcactaggttttacgtttactgaagtgaattcagtacgtgcgagcacaaccaaagttacctgttgccacttctcatcggatggaaaaatgcttgctagtgctggacatgacaaaaaggtaagccagaaatcatcattaggtgttctagcgttctgaaacttagagagcctcttggtttggttcattttgcaggctgtactatggtacacagacactatgaagccaaagacgaccctagaggagcacacagctatgataacagatatccgttttagtcctagccagcttcgccttgcgacttcttcgtttgacaagactgtcagggtttgggatgctgataatgtaaagtgaaagttgatccatacactatgttgttttatctctgcatgaatataattttttccgacattgtgattgcttaagagtttgtgaatctactttgcagaaaggttattcccttcgtactttcatgggacattcttctatggttacatcacttgacttccatcccatcaaggatgatcttatatgttcctgtgacaatgataacgaaataaggtactggagtatcaacaatggaagttgcacaagagtgtacaaggtagatttttttctcttgaaagccaatagttcaacattatttacgtgcttaatttagcaattagatacatataatttcacttttgtctttccacagggtggttccacccagataaggttccaaccacgtgttggaaagtatcttgcggcttcatcagcaaatcttgtcaatgtactagatgtagaaacacaagctattcgacactctttacaggtttagtgttcaaacttttcaaacacgatgtttctgatagatacttattttgtaatatgtaccagcaaaagagagcaactaaaaaaatagcaaaagagagcaactaaaaaaacggttgactaattcgtttgtgtaggggcatgctaatccgataaactcggtttgctgggatccctctggtgacttcctggcatctgttagtgaagatatggtaaaagtatggacgctggggacaggtagtgaaggagaatgtgttcatgagctaagctgcaacgggaacaaattccagtcatgtgttttccatccggcttacccctcgctgctcgtaattggttgctaccaggtaaagttgaaatcattacaatatctgtttaaaaaagtttgtgaagaaagtaatgcaaaaatcccaaatttactcctaaacttgtgtgtgtatgcatgcagtctttagaactatggaacatgtcagagaacaagacgatgacattaccagctcacgaagggctaattacatctttggctgtttcaactgcaactggattggttgcatcagctagtcatgataagctagtgaaactgtggaagtgaaaactatgagagaggaaaagagacgtttgttgtttaggtattattagtaatcatggttttttttttaacttgtagtgttctctctcggccattatctcgatctcaagatagttttccagatgttgaacaaatgttgttgtatgatctgacgaaattgggatcttgagaaattgtgaacaactcttgttgtaatctttactagtccttttggctcagctttaatttactggcactcttcttcacttagtttgggttggtttggtattttatgtttgaacgtttcaataactctttagcttttcgaaacgcttgaaaattgaaatgtgagagccaatccaataatacagttgcatcttatttcaaaactacaaaagtataaaactaaacgcaaacgtgatagttgaaaacgcaaacgtgaaagttgtaaacgcaaacgtgatcctaaacgcaatgtcgaagtgaaagtcgtgatggctccgtcgtatctgaaatcgtggtaattggtgatg

SEQ ID NO: 24205 - DNA, 3003 bp, Unknown; identical to SEQ ID NO: 24204
  misc_feature (1)..( 3003): 2750-1469P.txt file - cDNA_ID_2170085; gDNA_ID_2926202; Annot_ID_201935

SEQ ID NO: 24206 - DNA, 3000 bp, Unknown
  misc_feature (1)..( 3000): 2750-1469P.txt file - cDNA_ID_2170099; gDNA_ID_1620851; Annot_ID_170329
agaaatgggagggactgattgagaacgcaggctcggttttcataggaccatggactccagagagtgttggggattatgcgagcgggacaaaccacgttcttccaacatatggatatgcaagaatgtacagtggcgtctctctcgactctttcctaaagttcatgactgtacaatctttgacagaggaaggtctgagaaacctcggcccttatgtagcaactatggctgaaatcgaaggtttagatgcacacaagagagccgttactctcagactcaaggatatcgaagccaaacagcttgcataatccaattgagatttatattcagacaaaagaggcaaaaattctttttgtattgtatgaacatatttggtttcctgagatggaataacaataaaataagagatgttggaaaactcttaccataatcttgtttttcattctttaaatctaaatccttccgtatgtttgaaccaaagagtaagttaattgtgctaactttcccgaaacacaatgggattccaaatatatcttgttctttacaaatgacagcgacttcaaagattatacagaaaacttcagagagcaccaaagaaaaaacacgtaaaagaatgataaaatcgtattgctgatcagtttcttctagctcaagccggcaaaggttcttcgagaactgcaacacgaaagtaacagaccaaataaaacatgtcttgagtttagttcttgcaattctaacaaggaaaagaagaagaagacgaaaggaaaaaccttttgtttttgtggcggactcagctggtgtgatttccgcattggaagcgacaggagtttttgttggcacatccggaagatccagcttctcagattcttcagactcctttgtaggcacttcaggcatctcatcaacaataagctttaagcaaaacacacatcaacattagtctctttatctagtaaagataataatacacaaatttattttgtaaacccatacctgactttctaggttgtcaaattctgctaatatatcttcctcatcctctgctgatagtttctctcccaatatagcgttcagctcctgacattcggaaatgtaaatagagtcatcaaacacaaaagctcgacaaaaaagattatagaggttttcacactagacgagctcagaacaaaatgtgccacacaaaagcagtgatcaaataagaagatatttacattctgacaaagcggataacgtaataatgaatcataaacaaatgatacgaaacccgaaagtattttgactcacatcttgataagctttagcatcagcagtatcatccattagtttttgaacatcatcaaggtccaattcgctttgaatggccttaatagcactattaccctgctttaagctctcaaacactgccttttgtttgctcgtaagttcaatatctgttaactgcgagttcacatgaaagtttgagaaagccataattatgcatcaaaagagacgatgccggatacaaaacatacacacaaggagaaggatttacttgttgttcaacattgatgacccattgatccacttgcttcaataactcttcttgagttcgtttcttcctcaatgctaacaaagctctgtcctttcgcttttcacggattaagtctcttgcagcttgcttttccgcttcaattactttctcaagctaaattagcaaaaaaaatgagaagatcggttaacaaagagatgagccaaagaactcaaaagcttgagtctttcttttccatcacactactaacaatcataagacacatattgtgaaacgaatcaaatccaatctccaattaggattttggatgaatcaaaactatatgatctgggttccaaaagaaattgtaacaaaagaaaattaagatataagaagagagaataaaaaaccttctgctgatattgaccaagcttgcgtctttgggttttgagagagagaatcgctcgatcaacctccgtgatctgtggtttcttcacgaacaaattccccatcttttcttcacttatcgaaaccaacgattcggaaaatcaaacgagcagaagaaaatttagcaagatttgatcttttgacgaaattgattattagtctctagatttcccaaaaatgtcgccaatttcaaaccaaagtccaatttttgtgtttcttctctctttctgcttttcagtacaaatatctcaaaatagaggaaaagcatgaaccggaccgaaaaaatgtaaaaatcgatatcgaaccgattttagtcggtttgatttcatccacactgaaaaataaaaaaatcgaaaccaaacaaaaattccttggatagtaccgtaaacaaaatcaagctgaaatcgataagtaaccgaatagaccaatgtataattcggtctcccaattttgttcaagtttatatcaaaaccagaacaaaccggttggccacctttaacaaaatctcgaactcgcgttttcgatagcgcgtgattgcaaaacgctattgcagcgtcacgacaaaaaaggtttgttcgtttattaaaccggccggtttggaatcatgaatttgatttgaatccttttagctggttaaccgacgtcgtttgagtaaatggatccaaagccagacagatcctaaatctcgtcgacgacggtgtcgggactgaaagcagagagaaagcaaagtaagctagcttagctaggtccaagatccaagctttggaattttgtaaattgtctccactcttagccggtgagtctcactctgttccgaattattctttgtgatatggatttcgatttcccatgattcgattttgtactttttgctcttctcttgagtttaaagatgtacgaatgaatatatacagattcgattttatgttctggtggctttgatcgctgaaatttgaaaactttgtctatgtttcgattgcttgatactcttgtttcacatgttcatactctggaattgattatagattagtgtttttacagttttaatg

SEQ ID NO: 24207 - DNA, 3000 bp, Unknown; identical to SEQ ID NO: 4372
  misc_feature (1)..( 3000): 2750-1469P.txt file - cDNA_ID_2170256; gDNA_ID_1620702; Annot_ID_165106

SEQ ID NO: 24208 - DNA, 3003 bp, Unknown
  misc_feature (1)..( 3003): 2750-1469P.txt file - cDNA_ID_2170308; gDNA_ID_1620724; Annot_ID_165897
ctgaaccggttaatgcgtaaccggtgtttggaataatgatttaggagaaagagtaggaacatttgggctttgtcataagtttaacctggaccaagtttgaatattcttaagagatatgggcctagattaaaaacaatggtaatgtaattaaacatattgctaaatgctaataatgtggatttgtttgtttattaagaaaaaagcagcaagaagaagataaatcatttgggtcaacgacattaataattggaatcccatactcccaaatcataattagacatacacttttgtcttaggctgtcctttacactcatcggcatcaccaaatacttagttggcaactttgatcaattaatgtattaagcatgaatgaaaacaacttttacattgattcgataaattcattatattgtagataagattagtcaaaagtttacaaacattcgttaacaaattacaaaacttgtaatatctgcagcaatgcccatgtgggtagagctggctgacgcaacctaaccgggggataaaagcgtctttttggtaccaaatttaaagtttctttatgagtaaaattcccaaacccaacatcttcttcctgctgaagcagtaagcactcaaccaaaaaaccaattgcgtaaacactttcccttgaatacagagatcacattcgatcaggtaaaaacaaggtctcgatcttctcttcagtcaattttttcaaattattcgaggttcccgtcattcgattccgacttccgagcttctatttctgctcaatgtttttgtattttgttagggtttccagaaaattcgattctgttgtttttaatttgagctaataaaatctagaatgggaaaaagaaagagttcattttcgtcctctttctttttgtagaagctgaactttgtttttcttttacagcgagctgatttctcacaagggatatcaaaatttctggtgaagtgggattgtaaaattcggcgttgaaagatatataaagaggtatgtttgatcctcagtgaggaataaggatttttagtagttatatatctctccaagtgatgatacatacatacttgtggattagatctatgataagaataagcataagatagagactgagagacaagtcatttagggagattaaataatgttcatggaatgctaaagttcatataggagtttgtctcatatcagaatctagattagatcatgctcagatgacatctcttgaatggacaaaaaagtttttaactatgtgattttttcgacttcttttggggaatcaatgtactacaagctgagagttttagagtagtttcatctctggctaagctttgattcattttctagtggaaggttctggagtcgtttcaattcatggatgatggtactcctaagaagctaaacatattacctgatcactttagtgctcctagtcccacagcagaatcttctcagcacgatactccatcatcttcgcagccaaaggacgatagttctctgaggtaaattgttagcgaataaatatgctaagaagggaaattctgagctgaaatgaattgttttttcgggtggttttgtttagagtaggccttatagccagtcacggactcgcagaaacctgaaaagagcagcaactatgttgaatttgttcactcttcgccgtctgccttgggtttcagatggtcaagagaaggttccattctctcacacctttcttctttgtttttgattcacctcattgaagtttcagggttttctcctgaatcctgatcactctctcattggcaggtcgagctatcagcagcggagttagaatcacttagatcagaactttctgatatggaagaaagagaagcttacctcaaagcccagtaagtcatatactcaaatttgttccattctcagattaaaagcgcatatctcaatttcttcttgctgaactgctacataggttggaacatgtggatgaagtcttgcgctctgcccgtttatctggttatttgtttatcagaagtgtagggccttactctgaattacttatcattattgatccactaggatgttttacaaatttgccttatttttttgtttgactttagcgttgggcagctcttccgggtgaaccaccaccaatagatgatacagaagtagacgactggcttcctcggtttgtcgtccttcaaggcccttgtcttttcttctatttattgtcaacaggtgagttaaggttcagcttttacaatcctgtttcaaatttgtattcttcttgtaatgtctcttgaaattctctattgcagacttgagccctcaagattcgacattgctagcagatattgttgaaattggttcggtaccaagctacacgagagaattcgatgaaacccattattgcttttacatattaacccgtcaaggtctaagatttgagtgctcaagcacctctaaaacacaggtgaaccaaatacatatacatctttacacacagattgttgttgagagatcccacagcatttgaacgcaatgatttcgcggttttgtatggttttaggttgattcgtggttgtcggttttgcgccttgattgcaagtctgaaccagaagaaaggttatcaaatggatcagtcgaagctccagaataaattgaagagcggtcactgctctggatagttttcatttatatgtatataatgcttctttttagatgtagtagaattcacgtcaatgaaaggttcttttactgaactggtggttacaatatttttggtttacttcttttagctgctaaagacattggaatatattcgtttcttgaataggcaataattctagttggaaaacaaaagtgattagaaaggcaataaatcctgagcctttaagtccttgtctgatccgacccgatcaaaacatgttggtataaaatcttccaataggttcacatttttgaggtccctgtttgcacatcactcttctcagtcctcacgcatcgtatcagagaaaatg

SEQ ID NO: 24209 - DNA, 3003 bp, Unknown; identical to SEQ ID NO: 24208
  misc_feature (1)..( 3003): 2750-1469P.txt file - cDNA_ID_2170308; gDNA_ID_2926184; Annot_ID_200484

SEQ ID NO: 24210 - DNA, 3003 bp, Unknown; identical to SEQ ID NO: 20236
  misc_feature (1)..( 3003): 2750-1469P.txt file - cDNA_ID_2170372; gDNA_ID_1971690; Annot_ID_175079

SEQ ID NO: 24211 - DNA, 3003 bp, Unknown; identical to SEQ ID NO: 20236
  misc_feature (1)..( 3003): 2750-1469P.txt file - cDNA_ID_2170372; gDNA_ID_1620719; Annot_ID_165748

SEQ ID NO: 24212 - DNA, 3003 bp, Unknown; identical to SEQ ID NO: 20236
  misc_feature (1)..( 3003): 2750-1469P.txt file - cDNA_ID_2170372; gDNA_ID_2926191; Annot_ID_201079

SEQ ID NO: 24213 - DNA, 3000 bp, Unknown; identical to SEQ ID NO: 3816
  misc_feature (1)..( 3000): 2750-1469P.txt file - cDNA_ID_2170393; gDNA_ID_1620695; Annot_ID_164926

SEQ ID NO: 24214 - DNA, 3000 bp, Unknown; identical to SEQ ID NO: 3816
  misc_feature (1)..( 3000): 2750-1469P.txt file - cDNA_ID_2170393; gDNA_ID_1620666; Annot_ID_163934

SEQ ID NO: 24215 - DNA, 3000 bp, Unknown; identical to SEQ ID NO: 3816
  misc_feature (1)..( 3000): 2750-1469P.txt file - cDNA_ID_2170393; gDNA_ID_2926190; Annot_ID_200992

SEQ ID NO: 24216 - DNA, 3000 bp, Unknown; identical to SEQ ID NO: 3816
  misc_feature (1)..( 3000): 2750-1469P.txt file - cDNA_ID_2170393; gDNA_ID_2926191; Annot_ID_201018

SEQ ID NO: 24217 - DNA, 2319 bp, Unknown; identical to SEQ ID NO: 4291
  misc_feature (1)..( 2319): 2750-1469P.txt file - cDNA_ID_2170409; gDNA_ID_1620695; Annot_ID_164931

SEQ ID NO: 24218 - DNA, 3000 bp, Unknown; identical to SEQ ID NO: 3814
  misc_feature (1)..( 3000): 2750-1469P.txt file - cDNA_ID_2170409; gDNA_ID_1620666; Annot_ID_163939

SEQ ID NO: 24219 - DNA, 3000 bp, Unknown; identical to SEQ ID NO: 3814
  misc_feature (1)..( 3000): 2750-1469P.txt file - cDNA_ID_2170409; gDNA_ID_2926191; Annot_ID_201023

SEQ ID NO: 24220 - DNA, 3000 bp, Unknown; identical to SEQ ID NO: 19482
  misc_feature (1)..( 3000): 2750-1469P.txt file - cDNA_ID_2170413; gDNA_ID_1620666; Annot_ID_163942

SEQ ID NO: 24221 - DNA, 3000 bp, Unknown; identical to SEQ ID NO: 19482
  misc_feature (1)..( 3000): 2750-1469P.txt file - cDNA_ID_2170413; gDNA_ID_2926191; Annot_ID_201026

SEQ ID NO: 24222 - DNA, 3003 bp, Unknown; identical to SEQ ID NO: 19480
  misc_feature (1)..( 3003): 2750-1469P.txt file - cDNA_ID_2170418; gDNA_ID_1620666; Annot_ID_163944

SEQ ID NO: 24223 - DNA, 3003 bp, Unknown; identical to SEQ ID NO: 19480
  misc_feature (1)..( 3003): 2750-1469P.txt file - cDNA_ID_2170418; gDNA_ID_2926191; Annot_ID_201028

SEQ ID NO: 24224 - DNA, 3003 bp, Unknown
  misc_feature (1)..( 3003): 2750-1469P.txt file - cDNA_ID_2170845; gDNA_ID_1620587; Annot_ID_161324
tcataagctgtcgaaagtctctgtttaggtaattgggattaagaaagtaatgaaacctggccaaggactattctgtgtttagcttttatgatggttcctgcatattgagctttgagtattgcagcacgaagagctttctcaggaggtaccggcggcagagcaggaaaagccgttttcaactctgtagcaattataaaatggtattaagaaaccaaactatacaaaaaagaggaattctacagattcgattaaactcataagagaggaataataacaacttaccattacccaacagatcactgtttgaaggtttatcaagctgagacttgagactaccatttctctccttctttgaagtgtcagacccttcattgatatagaatttaaaagtaaactgttagaaagaagtgataatagaataacaagtgcgaatgaaactatgaaagatagctttagatttcttaccattagattgaggatctaactcgctcgcttgtgcacctgaaatgttctttaattgacaatcctgtttgacaagagcattgaaacataaatccctattgttagtgacaagactaaaaggaaattaaatttgacagagatcaagaaagaatctgtatataccgttaacgaacaaacgtcacttccaaatgagctacaggacttgaggcatatgcaaattatcctaccacatttacaggttgctaatgctttaggcgtcacagcaggagtattctttttgctctgcactttcactggcttggacgaaagagaacccttttcggagttctctttagctggtttcgtcaatcccaccccagaggaagctgatgttccagtgctgctccgtctagaacaatcacgttcaactggctgtctcttataaccttctctaacttcattccaggataacctcaaaacctttttcttcatgagtgattcccatctaacctcaaaaatctcattaatctcctttgcaatcgtgtgaacctcattccacagaggattataatgcatcgcattggcaaaagttaaccgaacatccgctgcaaactcatcagcattactgtagacattcttcaaaagtttcgatttgacagtgcctaaatccattggcttttgtatgacattgaagtaatcaggaatctccattttaacaggatcaacaggctccttaaagagccatccaccacggtgctccatcaaaaaacgtaacaatgccaaacattgactagaccaatcacaatccagcctctgcttcttcttaggttgaacttcatctagctctttaggcccaccacgcttctttgatttctccgaggattgagataaatcttcagtcactacatgctcaattttcttcgaactatcagacaacgtttggaatgttctgacagaaccttgaggaccaaactttatcttaatattgggtatcgcaaccattcttacaagaacaaataaaaacctgtaagcaaacataaaaagcgactgaaattagggtttatctacgcgacatcacaagactcgaaattagggtttatacgtcaaaacgaacaaatcgacaaaacaatcagatacccaacaaaattccgactaaataccgactaatttcgttacaaatttctaacgatggaagaagatgaagaaggagtgaattagggtttatcaatttcgcgatcgattaacaaaaaaacttgaaaaaggtactttgagaaacgaattcaatgaaatatatagcgaaaagagtattattttacagagataaaagcttaccagaggaagaatcaatggaacagtatgagagattttggagtatcgagtgtgagagtcagagtgaggaggaggaggaagccaaagcggcgatagaagtttcttttttcttattgagggtttgtgtgttaaaaatacttgagataaaacgcgtattttgtggttaaaaacacttatatatttcactattttgaaaatactacttaaaattatctcaaacgatgtcaaaattaaaatatgacaacaaaatctgttgaataaaaagtgatttaataaaaaaaagctttctttaataaattatttcctatttttttttaataatatatacacggatttttttctctttttttctttacaagtagcggtatttctcgtactacttttttaccgttaattttttctcgtatcatattttttatactcactaaatcttaaaactttgcgaacctcatacttgaatttctttttcttctctttttcttataaacctgttttttacgtaccataaaccattgatggtttctaaacatcgacaattttaccttcaaccaatttttttttagatcgttaagatctcttttaatttaccaaaaatgcggattgagaatgaatggtggtcaaaaaaacaactcttttataaaatatcagcaaacaacaactcaatgataggataagcctaagaatactatttataataacatctcgaaaccctaaatttttttaataatatagattatttaattaaaagataattacataagatatttggataatttcgaaatatcatatttttaggttgccaaaataagacctactctttatattagattaggtctaccatcaaattctttttgcaaatagaaacaggaaaattctaacaacttaatattttctttaaaaacttatctcaagccaaaatccaacgatatctatcgatatggtattatcaatcaaaagattaatattgcataaatgttttgataattttgttaacaatagaataagtgtgaaattatgaaattaactggattctaattctatcccttgtaacttgggaagggtgttaagtgttaacacactcggtaaatcactcatggactttgaattttatatttgggcccataatggatcaatcgtaaacccatcaaagaagctcaaaacatctaattttattccatttttggcacctcaaaatatataaacatttatattattgcgaaatttccgatcatg

SEQ ID NO: 24225 - DNA, 3003 bp, Unknown
  misc_feature (1)..( 3003): 2750-1469P.txt file - cDNA_ID_2170848; gDNA_ID_1620587; Annot_ID_161326
agagatataatctctcgtaagattatatgattttggtagtaatctctctttcaagagatcataaaaaaatatcttgtaaacactaaaccaaagagatataatctctagtaagttaatatgattttggtagtaatctctctttcaagagatcataaaaaaagatcttttacaagatacattccgcatcgaacaacattttctatacgtggtttcacgcacaaaggtcgctcactagctggagtaatgtggtttggcaaaattatgtcagtgagcaacttcaccaggagaccatataactgcattaccatttcctcaaagcccctatcccaaaaatagctgtaaattaacacggtggagtaaatatgttgggacaaatattgcatgaaaccaaaaaaattcataatttaccataaaaattcttttaaaaaaaatctgagaccttaattttttcgacaatccaaacacaacagagacagaagtaatgttttagtatgggcatttttgttgttagcaacgctttgtcatgtaaacttttgctacaatgatcttcatggatgtgtgaaacagaggctgatttggtaaacctttttcaggtatcccacgcctcttcaatgagccaaatttatgttttcacacaatggtgagtcttagttttccattcctaatgagtataactctcttatgttcattgatctgatactttttctattatgatgtattgatgttcaaagataatcccacaatgtcttcattaccaaagctgatatttctttggacgtgagaaataaaagatcgccgacatttctactgaacacgcttcttgcagatcttattcagtaccggtaaattctgttgtgtagttctctagagaatagtaattttcttgaccatgcatctaatgagaataaggagtttaggttaatactaatatcattgtgtatatacttgtctcttctattggggaagcaggtgagaccttacattttagatcttggcagcaccaacaaggcctacattagtgagagtgttgaattgcatctcttcttaattgttttgttttcgtggtttagataaaacgtacgttagtagtgacctttgtttttcttttttcagaaaatacatattgaaccacaacgctactatgaactttttgagaaacaggattataattaagataaaagaattaaaaaagtgtgaaggaattaaaattttaatttcaatgaaaataaggggccaagttgaaatatatagaatatacaaaaaagaaattgtacaactattttccttttgtatgaaaataaattagttttttcttttagcaaaaaattagttcatgtatttgcattgcatcaactaaaatagttatattaaaaaaaggatttttgtgtagctgtgatatttggaatagaaaatccagaataataatatcgaaaattgtttgctttatccccctttcttttgtagaaattctcatatgattagtggatgattcggtccaagtactatcatttaaggatctgtgtagtattaaaatctcgaaatctctattcgttattaactttgtcggtgaaggggttgatatataataaaccgaagactttttgtgtgaaaagaatcatgtaataacggtacttattcattttgtacttatactaaaataaataccgattatgttggtggtagacttctaaattttaattagctttttaaaaagacccttaatttttaataaaattgatggaaagaggaatagttactttctatcttcggtaaaattcaggacccaagaaggtcgaggcacgtgccccatgatagacttgtcatgtgatgtgacctattttctttgtccaacaattttttaaaacaaattgtcataggctagaagtcgtcaaaagttaataagcaaaaaacgcaatatttcaaaaataaaaaatttaacaagaatgaatgacacaaacctaatcgtcttgacattttatctcatatatcaataatgctcaatcgagtgtaaatactttttttacatagtaaaaggcgaataagagagcagatcatgtagcaattattttcactattattgttattgtgttgttgactttgatttttagtttttaatagcagggtacaaatttgtaccttcaattatgtcaccaacgagtgtttgagataagattagacaatagtaaacacaaaattgatgtaagctatttaacatgtttattgaactgtaaataattatatctgttttaatatattttttaactattttttttcttaattgatattttattgtattaacactccttcttattaactttgcaaaataaactgtcatcttgtaaattattaccaaatcttaacactattattattgactttagaatctaagatatacctaaataatttcttaaggccaaaaaaaaaattatcatctttttatttaagttaatctaagatataaacattaagagaaagttgcaaaattaaagaaaaaatatctatctttacctggatacaaaacttatacttttggataattcatatgaaagtctctcttctaatgtagtaaaaacttctacatttcacagctaaaaactgaaacccaaatttaaaatttcgtgtatagtaccgaggaaaaaaagtatttgcaagcaaaatctagagcagaaaaatttaaagatcttttgcttcacatgactctattgtttttttcttacctctattttttcaagtctgcagctttttgaagctatatttttcagatctttcactctctctctagctacttctttttgtctttaagttttcaaattttattaaatttttatattctactgcctcctcagcttctctcacaaagcacaaatccaagccccaaatcaaatcccaccattgttttattacctcaatccaagaacactagacacaacaaaaatctctgtttcttatccaaatttctgatctttgtggagaacaatattttgattggatgtgagacaaatg

SEQ ID NO: 24226 - DNA, 3000 bp, Unknown
  misc_feature (1)..( 3000): 2750-1469P.txt file - cDNA_ID_2170877; gDNA_ID_1620815; Annot_ID_169199
tagccttgtcgtttttatcattaacatgattgacaagactatgacctatatatcttattattatcattgctctctctatttgtttatattgattattactttttgagatttttcaatggttttatctctaactaaacattataattagtgaaacaagcttagtagaagtaaaagtattattctatgctaaagtacattgattagtagagtgtgtaattgtgtatacagataatctataaacaattggtgcatctgtatataaaactttatgatttatttattgtatttaataagtatatgaattgggtacctaactttctaaacagttccaaatttattcttaaatcaaattgcatatgatttttaaatattttgagacgattttattataacgcaaacaacagagtaaaagaagcatatgttgcaaattgtactatggcaagttcaaatcgaaacatttttgtgaaaatcaaacatgtgaaccaagcttctacagtttaattccctttcgtataatttaatttcaacaaatttattgatatccatctagaaattggtccaaagttctttcacccttgagtcatttagtgataaagatgacatgatttttggtgataaattttccatcgttgctatatgtcgttatattattctcctatatgtatattatactatttacatcagaaaataatccaaagtttagagattcttttttacaataataaaatttcccacttactaaaaagagctccttttctgctgaagagaacctaaacctttattcccaaagttcattgagttagagcattttcagcgaatcacataagagatgctctcttcttcatcactaattgacatctcattgttttaaaggttgcacttgtacctgttgatctgattctcaatccacttaagttaaaccaaatagacacgagaaaaaagcacatttatttgttgctaagtatgcatatttttcagcgtttacttcttaatctaatgtatatcataagataatatctaaaagagaatgcacaaaagattattaatatgagaaattcgctgccatttaggaaggacctttataccaatataccgcaataataatagaacattggtccccaagtgtatgtcaaccccaagtgtatagatttctttaaagattaaaatccctttttgttgctaaagcacctgatatatttttctatcaaactaaaaaaattgttagcgggatgaagatatattcgccaagaaccatagtgcttgtataacggcagaccattaattcacaactattattattttattgttagattgttgatagaatcgattttgattgtggcagaatcgatcttgtaaaaactgctttaaggtgcttacttataattaagaaagattcacttatgtaagttaagcatattaatcatatcattcggcctaattcattaggaatattttgctattcgttttgccatcattaacaacaaaattgacacgttttcagccaaaagtattaacaactaaacctaaaacttcaaacattaaatagtttttagtatctttagtttcaaactagtgatttgtcctaatatcaacactacgaacgaatttatatacattgaacttttttctgaatcaccgattacaaaacgaatataatttggtatcggcagttgctattaatttgatcggtttggactttggactaatcacgatcaaatcttaaatggaccgaagtgaataaatccctaatgttttcaagagagtcacacgaacgaaacaaaggtaaaatatgaacatagagcgtggggaccttgaagcagaaggtctgtatggtgacagaccggtgagtggagtgtatgaatgaacgagaagtgagaagacaaaatacaagaaagagcgttgacttggaagttaaagccaaaaaaaccacaaggggcaaatttgtctctttaggaaaaggacacagacagactttctatacgggccaattagaaaaataggccctacttctaattaaagcccatttacttctctccttgtcttcttattcctcttttctccccatcacgtgacgacgatgctataaacgccgtcggattatataactggtgccgttgacaagacggcgacagaagaaagaaagaagaaaccacaggctctagggaacgtaacgttatgtcctgtctatagcatttataacggtcagatcaacgccgtttagataaagatctgtcaatgttaaagaagagatgcatctctacaccgttaaatttaaaacgccgtgaacctcttatctattgatttttgtttgatgaagccaaaacaaatcgtgtcagaagacttatcagagaagaagaaaacgacgacgttcccgtttctccatgtctaataagtgtagtagtggcggctactaaaaactctaaagtttgactccagtaaaactgcctttctagtgtaattccagtgattttagagtttgaatagtgtgtgaccaaatttgaaagtacaatctcagcaatattattgatcactcgttataaaagaatcgaatgtaaaaatagccaatgagagactgagacgtatgtgtttgaccataagtcgtatagtttgtatctatctacctgcaagatcagcagatggttctctgatcaattgtaccttaattatcttttattttcgtaaaatttctctattcacaaatgataaatctacttaagacagtaaccataacaagatttacaagataatttgaaaaatgaacacataaaagtattttggcgcattatttttaataataacaatatttatgtaaagtcacataaaagtatatattcgctcacaaagtcttacggtatttagaacagtagtaccacatcgattctcttcatcttcttcttcataatatgccattgttcatgtctctgtgtcctatcgcataacactcacgctatcttattattttctctcgctctttctcactgagaggacactaaaaaaatg

SEQ ID NO: 24227 - DNA, 3003 bp, Unknown
  misc_feature (1)..( 3003): 2750-1469P.txt file - cDNA_ID_2170881; gDNA_ID_1620815; Annot_ID_169200
aattgtttatagattatctgtatacacaattacacactctactaatcaatgtactttagcatagaataatacttttacttctactaagcttgtttcactaattataatgtttagttagagataaaaccattgaaaaatctcaaaaagtaataatcaatataaacaaatagagagagcaatgataataataagatatataggtcatagtcttgtcaatcatgttaatgataaaaacgacaaggctacaaaagtagtagtagaagtagaagaagaagatgatgatagtgaagacaaacttgtgtcataagtggtcttacacaaatccgtcttggaaactggtgtttgcctaatggccctgctgggcttttgcttcagtcattaccgaatcctcttgtattggcagctttaatcccaaatctattcaactcatgcaatgattttggacgaagaaacttctcaatcccaaatgacccttacttcacctttcactttttgttccatcgtaaagatttgaaactttttagatcttatgaaaaggcaccacatcttcatcaagtattttctttaaaatgtaggggaaaaaaaaatctagttcttttgttcatagtcaacctggaccagtaggtcgttgggccttgggtcttcagtcacgtcggcaatcaacattcacttacccatttgaaacattggatcagcgtgaccaatgccaacccattaatctaaatggtttaaacaatcaagcgtgcaaggataaatgcattggacttgagagaacaagatatggaatttgaaatgttgccttaccagttaacaagtgtctctgtttcctcccaagttaatgtaccaaaactctttggtgcttaattgtgggggcttttataatattgggtacattttgggccataaattagagaaagagcacattatgattgagtttatgaagataggcagtttttgggaaataaattgacgaaattgcccctgcgatttcactcattctcctaaattgtttttgcagaatcttttcctgaattgtttttgcagagcctcatattggatcgattcctaacttgtttcaatggatgatgtattaagtacagagattgattatcctatttctctacttaatcaatgtttctttctacaagacaatatatacacaaaagatgtatttacggaaacaaaatcgatagagacaaaaattagaaaatctgttaataacatttcatcaccatccaattcagataaaccccaataaaatcagttaaaagctttttgatggaagaaagctaacccctaagaaaatattatataacgaacccaaatatactaatcttaaataattggaatcgattaaaattttcaattatttcttatccctctttgaaattgaagaaagagaggatgaaattaattcagatcaaacaattcaaattcaaaaaagctatggaggattaccacctgcatcgtcgaggaagaagattggccaggcatagatctgaattttgtaaggtgatggagaagcaatggacatcaatggtgagtttagaggcaatagattccatgccattagagaaagagaaagagagagaaataatcgcacatttctgagatcgattgatattgatgaattctcctcaattagattgaaggtacaaggagaagaaactcaattagattgaaggataaaacagtcatccatataatataaaagtatctaaatttgtaaggaacatgagatgttcctatatctacaaaagcacagactttaatatgctaatcccataattgatcccttaattgtgtgtgtattcaaaataagcccacttcttataggcaatgtaacacttgactcaaaagccaaagcagccacttaaatagttaagttacattaaacagagaagcagccttccctaagttaagcattcttaatctaaccaaatataattcatatctaacaatgttaacttctctttctattcttaataataacctaacaaattaacttgggtggtgtactattctgagtttgttacttgtcttgtccatgcacggctagtgctggtgctgtcttagaagggcttgaaggtacgtggctgttgatacagaaaatgtttaaagaggagacaagtctttgtcaaagtttgcggatgacggctatgaaatcgaaaacgaattttctttcagtttttcttaaaaatttttttttaccttaaaacaataagttaaataaataaaattaaatcggatttatcttctcggtcgtccgaaaatggcagagttgaatccaagaagttttgtgtgggagttgaggtgggaactacgaaattaaatataatctatgcgctattttacaaatttgttagtccaaatccactatgttgctaatatttaattacatgtttagatcctaattagtttgatgattatataatcaataccaaagaaagtgaagaaataacctaatttatcaacttgccagctagtgaagtagctccttggaggtttcagtaaaaaataataaaagtcgataaaaaaatactacccaacttcatggtttattattaaatgcgatgtggtcgagacaaagtaccacttgagtaccgtactaggatatgctcaacatatttaaaattttgaccaagtcaaattaaccagccagagatgttaacagttaatgtagtagccaccggtccaatgaaattgcaaatgaacaaacgtagcacctgaaaactcgccaccgatcacgatcagcacactttttatgaattggtcaagatattatcttctatcattagatgaatacttgcatgttagtattctctactatcagacggtgtgtatttttttatttatagggttgaacgctttattgtcccatgcacacgtaaaagtcgacctccccatcattttttcactataaatagtggttgatttcaagcagatttcttcaaactaaaacatatatacatcgaaaacaactaagtataaacaatagtcatg

SEQ ID NO: 24228 - DNA, 3003 bp, Unknown
  misc_feature (1)..( 3003): 2750-1469P.txt file - cDNA_ID_2170918; gDNA_ID_1620815; Annot_ID_169212
ttttgcttttggtgattcagtcttagatacgggaaacaataattttcttcttactcttctcaaaggaaattattggccatatggtttgagttttgactataaatttccgacgggaagattcggaaatggaagagttttcaccgatatagttggtataatatcccaatgttgactggctttacttaactctacctataaagatctctcactgcacactttctatagatccgagactaataatcttgattaatcatattatttatataactaggtagtattctcatgtggtgaagtcttctattgtatgcagccgaaggtttacagatcaaaagacttgtaccagcttatagcaagattcgtcgcatcagttctgaagaccttaagactggcgtttgttttgcatcaggtggttcaggaattgacgatcttacatcccgaacactggtgaaagaaaaaaaaaacttaattgttatttcgataaacactatatattatatatctcaaacaatgttttcttataataattggatggttgtgggtggttttgtcagagagttttatcggcaggtgaccaagtaaaagactttaaagactatttgaagaaactaagaagagtagtgaaacgtaagaaaaaagtaaaagaaatagtttcaaacgctgtgtttcttatttctgaaggaaataatgatcttggatactttgtcgctcccgctcttcttcgattacagtccacaacaacatacaccagtaaaatggttgtttggaccagaaagtttctaaaagtaagacaacgtataataaaataaaaaactattagtatgaattctttgtaaatgttcacactcgctcttttggttttatatatctatatttgaaggatttatacgatcttggagcgagaaaatttgcggtgatgggagtgatgcctgtgggatgtttgcctatccatcgagcctcattcggtggggtattcggatggtgtaacttcctcttgaatagaattacggaggacttcaacatgaaattgcagaaaggtcttacaagttacgcagtagaatatgatttcaaagatgcaaagtttgtttacgtcgacatatacggtactcttatggatcttgtcaaaaatcctatggcctatggtacgtatatacacactccctatataaatatatgcatgacgtaaccaagtgatagtaatatgtcatttgttttatcttttaaaggattgtgcatcctaacaattaatgttttttttttctttctttgtgatcaaatttatatccgaatcataacactataagatgatcaagatcatgattctaattacaacaatacatatacttgcagggtttacagaagcgaaaaaagcttgttgttgtatgccgaatgcaataataccatgcttccatccagataaatacgtcttctatgactttgctcacccttcccagaaagcctacgaagtaatatctaaacctattgtctatcagatagcgaaaggccttgcctagctaattccttatttcctacaatgttttattataatctttgaaaattatcaccatatcgataaatatatgtaaatgtataagattcatgacaatctattcgtttttcttatagtaaacaatgtataattcaaattacaggcttttaaatattgtccattttatataacccaagaacaaaagtgtttgtttacaaatgtgcatcaaacagataaatccgggaaaggctatatatagcaccaattgcaagcttgtgaattcgattaatagaagttttgattcaagtaacaacgtgagctacgattgttcccagcaaatttattcaaatcaaaccaaataacaaaaaatatttactccgatccttcgggctaaagtgaattaaaaatctccgccctcggaaatatttttttggtatctataggtacacccatattccgattcttcactcgtgagtcgtgagcattatgcagacgtgattatataagatcaattagcatattttgtctcataagacattttacctattcaaaaaacaaaatcatgtaggttaatatttgaaacagacaaaattaaaaaggctgtagataattaaggttaaaatgcattaaggaaaacactaaagataattgtttttcttatatgattaaaacagtagatatgtgttacagaggcaagtataagtaggttttcgggaccagaggaagaagaaacgacgataatgttgatttacatttaaaataatgattcaggaaaaaacacttataaaaacacacagcataaataatcttttatttataaaaacatgtacatcaacaacaacaaaagtgtactgaattatttcatctcattataattaaattttgattttagattaaatgcggtggatatttgtttttccttagctagtgtcggaattatatatccctcaacaaactagagagtcgtataatcaacatacacaatatgtggtgggattaatattgcatgcatgttttgttaatattgcatagtcatcatatatagcaaaaaaaaaaaaaaaaaaattgtatagtcatgcgactcatgcctatcaagtctcctttaaatcagtagtctttgttttttcttctttcacacggattgcattgtttctatatccctttttcgttgttggaatacaccacttactactttttgtaaacaaaatttaaacattttttccttctcatcaaacgtctaaataaaattacgggaaatattaatctactaacaaattaatggaataatcaaatatttttcacaacacacttttcatctcctacgacattcccatattcattgccggtcacgtatgtgaatcacgtggcttaactcttcccgtattttacttcaaaattaagaactaataaaataaatacatactaatcgagtgtcttatagtctctatatataacagcaaaaatcccttccaacatatttgccatttacacttcttcaagttttccatatactaatg

SEQ ID NO: 24229 - DNA, 3000 bp, Unknown
  misc_feature (1)..( 3000): 2750-1469P.txt file - cDNA_ID_2170936; gDNA_ID_1620815; Annot_ID_169220
taaatcaacaaagcacatacctgggaacggttcgattcgagcagagagagagggagagagggagagagggagagagagttatggtttatgagtctctctgtgaacgtagttggaccatatctcaaatctatcgtttttgtagagggagggctcttatttacgtgtaattacagtttaaataccaaactctataacattacaaatatggcccattaccagattgtgttttctgccacgtcaccataattgaaatcaacggttagagatgaaaggagaggtaactgtctcgcttagcttccgagtaatcgtagccgttgcgtatactcaccgacaccgtccctctgttttaatcatctccggcgattctgggaagagagaaaaagtgtgagtcagagaataatgattcgagcggttctcctgttccttgtcttcgtcgttgagacgagagtacaagcgcagctagtgccgccggtgaggcaagatggtttcgtttacccaccgggtcatcgtttcgacccggatactatactaattgaggcgtattttgacccggtttgcccggacagtagagactcttggccgccactgaagcaagctcttcatcactatggatctcgcgttgcccttctcctccatctccttcctttaccgtcagtgatctaaaattctctctttgccttcattctttgctctgagcttaattcatgtattgatcaatcgacaagtggcttaagaaaggtctggactttaaaatatgtttcactgtctgttttatgatttgttccatggaaatgtgaatgattcctttgtgttatgtcggattattcgttcttgtattgaatcttttttcttggattttggaaattgcagctaccatgacaatgcctatgtaacatcacgggccttacacattgtgaataccgtacacgccaatgctaccttcagtttgctggaagggttcttcaagcatcaggtttgttcaatgttaatactaaaaacttaggtatatatgtttatttatctgcagttgctggttattgtttgcatgtattcaataatgtttatctggttcactgaaactgtttttttttttggcagtcattgttttacaacgcgcaaacacaactcctttcaagacctgcagttgtggagaaaatagtcgaacttggaacagtctcgttggggaactcatatcaatcggttcttaaatccggcttcagcgacaaaaaatcggatcgtgcaaccagagtttccttcaaggtaattcctttaggaacttaaatttcttacaggaaggtcattggctgcatagtcatcatcttattatactgccttgcatctatatcacacacaagaaaatgagtgatgtcagggcaatagaagaatacagagtttaatggcctgaatctttacctatcaagtataattttgtgacctatttgtcgatagtaccctgaggctgttctcgttgttttctgaaaacgaacaatagtgacttttagttcatcttttgctttcgtggcgttgtgtgttgcagtatagcgcttcaagaggggtttatggtacaccaaccttctacgttaacgggtttgtattgtctgatgctgcttccccttcaaattttggaggatggaagaaaatcattgatcctctggttcaagcacatgagatggaagataacttcattcccttcctttgaagattttaagtgcttttgctgtgtcaattgtcatggtataatactatctgtaatgtatagactttctcaaaacctgtatgttgctcattgtaaatttgtaataaaggaaagtgatccatataaaagttggccagcccagatttattaaacagaaattgtaatacatggcaataaaattaaaatttacatgttacgtataatgaatctattgctttgagtttgagctctacactatattaatgtgataaaataaaatattttgaaaaatacatttattgttaaacccgattttggtatttatttaaataaaattattacttttataccaaattatccatatcttaaaactgtggcctacttttgttttagtagtagtgaaccaaacgaatcctccatctgtctttgtgttaacgacgtgagaggaagtgtgatcatgtgagaaagctttgttaatacatttccgctgattcacagccgaatatattacctcgacaaaaggtacattatttttcagatcattaatacagaattaatggaaattttacttgattatgtcatcattacatcgttaattagttatgctattagtcttacattgtttcaagttttggattgtgccacaaaacaaacttaaatgcttctcacgtttgttgggtcaagactcccaacaatattttattttgtaattatggatggttacaacaattatatggtaactaaaattcaaagagacattacttttcttttctcctaagaaaacatagatctcagtttcttgttgaagtttgacaattattatttttgatcataaaattttcgcgaaattctgtataaaatactttactaaatattggtataaaatattaatctttattaactaataagtaaacatagagataacatagacacgttctccaaatattaaaattaaactacaaatttgtcttttcgttggttaatagtactagttagtaccgaaaatccagattttgtctattaataacgtgtagatttggttctcatctaaacaattaattttattttattttcttctgaaaaagccatttagactttttccttcgcattttgtgcaactggataatctatcttgaagattttattacaagaaatttggactttacactcacagaaaaaaaaaagcacaactaaaccgaaaaatcaatgtaaaccgatatacaaaacattcccggtcacatatcaattaagaaccttaattactggatctaatttaacgaataacagctaatcgttgatcaaatctctttttacgactgaagatg

SEQ ID NO: 24230 - DNA, 3003 bp, Unknown
  misc_feature (1)..( 3003): 2750-1469P.txt file - cDNA_ID_2170947; gDNA_ID_1620815; Annot_ID_169224
ttcccggaagacgtggatatccaggttatatgtacactgatcttgcaactatttatgaacgtgctgggcgtatagaaggaagaaaaggttccatcacccaaattccaatcctcactatgcccaatgacggtaaaatcatctttcttaagccaatccctagattctattttttatcttgagaaaactcaattcttactcgttgttgtttgacaaattgatcagatatcactcatccaactccggatcttactggttacattactgaaggtcagatatatatcgataggcaacttcacaacagacaggtaataaataactaccgctgaggccctgatcttactggtttcagtaatattatgatccggctctgaatgaatgtatctttgtttcttccctgaaaaacagatatatccacccatcaacgtgcttccatccctttctcgtttaatgaaggttagaattcaactccattttgattaatacccattgcattctatctccagatcttattaacgtattgtttctcattctgttagagtgctatcggcgagggcatgactcgtaaagaccattctgatgtgtcgaaccagctgtatgcaaattatgcaatcgggaaagatgttcaagcgatgaaagctgttgttggagaagaagcactttcttcagaggatttgctttatctagagtttttggataagtttgagaggaagtttgtgatgcaaggagcttatgatacacgcaacatcttccagtcgctggacttagcttggacattgctccgtatcttcccacgggagcttcttcatcgtatccctgcaaagacacttgaccaattctacagccgcgactcaaccagttaaaatgaggtaatggaggttatcttatcgaaactcttttgagagaaaagtgtgaatttttgtgatgtgtattatttggtgcttattataaagaggaaaaacaaagaaaagctatatattctgtgtctccctatctggtgatattttttttggttctgcattgtgttccaaagtggaaataaaaatcgataaacgatgtcgtattgtagtactttccttttctttgtatgaatttgttaagattggtttataaatgggattataataagtatctttaaaaaagagtgtaattagtatctttaaaatttgcagttagtattgtggaaaacaatcatgatataattgacacgatagaccaccgaaataaaggaatcaattagattagattattgaactaaaccgagttttgtccattctccaatcaatcgcaatcttcgttatctataatcaattaagtttacgcgttgattaatctttttgcaaaggaataggagaacctagagagaccccctccaaggggctacatagtgggaaaataatgataccctaaccttctctaaacgctaaagcaaagcactgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagagcaaagcacccccacaaaaccaaccaaaggcaacattatttttccttcttttaaatttcgtttctgttgcctatatttcaaagaaacatccaacaaaaagacaaaaaaaatcacagaataagaccgaagagtcgaagaccgatctactttgctcacatgcttcaaaaccaacataaaacgaccaaaaaccagagaaacaaaaacattggaacaaaatattttcttagaaaaaaaattatg

SEQ ID NO: 24231 - DNA, 3000 bp, Unknown; identical to SEQ ID NO: 5656
  misc_feature (1)..( 3000): 2750-1469P.txt file - cDNA_ID_2170990; gDNA_ID_1620808; Annot_ID_168936

SEQ ID NO: 24232 - DNA, 3003 bp, Unknown
  misc_feature (1)..( 3003): 2750-1469P.txt file - cDNA_ID_2171002; gDNA_ID_1620808; Annot_ID_168939
agggaatagagtttttgatgctatagatttggttagtaaaatggaggaaatgggatttagaccagatgttgttatctacaacacgatcatcgacggttcttgtaagatcgggttggtgaatgacgcggtggagctgtttgatcggatggaaagagatggggttagagctgatgctgttacttataactctcttgtggccggtctttgttgttctggtagatggagtgatgcagctcggctaatgagagatatggtaatgagggatattgttcctaatgtcattactttcactgcggtgatcgatgtgtttgtgaaagaagggaagttttcggaggcgatgaagttgtacgaggagatgacacgaaggtgtgtagatccggatgttttcacttacaattcgttgatcaacggtctttgtatgcacggtcgggtagatgaggccaaacaaatgcttgatttgatggtaactaagggttgtctccccgatgtagtgacttataatactctcattaacgggttttgcaagtctaagagggttgatgaaggaacgaaactcttccgcgagatggctcaaagaggattagttggtgacactatcacatacaacactataatccagggctattttcaagcgggtagaccagatgcggcgcaagaaattttcagtcggatggattctcgtcccaatattaggacgtacagcattttgttgtatgggctttgtatgaactggagggtagagaaagcattggtgttattcgagaatatgcaaaagagtgaaatagaacttgatattactacttataatatcgtcattcacgggatgtgcaagattggtaatgttgaagatgcgtgggacttgtttcgtagcctttcttgcaaaggacttaagcctgatgttgtgtcctacactacgatgatctcaggcttttgtaggaaacgccaatgggataaatcagatttgttgtacagaaaaatgcaagaagatgggcttcttccattataacatatgaaaactgtatattatttgtaagtaaaaaacaaattctttattttgtattcatcaccatttgtaattttgtattattacaaaagaaatacaagtaagctggagtttaatgtaaagtctttgaaaccagaaataaaagaggcaagaaaagggagataaagacaagttttcaaaacattgctctccatgaataccacttgagtttaaactgaaacaagagtggaggaacaccaagaactcctctttgaatcctgggatcaaacacatcgaattgtactttatttaacgaatccagaagaacttgtaccggcacagaatgaagcagtaccggtttagcttctgcaggaacctttcccgccagttcacgggctttcaggagatgtgcattggcaacagatgcaatctcaaacacgacattgcttagtccttctcttgaatcgttatccagaagaatttctaatcgtccaccttgtttcacgagcaacccgtgcttctcagcgagatctgcagggatgtaactctggtgacggtttctggtacagtggtacggtaatgatttaagcagcaagacaagaccactggctttaccaatgtgtgaagctgcatgatcagctgttgttgaactaattccgcctgcttggagtgtattgtacagaagagtggaaactgtgtcttctgcgtatttctctagctccgcaatgctctctggtatatcgtctacttctctttgggcatctcggattctagcgtcaactgagcgttttagccaaggtttactgatgttatgttctgatattgcccaagacagagcttgtgcagctggatggtttatgggctttttggtgtagagtttgtcaattgcttcttgccaccaaagtaaccgcatcaagccgattttgggatcagatgcaacatccatggctcttgcggtttctacattaaaagcccggagagcaaatgctgctttacgcatctcagttgggagttcaaggagacagaggtagtgatgatagtcatagtttcgtacttgctgcacacaataggacaatgctgaacgcaaactactcgagcctcctccattcatcagtataactccaactgtgtttctttctcttatcctacaaccatataaaccacaaacaagatcagttcataaaaacaatgaaaaactctggtttcttctatcactccattataaaacagtaacacagaattcatctacaaacacaagagaaaatcctccaattatcaccacttcaaataaatatactgaataattctcactaatccagaggttttgtgaaccgttaaactcattcaggaattaacacaaacacttggtggacaaagcactggaattggtatttaacaaacaaaatgagaacttttcaacattgcttaacacacaatcataaacccaataatcacacatggataacaaatgagatcactaaagttcacagaaactttccaattagtaatgtaaaatcgctggaaaccattaatgtcgtccaacaataacgaaacgagcaaaaaacaccttaccctaactcgaaaaactctgagattcaagtttcctatgtttaggaactgaatctaccatccaaaatccaaataaaatcaacctttcgacccgaaaatggaaatcgaactctgaacaatcgtgccggagaagaagcgttgggtcaatgtagagaaatacgtcgtcgattaatataaaaccactaatgttattacacgacgtcggttctgctacagtgtaacaggaagtcggttttgttataaaatgacacgacgacgtttttatgtaaagaactgtttaatgaataaacgtgattaggatagtattaacccgaaaccaaacactcttatatcgaacaaatatatatacactcgtatttattcgcctaaagccaaaaacccattagcccctcaaggtatcttccagaagcaacgagaagacctgcaagagaaaattttcagattcaactatg

SEQ ID NO: 24233 - DNA, 3000 bp, Unknown; identical to SEQ ID NO: 5657
  misc_feature (1)..( 3000): 2750-1469P.txt file - cDNA_ID_2171006; gDNA_ID_1620808; Annot_ID_168940

SEQ ID NO: 24234 - DNA, 3000 bp, Unknown; identical to SEQ ID NO: 5658
  misc_feature (1)..( 3000): 2750-1469P.txt file - cDNA_ID_2171020; gDNA_ID_1620808; Annot_ID_168944

SEQ ID NO: 24235 - DNA, 3000 bp, Unknown; identical to SEQ ID NO: 5660
  misc_feature (1)..( 3000): 2750-1469P.txt file - cDNA_ID_2171022; gDNA_ID_1620808; Annot_ID_168946

SEQ ID NO: 24236 - DNA, 3000 bp, Unknown; identical to SEQ ID NO: 5659
  misc_feature (1)..( 3000): 2750-1469P.txt file - cDNA_ID_2171025; gDNA_ID_1620808; Annot_ID_168947

SEQ ID NO: 24237 - DNA, 3000 bp, Unknown; identical to SEQ ID NO: 2756
  misc_feature (1)..( 3000): 2750-1469P.txt file - cDNA_ID_2171070; gDNA_ID_1620588; Annot_ID_161338

SEQ ID NO: 24238 - DNA, 3003 bp, Unknown
  misc_feature (1)..( 3003): 2750-1469P.txt file - cDNA_ID_2171183; gDNA_ID_1620589; Annot_ID_161374
gcttcttctacaatctctctccaatctatctccatgacaactctcaacaatctctcatatagtaaacaatttcatcgaagctctcttcttggtttctctaaatccttccaaaattttggtatctcatctaacggtccaggttcctcctctccgacaagtttcacgcccaagaagaaactcactcctactcgagctctctctcagaacttgggaaataccgaaaaccccagaccaagtaagtttattttcttcttgatcttttcgcttaagtttcgaaaaatcatataaacagagctttttccaaaaaaaatgaaatacttttttttttttttgctaaactgcaaatatcatataaatgaagggaaaggtttacatgagttagaacctaaacaaaaaaatgaaatacttacaaaacattttctaaatacattatctttatattaaaatcagtttttcatttcataatttttctaactccattaaatttatatgattccagagccttaaaaccaaaaatttgcaaacttgataatttaaacataatatcagatctcaaaatcaagaacgtataattaattcacaaattgagtttttaatttttcaggcaaagttcaagaactgagcgtgtacgaaatcaatgatttagatcgacacagcccaaaaattcttaaaaacgcattcagctttaggtttggtctcggagatctcgtcccattcacaaacaaactctacaccggcgatctcaagaaacgcgtgggaatcacggctggtctctgcgttgtgatcgaacacgtccctgagaagaacggtgatagattcgaagctacgtacagcttctacttcggagactatggccacttgtccgtacaaggaccatacttgacttacgaggattcgttccttgccatcactggtggcgctggaatctttgaaggtgcctacggacaggttaagcttcaacagcttgtgtatccgacaaaactgttctacactttttatcttaaaggattggctaatgatttgccactggagctcataggaactccggtaccaccgtctaaggacgtggagccagcaccggaagctaaggcgcttaagcccagtggagttgtaagcaactttacaaattagtgaataaaattagtcttatctttctcgtgtcctgtatatataataatctttttcatagagaattttatattcttatacttgtaatcaaataatttgtatggatcttagtatccttgtgaatgcagtatgtttgagttgaaaaatacttgtaatcgaatctttagttttgagttgtccccttttggggagtaaaatatcttcttcttatttttattgggttgaaaataggtttttgcatagttttttttatcgacctttcaaatacgtcacaattacatttataggagttagggttggtgttgtaatccatatacattaccactatgaaactttcagcgaatacaagcatatactatcaaactccaagcgaaataaatactcacaaaaggctcaccatggtcgtaaagtgaggattgaagaaaaatgatcatgttgatggatcaaataaatcttccatcgcctgatttcatcatgatgtacactcatctcaagaacaagaaaatgatactaagaagaaaaaagataagctggattaggcacgaaggtttggaagaaacccaaactctaacccaaatattgtggataaataaaaaacaatcaactttcgagttccttctccagccaacttatgggttgcaaagatacttttacatataaaagggatgctgacctagtgcgaatatcaagaaattgtgtgtgttttatgtgctccgggttcaatctctatttggtatacaaatgactgttttttaaatccggatatctaaagtctaactttgagtactaggaagattataaggcaaagatctagaactcttatagcttaaataaaaaatgattttacatgtaaaagacagaaattacctaatattagttaagagatgatatattttcaagaaataatgattctagttgtataaaatacctagttttttttttgtatttttttttgaatatttagaagtgcaagtccgaaggccatacatttcctagagatatgatccacaccaggttaaattcatttcttttggagaagagatccctcccaacagacttcgaacccaacacctctacctgcgagattttttttttgttattcgtattagatgtgattttggtgcaccacgctagcgttggagatgaaactcccacattttcgcactgaatcgactattaaagcttggtctaagctatcaatttattacagtctatgccagaaatttatggcatcctacctgatataaaaagctttatggcatcctacctgatataaaaatcagtgttctatcctttaagttgttcatgtattttcattccaagagcagccaatgttgagacagattctcttgctaagcttgccttatccgtttatgctgaaaacattgttagttaatccaagtattggcgtttcaaaaaagaagtgattttggtgcaaatatcttttcacagaatataaaataatttttaatcaattttacatacatgtatccgggacaaaaatatagttagattcattacatttagaaggttttttattttatttttgtagtttagggaccggccaaaagtatttcaacttaaatccaagacccaatgcttagatcacgttccgaccatggaaaccaaatccaaattcctcccaaagcatctttttagtttgagacccacttttggtaatttacgcacgtgctacttcatcaatcatccccattcatcactcatccaacatgtctatctataaatagacggagatatttcgtagaactcaaatcactcaccacataaagtaaaagtctcatctcttcataaaatagctttaaaccaatcaagtagagtttcttctcaagtctttttattttatttttatcaatg

SEQ ID NO: 24239 - DNA, 3003 bp, Unknown
  misc_feature (1)..( 3003): 2750-1469P.txt file - cDNA_ID_2171191; gDNA_ID_1620589; Annot_ID_161376
ctctggaatctttgaaggtgcgtacggacaggttaagcttcgtcagcttgtgtatccgacaaaactgttctacactttttaccttaaagggttagctaatgatttaccgctggagcttactggaacggcggttacgccgtcgaaggatgtgaaaccggcaccggaagctaaggcgatggagcctagtggagttataagtaactttactaattaagtaattagctgtttaatagttgttttgttttgtaatagaatattttgatgagttgtgtgaggttagttaatgatgtgttgagggaataaagtatttattttgatgtgactttattgattacaactggtctttctacaacgtggaactgttgtactcgatttcaaagtaaaactttttacattagtttcggtattttcacggaataaattgatagctagaacctttaatcttatggtttaaaatggtacactcatatacacagttagggtagtggagttaatgctagtaattagtaacacaatattttttggttcgttatggttttggtgttaattgtgttaatgtcataatgctttaacgctaatttgttgttggcacagatatttaaaactaaaaaaagcaacctagttattgctggctatctttttaaattgagaagttaacatcttgtcaagtgaatcgtgtaatattgttatactctaaagatcgatattattgtgtctaccagtcaaaacatgtgttggagggaaattttatttgtaggttcatcatatgtcaggaacattattgtcatgtttctgtaagctttctgacatttaagttcagattttgaccataagttttgatcataaatgagaaaagaacaaagttaagtttagttttgcgaatgttaaaaaaaataaatatcttatttgcactttttgaattatttaccaaatataaaaaccaagatggtgttttttttgtaataccaaaaaagagagaattttagctacgagagaatgcaaaattcggatttgtgatccgttttattgaaaaagattttagtttcatagaacatatatcaagtagtatacaaattgaaaaatagggtctgatagatccgagacacttgggtattatcacctaacttttaaacgtttatgccagttttttgacaaacaaatcacgaagtatttgaggataaatacagtatttgtttatgttttctatctttttttaggaggatgagttcattggtttgatcttaaacaattgaaaatttataggttaccaccaattttgcgattttttttcttcttctatactttagatttaagtttatatatagatattttcgtttgatatcaatatgggaagcccacaaagttggggagtttagtggtacctttttttttggttcacaattgcatacgaatattggggagtttagtggtactattgcatacgaatattggagatacgagaaaggggtggaaaaaattgatgataaattgagcccaagtaggaaacaatacacaaggccgtatataaagttggcatgttgggttcaatacatgaggccgtctttttgttcggccgcggccagtggtgaacactgaatatggccttttgagactccgaggggacaattataatccaacactaaaatacatctctaaactctatttgccaactaatttctttatttaaaatacgtttcaatctaatcaaaacagataagcctgttaaacacaattttgatttctcgagactacgaataggtggatctatttgtatcataacatcataacatataaatcgatatttaaaattttgagtaataaatttgatgttggtctctaacaatttgcgggtaatttcttgatattttggacatcacccgaacatattagctcattacacaccaatttctatagaggcaacatattttcttatcattaaagttgacagctattagagcccttaatcacgtttgatttcatatctaattccaaattatatggatataacaacagcatagcatataaattgatatgtgtagcattaggttatatctttgaccgggaaatgcattggcaggccattatactgggaagatgcattcgcatatatattagtaggtgtacttagtaatcgtctacttgacataattaaaattaccggtcaaaaacacgagatatataggaactcatattgtgtggatatatatattagtttacatgtgtatttatggataaggttataacgaattcaacaaattctcaaggtcctatgaaatttcaacaagtatattacagttttttttttatatatggcttttcttctcccatgtttcggctgtctacgaagagacatttggcttttcatattgggatattgaaaaatacattttcaacgttttatatatgattttgtgtgggtgaaattaatacttacagaacaaaagagctcatgcacgtttagtgttattttggcggctgtttttaaggatttgcatatattctttcccacgtattgaattctataaatgacataataatcaaacttgtaaaaataatagaatgaatagtttatagtcttccaaaattcgatttctgttgtagtggaatcgcagacattttctaacttatgaatgttgttataggacttctttaaaccttggttggatatacccaaataaatataaagttcacacgaaaaaaacttggaatcacatccaggaatattcaccactggatcaatactactatacaacaagggaaaaaaaaatatttaacttgggaaggtatatacttattttataaacaaaagcaagattcgccttgtaatgcgacggcccgacttctctctttcaaataatgatccttgagaaaccctatagagccatatatacgttgtctttataaagagacataactcatctcttcttgactaactttatagttaaagttatcaattattcgaaaacaaagctggttttttgttttgtcccttaaaccagcatg

SEQ ID NO: 24240 - DNA, 3003 bp, Unknown
  misc_feature (1)..( 3003): 2750-1469P.txt file - cDNA_ID_2171209; gDNA_ID_1620589; Annot_ID_161382
ctcaggaactatgaatacgaatttttgaaggtattatcactcacaggagcgtaagggagaagaaagagccatagtatatacacagcttcactagtccatagaagataccgaacaattctccttatagaatcatcttcaacctctaccgtcgccgtctccggtttccggcgagcacagcataagaaggaactgtctcgtgttcgtaatttgaaacgattcgtagactgccatggattgtagcagcgatcgactgtggagatttctctactccgaagaaaatggcggcgaatttgtggcgatttgatttgggaactgtggagacggtgacggagatatgtcaacgtcggtgaggttatcagaatcatcgtcgtcccttcactgcattatccaccgtttagtcggagaattttttttatttatctgagagagacttgctaaaacggcagcgtattggttatctaaatttgaaagcaacgacgtcgttttaattgaatcgaattacacattacagttggctttaaacaggccattggcccacggccttataaaacgccgtttcggtgagacactgaaattggatagtcacatcattattatgggtgctaagccaaatatctttttcatcattattattcgacattcctcaattttcgtcaacttcttttaacaaccccaaaatcatggttatataactttgctttatatctagaggcttagttaaataaataaataaattcaaaattaaaagaacattgaatcatgtaggcaagattcaatttcaactattttggttaattttattatttattttcatttaattattgtggaacgtatgatttattcatgtagatagttttctaatctcattagaatatcttatcatataatttaagtgtggaccaaaacataatttatttcttctacgttatttctcttttttttttgtgtgcaaaatacttgtattcattcaatcaagaaagaaccaaatacaaagagaactgacttatttctctatatgtaaattattgaagaaattataccttttaaaaaaataaaaatgtatcgagatacatttaaatttctgttgtatgtaatgtgtatacgtgtaatccaatttcttgggattctatataattatttatgttgttatggtctgtacaaaaatatcacatgcttataatataagagatatttcttttatacgtatgtattcttttaatggtttttaatatagcaatattaagattcattgttcatctaaataagtttttattagttagcgcaaaaataaaaactcgtttggagaaacaaaaaatggttaaagcgattaaatattgtttttcaatacattaaaattgtttgccatcttctaaagttgtttactcacttcagaatacatatgatactctctaatgggaagaatcccatgagccaaaaccaattgtctttggagtagaaaaaacttatagatctttttgtggaatcataaccctagattcagtagggtttattgaaaaaggaaaagataatacatatcctaacaagacatatccaaactaatccacaaaaaaactagacgattcgtgatatattggagatatcaaatgtacgatgtggcttcgaattcctgccaaattcaaagggatctaaaaggtctttaatgattcttcatatgtcatgaatttctactacattgggatgaaagtaagttagttagtttttatttgtttgcttttcatttttgctaaaatttttgatgaattttatcaaatataaaacacagtagcgtagactatattgttaaattttttttgatgaattttatcaaatttaaaaatacaatagcgtgattttgagaataaagcctataattttccttcatacggcttattgagtatacattagaactatattttttacaataggataacatagttctgaaatgagtaaattgaaaagagtttttgaattgattgaagtatgattctggttgtttagaaaaaaaaaaaaaattaataaaagaattaaaccattatgtgtgaactgtgaatccaaatattgttctttttctcacttttattagttaatcactgatatatctcatcaatcatagatattgtttgcaaaaatacttaaaccgttttgtgtacattacgatcacaaaacaagagaatcacataacctttttttcaaactaactttttttattaagttgaatcaaataagtttacttctatattatttaattatatctctctacaacatttaaaaaccaacacgtaaattcgtattaaaataatatggaaattgttttttcaaaatcctctacacatataagttatttgaatcattaaaacggagttacaaactttttttcttcgattatcaatgtttttctcctaaagaacaaatgaaatcgacgacaacctaattttttttggcatgtctgccaacaaaactcatagccatcagattgaactgtcttgtaatcaaacttgaactgtctccatcacttaatctttgtacgcagtttttataacttctatatttaatcatgtagaagattttaattagataaatttcagttacaaaaagtggatattagacattgcgaaaagagtattgacatgcagcaaaattgggtaaagtttgtcacactatttaattgaatatacttgaaaaataactatttatctggtaatcttgtaaataaagatataataatagatatctttaaataattgactatgatttataattttatatggtgaaaatagaaataaatttggtaaataagatattgtagttggcacatacacaaaaataaacttcaagttaaaccaaattggacaacctattgaaaaaaaaaaaaaacagaaacaaaatcatgtaccgaaatagtgttctaagtcatcattctgactctgtctatataaagttataaacgtatgtgttctccaatatattcagccagaaagaagagaatcttatactaattcaatg

SEQ ID NO: 24241 - DNA, 3003 bp, Unknown
  misc_feature (1)..( 3003): 2750-1469P.txt file - cDNA_ID_2171255; gDNA_ID_1620590; Annot_ID_161395
gcccaatgatctcatccattcaaggtacaattccggtctatcttttctttcttcacctttggccactatcattattccttttgaaacgaaaagattccggattatgattaatccatggcattggatcgtaaaatctcttgaatatatacgcagaatggccttcagacaaagcctatcgtattggaaagagaagctgggacacacaacgatcgatttgggaatagcaccagagaagctggagtcttaccacaatggagacatcaagagaagcgatccaatggacagactaaaggcgataaaaggacatctcgtctctttccctttagatttcatgtgcaaagaagatctaagaccggtcttcaatgagagtgaatactacgcctcccctcaagtcttccattgagatcattacatcaattcttgactgctggcttattcagtgacagctctctacacgaagaatacttcattgctacctttaaccattttcatctcatatgtttatgagaaagaattaaagatgtttgtatagcgatatgatatgtgcaaacagaggaggaaactgagaagggaagccattttgctagtttttggtttctctcttccgaggtaaagtaaaaaaagaaaagaaacaggtcattttctaagtcaaatattggcttactatctataacagtgaatgtgtcaccccacacagacacatatgatttgtaattatgcgaaaaaagactgaataatataatgtcggtgtcgagatccacgaggtgccatgtgaatatgaaaatatgatgtgacaatgagtttgggtcttatctttgtttgtctctgagtcaaacaactccatctttaccacttgcatctcctttgttgtgtcgtattttgttcacaacctgtttgtatctatttatctcaagtctcaactgacaacaaaaaaacttaaatgaaaagtaatacatagcatgtggaggatttggtgatcaaatattaatccacacatgcaatatacgaaaagttaactttttgttcggttctgaaagtaatgaaaccaaaagcaagagaaaaatcagtttagttaggagttctatttaacaaatttcaacattaatctttttcagaaaaagattaaaatcaaagaaagcaaaacggacagagttttgtaacttggttcgggtacatgtttacatgatcttatttcatagtttcccaagtaagaaatagatttggtttgctagttacatttgcgaccatgcatttagcatattccatctagtgaaaattaattaatattatctatttctattttttatcttttatttcactatcttatttctaccacccacccaagctagaccgccatcttaactaataattaatcaaacttaagagtcgtaagcactgatatctatggattacctaagaaatctatagtggacatgtataaaatctaacatatgcactagggacatccatatcttaggcacatatgtatggttaaagacaattaaaaaaaacaaccttacacgtaaataccttatacacacgtaaaatttgcatacgagccaatgtctttcttgtatatgtatgtattgatatttttttctctttttcattctttgttaagggaaatatatacttatcttatatgacccctaaacggctaaacgatataaaaacaacgttaaaaatcttattatggtgcatggcttgcttataattgtttagctatttttaggttattagtagtcgcagcataaaaacggtatgtcaacaaatttcatggtagatctagattacgacctcaaaactcgtttatacaaagtatacaacgtttctacaatttatattaattagttttttgtgagtatgcatatatatcgtaactatgtcgggttttatattattacatttaaaatgataggaacttatcatttgacaaggtgtaacaaaaataataattataaagatgagagttgtttcggatcaaaggcacttaccattagcttttagattcgagagcctctcacagccacacctttttttggactagtccttattgtttaacaaaccccacatgatatccttttatatttacaccactttcgttaatttattaactttcttccacatccacatttaaatttgatctagacattttcttatattaaactatatacatctctatcctaatgaggtattaactagctatagtttattcatttgtcggtcttaagctttattatttgtcatggcaagaaaaagaaaactttgattggttattcattgtggttgttgtaacgcttttttttgtttgtgttatttgaccccaaacataaataattcttcattttcttgcgcgttttatgattgcgttgaaataacatcttcactcgccaaacactccagtaatacccatttttccaacatatacacttctaatcatacccacaaacatacacacgttttaatctgcagcttcaaggatatgttgccttctttaattgaatcttatttaccaatggagaatacgtatacatttccttagactaaaaaaatatataaacccttttgttaattataacattcaagtattcaactataacttcttaaataaaaaaattcgtcaactttattcataacatatatacgtgtccttgtcgacatgcaaaaagaatgtatatgtgcatttgtacgtgtatatatgtattaaaataaaaggcttagaatagtcgaaggagagaaagcgaaagatgatgatgagtcatagagacaattcaccagcttataagtagtaaatccaccaaaaggaaaatatattcaacagagaaactccgatcaagaatattcatatcagagaagaaaaagtaaattcctattaaacttctgattctcttttttctttttgttctgcttttcatttgctttttggatatctttttacagtagttataacttataaatgaagttcgtaaatatattgtaggatcataagagaatcaaagaatg

SEQ ID NO: 24242 - DNA, 3000 bp, Unknown; identical to SEQ ID NO: 2771
  misc_feature (1)..( 3000): 2750-1469P.txt file - cDNA_ID_2171259; gDNA_ID_1620590; Annot_ID_161396

SEQ ID NO: 24243 - DNA, 3000 bp, Unknown
  misc_feature (1)..( 3000): 2750-1469P.txt file - cDNA_ID_2171441; gDNA_ID_1620591; Annot_ID_161428
gttccagttaggcctgatcagcagtctagtgtggggactaccacgagcacgaatctgcagtctaaaccatttgtttctcccttgtcttcaaatcattcacagcaactgccaaaatcattccctggtgctttgcctccatcccctcaacaacagatgcaattacattcagacaatagcatccaaggccagagctcacctgcgaccccatgtaatattttatccacctctagcccgtcaattgcaccagcggttgcaccttctaaccatcagcatttgttgatacaccaaaagcagcgcaatcaagtgcaatcaacagctcagcgagttgttcaacataatcatctagggaactctgagttatcaaagaagtcccaagctgaacgcatgccacgtgttccacagtctgtaaccaatactacccaaactgttagtatgggtacgaccaagggtatgcctcaagcgagtaatgatttgaaaaacataaaagcagttggttctactgcggtgcctgctttggaacctccatcttgtgttgcttctgtgcaaatcactgcttcgaaagtagtaaacagttccaatacagattcagcaggaaatgatccagtatcaacaccgaaccaaggactagctcaaaagcacgggatcaagggcgttacacagagacaacaacagtctctaccttcagaagaaaagagaccgaaattgccagagaagccgactgtacaaaatcagaaacaccttgcttctgaggagcagcctcatttagaagaagcacaagaattatcatcttccaagcctcctgatacaaaagtggaatgagaggcatgacagatgaacctagaaccttgagtagctgtagatcctgcaaagcttaacgctggcccttaccgacaacaaccctgtacaggaacccaaactggtttgtgtcctccaccttcagagtcgggtctctttttggcattaacatcttgaagctgctggtggtctttggatttggctgagagtataacataacaaactctacagattgtggagtttgcagatttggtaaggccagagggagatcaatagggaagaagttggtggataggataaaattcatgcaggtctttttgcctcttttgatgaacacaaagagaagaaggtatatcataatgtaaattacccacttgcatcatagagaagtagtctcttcttcttcccatcttttggtttgggagagagtagaaacagtttataatgttttgtatagaagtctctactcctccatccttgtggcatatacttagggcccttttttaaccttttcctctaacttattctcttgtaggtttaggttaatttgatgaatgtatcattgttcttttatggttaaaaaaaaagttcacttcactcccataaacattagcttacatagtgcatttcttcaaatccgttacctatgttacaaatctaaaagcaacaatgactaaatctctacgttagaaagaatcaaaagcattgttgataaattgaagaagctgagtttgagaactctgaatcaaattttagattttttggatacttcggataaacccgaatccgaacccaaaatatctgatccacatccgatctaaacccaaattttaatatacccgaatgcgtcctagatttctaaacccgaaaccgaaaactccgacccggactcgatccgaattgcctatggacaacgtgggacaaatatagttttacaaaaccagcgacatgcctgagatttgtagagatccatgtcacacaacatgaaactgttataactttattactacaaaaaggcccgaaacaagaccaagcaaacaaaaagaaaggccttgtttggtcaaaatctcaggcccagaattcggagagagagagagagagtcgcatactgcgtcgaggagagagagagagagagaaagaacgaaaaaaaaacatcaacgagaactcaatttttttttttatctcccgagagggaaaccaaaattgaaaacgaaaaatagctgaattaggaatcaatctcgcaacaagcaagcaatttccatggattccttgttttgggaggagcttcttctcttctactctctgagaaattgattctcgtctttcgatttgaaagaaaagcttataagaatttggaagccctaggagagagaaactaattttagaatttggtgattttgcccgagttttgtgccctagctttttgccttcgttctgttctgttctacgttcaatttccaggtttaactctcttctccttcactcttctattcaaaccctagagtccagctttgctggagcttctgtgattttgaacccagtgcttcttttatcaggaatgtgaattgtttgctgaaattgtgtctctgtagttctttgtttctactcgtttagcttggaaatgctcaatacttgattcaagagttcgtaggcacgccattaagtagcttaagctgatcattttctaactttggttcctagtaatcgttgttagtgttggattaagcttctagaacctctctgccttgaggcaacatttcatttctttggtatcttagagttctattctatctctgttatgctggaatacgtagttgtgagcttctcggggatcagaatggtattggcgttagatatatagaattctcagtcaaatactagattctggggagttatcttcactttgatgttcctttggatagtggctagagtatatgagtgaatgttgttttacttttgacatcttctgagcagttacatcttgaatctgataagctactctattatatgatatcatatggtactgctttttgcatcatgagaacatacattttaccagtgttatttgtaggtccaacatttaggtgtaactgattctaacttctgcagtatgatcattcggaatgctgtaaatactgaaagctcttgatataatttttcagttaagctagaattcgaattgatggggtattcgacgtggtgatg

SEQ ID NO: 24244 - DNA, 3000 bp, Unknown
  misc_feature (1)..( 3000): 2750-1469P.txt file - cDNA_ID_2171445; gDNA_ID_1620591; Annot_ID_161430
aaaaggtaagttactatactttgaacgaaggtccactagaattttaattttctcactgcggtcaagagcctgcaagttaatgaattacataaacctcagtcagtttcgcataagtgggaaaaaacagagaaaattcaagtcatatattctcaaatgaatgatataaaattatgagattgacatggatatatgattcagaccttctcaatgttctccatcataacacctttcattttggtcactagagccttaaccttggcaagtttgctaatctcctcgggatgagccaaaagtaccaaaactctttgttcaagctgttgggttaagtagttgtagccattcctatccaccaccatatctcttgttgaaatcctcttaaactcgctccaagaatgccattggaatctgccgaaacaacgcaataggctgcacaaaaagaaaagaatctattgtcatgtccatggaaaaatatgagagaattataaacaaaggacactaaatacgaaaaagaaactgtatagtattgctcatatatcacctaagttcaaatacaagaggcaaagcaagctaaagacataactacattcaacagtttcacttccgtttaagcaaagactcaagtcaattacaattgccttctaaattctcacaaacaagccaataatacataagctgaatggaatcagaacaccaagaaacatatatcatgataaatccaaacgagagatacatcaataagtaaaataagaaaagtctcatcaatcaatggaaaccttaacagaagaagaaccaagtcataaatatacaaatgaatgagcaaatgagcaaagagatccagtgaaatcaattgcaacacgaacacgaatatacatctaagtctaccacatagatcgaaactaggctttcaagagggcgaaatcgaaactcatatatacgaaaaaccaggaaaaaagagaacatgttcggtttgagaagggagaagggagactcactgaagccattttcgacatttgttgtaggaaaattggtatcggagaaggaagcttcttctggcaacactgtgcagtgacggcagtaaaattccctttttgcagaaggcaaaaaaaattacttctttttttccaactcgaaatttttactttggctgtaaatagtaaaattgtttttgaggaatttaaaatggttacatcatttacatgttgaggtatacttgaggaatttgtgaggaattgttcatgtttaagagttttatttttgtttttaagttgtttcataaattaataaaattattattcttagaactaaacaacgcaataggctgcacaaaaagaaaagaatctattgtcatgtccatggaaaatatgagagaagacttccactagaagttgttagtaaggaaaattctaaacagaaaaaaatagtttaaattttattttaaaagtaaaaattagtagtttattttattagtttatgcgtttatataatatttctatttgataaaaaataagattaaatgtattacattcttaatattttgtaatttgtaactttttacaaattaagttactatcttatgtttaataaaattattaaattatagaaaatttcaagtttaatattttttcatatgttttatttggtattagtctcttagatttctaaacccgaacccaaaaaacccggactcgatccgaattgcctatggacaacgtgggacaaatatagttttacaaaaccagcgacatgcctgagatttgtagagatccatgtcacacaacatgaaactgttataactttattactacaaaaaggcccgaaacaagaccaagcaaacaaaaagaaaggccttgtttggtcaaaatctcaggcccagaattcggagagagagagagagagtcgcatactgcgtcgaggagagagagagagagagaaagaacgaaaaaaaaacatcaacgagaactcaatttttttttttatctcccgagagggaaaccaaaattgaaaacgaaaaatagctgaattaggaatcaatctcgcaacaagcaagcaatttccatggattccttgttttgggaggagcttcttctcttctactctctgagaaattgattctcgtctttcgatttgaaagaaaagcttataagaatttggaagccctaggagagagaaactaattttagaatttggtgattttgcccgagttttgtgccctagctttttgccttcgttctgttctgttctacgttcaatttccaggtttaactctcttctccttcactcttctattcaaaccctagagtccagctttgctggagcttctgtgattttgaacccagtgcttcttttatcaggaatgtgaattgtttgctgaaattgtgtctctgtagttctttgtttctactcgtttagcttggaaatgctcaatacttgattcaagagttcgtaggcacgccattaagtagcttaagctgatcattttctaactttggttcctagtaatcgttgttagtgttggattaagcttctagaacctctctgccttgaggcaacatttcatttctttggtatcttagagttctattctatctctgttatgctggaatacgtagttgtgagcttctcggggatcagaatggtattggcgttagatatatagaattctcagtcaaatactagattctggggagttatcttcactttgatgttcctttggatagtggctagagtatatgagtgaatgttgttttacttttgacatcttctgagcagttacatcttgaatctgataagctactctattatatgatatcatatggtactgctttttgcatcatgagaacatacattttaccagtgttatttgtaggtccaacatttaggtgtaactgattctaacttctgcagtatgatcattcggaatgctgtaaatactgaaagctcttgatataatttttcagttaagctagaattcgaattgatggggtattcgacgtggtgatg

SEQ ID NO: 24245 - DNA, 3000 bp, Unknown
  misc_feature (1)..( 3000): 2750-1469P.txt file - cDNA_ID_2171505; gDNA_ID_1620593; Annot_ID_161470
catctgattcgtttgaaacggtagaagattcgtgagggttctgtatcggttgatcagcatggtgttgctcttctccctcagaatccgcataagaagagaaactagctaaagggcagacaagtttcagaggaagagaagtgtgtttctgaggagaaaggaattgggcagtgttcttcctgaagaaaggggattccttgggagagaaacaacaaccaagagctgatctgggtgtgcagagatgagaagtcttaagtagaagtgagtggtttctaacggaagagaaacgataaggaagagtcatgtctgaaaagaagaagaagaagaagaattagtgaatcaagaggagaaaatgaggaggaggtagagagatgagaatctacatagatgagaaatgggccatggatgatgagaatgaagttggtgatgatattgatgatgatgaaaatggatttgcataatgggattttgatttcaggagaggcgagaaagggtaagtgatggtggcacaggggaatgtgaggtggaggtgagaggattgcgtttggatgcttctttgtgttaggagtgagacttttgaatttgtgtggttcttgtggaatgtagtgagaggctcttttggttgggcctcacaacctcacaaatgcccacttgtaaaaaagaagaataaaaatgatttgggaattttgttctttgtttggatgtagtcaaagaagagaattagatgcactgtttaaatttttcttcaattttaataatgatttaacaaaatggcattatctcttatgttaaagtaaatcaatcttcaatttttattacatatacaaattgtcaacagtaatactaaatattacaaatcaaatcaaacattttagttcttaaaaaaacatggagctgagtgtgttcgtggggtaactcgatttcatcatgtggtttatgaggtaggtgaggctggttagttaggtgatggacaccatcttctcttaccattatggcttttgttttccttttatgtcaaaaaaactttaatacattttccatcaaacatttaatagatttatccagcttggttttcaaatattcgaatatgtttagtttcattcagtttggttagtataaaatttgtgtgtttcgattaaaaaatgtttggtcgacatgcattaaaaatagttcaaaacatttctaagatatgatctttggaccaatttggtcgatatgcatcatgataagatcgattgtggaagattgggatgatccgatcatatagacatatatgtatatagttttttatttacctgggagatcatatattgatcaacaacttcagtttaaatttgtatttcagaaaaaaaaaaaaaaagacttatttagaacttgtattttgaaaatcatcatgatataactacacaaaataaaaccagaggtggattttctttcggttttaccaagatattttgagttttcggcccataattttcttgagtaagagaggagatcattttaattcaatcatttcccatcatggatattttaatatataattttgtggtaaatttttttttggaagacccctaatacacaaatataactgcatatacgctcgagaaaataaacatactcattcacatcaattataaattatagtaattcaagtgttagtttgagggcatagtgtttagttaactatatgtcatttattaacttggttttcatagatttcaccttcgattcaattagttttgataatttagcatcctatttgtagccaacaataaaacaataaaaaacttattttttcgtttgacatagtgttaatgttgggacgaattatgtacacgatcaaatatcaaccgaaagacattcatcatgatgattaatttttctccttttttaaaattcaatgatttttttttgtgtgtggatatgactgaagaaaatttcttattggtattatcaactttttatacaattttagttcttttcttctttataaatctttattctataaacaaaataataaaaattcaacgttgataaagatttcctaccaagtagtccaatacatatgatagcttcttccgtatatttaggaaaaatattggtaagaagagtaacaaagtattatttgaataagtggtatacttatttgcgattttcaacgattttatttttatgttgcaatactatttggatatagttagatatgatctttagttgatcaagaaaccttgtgattaatgtgtatgtattggggataacaatctgtttatttctctataagatattcaagttgttttgagttttagagttataaatgataaacgcacctctactctgagtactctttcatgttactagcattagaaaactaaaaatgcggagttcactaccatattatgtactcatttctttttttaagatgatgttgcgttatttttagattgaaaaaccttttaaacttttcttttaaattaaaaattcaacaatttgtttattctttcagaaaagataaattgtttatctccctgtttttctaaacaatgtaagagcatcttcaatggtgactaaattgggttctctcagctgtttttctggaaaaagatgattaaaaataaatcaaaatcatgtattattgagaaagttgtctctcttgagagagtttttgaggaggatgagagacgacgacgtggccgttctgatgtttttcaattatacaaattgaaggttagctatattgaggaaaaaaacaaaaaaggtaactgcgaaagcccattaactttaagttgttttgcatcggcccaaatataaatcctaaagaaaaagttacatatgtttaaaaattaaaacgcagcgttttaagagtcagctatttcagaaaaaaataggattagcaaaatcagaactctgcgagcgtctataagaaaaaaccctagaaagaagtcgattatccagaaacagtgtcttcttctctttttgttgttacttcctttggtttcttcaatg

SEQ ID NO: 24246 - DNA, 3000 bp, Unknown; identical to SEQ ID NO: 2790
  misc_feature (1)..( 3000): 2750-1469P.txt file - cDNA_ID_2171657; gDNA_ID_1620596; Annot_ID_161535

SEQ ID NO: 24247 - DNA, 3003 bp, Unknown
  misc_feature (1)..( 3003): 2750-1469P.txt file - cDNA_ID_2171784; gDNA_ID_1620598; Annot_ID_161596
atttccgtttattttcttgtgaaacgtatatagtttgtctcacctacgtaccatttgtggtcaattcttctttcactataaaaagacgttttcatagtatataaatgttcaaggaagtttcttagaatttgttttcgaagaaaaatagaaaaaggaactcaattccaattttgttagctcgaaacctcgaataaaaatttggtacgttggttgatttggtatcttcgagaagtcttccgataaatcgagaatgtgttcatatttttttttttttaaagaacggtgggaaatgattgtatacgtaacataattacacgtgaatgaaaccaatcagtgattaaaaaaaatcatttatgttagaaaccaaagaagctttttgtttggttgacttctggtatttagtgtagttaagggatgtaggcccatgaaagttaggcctaaatattagaacccaatataaatggtctcttattcgattagtgatgttgagtttttgggaaataatgatgggcctaaatggccaatgtgttgtgggacgattgtttggactttttgagtgactttgcatgtgttcataacttaaaataaaaattgcattcccatacctctttaagaattcaaacttctaaaggcctttaactcgtacaataatttaacgtgagacggtcataattcagttaagaacggattgcgaggcttggccaaaccctaaaggtgttggcctgctcatgaaatgcaacattagttggatcttacgagaccgtacgtgggaaaccaagttccatggacaatgttcacgttttgaggccaatttactagtttacagtttacactgggcaattgaataacagtaaacgaaaacaaaaacaaaaacaatcgtatcactaattactagaatttgtcgagtagggattgaatgtttatatatatgagatattaatacaacggccaacacgtgtgtatctgaaagtgtacatactaacatttatggtagaaaggaattcgtgtcatcaagtcaagtaaaaccttttttgtccgttgtgtaacctacacaacgatatattcaaacaaaacatatgacacatataatcgtatgtgtcatgtttatacatatacaatatgaaaagcaaagagaacgacacattagttgtttttagttacgtttggtcttaaaattaacaagtccctcgttaaacatcagccgtgtgataattaacaagcatccatcgttaaacacttccaatataacattttttgtcgtgaaagttgattttgttcaagtcttcttcgataggagttactcatttaaagaaaatagcatctcttgtatgtaaatttgatcactccttccaatggtccagactccagaacaaaggaaactgtattcacaacgaataaatagataaagggatccagaaaatcatgtaatgcatgatacattattagaaatatatatagaataactgagtaaaaaaatatatatatatatatatatatatatatatagaataaatgagtgacaactgacatcacattagtattctctgtatatataagataatttatatttagatgaaaatgtactcaatcgagaaaaatgtaataaacgaaactaattagttgacaaaaagggaaaatcatcaaagataaaagtttaactacataaacattataaattcactttctaccaaaaaataataattataaatttactttattccagtttcgacgaggagtgtggattctgttgttgaataagcagatatttgattcgccgagattttagattacaatattcaaataatttcgaaaatactggagaggaacgagattaacgataattagaggaaaaaagaagacaaaatcctaacaaacgcaaaactttatgcagcagtagcagcaggcagcggacttattagttatttaacgagtctatgactcaaaagacaaatacgaaacaataaattgaaaacaaactataagaaaaataagaagaagagtttaacaaaaatgaaaagaaaagcaaaagagaagaatataaccacaacgtggaataaaataatagcatggtcgatattgtcactttatatgattccttatacgataacatatgaagtagattttttacttagacacagattgcatcgaaatttgaaaatcgtatcaatataaaatcatcaagtgtgcagtattttcgatatctctgctaaaaatatcatatttactagtagaataaatttgctatagaaccaatagatacacaataagttaagtaggaaaatcgtaaataagtgacaaatcattttgttttcacggtttaatgaaaaagtcatccgcaatcatacatgtattaattaaacaatgtgtcattggataaaatgagataaaaccaaataaaatctaaaaaatgttattttatccaaagattattttgcaaggaaaacttgatagggagtagtatttttagtgagtgtaagctatttattaattccattatttagggtctacgtaaactatgaggcattcgtgcaaacaataaaaagatagcgggactcaaatgtaaattaattatgacactcacaacaagaataattctcattttttttttttttcagtcttatgaatgaaagttagcgtcttagcgaagtagaaaaggccaaaatagagagcggccaaaacggaagcaaaaaaaacctcatcattcttcatctcctctcttctcttctcttattcatgctcaccgccataaccacaccaccacacataagctttcttctgtaatctcaaactcttttatgggctaattattacattttcactatatacgtctacgagaacgagatcaagcacttgctaattattttgttgaagttcttgaatggttttccttcagtgtgtcacatttttggatttagctgaattgttttgatcataaggagaaaactttctcttccttgtttttttttttggtctaaattttctctgttttttttttatccaatg

SEQ ID NO: 24248 - DNA, 3003 bp, Unknown
  misc_feature (1)..( 3003): 2750-1469P.txt file - cDNA_ID_2171849; gDNA_ID_1620597; Annot_ID_161568
aaaataaaaaatcatcatcttcgactattcatcgtccgaccactaacattttagatttttattcagtactttgtatctattcaccattttttttattgcaattgttattataagatcccagttatccattggaaagagagataacactaccatagaaagaaatcttaattcgaacgaatcttgctaagattggaatttttgtttttgtttttgaaccacataaatattgcaatttctaaggcataatatttaagagatctttgctccaactctaaacaagaattagccgtaaaaaccatactcattcctttatgctctatataagagaaggtaaccatctcacataatcataactcaactaactttttattgttctcaaattgatgtttatatggatcaatccatactaatccaaaatccatggataaaaagagtggaacttttggatattggtagataggatttgatgagtttcatgaattagattgaaataggttgggttataatggattagtggattatccataaccaacccaatagagtgtaaaccatatataacataattaaatatctaaaccgatttagtaaagcgaaacaaaatattctaaatcaaatttgtacactcatatgacggttgatttgatgatggtgatggtaattaaacatgagaacagtccttgataacatgctaaatagaacatgcttaaatcgaacatgagaatatgcttattgaagattatgacactcggtttgatggttaattcgatgtgatggtgatgatgattatgatgatgatggttattaattaagtattaattatttaaattgtaataagaatatacaatccattaatttaaatgagttatggtcttacgaattaatccaaactatttgctaattgagttggttggtctccctaactccatatgagatatatgagttggtttgatttggtttaactaatttgacacctctactttcatatgatcttatatcacaattatcaatcattgctaatagttaggttatgagttccaccaaatcaataggtaaaaaagtatctcttatgattttgattaatactttgctgtaaatattgatcggtgtattaactaatttgtatttgcaaccgtatacattgcaagaaatgttggaacaatttgcgagaaaagtctaacagtttacacagcgcagaagtaataaagtcattacatggaagcaatattggtgaaatgcttaatgattatgaatagtgatgtatataaaaatcctcctttttttttataagtctttttctaagatttatcttttcatctcatcctaacaattttgtattaaaattctactatcatcagatactcgagaagatgtatttgggaagttattgctgctctatttcgaggtaaattcttggacttaataatacttctggttatactcgagacaattaccatactaattggtaatttaattttcatattattgatttcagtgtaataatatattttggttgacctttgtaatctaacatttcaatttaatattaattgtttgatttatttactctccacttggattatatgtgtatcttaagtcttaacgtaaaaattgtcatttcattgatcaattgtttttcttgctatgaaggagtgtttacatacaagtaaagtagttcaatcaattcgttaatttgaattttctctctaacttgaaattgatgggttttttttggggaatttttatatcagttttaagtgaaggtcactataatttcaaaaatcagaaaattcaacgccttcaatgtttaactttgtttataaactattttgtcaagaaaacaaaattttatttgttaacaaacatcttatttgtcaaacataagttagatatgttttatgtttttgggttggactaccaatgtttcttattttgttcttttatctactcatcaagttaatccaaattagtactattttaatttgatcaaaaagaaaaataaaatccatattttcaaaaagctccttaatatatcatatcgaaaatgagttagaatcaatatgaatatatattagataaatataaaacataattattctaacttaaaattgatgtaatattcatagttagatggaaaataaataaagaaaaattattttagttaaattataagaaaaagtgataattgtactaatgatatatatatatatatatatataaatgagaaggattgtataaactttatgtcacatatttaatattctatattctaatggtttatgttattttttattcattatgtatatatacacactctgtttaccaaaatcctataatgttaatgtagctaaatggttgagtgtctcttatgaatccaaaaagtcagatgtttgattccccttgatcacaaattttgcttcttattttctaatgtctagaatgacgtcattttgattttacggagattctaacggaaagataattccgtgattgacatatcctaaatggccaagtcaatgaaagtatgaaacttgattatttttttcaaaagtcaaactaaattttaggatttaaatgtcttcttgaaagttcatgttttttcatctcaaatttaaaagtttgggtttttttcgacattttccaacaaaaaataatattttctcttgtttctttatttgttttcagaaaaattggtatgtagctaatttgtctcttcaaaataacattttttaaaaaaggaaaacaaggccttagactttgggcctttcttaagaaaaagactttagaatgggccaatattgagacagtgtacttagctcataaaccgggcgttgttgactccttgtacatataaccgtcgtgttttaatatacgcctgagaacgagaaaacgacgtcgtataaattcaaaccgccgtcgatcgtcactacgtatataaagggcttttaattacacggcgaagtctctctgttctcaagaaattaagaaactgagaaaaaaaaaatg

SEQ ID NO: 24249 - DNA, 3003 bp, Unknown
  misc_feature (1)..( 3003): 2750-1469P.txt file - cDNA_ID_2171853; gDNA_ID_1620597; Annot_ID_161570
taatataccaaattgagaaagaaaaaaatacaaaataaatatgtgattgtatatatagacgttttatgaatatatgtctagagatgtatcacatcacatcactgaaacatatatttttgtagttttacttttactatgtttagattggttagagatgcaactgtaggttaattgttgtaaatgtagctttgttttttttttctctgtataaaatatcttatagtatctaaatatttaatataactgttttggaaaaagactcaaatatgaacaaacacaaaatatttcgagaggtattactggtaaagtcttattggtaaatcaaagtctggagacattaccaattcacatacatattttggtagagtaactattaagtttaaaattatattatcgaattacagttaaacctttataaattaatactcgataaattaataatctttacaaattaataaattcttccagtctcgagttgggaccagtgtaaaaagtgacacaaatcgataaattaataagataataacttttttgaaagtcctatgtaaatatatggtcccatcaatatcataaattaataattgtataaatgtatcaattatatatatacattatatgtaagaaatttttttgaaatataattctaataattttttgcttaaatttgtatttattcttatttaaaatttagatttagtattttactgtatcaaaaacttttagtgttgttttctaaacatgatattatgttttacttgtaattgatttttgaaagatattttctagaatgaaaaaaatcctttagaaatttttgaaaagttactaaattaggaaaatctctctataaattaataaatattaatttatcgataaattaaaacttctctaaattaataaaatattgcagtcccaacattattaatttatagaggttttactgtatatgtatttgttgtaactcacgggttcaatagtgataaaggttaatatttctatatcatgattgaatttgattcccattgaacattaactatgcagattaatggcgacaaactaacggtaatctttaacatcggtgttgataaatcatgacgaagtgcttatgtgaaaagtcgttcacaaaatcgtttaccatagaaaaatgaaaagatttaagatttgttaatcatgaatattaagacaattatttattacaaaattcaaaatttaaggtattttctaatgatagcgtaacaaattaaaaaaaatacttatttacacagaatattatttatactattttttttctaacatgattttagtcttaaccaaataagtttgtaagttcaaaaatgtgttggttatctattataaaaattacaaaatttgattgaaaaaataattataatgctgattgtaactattttcgtaaaaatgctaattgcaatataacttttctataagattatttttttatatagcttttatttatttataagtctaattaaaacaacatgtacccaaaataaacaaaacacaaatcatagtcaatggtgtttaaaaactaatgtctcaaaccaagaaacatatcaatctcctttagtaatataattataatcttaaagttatttgttcacaactttttaaagagcttaatttaagtttatgatttgaatctaaaattgagaggtgggcaggacaaagtgagatgtcgagacaaaaatacagataagctaatttgtgcggtggattttacacaaactttgtcagtcacgagactctttcttattctaatggcaccaaaccctagttttgttcttttcttctttacttttttatttatcataaatattttatttggattctcatactctcatatgtctctttccctattgaccatatctttttatctcatctcttccctttcttgtgatataactttttactctattattatgacaagtcggggctagatatggttgtagtccaatgatcttattatttgctagactatagatttatatgtattggacacacacacttgataagaccatattttattgattctattaactagtaagcactaaatatagtctcgatatttttagtcttttttttttttgtcatctgaaatttaattaataaaacttgttgtggaaacaaggagagatacatatgcccaaacaagggaaactaaagctggcggacaaaagaaaagtccccagaaactaaagccggcggaatacatgatttccccggaaactaagccctgtgaaagggaagttaaaaacaacagaattaccaaacagaaaattcgaatcgaaagaggacgatgctataaactaagaacagaggaaaaaggctaaaatcctaagggaagcgataaaccaaagaatttctcgatatttttagtctacaaatcataatttcttttacgattcaaaattatatattttcgacaaataatttctattattttatctaaaaaactcggataattagtcgggtacggattaggttatgaaaataccttcgtaaaaccttataatatgatattgttttccggatattcgagtgggtgttctgacctcaaatgaagataaatccctaaaaccttgtaagttgtaacatggttttagggaatcatgttaatttttttggcaggatagggaatcatgttaatggcattaactaatagtgtgtacctaattagtaaagacatgtctattaagagaaaattgactaaaccggacaattttggttagaccggataaagaccatgtggtccatttagccttagtgatcatatgtatactcgatctagttgtaagttgttgtcatgtagctaacttcagaatcttactcactaacacttcgagtttcttctcattggcacaaaacttaactccattctctttttctctctctcttctatctttcaccaaaatgccataactctctcttcccctatataccaaaaattaatctgtatctctctatccatcaagagagagcatcacaatg

SEQ ID NO: 24250 - DNA, 3000 bp, Unknown; identical to SEQ ID NO: 2802
  misc_feature (1)..( 3000): 2750-1469P.txt file - cDNA_ID_2172027; gDNA_ID_1620599; Annot_ID_161634

SEQ ID NO: 24251 - DNA, 3003 bp, Unknown
  misc_feature (1)..( 3003): 2750-1469P.txt file - cDNA_ID_2172063; gDNA_ID_1620602; Annot_ID_161677
ttgaaatcaaaacagtgtgtatataaatatatgatcacaagtttgggagaaacatcgttaaggtaaagtggatacgagagattgcaattttaagagaaacattagttggatacatgaagaaacttatatcaaaaattcatcttcaaaaatgatgaaacaaaaggtgtgtatggaagaaccagatggtcaacttgacacatattccactgatattaataactgtttaatctatgactttggaagagcaatgattcttttttcctatagaagtgagagaatgttcatattagagagaaaaaaaatctttgataacaaaacaaaatcccttgtctagttgtggtctcaagtagaaatttttgtttcactcacttccaacttgtctaagacattatatgttcccaagcgtttaaaccactgaaaaacttccattcattaaataaagcttataggaaaagatgcaacaagtgtatgacgttaatgtctacacacccaccttacctagactgttgttagaacactagtttaatatttttccttggctaggttattttactcaaacttacctttaataaaaaaaatttaattattggatagttccgcttaagggtttgaacccaaatacttatcggaaaaccgatcgaatggattcaatttttctatatccgatgaaccaattccgaatccaaaccgaaaaagagaaaaaattgatgtagaaagtttctttgtaaattaagaatatatttgaccaaaacctgaatccgaaccgaaatcaactgtaccaaaccatctattttagattacattttcagtttgaaaccattattcatataccaaacatataaaaacccgaaccggattggaaaagcgcattagccaatcagtaggcctaatttatcagtccccgtaggcccaaattatttaataacgtaacatcaaaactcaattactggaggccatatgcaggcccaaattagtgtttcgcttgctagggctttaaagtaaggttatggattcttgtttgtaggatcttctcttgcttagccaaggcaactatactctattactagatgagtatccgtactacgtgcgagtttatgtattattatttacaaattgttttatataatgtatgttcatataaagtaaagttgaatgcatcggttttgaaacataaatataatttgtaattgtttttgaaaagtcctactatattagttcatctgaaaaacgaatgtgcttgagttattttttattgttgttttaaattctcaggttttttttaatttatatatccttgttttttggttctaagtgtagattgtgagacggtgaaattttagaaaatttatttcttacactaaaaatataacatgtctttattaaccatgtctctgcatattcaatctaagcttattcaacttgatgttcttgaaaagtttagttaaaatcttgtcataatcttatatctcacgttttagttataaggatagctcatcaaacatctttcaaattacttgttttcttagcataaatctcgaaaagcatctgcatattcatttagtttctttcataataattgtctaatttttaggcaagtctaatttttaggcaagtaatatatgtagcatgtttggattttatgatcactttagccacttaagtggatctcaaaattaaagaagatatattgaattaaaaaatatagaaaaagtgatggttcaagttctgattaattatatcctttatgttgaattaattactaattatgtattacttattttatgaagtctaggtggcaagctctcatgtgctgatgtgtcaagttgtgggagagagttagcctcctttcatatatatgattctacctgttccacattaagctccagtttacaggacagtactcagaccgattttagatgcttaatagcttcagctctgtgacagttctccacactatatgtctatatcgggtataattactccatgttcctctcgttcagtctgatccaacgctgcctagctaaactaaggcagcatcaacgtcactactttccgattctaagaaatctaaattcagaaacacttcaaatttctaagcagctcagactttgtttacctgatgaaacccaggttcatgagtcaatgtaacaccaagctcatgtataatagagtataaactggagcttaatgtggaaataacctgatgaaacccaggttcatgagcttaatgtggaacatgtagaataatagagtatagttacactcttactttgatattttcagatgaaggctccacgtcgccaatgctgtgacatctctccatcatatgaggaaacaaaaggctaacttttcatggttcagaaacttgtggaagtctgtatccgaagatctctcgacattctgacaatatttgtcgatgggtttggtcgtttttgtgtaataatatgcaacattgtttaaccagtacggcttctcttctcttgttattaagttttcctagttaaactattaaatgtataaaatgctaattgtagatgaaactgaaaagttgaaaaagaagaagatgaaactgaaagtttaaatcttatatttgacccaaaataaaataaaaacagagaagcttgtaattatagaaaataataattccttcatttcaggttgtcaccataaaaatggtgtgactgtaagagtctgaactcagtcacacctctttactttttcttcggccttcttgtagccgcaaatacttctctgtcatctccgttacaagctctaaacatttatttgaatttatcaatagaattcgtataatgtaaccaaaaaccgtaaactaaatatattttataaaacttatctccattcaacatccaaatccgttcgagtctcacacaaaaatccaataaaatgtactattcatcgccgacatgcttcgttttgatcactatatttgccgtggtggtaacacaactgatctttatgcgcaccgtttcgtccttgaacatg

SEQ ID NO: 24252 - DNA, 3000 bp, Unknown; identical to SEQ ID NO: 2805
  misc_feature (1)..( 3000): 2750-1469P.txt file - cDNA_ID_2172187; gDNA_ID_1620601; Annot_ID_161654

SEQ ID NO: 24253 - DNA, 3000 bp, Unknown; identical to SEQ ID NO: 2810
  misc_feature (1)..( 3000): 2750-1469P.txt file - cDNA_ID_2172195; gDNA_ID_1620601; Annot_ID_161657

SEQ ID NO: 24254 - DNA, 3003 bp, Unknown
  misc_feature (1)..( 3003): 2750-1469P.txt file - cDNA_ID_2172236; gDNA_ID_1620601; Annot_ID_161670
tttggttagtgatttgtagaaaaaaattacatttgctaatgaaattaagccagttgattgcttatgatgtctgcagctaaacatagtaaatgacttttctttgttcttccaagttatgtgtttgttgttaattcacattggtgcagctatgtttttgtgcagttgatttgagtgaggagtgagattacttggtaaaatagtgggcctatatctggttacgaaaggcccattagtagcccattatgttttgtccgtttcagactaattattggtcttaacttaagtatattacccacatacgaattctgaacttagaataagccaaatgcatttgaatccaaagtttgattgattccttgaaaagttaattagtacgtgtcgattttcaaaatactaaaaacacaattatataatcttaaacagaaagttaagtataatgtttaattaacataaatatttaaattgagggagtaagtaagtggtaatgttaaaaagaaaaaagaacattttgggaaaataaacaaaaacatggagagattcgcacaaggagagactctcgaggcaaagacccttgaaacaaggcaacacttcttatttctttatttctaaaaactgcgccgtttaagactcttatggtctttttctcctttatttcttttgtttacttgtaataatggcttgtggtgcgctaattattctatgaactttgcttaatttattaaatttttcaaaagtaacattaatacgtattagaataaatatttcaatgtatgtcatgtgccggtaaataaaacattttttctctctctacgataaaaatccatacttgacaactttgcatagattacttattaatttgtatttttattttttcaggtataactaaacttattacagtaaaacatgaccaaagtttttcgaaaaaagtaataaactaatcgtaattcaatatttgacatgaccaaaatgctgataagtaataagagaaaaagagttaaagaaaaaaaaacaatttgggattttaattcaatcaaattggagtttaaagtaaaataaaggtaagaatcatgagagtggagaattagggtaggtgagaatgagtgaggctcggtgtggtcacgtgaggtatcctcaaaatcagggattgttgttttgtccactacactccctaaacctaaacccactcatcctttgcttaacctatttcttaatactatgattttagtaagttttctatcaataactctctttctttttgcatacctttttggtcaatattttgtacttataagttttaaaaattggaaagagtgtttattttaaatatatgaatagaaatttgacaacaagtcaagctacatcttaaaatactttttgaaaaagtgatggaaactcggaaaggaaacataattaacacgagattatgttaatgattttatttctcagactgtatttgtattagataaaaaatcaataaaccattagaaatggaaaaaaaaaaaatgaaaattcattggatctagcaaaaggttcaagtctagtcatcttatttcaaaggattcttaatgtgtgaaataaacagcaatacaactatatctaatttatagagtaaccttgttttcttaagattacatttcggctcaaaggtttaaagtcaagaagataacaactatagaaagaaacagtaagctactagagtattaactaacatatacaataaaatatactcaagtagaaacaaagggaataaaaacgaatcactgattcaaccacttgcttggggtttgagcaaacgcactcgtttacttacaggggattaagctaaataatttctttaaaacaatcttaattaactgatccaacagtaacataaataaaaatacttatacccataaatttacgtaccaacgcatatatatcagacggctattgagtccagttagcacaaaactgttggaatctcgataatagcatgagcaactagttatttttgtataataaactacgatgttatatagtatataagtagataaaacattctaatctcgaagtaatatttatatacacttttcgattaagcataatttggcttgttttagttttacttcagcttagtcctaagagatgaaactgaacttttgtagtttttacttatatcttttacaaatttaaccacattatattagatcgacaaaaggggaattaaaataagatataagtatgtacattacatgattcacgtaaactataaattacactgcacataccactagtggttatatcaccaacaataagcatgtatccataggtaattttgtactaattctagctatttaacaatagaattttctttttaataatttttatccggaattctataccgagataatcatattttttcttgaaaactatattgattagatatttacatagtaaaaaaaatagaatatttccccatattgaagagcattttaattaaccaaaatttttttgttacctttaccatgtctttaaccaaatatgtttagctatttacttaatatcacttttaaacatcttaccttacgactatttcgtttagttagatatgtttctactctccacgcaatgtatatgtataataatactaaagaaaattagtactaaaatattactggtaaagaagagataggccataaataggtgaggtggcaaagaggtggggtggtgcagttttgttgatctcaaggcattgtgtttccctattttcctttgtactctttctcctctcttaaatcgccactccattattttaaatttcttatcttgataaaacacacacacacacaagtattagaagaacttaaaccctcttatgttctcttcctaagcttgagtttaattcaagcaagaaacagatttcgagagaagagtaagcacagagatagagagaaagaaggcaccaaaccctaaatgggtctaaacccaagattttaatcttcttttcgtattttgaggcaaatg

SEQ ID NO: 24255 - DNA, 3000 bp, Unknown
  misc_feature (1)..( 3000): 2750-1469P.txt file - cDNA_ID_2172263; gDNA_ID_1620822; Annot_ID_169521
tttttgacaaaggattacctcatgtagttgttgccaacttgccattaaccatgatagtgacgcaggcttccaaaacatttcgacgcgagagccactatccgaatacttgaataatattattgttgcgattttttaaaaaggtcttgctgatggccaaaaataaaataataacaaaaattattgtatatacaatatataaacgtgacaaaatgagctgttgaatatgatactagtatagttcgtatattaatttattttgaccaattgtacattttcgtcatcggggatgtagctcagatggtagagcgctcgcttagcatgcgagaggtacggggatcgataccccgcatctccattttcctattttttgttatcattattttttcttgtcccggtttttccccacgtgggaaacgtgaataatttaactaagacatgtacttcttctcatctatcttcgtcgttgactcgtgaaacttttgacaacttgtagtattaagatccaacttcaaaccaacggcaattgcattttcagctaaaagcaatggagtcatcacttccccaagttgctgcacttgatcgttcaactctactcaaagctttcgacgagactaaaaccggcgtgaaaggccttatcgacgccggaatcacagagattccttcgatatttcgtgcacctccggctactttaacaagtccaaaaccaccttcctcctctgatttctccatccccacaatcgatctcaaaggaggtggcacggactcgatcacgcggcggagcttggtggagaagatcggagacgcggcagagaaatggggatttttccaggtgatcaaccacgggatcccgatggatgtgttggagaagatgatagatgggattcgtgagtttcacgagcaagacactgaagtgaagaaagggttttactctcgagatccagctagtaagatggtatacagcagcaacttcgatctgtttagctcaccggcggcgaattggagagatacacttggttgttatacagcaccagatcccccgagaccggaggacttacccgccacttgtgggtaagatttccaaatttgttaaattacgagtttgactatttttgcttttgtaacatgttgtgttcctcggtccgaagaaattatatatggtcgaatagtgtttcactactcgttagacgaatattaatccaataatacgttttcttttttaacaaatttttataacaattgaaatacataaatccaataataacttattcaaatagttataagcgctaggatttcgttgaagatttttacgcccccattattcattagtgtgtcttaaagattttggtggacattttttcagggagatgatgattgagtactcaaaggaagtgatgaaattgggtaaattactcttcgagcttctctcggaagctctagggttaaacactaatcacctcaaggacatggattgcactaactccttgctgttgctcggccattattacccgccatgtccccaacccgaccttactctaggcttaacgaaacactccgacaactcttttctcactattcttcttcaagaccatatcggagggcttcaagttcttcatgaccaatattgggttgatgttcctcctgtccctggagctcttgttgttaacgttggagatcttcttcaggctaactaactaacccttttggttttttatcagtggttaatcaatggactaatataaatctgacttttattacctcattgggtgcagcttataacaaacgacaagttcataagcgtggagcatagggttttggccaatgtagctggaccgagaatttcagtggcatgtttcttcagctcgtatttgatggcgaatcctcgagtttatggacccatcaaagagattttgtctgaagaaaaccctcctaattatagagacactactattacagagtatgcaaagttctacagatccaaaggattcgatggtacctctggattactctatctcaagatctgagaatgtgatttagcttgtctaataagggtgcttgggactttgattatatgtgtaatgccttcttttatgactgttaaagccatgcatgaaactgtcacaaggtttttttttttttaataatatcaacctatatcaatggttttgatgtaaaactaatatatggtttatatatacttatatagtccgaccatgtagatttgcatcatgtcatgaggatttggagcacagttttagtatatagcttgatgaattaatctgattgtatggctcctaacacggattttgcaaattcaagagtttaaatctcgtaataacgtaacattagagaatcgttcatgtttttagataaatgttataaaagttgtaatttttgatattatttctcataaattagctggtttccgacttccgagaggcataaaaaagcttatgttaaaatgtacttaagtcacatgttaaaatgcaaagtacttacctaattgtcaaatgactaaacactatggtagttatccacaacttaaaaatcaatctaaatgtccagattgatttcggtacgcgtcggtttccattgatgtttggttcggttcaattaacatatccacatataaccgatcggttttaaaacgaaattcctaattacccagaattgctcttgagaatcgatcactagtgtctctttctctccgccgtcctccaccgcttgaacatcgtgtacggatttggttagcatcgttactttcgtttgcttttgttcattcctttggatttaacggaaacttgatattttctgatcttcgtaacgtctcttgttcttacaatttctcaccttctttagagaattcaagcaattttgagcttctacgactaggttatacattttcgtgaaattaggtcgatttttggatacattattggtttatgtgttaattcaaggcagttgaatcacttgatgtttcaggtactgttgtttatctctatg

SEQ ID NO: 24256 - DNA, 3003 bp, Unknown
  misc_feature (1)..( 3003): 2750-1469P.txt file - cDNA_ID_2172271; gDNA_ID_1620822; Annot_ID_169523
cggaagtcggaaaccagctaatttatgagaaataatatcaaaaattacaacttttataacatttatctaaaaacatgaacgattctctaatgttacgttattacgagatttaaactcttgaatttgcaaaatccgtgttaggagccatacaatcagattaattcatcaagctatatactaaaactgtgctccaaatcctcatgacatgatgcaaatctacatggtcggactatataagtatatataaaccatatattagttttacatcaaaaccattgatataggttgatattattaaaaaaaaaaaaaccttgtgacagtttcatgcatggctttaacagtcataaaagaaggcattacacatataatcaaagtcccaagcacccttattagacaagctaaatcacattctcagatcttgagatagagtaatccagaggtaccatcgaatcctttggatctgtagaactttgcatactctgtaatagtagtgtctctataattaggagggttttcttcagacaaaatctctttgatgggtccataaactcgaggattcgccatcaaatacgagctgaagaaacatgccactgaaattctcggtccagctacattggccaaaaccctatgctccacgcttatgaacttgtcgtttgttataagctgcacccaatgaggtaataaaagtcagatttatattagtccattgattaaccactgataaaaaaccaaaagggttagttagttagcctgaagaagatctccaacgttaacaacaagagctccagggacaggaggaacatcaacccaatattggtcatgaagaacttgaagccctccgatatggtcttgaagaagaatagtgagaaaagagttgtcggagtgtttcgttaagcctagagtaaggtcgggttggggacatggcgggtaataatggccgagcaacagcaaggagttagtgcaatccatgtccttgaggtgattagtgtttaaccctagagcttccgagagaagctcgaagagtaatttacccaatttcatcacttcctttgagtactcaatcatcatctccctgaaaaaatgtccaccaaaatctttaagacacactaatgaataatgggggcgtaaaaatcttcaacgaaatcctagcgcttataactatttgaataagttattattggatttatgtatttcaattgttataaaaatttgttaaaaaagaaaacgtattattggattaatattcgtctaacgagtagtgaaacactattcgaccatatataatttcttcggaccgaggaacacaacatgttacaaaagcaaaaatagtcaaactcgtaatttaacaaatttggaaatcttacccacaagtggcgggtaagtcctccggtctcgggggatctggtgctgtataacaaccaagtgtatctctccaattcgccgccggtgagctaaacagatcgaagttgctgctgtataccatcttactagctggatctcgagagtaaaaccctttcttcacttcagtgtcttgctcgtgaaactcacgaatcccatctatcatcttctccaacacatccatcgggatcccgtggttgatcacctggaaaaatccccatttctctgccgcgtctccgatcttctccaccaagctccgccgcgtgatcgagtccgtgccacctcctttgagatcgattgtggggatggagaaatcagaggaggaaggtggttttggacttgttaaagtagccggaggtgcacgaaatatcgaaggaatctctgtgattccggcgtcgataaggcctttcacgccggttttagtctcgtcgaaagctttgagtagagttgaacgatcaagtgcagcaacttggggaagtgatgactccattgcttttagctgaaaatgcaattgccgttggtttgaagttggatcttaatactacaagttgtcaaaagtttcacgagtcaacgacgaagatagatgagaagaagtacatgtcttagttaaattattcacgtttcccacgtggggaaaaaccgggacaagaaaaaataatgataacaaaaaataggaaaatggagatgcggggtatcgatccccgtacctctcgcatgctaagcgagcgctctaccatctgagctacatccccgatgacgaaaatgtacaattggtcaaaataaattaatatacgaactatactagtatcatattcaacagctcattttgtcacgtttatatattgtatatacaataatttttgttattattttatttttggccatcagcaagacctttttaaaaaatcgcaacaataatattattcaagtattcggatagtggctctcgcgtcgaaatgttttggaagcctgcgtcactatcatggttaatggcaagttggcaacaactacatgaggtaatcctttgtcaaaaataaataaattgaaatctctgataaaaagataaaatatagattctgttctaatacgatatttagtcgaaactaataaaagagtatatacgaactttttaatgtctttgtaatttgtaaattccgttgtagttttgtaaatttaagaaagttttgttgccccaaaaaaaaacgaaattaaaaaggaagttttattcgtttgattattagtttatttagcttcttttatttcacctttgggccttacacatcaaatcaaacttaaaagttaaaaggaaaactttgggccttggcctctgggttatatactcttaaggcttaacccgacggcggtcaactaccggcctgaaataaccggtttttatttttcctttgtttctcttttcaaagtgctcactttcccggtgactctttagtcaaaatttcaaattaattcctctaaggtgccctaatcccggctgctcgtcgggggaaaataacccggcagggattgagcaacagcgtgagtcccaaagtgagagacagtgtgaatcccaaagtgagagagtgagtgttttagcgacagagagatatg

SEQ ID NO: 24257 - DNA, 3003 bp, Unknown
  misc_feature (1)..( 3003): 2750-1469P.txt file - cDNA_ID_2172323; gDNA_ID_1620822; Annot_ID_169542
actatatggtgcttttactctctttttaaccaatccacaatttcctttttccgtcccaaaaagtaaattacatataattaatagataatggcaaaacttccaatacaagtattagattaatatgtaaaatgagtatcaattagtgtttaaacttttgattttaaacactaagaacttgaatggttattgttattagatgctttgacactaattatagaaatcgcatcataccattttaattctttgtaagtcaaaaacttatccataacattaaaatattttgttttataaaactttatatttgacagcatttatcctctcataccaaaagtttatgatatcaaactagtataattatttactaggctaaactattattgtatgtgttttattagtttaaataaattttatagcggtaattgattcgcttatagatgtgttttggtcttggacatgaaaatacaaaggtccatataattcttctacttcattttttaatttcgttttttcccttaatgcctgttaggtgttcgatataattccgcagagagtgtgggtatatacagcgacgttgtggaacgcggaaactcaaaatagctccatatactctttgagatactatgaggttcctcctcatgagatcacttctggttcacccatgtggtggctccatcatcaatgtccgatcaacgactacgtctgctcaatatgtagcttccagatcaagagaccctgttttcgagaagctcatggacaaatacaagaaccttctcaaggtcattgccatacaagaccttaccctcgccaatccaacagctgatcctccctctctatccattgagtttctctccaggctctcccagaagctccaccttaatcgtggcgctgcttctttcctgcgaaagtatcctcacatctttcatgtcttgtatgatcctgtgaaagctgagcccttttgcaggttaactgatgtagccatggagatttctcgccaagaggctttggctatcactgctactttgtctcttgttgttgaccggttggttaggctcttgtctatgtccatatcaaagtccattccgcttcgtgcggtttttaaggtttggagagaacttgggctcccagatgattttgaggactctgtgatctcaaagaaccctcatctttttaagcttagtgatggtcatgaatccaacacccatatcttagagctggttcaggaagaagagaaaagactggaatttgaggccgcggttgagaaatggagggtggttgagtgttctaaggaggattgcagtgtcgatagaaccgagattcagtttagtttcaaacatagttacccaccaggaatgagactgagcaagacatttaaggctaaagttaaggaatggcagaggctgccttacgtagggccatacgaggacatggttggtaagaagaagagtagatccggtgtgatgggaatagagaaaagagcggttgcgattgctcacgagttcctgaatctgactgtagagaagatggtggaggtagaaaagatcagccatttcagaaaatgttttgggattgatttgaacataagagatttgttcttggatcacccgggcatgttttatgtgtcaactaaagggaaaagacacactgtctttctcagagaggcttatgaaagaggacgtttgattgatccaaatcctgtttacgatgcgaggaggaagcttcttgaccttgttctcttgggacgccatgctgctttatcagaatctgggaacactagtatgtctgaacaagaatgacattacgatttttcaggccctattgagtctgagctatgcaatcttccatatggaagtgtatgagacacttgagagattaggtccaccaagaatcaggcaatgtttctatggcgtttgtccgaatttcggactaattggcttgctcacaagcaaaagctcgagataatctgaaagcaggaaaagcgagttacttgatgtagcgtaagtgagtacttggatcaatacttgtctacgaaaccaatgtaggagtaaacggtctttgttgtgtacttttttggttatgtattgtcgacagaaaggttagaaactagtatccaaactcaatacgtcttctttctttagattttgcttggttgctaattgcttcatgtggctttccttattctactaaaactctcatctttgttcttgttctattttttacttttacatcctaatttttttgaaatattattttttggaataaaatttgaattctttttcttaacctttatcactaccagggtttaaattataagtttaattatataatgtaaaaattgtgaacgttatttatgtattgaatttttgatggatggtttttgtggaaaaaatggttatagaaaaaattgtgacaagaaatgagtgaaataaaaaccgagagcccatgaaaggaagccacgtaagctgttcggagccacatctcttgtcttcaaaagtaccaaacttcatttgcttctccaaacaaacaatctctttctcttcttctgccaaattccacaggtgcgtttcactcttagctcatctgtgtaatctcaagcattttctgctttgtttggtctgaatttctgaaatcttttgatgataaaaatttctatgaaatctcggtctgcttgttgcatgattcttactacctgggttttgttcagcaagtctatttgtctttatctgttttcttcttaatttgactttaggaatgtctaataatggtggattcatgtgttgaaatatagactaatgttatatccagtggcaatttctacaaatttttttatcttggagcatgaaaatgttccaatctttcttcatatgcgtcgctaatgatcgcttatgttgattatagtcttaccagaaacttgcatgttgttaaaggtctcgttttgtttggttgttctttgttcagattgtttttttttgttcacgccatggcttgtaatcgtctgtgcagatg

SEQ ID NO: 24258 - DNA, 3000 bp, Unknown; identical to SEQ ID NO: 7598
  misc_feature (1)..( 3000): 2750-1469P.txt file - cDNA_ID_2172425; gDNA_ID_1621154; Annot_ID_173369

SEQ ID NO: 24259 - DNA, 3000 bp, Unknown; identical to SEQ ID NO: 7602
  misc_feature (1)..( 3000): 2750-1469P.txt file - cDNA_ID_2172437; gDNA_ID_1621154; Annot_ID_173376

SEQ ID NO: 24260 - DNA, 3000 bp, Unknown; identical to SEQ ID NO: 7607
  misc_feature (1)..( 3000): 2750-1469P.txt file - cDNA_ID_2172458; gDNA_ID_1621154; Annot_ID_173387

SEQ ID NO: 24261 - DNA, 3003 bp, Unknown; identical to SEQ ID NO: 18552
  misc_feature (1)..( 3003): 2750-1469P.txt file - cDNA_ID_2172468; gDNA_ID_1621154; Annot_ID_173395

SEQ ID NO: 24262 - DNA, 3000 bp, Unknown; identical to SEQ ID NO: 7612
  misc_feature (1)..( 3000): 2750-1469P.txt file - cDNA_ID_2172472; gDNA_ID_1621154; Annot_ID_173396

SEQ ID NO: 24263 - DNA, 3000 bp, Unknown; identical to SEQ ID NO: 7635
  misc_feature (1)..( 3000): 2750-1469P.txt file - cDNA_ID_2172508; gDNA_ID_1972143; Annot_ID_179290

SEQ ID NO: 24264 - DNA, 3000 bp, Unknown; identical to SEQ ID NO: 7635
  misc_feature (1)..( 3000): 2750-1469P.txt file - cDNA_ID_2172508; gDNA_ID_1621154; Annot_ID_173415

SEQ ID NO: 24265 - DNA, 3003 bp, Unknown
  misc_feature (1)..( 3003): 2750-1469P.txt file - cDNA_ID_2172514; gDNA_ID_1972143; Annot_ID_179293
ctattcaatcctcacgcgattgaggagtgactgaccaaagtttatttctataggggcaatttaataactattgtaaactttcaacgtaaaaattaattactttgaagttatggggcaatatcatcaatagtaataaatataagcccttactcgtaaaatacaaaaggtttatttgttttctgaattgagagcgtgtaactactaccatcgtcgtctccgcgagttcttctctgcgtttaagccatagataacaaaccaaactaaaaaaaaaaagtttctccttttatcattccttctcttcccttgtataggtgtgatcctcttcaaggggatttctctggcgggtcatacattcgcaccgatcaaagtcggattggtctttcttaacgcaatcttgacccgattcaaaaaatttctggtatcctttttaagaaatgaaattaattgattccttgtcttccaaacgagtaaatcgactaattgattagattttgttcattagggtttgttagtgaatagataagaagataaatgggagctccgttagtgtgccacgggcattctcgtcccgtcgtcgatgtggcttatagtccggtgactccagatgggttctttctcattagcgccagcaaaggtatgatcttcgatcgatttgtatttgactatctatgatctttacttggaactgtgcctattttggattatgatttgcatagcgaatgtgctttgacgaatttgattttgctgccttttattatatatcgtctgaagtttgatttgtggctgatctaatggagaaattaggatgataagttgcatacattgttgaactctagctgaggtttctttgacttttgatatttcagattcgaatccgatgttgaggaatggagagactggtgactggattgggacttttgaaggacataagggagcagtttggagttgcagccttgataaaaatgctattcgtgctgcctcagcttctgctgatttcactgcgtatgttcttcttctttcttgttgcgttttcaagtcttttactttaccatttagtcttgcaatttcagtatcctccggtgatgggttgtttgcttaaagttataagttatggggaaactatgttcctagagaaaaatggttaagtgagaatagattaatgggatttaacactatttctttgttttcatgacacatttcaggaaaatatggaatgcattgacaggagatgaattgcactcctttgaacacaagcacattgttcgtgcatgtgccttttctgaggtaaactgtagtttcttcccaagcaaagagtgatttgatcctgttgccaagttttctggtttaaggatataatggtgggattcactaagattacttgtagcatttgagggtctataatcgttggtgtcatttgtgttactattgtggtcttaatgcataactatttatattctaggacactcaccgtttactcactggtggaatggagaaaatacttcggatattcgatttgaatcggccagacgcacctccaaaagaagtcgggaattcccctggttcaattagaactgtcgaatggcttcatagtgataatacaatcttaagctcttgcacagataccggtgacattaggtatgccaccacgtcgttccttgggtttagactcagtcctttagtattcctggtttcattgttcttttgtgtatgtcctctgtaggttatgggacataagaagtgacaagattgttcatacattagaaacaaagtccccagttactagtgctgaagtaagtcaggatgggcgatacatcactactgctgatggatctagtgttaagttttgggacgctaaaaagtaagttaaaaatatagaaatgcatcctcagttacagttttatcgtttttctttgatggttgagctttttctcctgctctcctagttttggattgctgaagagctatgacatgccttgcaatgttgaatcggcatcgttggaaccgaaacacggtaacactttcattgctggaggagaagatatgtgggtgcacaggtttgatttccagactggagaagagattggtaagtttcttttaaaaaagaatgaagttttcattttaggaacctgtgtgtatcctttaaagccaatgtggtgaatgtagggtgtaacaagggtcatcacgggccagtgcactgcgtgaggtatgcgccaggaggggagtcatacacctcaggctcagaagacggaacggtcagaatatgggtggtgggttcggtaaaccatcctgaggagagcaatctaagcggccacgtgaagcttgtggcagaggaggttgtgcgtaaagctgaaagtctccgtatcagtgagaaagccgcagaagctaaatgaaacaccatcgttagcttatgatatcacatagattcatagttgtttttgcatcattataagatgtgacaaaggggttttgccttttaaaagtctctcagaccgaataaaacgaaataatcttcaactatacttgagtgaatagtgaatctaatccaaattttgacaagaaactttacaacggtatcaaaaatatctttaaacaactgtatgtcataaatagttgcaagttttgaaagcccagttgaaactagaggggcccagaaattaagcaaacatcaaatagtcaaatacaaagaaagtgtgaaagttaaaaccctaaacccttaatttgagctctctgctctcctggttttagttttcctctatttcgtgctcaattcgcttgttctccagttccactctgtaaggatctgttacttttctgtaatcctctcaaaattcaatgcttttgcttactgggtctgatctttgcaagtgaaatgcatgacatttcgtccaaaatcagaccttgcaaaaatggtttcttttttacctaatctgtttcgtctgtgtgttttgatctttacaaaagcagatcagtgccggcggcgatattgtccgaggataaaacatg

SEQ ID NO: 24266 - DNA, 3003 bp, Unknown
  misc_feature (1)..( 3003): 2750-1469P.txt file - cDNA_ID_2172582; gDNA_ID_1620824; Annot_ID_169627
gattccgggagagagttcccggcccagacgtagcaccgttggtgtgaactgggttaccattgtgtgtgtgttctgttctgcatttctcattacaaaggttctgtttttggttctaagtcgaagttggttctaaagctgaaacgttcttggtttgtggtgtgttaatcttcacaaaatatataacttcaaactttaaaagaaggaaaaaaaaatcggtgaaatttatttgaaaaagcaatttggaataggtcgaacagaatgttataaaagctcgttgttgacatatatataattcgtacgaatgtacttcgctgactttacttctacttacatcatacagaatacgaatccttttgataaaagttattagtcgtgttgatttcgaaatcgcacaaccactgttattatacaatcactaatccaaaaccacctcattcgttgttaaagctaatataaattcatcctaccaaaaaaaagctaataaaaatttatttggaaattgcaacgaaagatcttaaaaagtttaatgttttatatattcggattatgttatgattggtatatgaatcgttttagttgaattggtatataatttggtggtcaagtaggtttgcataaaatttaaatactagctagctttataaacttacattatacataagcacatgcctctcataacatatattggattttggccttttggtcgtttgagtcaagcaattaaaattttatttgaagaataaatttaaactatcaatattcaatcatgccagacgagtcgttaaaagtcaatggaattattggttgataagatgagatattttcgatcgttcttatgactatctagatatgaagatgagtcatacaagctatgagttcaaaaacggtgtaattttgccttgtttgaaaggacacaacaattatgaaattgtgttagtttaataaaggtttatgagtctttaagtcaagacgacgtgcataatcatatggaatgaacaaataattaatcttgtaagcttaatattgttactttgctagtaagttctgaatttaactttgaccaaaactaaaaagttttgaatttgatattcactttgttatacgcatattttagaatagcaatgaaattggaaaatttaaaagtagtattgattttttttttttaatcaaaggtttgttttcattccattagagtagctaacacatacaaggataaaaggactctaagatcccaaaatttagaacaacataataaagggtataccccaaaattactaacatgaaaataagagagtagatagagttaatcgacaaattatcttttgagagctttgaaccaaaagctaaggggctttgtagaacatgtaaggtcaaggtttgtcgaagtttcttccaagagcgagtcattgggtgaacgaattgttaatgtcgagagatgaaatatcgttgatgagggggctaaagataagcttctcgccgacacgaggagaactacacaaaatagtgatttagcaactgttcgggcaatggtggtggtgtcgcagtgagggtttaagggcatttgaccaatgttgagcaagtaaacaaactcgcaacttacggtatttggtgaagctattataagggttcgcacatggagagagtgtaaagccgtaacataataggtggatcctctctcatattgattatgacttcgatgatgctaaatcacaatttggtattgtgcatccgttcacaaaagttaattaaatcattcgaattgtatgttctttggcgacccgtacgatacttgtttgttgataatccacacacatgggctgaggaaagttttaacctacggcctaagtactaatcacattctttaatcgaacttaaggcccaagtgctaaatcacgacacattcttttaatttcatcagagagacaataaccgtaacagcgcaacaaataacaaactttaaagacaaaatgtatttccaaagagcaaacgtgaaacagaaagatcgtggtcataaagacaacatcgtgggttcaagatgactagataaacatgagttatggaccttacggttttccaaaaatccattttttaaccattcattattggattctaagaatttttactaatttcttaacaaaatccaaaatctcatttcaatgggtttttttcaatttcctctacgagatccttttttctttcaattttccatttgattttttttttttttttttacttttgttacaaaatccaaaaaccaaaaactaaggccatgaatgtttgtaattttaaaaatggtttttggattttggtttttggtttttagtttttgattttcttggtttttgtttttggtgtagattttagtttcttaaaaacttgaatggtagtttgtttagattttggtttttatgttaatggataatatttttgtaacaaaaaaatctaaaaataaaataaaagaatgtaatggatggttttatgattttggttttctttgaaaaattgttaaaacactcaaacactagattctctattttttagaaaaacttatttttttcaaaatcttgaatggatataaaatagattttgaaaaaaactaaaccaaaatctagtttaaaaaccacacccattcaaggtcttaaaactaaaatatttatgtattagttttaaattacaaagataataaaattgaggacagttgaaaaagaagaaaaaaaagtttgtatgtatttggaagttatttttctcaagtagaatactgtgaaagacgattcaacatcccttattttacggttgtgtcaaggaacattcgagaactttttttaataactccttaagggacaagttctctctgtttttcttttttcaatagcttctctgacactttattctttctttctgatattataaacctccgatttggtttagttcaaaactagaagcagcaaaattctgaacacgtaaagctttgtttcactcagtgtttcccgatcagatccaatg

SEQ ID NO: 24267 - DNA, 3003 bp, Unknown
  misc_feature (1)..( 3003): 2750-1469P.txt file - cDNA_ID_2172586; gDNA_ID_1620824; Annot_ID_169628
acgaatttgtaatctcttttgagcaaaaactacgtcttcttctttttttggtattattgtatttcagactctgcattcagtaattatttcatattttgctaattttgtttctgagttttgttaaaatgctttagatctcggagattagaattacatgttcagtgtgtgtctgaaatttagtaagtgcattaaccatgatcatgttcggtcgctactgaagtatgataagctctgtatcattcaattacttcatcattccttccacttttgccccttgtggactaccacagatgttacaagacaaaacataatctgtaaattgctaatctctgaacctaagacttgatatgaaacatttatttttattcccaatcgttttataaagattctgttgcttgcacaatctcattcaccacactactcatgtactcccaggttaatcaatcaagtttatttgtgtccgaaaaaatggaaaaatatgagaaattcccatccaattttaaggattgtttgaatgatcaaagtatggttgttttagagaaatgaccttaaacacccaattttacgttgttctcgtccaaaactagcggaaaatttataaatttttcaaataccacaagatagtaagagtttgtaagttatggtaagttcagaagaaaagaaaaatacataaatgatagttttttgagaattgaatgcatatttcgtcttagagtcaattagttacaattaacatgattaattaatagttattttgttgttttgttatttgttgtttgtatgaaatggtgttgttatatatacattggatactcttatagaagttgaagctgcaatttcttcgttgcatgacttcaacatttgatactcgttagtcaaaatctttttcgttacatcagactcgatcaggccacataatcatatttagaactaaattacaatcaattacgtattgttccaaacttccaaaagataattgaccacaaacactcatttccaacagaacatgactattactgactgactcacaagcatacactaataactatatccatttctcaacatatatctttacatccatttctcaacataaaggattgaacaaataacttaatttttcatcaaaattaacaataaccctatccctatgaattctcaacaaaaaaaagtttaaaacaacactagctacgagctctcaaaatgtttggtcgtgtgttcgagaacatttatataattaagttttttctcaacttatataattccatttagtgaaaaatctatagatatatttatataattaagttttttctcaacttatataattccatttagtgaaaaatctatagatatatttaaaaagtttactatttctttttggcggtttagagagcaattgttttttttaataattgagttagtatgtttgagtggtcgaactacgtattcactaattaaagacattttaatcttgacatagtcataccattttacataagtatggctaaatcaaaattaaaatgatcttaattagcgcagtgcctaactaaagttattttaattttgacatagtaaaagtctagtttatacaatcgcctttatagtgtataatgtattaaataattctaatcaagcaagtgttttacgcaactgatgcttttgttgaaatacattattagaatttagattaatatataaaccgatgtgaacgttatgaatttaaaacggtgttggctagtgaatgttgtgaaataaatatcagtaaattatgcacaagtcacataactttcagagattgtgctacactgctacgcctatcattcagcaacatgattttttatctgtctagttatctcatgttatagcggtttagtcgaataatatatgattaatcaaaattttacacacaaaatatacgttcgttaattgtatcacatcatcaataataaaacaaaagatcttttgactcgagctaagtaaaccacgttacatacgtaattgattctccaatcttctttattacctttttcaaaaagtatgcgtatgagcgaaccgatgagtaagtaaaagtgatcgttgatctgttggagatgagagtttgtgtaattgacttcatcaatctcttaactaaaaatagcaatgcgtgagggaaatgtttttcaaaagatgaaaagacacataaaaaccaatggaaaatacaacatcaaaagattctttacataaaatggtaaaaagaaaaatttacaatcaaagttttctttttagaaaactggaaacccacgctaatgcgtatacaatactcatcagtatatgatatatcaaatatatagccacatataataagtccattattaaaaagtaccgttattatcatgaccaaaatttaaagacaatacacacgtacaactaatattatttattaagaacataacaagtattattattattagaagtagaaatttttttccaaaagaggaaaacgaaaactttaactttatttacttacctaaaaaccttaatttttgacacctctagtgggttattataatgtcgttttcgatcgaaagtgaaacagagagacagtggacgcaagaaaaaaaccgtgggtggatgaaagaaagtaaacatgagatttttgtttttctttgttaatggtttccttaaataaattacaaacataattataattaagaagagagtttcaaataaaataaaatgaaatgccacgtcttacagttgcatctgactctgttttatgttaattgtgacacaagtttaatacagttgtactttcttactttttggtggtttcgtggaagattacgacaactttacaaactctacgacttaagcttctctgttcctacaccttttgttcttctatttaaagccctctgatttgttacttcacattcacaagttttgaaagcaaacacataaagaaaattctagttcaatcttttgtcactcaagagtcttcccgaccgtatccagtcaaataccatg

SEQ ID NO: 24268 - DNA, 3003 bp, Unknown
  misc_feature (1)..( 3003): 2750-1469P.txt file - cDNA_ID_2172593; gDNA_ID_1620824; Annot_ID_169630
tagccgagaccaaacttggtctagtgactcagtgtttcttgaccatatctgccattaaaggagaaaccgtttctgatcagtacttggcaaatctcgccctcaagataaacgcaaaggttggtggaacgaacgtggagttggtggataatattttctctttcttcaaaaaagaagataaggtcatgttcattggtgctgatgtcaatcatcccgctgctcacgacaatatgagtccatccattgttgctgttgtaggcactcttaactggcctgaagctaaccgctacgcagctagagtcaaagctcagagtcaccgtaaagaagagatacaagggtttggtgaaacttgctgggagcttatcgaagctcattctcaggcccccgagaaacgacctaacaagattgtgatattccgtgatggtgtcagcgatggtcagttcgatatggttctcaatgtggagttacagaatgttaaggacgtttttgccaaggttggctataatccgcagataactgtaattgtggcacagaaacgtcatcaaacccgtttcttccccgccacaactagcaaagatggaagggctaagggcaatgtgccttcaggtacggtcgttgataccacgatcattcacccgtttgagtatgatttctacctctgtagtcaacatggagcgataggtacaagcaaaccaactcattattatgttctttcggacgaaatcgggttcaactcgaatcagattcagaaactcatctttgacttgtgcttcacgtttactcgctgcaccaaaccggtcgctctggttcctccggtttcttatgctgacaaggctgcttctagaggaagggtgtactacgaggcaagcttaatgaagaagaattctaagcagtcgcgtggagcgtcttcgtcttctgcctcggttgcctcttcatcctcttctgtcacaatggaggacaaagagatcttcaaggttcacgcaggcatcgagaactttatgttctttgtctgaaaaaaagtttgatcttaaaatatttatctaaataagaacgtctcattaacgcagttcttactcctttttctgattagaaaggatgtttgtgcgtgaatctaatcgttagatatgcagtttgtttgtttccttttcgttgttggtgtgttgaaaatagtttgtatttggtattgtaatgctctttagagctgaaactatgtcatgttatggtattttattatagttttcagactttggattcaataaatagttcatattttgctacttctctgttttgtgaagggcttgagaactcagacatgagtactctagttttgggtttacatgttctgccttgtgtctgaaattccttttttctaaaccatctattcatgtggaacattatctataaggttattttgtgtaatgatcaattgatcatgcatctctactttttttttttttttttttctttttttttttgtcgtcgatcatgcatctctactacatatgcattccaacaaaaaaaacataatggtgctcttgttttcgatataatatcagttatgggctctctgtttttattttattttattggaccttactgatatttcttgggttcatgaaccatagctataccaaatcattaaggtggattttgcacgatttctcaatgtttaatttcatgtattatatactcattgattggttgtttgcagaatcttatttactacattgactctcaagagtcccctcctatatttcatcaaatctatcttttcattttataatttttatgtaatgatagattcctcataaatgtttcttgaaaactataaaaaggtaactaacatttttttcctatatatatatatgtgtgatatatatcccatataaaaagtagcaacaagaaaatgattttagagaagtgataccaaaccaaatgaaaaagacatgatagtcgaagtgattcacacgaatcgaactataataatctatactctatcttattcacattttatcatctttttgtgtttcatgttattttcttatgtatatattcatttttcgtatattcttttgtttttatcaaaataaattcatttttctttttaccccactcattaacataagttagccatatattattataagatttttttcttgccaaataaatgtaagagtttctttttcccacaactcattaacaaagtttggcatatgtaaaaaaaagaatgaattttaaacctaatactagcctttaaaattcaacaattattttatttttattttcttattttcgtgcaacagctggagtgttttttttttttttttttgtgttcccagagatcgagtgttttgtgtttcttctctctatcgttcacatttgattaaagctaaagctttcttcttcttcaattgatgctacttctgatttaccctttctctgcttttttctctcactctctcagttttctcctccttgattcctaaagtcttctcctttgcgtgcatttcttcaattttcagattcttcctaaggtacccttctcaaaattcttccttgttttgcgattcttcatcggttcaatggatcctctttgacttcgattttgaatccgagcttcgttatccctcgattgctaatttcactcttttgtttaggattctttccccaatctaggtattgctttgcttctctgtatctatcgaatctgcattttgttagtttcgaaaattttgaaattagggttcatttgtgatttgttcatacatctttgttagattgcagaatctgttcatcatttttcgaattcacataactcagattagtttgaatctattgagattgagaaatttcttaaaaactctggatttgtgtggattaagattagtgttttgagattgatctctttgtcaatatggttttttttggtgtaggtggtagaatgatgaaatgagaatcgatagataagagtttaaagagcaccagaatctttgttatcttgcaatg

SEQ ID NO: 24269 - DNA, 3003 bp, Unknown
  misc_feature (1)..( 3003): 2750-1469P.txt file - cDNA_ID_2172606; gDNA_ID_1620824; Annot_ID_169633
cattttaggttatattttcctagacaaagaatccatagggataaggagtgaatcctgaacaaaacccaattgagcccaatgaataaaaaagacatccaaagtaggtttgaaggaaaggatagtccatgctccctccatgtagagtgagtgatggtaagtaaatgtgtcttatgaagctatcgacaccaagttggagataaacaaaattgaaaagccaatgtacgtatgatgttgattcaggattaaaaatttataatatggttataaagtaacatatatcgtggatttgaaatctgaaaaagtcacgtactgtatgttgaatatgtaaggtgtgttaattgtaaatcattatataataacaggttcaaagaaaacgagtagccacctgccgatgcaaatttttttttgccaattacagacaaatcaaagatttgggattggagaggagaagatctattgaaaccgacacattaggtccaaaacatttcattttaattattatgatttaacgaaatagtaaaatacatatatcaacctttttggtccggtccctgttcttacgtctgtgatcataaagtatagagtgattttttattttttttcattatacaaattacaaatgactaatttaattaattagtgaacttttaatttgtcgataaccaataagaatgatggaaaacggcaaaagagtcgactgttgaagtttgtcggaaagacactccaccaaaatataaatacaaatcttatcactagtggaaactgtcgagtgtgtgtagttctcttttccttctaataaaagaatattatctttctaaattcttccaaattcattttggaattttctttcctttttctttttgttgacatgaaattttggagtcttcttctatcgccaattacgactaaaaaaacgattttatatatatcaacatagctctaacaagaacatgataatcgcaaatatacatagatttgcctatttgtacacaagcaaagttagttttaatactcagtatattacatctcatgaaaagaatttacagttttttctattaaagctgtgggagttttcttctaaaatgtttttttttgtcgtccttgtaaaatgttctacattcgtcattttcaggctatctttgatttcgaaagctgtgggcgttttctttttttaatttttttaatttttttttttttttgtctttttctacgaaaataaaatagcgtgcactgtattgtttctttcaactttattttttgactagtgaaagactagacattttgttgccctgcccctatattttttgtgtttattttaaggttgttttttctctttttataatgaccgtaaaatgagtttttacaaaatctgcttcaaatatgtaatgaaaaccttgataatatgtaaatgtactaaaaacaaaatcttgatatgggtacatgtgaaaatagtatatttctgttctaagaatatactgttttatgttctaaaatatcaacaaatagatatctttgcatttttttttatacatcaatattagtattacctacattgtctaagagatgtaacccaacttatgtcgcaactagaactacatctcagaaatcaccgagccgagagaaaattgtaagagtcctcgaccagcaaaacgtaggaacatcaactcaaagcagtcgagaataagaaccactgacttgcatcaaaacagaagatctaaccacaccacacagaatccgaaaagaagacatccaccatcgtttaaactttcaacccttgacccaaccaccggtgataaagacttgtccattatagtttactaaagtttatgatcaaacttaaaatatctgttgttagattgatacctctaattcctttgaattgcttcttagatttccactttacccttccacgatttttaagcaatggaaaattaagtttcatttgtttcagattttaatattaatccccttctatgcaaattgagggaccacgtagaaagttgtgagaatctcaatacacaaaagatatagaaacaatgattacatgcacaagcacgaggccataaatttccttatcctatacacattttcaataaagatgtaacattccaaacagaaaaccctcttgtagctcactctacaaaaaaaagagtatagaattccaatattaaagtttataggtcgactatttcaaaaccaattgctataaagtaaattgattaatatttttatactttcttcgatttataatataagttgttttggaccaatttttttgttttacaattaaattgtttttaagtttttatgcaaactatatatttattttaatattttataattatttatattatgcagtctcttttgtgattggttgaactttttaaaagtaaatattcttaatcttcgtacttttaggtaaaacaacttatattgtgaaacggagggagtatatcatttacaatttctctttatttagttttgtggtgattccgaatattaattacaacttgtaccatttaattcaaccatattcgaagaaaacattaaaggcaaaacaaattaaggggaaaaagaaatcaaaagttaaaaaaaaaaattaagaccaatgagaatagataaggggtaaaagacaaaaagagaatataaaaaaaacaaatagcatttggcgccaaaagtaaaactaaaatggtcatgtcacgtgatgttaatttttgctctacgaccaaagcaaaacaaacctaaagttttccaaatctctgggtcccactctcagatgtgctgacttttattttttttacttttgtcttaaatctttggaaattttcagttttaatttaatttaattcatctctctttctcactctataaatccccacagatccgtcacacttcacctagagaccctcccacagctttctcgataactgacaatccaacggttgagattcagttcttctagataaattcacatatccaaaggacacgtggcggcgagagatg

SEQ ID NO: 24270 - DNA, 3000 bp, Unknown; identical to SEQ ID NO: 5904
  misc_feature (1)..( 3000): 2750-1469P.txt file - cDNA_ID_2172610; gDNA_ID_1620824; Annot_ID_169634

SEQ ID NO: 24271 - DNA, 3000 bp, Unknown; identical to SEQ ID NO: 7244
  misc_feature (1)..( 3000): 2750-1469P.txt file - cDNA_ID_2172709; gDNA_ID_1621134; Annot_ID_172591

SEQ ID NO: 24272 - DNA, 3003 bp, Unknown
  misc_feature (1)..( 3003): 2750-1469P.txt file - cDNA_ID_2172861; gDNA_ID_1621125; Annot_ID_172239
gcattaaccagtgtatactctacaactatttgttcagattttcaaaaatgttataaaaatttgatataatgaaaatatgcatttgagtttgtgtacagaggaaatactacattgctaatatttgaaggcaaatgtggatcttgaatcagaagaagatatgatttagaatcagaagagaattaaagccataaatgcaatattgcacaatgattattttatcttatgttatcatcctctaatatgcatgtaaatgctaacatgcatattctttattatttacatggtaattactaattagcgtaatttgatgatacacaatcattttttttttgtcatcgatacataatcattcctatccatatatctcaacattaacttttaggtaaaaaaattggaaatcatttgactgtgtcttgattataataaagacataatatatccataaatgctgattggtgatcaactaggtgacattaaagtcaaaaactctattcgtgataatccaaacaaaggaaaaatacagaaaagaaaggtgtacttaccacaagataaccaaagaaacaaacaaaccgaaattttttctataatactttgtatatatcgcatccaaaattgttttataccgcatgttttcattaggaacttaagtggcttatgagctgacaacatatcatgaattttaaaaatatatcagttcgattactatagtaatattttaggtagacaacaaataacattataaaatttcaaacacttaaaagatcaaatttacttaaatttgcaatgtacaacacaattgacaattttaaatggagacgtaagatgtatgacacctaaatttgcatatactgatatatatacatatctaaatttgttcctcaccatgttactataaagattttctttgttcctcaccatgtattggtcaaacgaaccttcatagcttctgtcatattttgagagttttattcaatattcataatccgagttgtggtcaacacaagttgttaagcatcacttctccaccagaccgattaaacttctttctttattcaataatcaaatcttctgataactagtatacaaaaagttataaacttaaatagttctccatctgtcatgtaatgttaccaagagactattactaacagtaccattgcaaaaggctttcaattccgttgtgtagtaaaaatgataggtccaaatcggtgcccaaaaagctggtagacaatgttggatatatatgtaaatatatttctcagaagattaaaaatacttgtaattctcttccttttttctcttataattgatgtttgcattcagctgttgcctgatgatatgacttcacattgttattgtattggtttacaaatggttttaaaaagcgaaatgttgtagttagtgaagataaaattacaaaatttctagataaattatacaaaacgtatgagtagattgtttccaattacaattcttgtgctttatataaacaactacaattattgatttatgtaaatttttacgaactatttatgtatatatgatttgtagacttgtagtcttctttctctctaaacgaggttcaaactcggagataacttataaaatgtttctatatgcataaaatcgagtttgattatgttataaatcacaccgcaagtgtatttatgaaacaatggggattgcgaccctaattctattcctaacaagtagacctttaaccatcgaagtcaaaacaataaaaagtgctggcgtaatgatcggcagatccgaaggaattgcgatcattaatggttgaattttatgcaacatgcacgatctatatttatggggatttgatgcaaattattttaatttcacttatgactacggtcgattaagatttaacgaaaccatttacattactatacattataatagtcgaataaaggcctttgtaaaaacgtccatgggcttttgtaaagaaaactaaatggagaaatgtgctgaagctaaacgaatccaccacattaattttcctacacgagtttctcctattttatttcctcacctacatgaatcaataaacttaacactatcgcgcgacccatgggctaagtagctgatgctttttagcgaagggcccgcaggcaagaagagcaaaacattaaaacgcaccgttttaaaagttgccgcgttggaatatcatctgcgtgtcgctagtcaatgggacatcaaaatttcattattcaccgtccatgactcgtctcccaccagcttccttccacgaaccaaacttggtttcaactttcattattaatctttttttttttttttttgcaactttcattattaattatttaatgttctcttacctgtacaaaatttagctaatttcatatttaaaaaagaattgactaaaaggaaagaaatcccaaacaagataaaattaataaattttctacggactcttgaccaaaaccaaattctattctccctgggaacaaaataaagaatttattctaaaaagtaaaaaccctatatatataccaaggaatcaatagaggatcataattttacacaccttttttttttttttttttaataatatagctctcgtcgtttataattttttttttttcgtctggggcaaattgtaatctagaaacgacaggaaccaaggtttggatcctccccctcgaactctacgattcgttcttattctcaatctctcctccttgttgttgttgttggatattgaattctcggattgaaaactcgagatccgtgttctgtttttttttccttcccgattcaacacgatcaattggcaattcgttgtttgcgtttcctgatccgttaaagttgattgcttttttattaaatctgcaaaaatattctgacttttatgcttttggatttaggtagctttagaaattggacgatttatttcagctcattacgatttgatttgaaagatcgttttttttttgttcagggttacgaaattgaagatcgaagatg

SEQ ID NO: 24273 - DNA, 3000 bp, Unknown
  misc_feature (1)..( 3000): 2750-1469P.txt file - cDNA_ID_2172861; gDNA_ID_2926198; Annot_ID_141373
ttaaccagtgtatactctacaactatttgttcagattttcaaaaatgttataaaaatttgatataatgaaaatatgcatttgagtttgtgtacagaggaaatactacattgctaatatttgaaggcaaatgtggatcttgaatcagaagaagatatgatttagaatcagaagagaattaaagccataaatgcaatattgcacaatgattattttatcttatgttatcatcctctaatatgcatgtaaatgctaacatgcatattctttattatttacatggtaattactaattagcgtaatttgatgatacacaatcattttttttttgtcatcgatacataatcattcctatccatatatctcaacattaacttttaggtaaaaaaattggaaatcatttgactgtgtcttgattataataaagacataatatatccataaatgctgattggtgatcaactaggtgacattaaagtcaaaaactctattcgtgataatccaaacaaaggaaaaatacagaaaagaaaggtgtacttaccacaagataaccaaagaaacaaacaaaccgaaattttttctataatactttgtatatatcgcatccaaaattgttttataccgcatgttttcattaggaacttaagtggcttatgagctgacaacatatcatgaattttaaaaatatatcagttcgattactatagtaatattttaggtagacaacaaataacattataaaatttcaaacacttaaaagatcaaatttacttaaatttgcaatgtacaacacaattgacaattttaaatggagacgtaagatgtatgacacctaaatttgcatatactgatatatatacatatctaaatttgttcctcaccatgttactataaagattttctttgttcctcaccatgtattggtcaaacgaaccttcatagcttctgtcatattttgagagttttattcaatattcataatccgagttgtggtcaacacaagttgttaagcatcacttctccaccagaccgattaaacttctttctttattcaataatcaaatcttctgataactagtatacaaaaagttataaacttaaatagttctccatctgtcatgtaatgttaccaagagactattactaacagtaccattgcaaaaggctttcaattccgttgtgtagtaaaaatgataggtccaaatcggtgcccaaaaagctggtagacaatgttggatatatatgtaaatatatttctcagaagattaaaaatacttgtaattctcttccttttttctcttataattgatgtttgcattcagctgttgcctgatgatatgacttcacattgttattgtattggtttacaaatggttttaaaaagcgaaatgttgtagttagtgaagataaaattacaaaatttctagataaattatacaaaacgtatgagtagattgtttccaattacaattcttgtgctttatataaacaactacaattattgatttatgtaaatttttacgaactatttatgtatatatgatttgtagacttgtagtcttctttctctctaaacgaggttcaaactcggagataacttataaaatgtttctatatgcataaaatcgagtttgattatgttataaatcacaccgcaagtgtatttatgaaacaatggggattgcgaccctaattctattcctaacaagtagacctttaaccatcgaagtcaaaacaataaaaagtgctggcgtaatgatcggcagatccgaaggaattgcgatcattaatggttgaattttatgcaacatgcacgatctatatttatggggatttgatgcaaattattttaatttcacttatgactacggtcgattaagatttaacgaaaccatttacattactatacattataatagtcgaataaaggcctttgtaaaaacgtccatgggcttttgtaaagaaaactaaatggagaaatgtgctgaagctaaacgaatccaccacattaattttcctacacgagtttctcctattttatttcctcacctacatgaatcaataaacttaacactatcgcgcgacccatgggctaagtagctgatgctttttagcgaagggcccgcaggcaagaagagcaaaacattaaaacgcaccgttttaaaagttgccgcgttggaatatcatctgcgtgtcgctagtcaatgggacatcaaaatttcattattcaccgtccatgactcgtctcccaccagcttccttccacgaaccaaacttggtttcaactttcattattaatctttttttttttttttttgcaactttcattattaattatttaatgttctcttacctgtacaaaatttagctaatttcatatttaaaaaagaattgactaaaaggaaagaaatcccaaacaagataaaattaataaattttctacggactcttgaccaaaaccaaattctattctccctgggaacaaaataaagaatttattctaaaaagtaaaaaccctatatatataccaaggaatcaatagaggatcataattttacacaccttttttttttttttttttaataatatagctctcgtcgtttataattttttttttttcgtctggggcaaattgtaatctagaaacgacaggaaccaaggtttggatcctccccctcgaactctacgattcgttcttattctcaatctctcctccttgttgttgttgttggatattgaattctcggattgaaaactcgagatccgtgttctgtttttttttccttcccgattcaacacgatcaattggcaattcgttgtttgcgtttcctgatccgttaaagttgattgcttttttattaaatctgcaaaaatattctgacttttatgcttttggatttaggtagctttagaaattggacgatttatttcagctcattacgatttgatttgaaagatcgttttttttttgttcagggttacgaaattgaagatcgaagatg

SEQ ID NO: 24274 - DNA, 3000 bp, Unknown; identical to SEQ ID NO: 24273
  misc_feature (1)..( 3000): 2750-1469P.txt file - cDNA_ID_2172861; gDNA_ID_2926198; Annot_ID_201612

SEQ ID NO: 24275 - DNA, 3003 bp, Unknown
  misc_feature (1)..( 3003): 2750-1469P.txt file - cDNA_ID_2172926; gDNA_ID_1621125; Annot_ID_172265
tttctgcaggatgtgatgagaagtttagattgcacgggactagacgataggcgaaaggtgaatgattacgcgatgagcgagtttgaaaacttggtcctatgtgtttaaaggtcagttcctgattgcagtattcggatcatttaggtagaaaaaacaatgtgaacaactgcagagatacattaccagattgaagtctgtatttttcttctctttgtgtgtaaatatgaaacgaaggcggtcaaattatatataagcttcttctttcttccgttcttatgaagttttatgcaatcatagaagcttcttgtttgctgcagagttctgttataagtttctacttttgatagcgtggttatctgaattccaccaagtccatttttcctcttactatataaatatcgagtaatttggctcgagttagttcggtttctttcagggttggtttttcttggcagccgatgaattcttggattcatcgaagtagccatcaattagtaggggttcaggtttttgttgaattgtgcttagtagtttgggatatagtagtgaccatattgtcatttttagttgttacaaggctctgaagtctgaaccatattatatataggaagaattcatcaaggtgcgatgatatttctatcatttgttgagatcaaaccttcgatttatacattttggaataaccagagtcgcagtctcacgttttcatacctaatgatttagagtgttcactcaatctccaagttagagcaggctaatttcggcaaaactcttacctgcaaaccattatttggtatatgtgagtgtacataaattgtcaccggaattaaaccatcaaataacttgtcacaagcactttttctgcatatccgaattcgatgatgtgaagaaaatggttgtaccaattttcaattgcacatatgtctgtcattttcagattatgttacatgtaaaaaccaagtatggttattatattttgttttcaaaatgagaatcaaaataatagaaatcagtaagtatttcttatcatggtagtttactttgattggttatcttattctgtgtaagctctcgacgattttattcatattttgaaatactatacaaaagtcatgatgtgtgtacattttccattaggactttctagacttgagcattattttccttgatagcttcatcgacgtttaggccctgaaatccaaataaacaaactcataattaaaatcctgcttttctaaagtaacaaagaatattaagtgataaagattgggagaaataattacggaaaataatcaatgttaataatcccagcgacaggattagcgatctgagcaaaagcttctcgagaaagatcgagcgtagaagcacagccactgggacaatggtcaacgatcttgaccttcacggatttccccgtgcaagggtgaggcacggcgttacgaggtccgctgcatttcacggtgaacattttgccacaaactcgaccattgtcccataatgtatcactcgctgcagcgatcatcactccttcttgagtacctctgtaacatgctgatgctatcaaacatgaaataaaagaaaatgattttataacatttcgctgtaggttgatatgaaaatgtataagataagtttgttgtttgtatttgttttataattttggtagtaaaacacacaaaaattcttacgagtgtaacttgtgtaaaaagttgcaatcccgggagttgcatatgagaaagagaagagaaaaacaagaacggtagaaaaaaacacaatacttttactcatgattcgtatttatttgtaagagtgtttatctttgaaatgtgacatatctatttatatatctgctatatattatatgactaactctaaatatgcatgtattgtaattgtttgccattgaaatatctttgactgttcccattttttaacatgtgtatagttgtaaatttgttatatttaatttcttcttatctgtgttgactaaaggtttagaaagattgttatcctcatttgatagcaaatttacagccaaagactccagaaaacgtttactaactacgctgatcaaatttgccacgtaaatttatatgaacaatctcataaaaacaattcatcaaaaggaaaaaaactctccttttataggtcctaaatgtagtgaaatcaatatttatggactagtacatatggaacagttatgaggcgagcgttaatgggccgaacgagacgataagagacattattctaaaccaagctcaaccacgaagataaccggatcataaccgcaaaatgaaccggaataaaacgtgagaaacaacgagataatattaaaaatgatgcaaagaatttctgaatgtaaaggtaggtatggtgacataaggaatggagttaccgaggaagctgcccttgtcggattgtccttatcacttcccactcggcattaccagataggaagctcagaggacagagataataattggaacccaaaactgaaccctattttatataatctcatcaccaatactttatccttaaatgaagtctggtttcgccctttgttttctcctctagttttcttgtaacgccaaactacattctgtatgatcaaaatttagtaacataatttatcagaaccccattgttttaaaacgtgtctgtgtatttgtgtttatatacgcttaatcttcttctttctagttaaatttaatcaatttaatgaaaaatttggtatataaaaaaaaagactttgctcacgagttcctctcataagggccaaaactagttaaaaagttatcgtcaaaaactgatataaaaaagatgtccgaatattcccgcatataaatatctatcagacaaactcttttgtacaatatactttgaatccgataaattttcgatcttcaaaatccataaaaatctctcctttatttagccctaaaacagagtattagagtttgattcgtaaaagagaatatttttaatctccgccgcaagtcgatg

SEQ ID NO: 24276 - DNA, 3000 bp, Unknown
  misc_feature (1)..( 3000): 2750-1469P.txt file - cDNA_ID_2172926; gDNA_ID_2926198; Annot_ID_201586
atgtatcactcgctgcagcgatcatcactccttcttgagtacctctgtaacatgctgatgctatcaaacatgaaataaaagaaaatgattttataacatttcgctgtaggttgatatgaaaatgtataagataagtttgttgtttgtatttgttttataattttggtagtaaaacacacaaaaattcttacgagtgtaacttgtgtaaaaagttgcaatcccgggagttgcatatgagaaagagaagagaaaaacaagaacggtagaaaaaaacacaatacttttactcatgattcgtatttatttgtaagagtgtttatctttgaaatgtgacatatctatttatatatctgctatatattatatgactaactctaaatatgcatgtattgtaattgtttgccattgaaatatctttgactgttcccattttttaacatgtgtatagttgtaaatttgttatatttaatttcttcttatctgtgttgactaaaggtttagaaagattgttatcctcatttgatagcaaatttacagccaaagactccagaaaacgtttactaactacgctgatcaaatttgccacgtaaatttatatgaacaatctcataaaaacaattcatcaaaaggaaaaaaactctccttttataggtcctaaatgtagtgaaatcaatatttatggactagtacatatggaacagttatgaggcgagcgttaatgggccgaacgagacgataagagacattattctaaaccaagctcaaccacgaagataaccggatcataaccgcaaaatgaaccggaataaaacgtgagaaacaacgagataatattaaaaatgatgcaaagaatttctgaatgtaaaggtaggtatggtgacataaggaatggagttaccgaggaagctgcccttgtcggattgtccttatcacttcccactcggcattaccagataggaagctcagaggacagagataataattggaacccaaaactgaaccctattttatataatctcatcaccaatactttatccttaaatgaagtctggtttcgccctttgttttctcctctagttttcttgtaacgccaaactacattctgtatgatcaaaatttagtaacataatttatcagaaccccattgttttaaaacgtgtctgtgtatttgtgtttatatacgcttaatcttcttctttctagttaaatttaatcaatttaatgaaaaatttggtatataaaaaaaaagactttgctcacgagttcctctcataagggccaaaactagttaaaaagttatcgtcaaaaactgatataaaaaagatgtccgaatattcccgcatataaatatctatcagacaaactcttttgtacaatatactttgaatccgataaattttcgatcttcaaaatccataaaaatctctcctttatttagccctaaaacagagtattagagtttgattcgtaaaagagaatatttttaatctccgccgcaagtcgatgtcgataacgattccctacgatggctcaatctcccgcgagccatcaccgtctccaccgccgccaaaagcgaacacgaagaatctaccgacgaagattctctctaacttcctcataggtctaatcatgatccctgtagctataaccgcttttatctttatcctcacgtctctcggtttcaccttcttcttcgctttctactggtttcttcaacgaaactatcgccaccgtctccgccgccatcgccgtcacgaatactcagatgggttatctccaagatgcgtgaagaggcttcctcaattcaagtattgtgagcctagttcagagtacggaggcgatgattgtgttgtttgtatcgatggatttagacaaggacagtggtgtcggaagctgcctcgatgtggacatgtgtttcaccgaaagtgtgtggacttgtggttgattaaagtctcgacttgtccgatttgtagggatagggtttatagatttgaagaaggaagaagatggagaccacaaggtgaaattttttgatcggtggttttataattagatttgaaagtgtgtttagtttgttatcatatttagcagcaattttggttttcatcaatagtcatgtacagtgtcttttttttttttttacacggcttcacaattgaaagcttgtttcttcaccgtttgatgaatttgatccaataagagaatgatgggtttctgtagaatttaacttagtttgaggtttgattatcatgccaattattaaattcaatctagtcaattactgatagaaatgttgtccatttgtcactttaaacatgttgcttatgttaccttaatgatttctcataatttcacttgagattcagtggttaatcatcaatgtttctgtttcaatttgtccatgatgaagtataagttctaagtaaagcttggttcatgtgattttaatttacctacttcacctccaaagttatgtcaactatgttttcaagtgtgtgattcaaaagtttatattgaacataaaaataaaggaggctaaagaatcgttttctgattggaatgtgagattgtgactcacacggagaaagtgattgtgattggatctgactataagactaaagaagtgtttttgtgaagtaacaagtaacattgtctaattagtgttttgtattgtaaactaataatgactttgattaacgaaataatgtcactttagtcaaatgtgttgactttcttgtcttataccgatggctcaagtattcccaagaaaaaaaaacaaatatccctccgatttctgactcgtcccgtgactcagtgattctcctcttccaatcctctccggaagaactaaacaaaaacacgatctttctcagatttagagagagtaagagtgagagagtgtcagagacacgaatcaaagaaatgatttttaaaagcttctgttaattctaatttgcatagatttgtttactcgagcttgagcttgagcttcttctaatg

SEQ ID NO: 24277 - DNA, 3003 bp, Unknown
  misc_feature (1)..( 3003): 2750-1469P.txt file - cDNA_ID_2172943; gDNA_ID_1621125; Annot_ID_172268
gcaaaacattctgtagacgactttgtaatattttgctaacaaaacagctaacattttttttctaagtttattaaatctgttgaatgtttgagtcattttcttttcttttaccataatattgtaggccaataaaagatgagaggtaccgactagttgtgcaatcaatgcattcatcatgaaaaagttgaattctctttgacgcgttagggactccccgaaaaggtctaccttttccattttaaaggagcacaaattttttaatgcgatttctaatttcataaggtatatgatcatgtgaagatgaaaaaagccttcctcaaaggctacttattaatttgtgcagagagactatcatatgtatagattagatagcacaatttagttcttccaaagtcatcaaaaataaacttatgtaagttgacgtaaataatacaacgatgatcatatttcaatatttcatataaaagggcctctcgctgtggaaaaatatttgatgcttcaatgatcagaggcaaatcaaaatctgtaatgaaggatttattataaaactaaaactataatttgtcattaagctacaaaacccattcttaaatctcaactaaacccattaagttcattattggtagggccgaatcacattgatggctcgcttttctttcttatgataaatacaaattcttaggtgtactttgagtgattcaagtgtcacatgatgccacacttatttctttcaaaacatccttaattacaaacaattttattttatgatcaataaattttaatgatattcagtcacaataatctttgaaattacatatattcaaacttggttatatgcatccatgcataattgaatattagtatcatttgagttcacgactttaataccatcacttccaaacagagcggcccaactcgaatccataaaccaacacacacaaaatagacacaaattgagtctatggattaaatgtcaacactgatccactatagtctatatttttataatttttatggaagagtttagtcgaacttcagtgcgaaagaaagaaggctaagcaaccttaacaactcacttaagatttagccgtgaaactaaaatttggctaagcctcaaacctgaattacccttgtttgggttcatatgccgactcattacgtcccaccgctacttccaaaggcacgagtccatgtgggtcataaaatgacgtgtacttgtttttttcttacagagatgaagaacttaactgatttgattccgttcagaaacaacggattgaaaacatgttgattccgattcgtataatgtctagattccttttctttaactcgtaaatcctttcttggacgcggtttcgagactttgacgttgataaaatgtgaatatgtgtacatgtccacctttgcctcttacgttgacggtcgacaactttttgcaagtcttccaatttctttccatttatgcaatttttcccctcaacctatttatatcttcactatatgctaatctactcattttaaatacttttcattaaagatcaaatttaagattaatctgaaaggtaccaaattttatttatgattggaaaacgatgcctaaccaataacaaaaatgactttcattagcattttgatttattaaaatcctgaaaataattaagttggtcctagacacaaaactaaaatatatcattccaccaacatcatcatcatataatagaagtttataaatgttttatttgaattttagttcaagttacttggttttagaaaatgcgtaaccaatataaagacggctatagtatgaagcgatgttgatgcggaattgatctttagttaaacagctcttaacttttacaagaatttaagttatatctcaattaaaatttggtttcgacaacccctgaatcgtttgtttgttgtggaacgaaaggtttgtgtgaattgctttaggcaggttacagaggaattaacatataattcaggttttttttatctatttaaacagttgaacagttttaagttttaaccatacatgaatatatttttatcttgattattcagttacatttggattgaatagagtcggttaatccaaattagtcaccttttcataagattgtttatattgaagaactaactaacgtatgagaatcaatgtttagacagacttgagagcatttgtgaaaaatttaggtcccctgtatacccataaaacccataggctataatgggcttaaaaatacaagataattgttgtatggatcctaaaattcaccacctcggcccatacgtgagttatgtaaatgaaagttgaaataaaatagttatgtaacgcaccggttatttaggatgcaataaatatataggcatatctccctaaccagaaaagaaaaatgaatattggacagcttcacgatctaataacacaccacacccagtagggcaatatagtcataaatatgcggcccatatgtcacatcctgacacagtccactgcctcatttaattgtcccttttaccctttttacaatcttaacgtgacaagtaaagcatttaatagtctctctttctgtaaacttacatagttttgcatttacaagtcaaatatcaaaatatgcaggtattattaggggttttaattagggtaacaagtaaaaaaaactttaaatttgtagtcttacgatagaaaaaaaacttccttctcattcgccttaaaagatggtcacatataaatcaacgagatttaaaagtagtggcaattctgtaaattcgtaatactagtaagggcattttcatgtcgtttttttaaaaagttgcaaaatctacacgtttaaatacgcacatcgaagtacaccgattttgatttgctctgtcttcgaaaactaatcttaaaaaacaaaacacagaactgtcaatttattagtcttattgaattgtcttcaaagttcgatcatttttttacgttttattttaatttgtttctccaagaatctgataatg

SEQ ID NO: 24278 - DNA, 3000 bp, Unknown
  misc_feature (1)..( 3000): 2750-1469P.txt file - cDNA_ID_2172943; gDNA_ID_2926197; Annot_ID_201564
aaacattctgtagacgactttgtaatattttgctaacaaaacagctaacattttttttctaagtttattaaatctgttgaatgtttgagtcattttcttttcttttaccataatattgtaggccaataaaagatgagaggtaccgactagttgtgcaatcaatgcattcatcatgaaaaagttgaattctctttgacgcgttagggactccccgaaaaggtctaccttttccattttaaaggagcacaaattttttaatgcgatttctaatttcataaggtatatgatcatgtgaagatgaaaaaagccttcctcaaaggctacttattaatttgtgcagagagactatcatatgtatagattagatagcacaatttagttcttccaaagtcatcaaaaataaacttatgtaagttgacgtaaataatacaacgatgatcatatttcaatatttcatataaaagggcctctcgctgtggaaaaatatttgatgcttcaatgatcagaggcaaatcaaaatctgtaatgaaggatttattataaaactaaaactataatttgtcattaagctacaaaacccattcttaaatctcaactaaacccattaagttcattattggtagggccgaatcacattgatggctcgcttttctttcttatgataaatacaaattcttaggtgtactttgagtgattcaagtgtcacatgatgccacacttatttctttcaaaacatccttaattacaaacaattttattttatgatcaataaattttaatgatattcagtcacaataatctttgaaattacatatattcaaacttggttatatgcatccatgcataattgaatattagtatcatttgagttcacgactttaataccatcacttccaaacagagcggcccaactcgaatccataaaccaacacacacaaaatagacacaaattgagtctatggattaaatgtcaacactgatccactatagtctatatttttataatttttatggaagagtttagtcgaacttcagtgcgaaagaaagaaggctaagcaaccttaacaactcacttaagatttagccgtgaaactaaaatttggctaagcctcaaacctgaattacccttgtttgggttcatatgccgactcattacgtcccaccgctacttccaaaggcacgagtccatgtgggtcataaaatgacgtgtacttgtttttttcttacagagatgaagaacttaactgatttgattccgttcagaaacaacggattgaaaacatgttgattccgattcgtataatgtctagattccttttctttaactcgtaaatcctttcttggacgcggtttcgagactttgacgttgataaaatgtgaatatgtgtacatgtccacctttgcctcttacgttgacggtcgacaactttttgcaagtcttccaatttctttccatttatgcaatttttcccctcaacctatttatatcttcactatatgctaatctactcattttaaatacttttcattaaagatcaaatttaagattaatctgaaaggtaccaaattttatttatgattggaaaacgatgcctaaccaataacaaaaatgactttcattagcattttgatttattaaaatcctgaaaataattaagttggtcctagacacaaaactaaaatatatcattccaccaacatcatcatcatataatagaagtttataaatgttttatttgaattttagttcaagttacttggttttagaaaatgcgtaaccaatataaagacggctatagtatgaagcgatgttgatgcggaattgatctttagttaaacagctcttaacttttacaagaatttaagttatatctcaattaaaatttggtttcgacaacccctgaatcgtttgtttgttgtggaacgaaaggtttgtgtgaattgctttaggcaggttacagaggaattaacatataattcaggttttttttatctatttaaacagttgaacagttttaagttttaaccatacatgaatatatttttatcttgattattcagttacatttggattgaatagagtcggttaatccaaattagtcaccttttcataagattgtttatattgaagaactaactaacgtatgagaatcaatgtttagacagacttgagagcatttgtgaaaaatttaggtcccctgtatacccataaaacccataggctataatgggcttaaaaatacaagataattgttgtatggatcctaaaattcaccacctcggcccatacgtgagttatgtaaatgaaagttgaaataaaatagttatgtaacgcaccggttatttaggatgcaataaatatataggcatatctccctaaccagaaaagaaaaatgaatattggacagcttcacgatctaataacacaccacacccagtagggcaatatagtcataaatatgcggcccatatgtcacatcctgacacagtccactgcctcatttaattgtcccttttaccctttttacaatcttaacgtgacaagtaaagcatttaatagtctctctttctgtaaacttacatagttttgcatttacaagtcaaatatcaaaatatgcaggtattattaggggttttaattagggtaacaagtaaaaaaaactttaaatttgtagtcttacgatagaaaaaaaacttccttctcattcgccttaaaagatggtcacatataaatcaacgagatttaaaagtagtggcaattctgtaaattcgtaatactagtaagggcattttcatgtcgtttttttaaaaagttgcaaaatctacacgtttaaatacgcacatcgaagtacaccgattttgatttgctctgtcttcgaaaactaatcttaaaaaacaaaacacagaactgtcaatttattagtcttattgaattgtcttcaaagttcgatcatttttttacgttttattttaatttgtttctccaagaatctgataatg

SEQ ID NO: 24279 - DNA, 3003 bp, Unknown
  misc_feature (1)..( 3003): 2750-1469P.txt file - cDNA_ID_2172957; gDNA_ID_1621125; Annot_ID_172273
atgcaaagataattatctcatagggaacaaaaggttaaagaaaaaaaggcctgaggcacctgtaggatagccaatcactcaagtccatccacttatacaccattgaccaagactccttaagattttctttcacccataaaagctgcaaaaggagaaatcttttttcgtcaagctcaaacacaaagaaagcaatcatataaagaacccctataagaaagttgtacctacttttggtggctccatttctggagaaacaccgccaccacagtactgcaagactggagaattaaatgagttgattctctctgcctgctttacagctctatggtccatccatacaataatgtttcttcttgaatcaccactccacgacactgtaacaggagatccctcagcatcaaccgccactacaaacaaaaataaacgttacattgtcaccgttaagctcctcttattcagccaaacacaaagacggttataagcagattctacacaccgagagagcacgtggcagcaaagcctattcctttcacttccacatccgaaacatttgcaagagagcaagcagatttcacagcagcacaaactgcatgccaaatatctgttgaagattgctgttccaataatattatcaatgtcaaagttaatctctaaacaaataagccatgatctcccttatccaacataataacctcaatacagtctccatccttccaaatctgtattggactagtagcagatcctagaagcttcccattatcatcgaacaaacctgcatcataatcaacttaagctacaaaaccaaaattgcattgctggtcgattttcaacattaaaaagaatcgatttttagtagactgatatcaaatttcatcgccactaaatcaatcatcattctcacgaatctaagaagactacaatttttcaaaattgacgagattttaactcggggaataagacagaaggattaccggcacgggcgcttccagtgccaacgtcgacaccgagaaaaacggagcgagacggaaatggatttaactcagcggtggtcatctgaacggcaacggcggaagctacggaggtgacgatgactttagtggctcaccttcctttatctactttcctttcctttatacatcataaccggattgttcttggttagtagagagccggatttagctaatttggatcggtcgaaccacggtccacgtgctccgttttttcccctgttttatgactaataaaaccctacaagtccgttctttgacctaaaaaataattctccaagttgagtcttcttactcgattcatcgggaaaaagagatggcagatcgtatgactcgaatccctgtcgtcaacgcagactgttgcaagcctaagaagtagcttcttatgcaaggtacaattaccctgcaatgactataactcgaggggacttcaagctgagattgaaccaaggagaattcacggattctcagattatagttatgttgggagagaatggaacggggaagacaacgtttatcaaaatgcttgcgggttcgaagcttgatattgatgaagaaggatctcaagtacatgagataccacagttctctgtttcttacaagaatcaacatatgtcaaaccgtaaatttgagattactgttagagatttgatacacaggaagatccctaacgcatatgcagaacaccaattcgtgtcagacgttatgaaaccgctcaagatcgaggagctcatggataaaagcttcaacaaactatcaggtggagagaaacaaagggttgctttagctttatgccttggtaaatctgcggatatctacttgatcgatgaaccgagcgcgtttcttgattcggagcagagaattatagcttccaaagtcataaagagattcattcttcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatcttttctttggttgaaacactgtcgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaaaatg

SEQ ID NO: 24280 - DNA, 3000 bp, Unknown
  misc_feature (1)..( 3000): 2750-1469P.txt file - cDNA_ID_2172957; gDNA_ID_2926197; Annot_ID_141343
caaagataattatctcatagggaacaaaaggttaaagaaaaaaaggcctgaggcacctgtaggatagccaatcactcaagtccatccacttatacaccattgaccaagactccttaagattttctttcacccataaaagctgcaaaaggagaaatcttttttcgtcaagctcaaacacaaagaaagcaatcatataaagaacccctataagaaagttgtacctacttttggtggctccatttctggagaaacaccgccaccacagtactgcaagactggagaattaaatgagttgattctctctgcctgctttacagctctatggtccatccatacaataatgtttcttcttgaatcaccactccacgacactgtaacaggagatccctcagcatcaaccgccactacaaacaaaaataaacgttacattgtcaccgttaagctcctcttattcagccaaacacaaagacggttataagcagattctacacaccgagagagcacgtggcagcaaagcctattcctttcacttccacatccgaaacatttgcaagagagcaagcagatttcacagcagcacaaactgcatgccaaatatctgttgaagattgctgttccaataatattatcaatgtcaaagttaatctctaaacaaataagccatgatctcccttatccaacataataacctcaatacagtctccatccttccaaatctgtattggactagtagcagatcctagaagcttcccattatcatcgaacaaacctgcatcataatcaacttaagctacaaaaccaaaattgcattgctggtcgattttcaacattaaaaagaatcgatttttagtagactgatatcaaatttcatcgccactaaatcaatcatcattctcacgaatctaagaagactacaatttttcaaaattgacgagattttaactcggggaataagacagaaggattaccggcacgggcgcttccagtgccaacgtcgacaccgagaaaaacggagcgagacggaaatggatttaactcagcggtggtcatctgaacggcaacggcggaagctacggaggtgacgatgactttagtggctcaccttcctttatctactttcctttcctttatacatcataaccggattgttcttggttagtagagagccggatttagctaatttggatcggtcgaaccacggtccacgtgctccgttttttcccctgttttatgactaataaaaccctacaagtccgttctttgacctaaaaaataattctccaagttgagtcttcttactcgattcatcgggaaaaagagatggcagatcgtatgactcgaatccctgtcgtcaacgcagactgttgcaagcctaagaagtagcttcttatgcaaggtacaattaccctgcaatgactataactcgaggggacttcaagctgagattgaaccaaggagaattcacggattctcagattatagttatgttgggagagaatggaacggggaagacaacgtttatcaaaatgcttgcgggttcgaagcttgatattgatgaagaaggatctcaagtacatgagataccacagttctctgtttcttacaagaatcaacatatgtcaaaccgtaaatttgagattactgttagagatttgatacacaggaagatccctaacgcatatgcagaacaccaattcgtgtcagacgttatgaaaccgctcaagatcgaggagctcatggataaaagcttcaacaaactatcaggtggagagaaacaaagggttgctttagctttatgccttggtaaatctgcggatatctacttgatcgatgaaccgagcgcgtttcttgattcggagcagagaattatagcttccaaagtcataaagagattcattcttcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatcttttctttggttgaaacactgtcgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaaaatg

SEQ ID NO: 24281 - DNA, 3003 bp, Unknown; identical to SEQ ID NO: 20038
  misc_feature (1)..( 3003): 2750-1469P.txt file - cDNA_ID_2173018; gDNA_ID_1620705; Annot_ID_165270

SEQ ID NO: 24282 - DNA, 3003 bp, Unknown; identical to SEQ ID NO: 20038
  misc_feature (1)..( 3003): 2750-1469P.txt file - cDNA_ID_2173018; gDNA_ID_2926196; Annot_ID_201473

SEQ ID NO: 24283 - DNA, 3000 bp, Unknown; identical to SEQ ID NO: 3087
  misc_feature (1)..( 3000): 2750-1469P.txt file - cDNA_ID_2173042; gDNA_ID_1620624; Annot_ID_162439

SEQ ID NO: 24284 - DNA, 3000 bp, Unknown; identical to SEQ ID NO: 3094
  misc_feature (1)..( 3000): 2750-1469P.txt file - cDNA_ID_2173052; gDNA_ID_1620624; Annot_ID_162457

SEQ ID NO: 24285 - DNA, 3000 bp, Unknown; identical to SEQ ID NO: 4698
  misc_feature (1)..( 3000): 2750-1469P.txt file - cDNA_ID_2173067; gDNA_ID_1620723; Annot_ID_165857

SEQ ID NO: 24286 - DNA, 3000 bp, Unknown; identical to SEQ ID NO: 4698
  misc_feature (1)..( 3000): 2750-1469P.txt file - cDNA_ID_2173067; gDNA_ID_2926187; Annot_ID_200708

SEQ ID NO: 24287 - DNA, 3003 bp, Unknown
  misc_feature (1)..( 3003): 2750-1469P.txt file - cDNA_ID_2173159; gDNA_ID_2926150; Annot_ID_197987
gtgtttcaaattacctctaaaagcctttccatgttcctgagaaccaatcgatagaaaaggttggcctctgtatctttgaaccgtcgcattttgcttctccgataactacagttaaagaccaacaatttctacagtgaccactgaaaaactcaaaatcgagatgatcacaatctctactctatacagtgaatcaaacatagaacaaataggcaaagtcgcaaccttacaaataaagcgctcatcttcaccaccaacggaagcggcagcaacagaaactgtctcatttttcgccggagccaccgtctccggtacgagtgcttcaccgggagtcgatagcaaaaagacctcaagaacatctctgactagcttcttgtgattggttcccgataagtcgataccgagtttagccgaagcgtcaagtcggagtttgaactccgtcatttggtccatatcagattcactgagtatgctcttcactgtttcctcgattttttgtgtagcgacaatctccatagtttcaccagaatcaagcaacgaattctccatttcgcccgaaaaagaagaaaaaaaaggataaagaaaaagatttcgcagtagcgtcgagttttggttgttggccggcgttatatttagggttcataaatcgccgggggaaaaaatttggccggagtgtgaaaaaaagaggttctaccgagaattgaactcgggttactggattcagagtccaatgtcctaaccgctagaccatagaacctttttgctatagctgttgcatttaatactttatatatgcaaatatatatatatgagttttttttccttatctatatatcttttctgttttataatacgatatatgaatacatgggtgagatacgaatacgattgagaaatatatgggtgaaatacagtttttcttcacgaagccgataagatactaagagtcgaatccttctagaaactaaaccgacagaaagcaaattatttttgaaaattaagctcaaacaaaagaggctaaatataaagatagcaaggtaatagtcattaacatttgttgtgaataatctagtttgggctaatgttaatcttgttttacttgtcttctcactgcattgcagcttaagaaattagtattgcatgctgcgagctcagactcagccagagggctaacccaacagattttgatgcctaaaacatctttaagctcatttaaaattcttaagcattttaaatctatttataattaaagtctcaaaaaaacgaaggtaaggttcgaactgtccacgaaagagtcactaatctatgaaacaatcactagactacgaaacatttttaaaatttgatgccctttaatattatctataattttaggcgcgtaaagcatgagtttcaccaactttagcccagggccggccctgctcagccataagagaagcaaaagatgtaatgcaaaactccaatacgcagtaatgataacaaaaaaaagtttgttcgttaaagcttatcaatgcttacaaaacatcaaaaccaacttgacatgtgatggcagtaacaaaatcgagaaggcgatgctaaaagtaacttcataaactagattgatcaaaagtactcatagcttcggaatcaacataagacaccaaatatgttcaagtcacctttaaaagcaagttaatagccaacaaacaatgtgcatttcacatttcgcttctccaataactaatgcctaacaatttacagaaaacatcacttctttcctcgacaatccattgtattattttcgtgaaatgtcatcatagaagaagcacttaaaatgaaaattgggttggcccatgaatttgaattctctaacccaagaccaaaacccataaaagttatttacgaccatcgaaccacttttttttttttttttttaacggcaaacatttttctattaattagcccaaatgggcttcataaacaggtacaacttgaggccaaaagcccactaattgcaaacattaaatagacaatatgatgacacatgtatgcaatgtggagattgcagcgtagatcaacgtttcagcacatgccccgtcactgcttcgccggagaaatcttccgccggtcagcaaatgattcagctcctccatgaaactttctacccacatttagttgtaccgaatgccttttgccaaggatcaccggaaatagtctattggagttagtttggtcaccggaaatttaaacttcagctgattaggattagaatattccttggaggaccattaaaacatgacgtgaaccccaactcgtcatactcttctccaatcaaccacaacaccttgatctatcatccatgaagaaccgatgcccttacgcttttattagcatagcgaggaattttccttcacatggaagagtaatcaagcatccaatgaacacatttccatctaaaaacctccaagaattaaacatcttctaaaattgaaagtgttgatttacaacctgcaaaaggccttataaaaaaccggcaaagaaaaccgaaagaaactccgaacaattcggaaattaaaaccggcaagataccggaaacaaaagaaaagaaaaaaaacttaaatgaaatccgatttcaatcggagaaaatattaaacagagttttcctctctctcaaagataccagagagaaccacttggttaattaaagaaaatctattttaaccggttgtttaaaaaatagttaaatttggaaagaaaacagaagttgaaacggtagaatagtaaaaagtaatgaaacgtcttgttccctaattaataattacttacgattcacgaagtagactttaaagcccatactaccctctggactgtggccacgtcactctcctttaactactttgatagtcccaaagctgcgacggcgataaatcgatgaattaacgacgttcgaagaaactccagaggtctcttcattttccttttgtatactggtaaaaattggtggtctcttctttgtctccgagtatg

SEQ ID NO: 24288 - DNA, 3000 bp, Unknown; identical to SEQ ID NO: 8163
  misc_feature (1)..( 3000): 2750-1469P.txt file - cDNA_ID_2173159; gDNA_ID_1621198; Annot_ID_174759

SEQ ID NO: 24289 - DNA, 3 bp, Unknown
  misc_feature (1)..( 3): 2750-1469P.txt file - cDNA_ID_2173159; gDNA_ID_1620672; Annot_ID_164132
aag

SEQ ID NO: 24290 - DNA, 3000 bp, Unknown; identical to SEQ ID NO: 3548
  misc_feature (1)..( 3000): 2750-1469P.txt file - cDNA_ID_2173242; gDNA_ID_1620650; Annot_ID_163438

SEQ ID NO: 24291 - DNA, 3000 bp, Unknown; identical to SEQ ID NO: 3548
  misc_feature (1)..( 3000): 2750-1469P.txt file - cDNA_ID_2173242; gDNA_ID_2926176; Annot_ID_199884

SEQ ID NO: 24292 - DNA, 3003 bp, Unknown
  misc_feature (1)..( 3003): 2750-1469P.txt file - cDNA_ID_2173290; gDNA_ID_1621150; Annot_ID_56849
agatgctgactctaaaacggggaaaaagcaaagcagtggtgaagaagattctgagcagtcagagggtaaaacatccgatgttgatgccagagataaaaacggatctctggatgactctaaagttagaaagggcattgaagctgatagttcacctcgaacgaaagatacgaggaggtatgttttttgtgctagacctaatgtgttttggattgcatccttcttagctgttttgaattcatgtgtttccgtgaaaagtactgcaaatagaggaaaaacaggttcttttctccagagaagaatatatctcggttatttacattgtctatgttaattttccagtgaaaatggccatgatgatggtgaatctactgcttctgctggcaaaactgtaaattatgactctcacgacgagacagattcagtttcaagcgtcaaccctgacaacggcaaggtaaaccattttgaacaccccgaagttttgggtttgttgcgtttgataatatatatatatttctttaacctttgtatttcgacatgaaagaatcgttaatttttacgtaactattttttgttatgtttttaccaggacaaggatcatgggaagtatgacagtggttttggatttggatttgggtttgatgacttcagtattaagcctataaaaactggttcgaccatttcaaatgacttcctccctcctaagttatctatatttgctgattccgtcccaagcccaccggcaaatgcaagcgacgtttcccctacaaaaccttctttgtttgctgattcagttccgagcactccagcgacgaacaatgcctcttacccaggccagaaatcattttttgatgactcggtcccgagcactcctgcttatccaggcaacttgtttgctgagaagaaatccttctttgacgactctgtcccgagcacccctgcttatccaggcaacttgtttgccgagaagaaatcctatttcgatgactctgtcccgagcactcctgcttatagcacgtctgattttggtgggaagccatttgcatcagagactcctcgttcagacaacctgttcccaggaagaagcccctttatgttcgactctgtcccaagtacacccgccgcacacgatgacttctctaacaacagcttctcccgcttcgattcattcaacagcaacaacaacgatgctttctctctatcccgcacagactcgatgcgcagcacaagcgagcctgacccattcgcatcaaggtttgattctttcaactatcaaagatatgattccttcaatgcacaaagctatgattcctctagcaacaacaatgcatcggagacgcctaaagcctcattgacaagattcgactcaattggaagcaccagggactctgattacagtcatgggtttgggttcgacgaccatgacccgttcggttctacaggaccattcaaaacaacgacaactacagcagagacacctcggagttctgataattggaatgctttctagccagaagcccacgtgcgatatgaatatgatcacatatcatatactttgctgcttttatagtttgaatttaccagtcgaagagttatatgtatcttcatttctttggtttcacctgcttgcttcattttttattgttaatatataatagtcttttttgccattttttcttttaaggatttttcgaagagtgtcctttgttggtctctgcgtagtgtttctttttatttgtgtctttgtttgttaacttgaataatgaattattatttgtccctgtgaaaacttctattgtatctttgtaatcgtatggatacatttcagatgttgttatattagattgattggtaattttgggaataatccgtatccattttttgatttatactttctattttgtaaactgaaaggtaagtagatatactattagcatttctcaaaatctaatcaagtgttataatatcatacttttgttgatagtaattatgccagaatcatatgcaataattttcttaagagcatatatgtgttggaatttacgaattcaatctgatgccgttcaaatttgtttgataaaattagtgatttactgtatataaataattttccacagtaatatagtaaaaacgaagaaatggatgaacaaatgaaatacgagaaattgaaagaaagaaaaaaaatcattttccttatctttttatggtcataagaagaagagatggaaagtgaaaggcgcgtggagtgcacgcgcagctcaagtgtcaatccagtcacaatcaaatggaagaagcacaagttttaattcaacctcttcggcaatgaagaagaggacgaatccacgaggtccaccaaattcctgcaaacttccaaaacaccatctcaaatatccacattctccgccattaccctgaaccgtttctcgagttgtttctctcatgttcctatgcttttgcccttgccacgtacctatcatgagtcgcctttctccggccaccggaatctcttcccgcctccgcttctccattggtttgagttccgatggacgattaattcccttcggattccggtttcggagaaacgatgtcccgtttaaacgccgcttgagatttgtgatcagagcgcagctctctgaagctttttctcccgatttaggtttggattctcaggttacttacttacttctctcgacttccttgcttgttttcattcactttgttcgatcaatctaaacttagagagacagagtttgcgaagctgaatttaattgttcttaggatctttagattatcgaatcgtttcatgatttttaagcgaaacttttgctgatcagagttgcttatttagtatttcgactgacttcatacactttgatattgaaggctgtgaaatcccgcgatacatcaaacttgccttggattggtccagttccaggggacattgctgaggttgaggcgtattgtagaatttttagatcagctgagcgactacatggagcgttgatg

SEQ ID NO: 24293 - DNA, 3003 bp, Unknown
  misc_feature (1)..( 3003): 2750-1469P.txt file - cDNA_ID_2173290; gDNA_ID_1621150; Annot_ID_173198
ttaaaattttgataaaacgttgatgctcatttactagaggaaactcagtattgtatttttggctagttggcaaaagaacttctacatgtacaactgtatatatgtattcctttgtttatattcataaaatttcctctgttttacaggttggcagcctggaatccaggaaggtgctgctgattgggatgaagattgggataagctagaggacgaaggtatacttgctgtttagattttgattttgttgtcagatgagattattgtggaagcatggctgtagatataatatcgatatcttgtgtctttataatttttttttgggtgacctatcttccaaatttggctatggaatatgcagttgaacacttgaaattgacatcttattttctcttcacttccagggtttaccttcgtcaaggagcttacacttgatattcaaaatgtcatagccccaccaaaggaaaaatcatcagcgtggagaaaagaagttgatgtctcttcaaaagaaggtgaagatgtttcattctcagatgctgactctaaaacggggaaaaagcaaagcagtggtgaagaagattctgagcagtcagagggtaaaacatccgatgttgatgccagagataaaaacggatctctggatgactctaaagttagaaagggcattgaagctgatagttcacctcgaacgaaagatacgaggaggtatgttttttgtgctagacctaatgtgttttggattgcatccttcttagctgttttgaattcatgtgtttccgtgaaaagtactgcaaatagaggaaaaacaggttcttttctccagagaagaatatatctcggttatttacattgtctatgttaattttccagtgaaaatggccatgatgatggtgaatctactgcttctgctggcaaaactgtaaattatgactctcacgacgagacagattcagtttcaagcgtcaaccctgacaacggcaaggtaaaccattttgaacaccccgaagttttgggtttgttgcgtttgataatatatatatatttctttaacctttgtatttcgacatgaaagaatcgttaatttttacgtaactattttttgttatgtttttaccaggacaaggatcatgggaagtatgacagtggttttggatttggatttgggtttgatgacttcagtattaagcctataaaaactggttcgaccatttcaaatgacttcctccctcctaagttatctatatttgctgattccgtcccaagcccaccggcaaatgcaagcgacgtttcccctacaaaaccttctttgtttgctgattcagttccgagcactccagcgacgaacaatgcctcttacccaggccagaaatcattttttgatgactcggtcccgagcactcctgcttatccaggcaacttgtttgctgagaagaaatccttctttgacgactctgtcccgagcacccctgcttatccaggcaacttgtttgccgagaagaaatcctatttcgatgactctgtcccgagcactcctgcttatagcacgtctgattttggtgggaagccatttgcatcagagactcctcgttcagacaacctgttcccaggaagaagcccctttatgttcgactctgtcccaagtacacccgccgcacacgatgacttctctaacaacagcttctcccgcttcgattcattcaacagcaacaacaacgatgctttctctctatcccgcacagactcgatgcgcagcacaagcgagcctgacccattcgcatcaaggtttgattctttcaactatcaaagatatgattccttcaatgcacaaagctatgattcctctagcaacaacaatgcatcggagacgcctaaagcctcattgacaagattcgactcaattggaagcaccagggactctgattacagtcatgggtttgggttcgacgaccatgacccgttcggttctacaggaccattcaaaacaacgacaactacagcagagacacctcggagttctgataattggaatgctttctagccagaagcccacgtgcgatatgaatatgatcacatatcatatactttgctgcttttatagtttgaatttaccagtcgaagagttatatgtatcttcatttctttggtttcacctgcttgcttcattttttattgttaatatataatagtcttttttgccattttttcttttaaggatttttcgaagagtgtcctttgttggtctctgcgtagtgtttctttttatttgtgtctttgtttgttaacttgaataatgaattattatttgtccctgtgaaaacttctattgtatctttgtaatcgtatggatacatttcagatgttgttatattagattgattggtaattttgggaataatccgtatccattttttgatttatactttctattttgtaaactgaaaggtaagtagatatactattagcatttctcaaaatctaatcaagtgttataatatcatacttttgttgatagtaattatgccagaatcatatgcaataattttcttaagagcatatatgtgttggaatttacgaattcaatctgatgccgttcaaatttgtttgataaaattagtgatttactgtatataaataattttccacagtaatatagtaaaaacgaagaaatggatgaacaaatgaaatacgagaaattgaaagaaagaaaaaaaatcattttccttatctttttatggtcataagaagaagagatggaaagtgaaaggcgcgtggagtgcacgcgcagctcaagtgtcaatccagtcacaatcaaatggaagaagcacaagttttaattcaacctcttcggcaatgaagaagaggacgaatccacgaggtccaccaaattcctgcaaacttccaaaacaccatctcaaatatccacattctccgccattaccctgaaccgtttctcgagttgtttctctcatgttcctatgcttttgcccttgccacgtacctatcatg

SEQ ID NO: 24294 - DNA, 3003 bp, Unknown; identical to SEQ ID NO: 19751
  misc_feature (1)..( 3003): 2750-1469P.txt file - cDNA_ID_2173338; gDNA_ID_1620673; Annot_ID_164147

SEQ ID NO: 24295 - DNA, 3003 bp, Unknown; identical to SEQ ID NO: 19536
  misc_feature (1)..( 3003): 2750-1469P.txt file - cDNA_ID_2173372; gDNA_ID_1620673; Annot_ID_164163

SEQ ID NO: 24296 - DNA, 3003 bp, Unknown; identical to SEQ ID NO: 19536
  misc_feature (1)..( 3003): 2750-1469P.txt file - cDNA_ID_2173372; gDNA_ID_2926200; Annot_ID_201778

SEQ ID NO: 24297 - DNA, 3003 bp, Unknown; identical to SEQ ID NO: 19975
  misc_feature (1)..( 3003): 2750-1469P.txt file - cDNA_ID_2173383; gDNA_ID_1620701; Annot_ID_165076

SEQ ID NO: 24298 - DNA, 3003 bp, Unknown; identical to SEQ ID NO: 19975
  misc_feature (1)..( 3003): 2750-1469P.txt file - cDNA_ID_2173383; gDNA_ID_2926177; Annot_ID_199916

SEQ ID NO: 24299 - DNA, 3003 bp, Unknown; identical to SEQ ID NO: 19973
  misc_feature (1)..( 3003): 2750-1469P.txt file - cDNA_ID_2173389; gDNA_ID_1620701; Annot_ID_165079

SEQ ID NO: 24300 - DNA, 3003 bp, Unknown; identical to SEQ ID NO: 19973
  misc_feature (1)..( 3003): 2750-1469P.txt file - cDNA_ID_2173389; gDNA_ID_2926177; Annot_ID_199919

SEQ ID NO: 24301 - DNA, 3003 bp, Unknown
  misc_feature (1)..( 3003): 2750-1469P.txt file - cDNA_ID_2173453; gDNA_ID_1621101; Annot_ID_171422
tacataaaatcacttgacgggctaattgctctaatcaaatttttgattttaaaataaaaatcgatcggtatttggttcagttaaccatgatgattagcccggtttaaataagtttaagaaaaacgaaaagaacaaaattgttttctttttaaggtctaattaccaaatcgaccatgaatccaatgttacaagaacacaagtcttcgtcctaaataacaagttcaatcttcatcttcaacaatctgagagagattagttccaagttttaccgtttacaacaagaatcagaaaggtctttgattgcatatctcaaggttgagccggagcaggagctgaagccataggtggaggagattgttgctgcaatggtttcgattgtggctcaagatgttcagaatctttctttgcttcaggagattcagagagttttgattcacgttcggcttcttgcgttgatgaagctgcctttggtgattcagacaagtgaactctagcaaactcatcaaccactttcctcttatcctcttcctcagccataccaactttctctttagccttttgtccaacttcttctgcagctttagcaactttgttgaatgctccagtaacccacgtggcacctgtgagaacataccggttcttcattatagctgaacctgcattgctcactgtctgctccgctgcagcgattgctgatttggttttctctgagacttggtacttctgatcaacttccctgaccttttctcccactaccaccgtgcctgtgttgatcttatcagtgaaaccaattttcttgtcaaaagatgcgactttggctgatgctgtagatgttagctggtgcttctcgtcaacacttttggctttagctatggcatcttttcccaggataaagccctttgcaagcatgctgctcacaacatcttcggcttttctcaacacggagtcacctgccttgggagatttattgctgtccttgggttcctgtgaaaaagatgaaatggtaagattttaacttgtgaaaaaactcagaagagatgatgaattacgagcttaccaaggaagctaaagcctcaggggacagttggtaatcaggagccatagagacaatgactgaagaatcaacaatcgttgctccctgaaatgaaagaattacattaatactcagtcactcaaaggatacagtcatatagaggaactaatacaggctaagaagtaaaaataccgagagaagaaccgcagtttcagctccttgtagatccttaaaagtgacatatgccagtttagtccgctcagtctcgctgtacaaacatgtcaaaagagttaagaacctgacgaactaaaagctgtaatctaaaactttcaaaaggaacaatagagaggaaaccaaacctctgcgtctcaaggtacagaatatcgccagaaaaggaaaagaactccttgagatctctatcggttgctcctagagaaacattgctcactttaactgttgtcatctgcaagtgaaatataatctcgtgtgacttaaaaactaaaatttcaaaccatttcaccagctaaacaaaatctcagacttattcattagttgttcgattacacatttctcgattccttatcgcctaaaacaatgactaaacacacacacacacactcctaaagcaaccaatattatcaatacaatgatcagaaaacacagaaacattgcatcatcaatacaagaagataaaaagaacctcagaatctaggaaaagcaaatacttgtctcaaaactaatcctatggcacagatcagatattaacagattacaaaacaaaacaaatgctaaagtgaatatcctaatccaaacaaaagcaattttaccctaaaaaaaaatttcttcatatcagaaacagtaattttcacccaaatcaaaaacagagaacagcttcaaatcctctaaaataaaaaaactagcgattcttcactaataatcaacgccatttctcgcaaaacaaattagaaaacaacaatcaaaatcaacagatctgttcacatcttcctcaatcaaatcaacagcaaaaacatcgacctttctcaggataaatccaaaacaaaaaccaaaactaactagtttcaaaaagcgaagagattagataagctcaccgtcatgaagaaaatcgcgttgacgcggattgaaatggaagattgtttttccttcacacaggaggaacaatatttgaaacgaaacgaaacgaaaaatcaaaggaaagaaaaatctctggtcgcggatttgatgtgaagaagagtgaaaaataaaagaaaaaagtgggacctgattttaaacgccttggaaaaacgagtcttattcgggtttggcacgtgatatggtcggaaccttctcacgtgcgatgattaaaaaagagtcctaattttaaacttcttttgcttttgaccctttttagtcacgtaaagttctatctagagattttattcattaaattctggactaatctatcataatccttaatctaattctaattaatccgtaatctgttagtatcttggttaaaataatcaattaacgtcgtgacataatcactttctccaccaatgtctaccatccacgtgtcctgagctcagagcaatgtaatcatcgtagaccatttatcactttataataaaaggaggatataccgttaagattctaaactatagagtcacgtttggaatattatagaaaagttaaggatcaaaaaatgaaaaaagtacaagctttttccgttcatacaggtaatgtgacatttcacgttttgctcaatctctctctccgcggttcacgttttttctcaatctgtccggagagagagaaactcaccggggaatcttgaaatcaccatcacatcctctcttccctcgatctccgttatcgactgtaaatcgaattttgttgttgctttgttttcttgggcgaataaaagaggataatttagtggcggggttttcgagaaagagagagaaagaatg

SEQ ID NO: 24302 - DNA, 3003 bp, Unknown; identical to SEQ ID NO: 24301
  misc_feature (1)..( 3003): 2750-1469P.txt file - cDNA_ID_2173453; gDNA_ID_2926169; Annot_ID_199340

SEQ ID NO: 24303 - DNA, 3000 bp, Unknown
  misc_feature (1)..( 3000): 2750-1469P.txt file - cDNA_ID_2173470; gDNA_ID_1621101; Annot_ID_171438
tgccatttatgaaaacaaaggtgaaagagacaatggatgattgatatggggattcgaaccatgctgagcagaagaagacagtataattaaagtatcctatctcactgattcaatggactgttcctctcacagatacaaaatccctaaatccctttttaatttcatttggtcttagcatcaaacatctgtaatttatttgcatgccaacaaattcatatctcagttgtgcttttacgtacacgaatcttggtcggtatatatatatatatatatatatctgctgtcttcttcggtttgtcttgcttcatcttcaaagtattacattttctttctttagaagaaccttaataagagtcgataaccctaataattaagcgtccaaatcgtcactgggatctctaagtgaagattgttctttttctaagttaattcaaccgctagaaaagaaaatcatttgggtaaatattagaattaagtttgaatatgaccatgcgttgtagatatttttatttttatttttattttacaatacatatactatcaatgattggtgtaaattttaaaaaagataaatagaaaatctacatgctatgtcgaaaatatatattataaaataaagaaaatgtatgatgctagctagagatggtgaggaagcggggaccaaaactagaagaaacaacatattgttatgaatcaagaggatgcccattataaggcccattatctaagcccatcatcgagatgtttctagggttttaccctttccttgtactcctatataaagaaccctttatctcaatggaataatacactgatttcctctatctctttctctgtttacaacacgttatcagcacgctctaaaaggtagatatagagattcttacattttttttaagaaccatgtttacttatcgactcatggttcatagtacttattttctattattgaaacaaaacaatatgagtcgatcgatgattatagtatagatcggtaaaagcatgttttcaatgattcaataaagaagagaatcatgcttatcatttgtttctataattactatcgcatgattcaatgattctacaaagaaaatcgttaaagaagagaatcatgcttgttaattgttaatctttgtgatttactattacaatattgaatatataaattaccaattttataattatataactaattttgtaactattcatagcccggtggtgggtgatgtaagcatgtattaatgttttagcattccagttttgaatagttgcatctatattcaatatcattttataaatactatattatctaaaatccatttatgattgatatgatatcccttatttaactcctttgattaaaacgttatacatatcttatcacttttagatattgacttttccctattaaatatttgatttccatatatttgattgtgttattattatttttactaaaaacgttgcaagataatttttctttttataagattcttttctctaaatctttgtggtatctaaaaaaaaaataaaaaaataaaataaaattgttcatggttttgccctaattttgcacgaaattattttacctaaatcttacacgaattcatattaccctaaataaaagttttgtcaagatatatgtaaaatccaaattttgcacaaaatagttttattgtgattggttttacaatattgcattaaaattgtattagtatataatacttgattattttatgaaataaattgattgataaataacttaatttaaaggtataatcacttatagaaattttcatgaatgactagtttaatgtattttaagaaaatatcatatttttgatggtcaaagttttttcaagaacttaaattatcaccagaagttgagaaaataattttaaaaaaaaaaaaaacatttctaacgatgaaataatctagtatatcaagtagtataaaatcttattaaaagattctagaagagcatatacattgttttctatgggaatacaaaattaaaatcatcgatgctgtatagttctccaaatctcaaagttaatatgatgagatataaatacattatgattctagagtggaattcaatacgagatggatgaacttgaagtttcatcatctcgagaaagagaagtaatgaatggataataagtgacatatccagaagattatgttcaatctttgactactaaagatctaaaagttgtataaagcaattcttatatgaatgtgttattagataaaataaattattactaaaataagttattactaaaacttcaagacttgaagtctctttttgaatataactcacattgttaagagaatatctctgatgcggagatggtaaaacagacgattaaacttttacgcaagtatcgttgtcctgtagacacaatatttgaaagaaatttaaaaactattatgaacttaaatcgagtgtttttcaaaggctaaaaaaaatatatgagttattgatgataagtaatactcatattctaaagtgaatataagatcttacataactagtcaaattaaatttaatatcgtttatattagaatctaaaattttaattattatctcgttattgttttattaacatatgattgattattaaaatatatggaagtaattttgattataagatctcattaagggagtaactgataagcaatgaaaagtaaattagaagttttgaaagaactagaagtttcaaaagaattaaaagtttcaagagtatatttggcttaaccggattggtcatcctggtttaatgatgatgtgaaagtattgagaattatgtggacattaggtgaaaaaccagaagattctccctaatgatttatcaattgttacttgctccgaaagcaatatgataatgtgattttttacgagtcaaaataatttggactttatctattcgtaagtatatacaaggagatgattatggattgatcacccactgtatgatatttagatacctaatg

SEQ ID NO: 24304 - DNA, 3000 bp, Unknown; identical to SEQ ID NO: 24303
  misc_feature (1)..( 3000): 2750-1469P.txt file - cDNA_ID_2173470; gDNA_ID_2926169; Annot_ID_199355

SEQ ID NO: 24305 - DNA, 3003 bp, Unknown; identical to SEQ ID NO: 17945
  misc_feature (1)..( 3003): 2750-1469P.txt file - cDNA_ID_2173491; gDNA_ID_1621096; Annot_ID_170994

SEQ ID NO: 24306 - DNA, 3003 bp, Unknown; identical to SEQ ID NO: 17945
  misc_feature (1)..( 3003): 2750-1469P.txt file - cDNA_ID_2173491; gDNA_ID_2926163; Annot_ID_198922

SEQ ID NO: 24307 - DNA, 3000 bp, Unknown; identical to SEQ ID NO: 6515
  misc_feature (1)..( 3000): 2750-1469P.txt file - cDNA_ID_2173556; gDNA_ID_1621096; Annot_ID_171031

SEQ ID NO: 24308 - DNA, 3000 bp, Unknown; identical to SEQ ID NO: 6515
  misc_feature (1)..( 3000): 2750-1469P.txt file - cDNA_ID_2173556; gDNA_ID_2926164; Annot_ID_198971

SEQ ID NO: 24309 - DNA, 3003 bp, Unknown
  misc_feature (1)..( 3003): 2750-1469P.txt file - cDNA_ID_2173579; gDNA_ID_1621096; Annot_ID_171041
tctgtttatgttataatgcagactttaagtcttttatcaactagggtggggtttttgtaacacaaatgatatggacttctcttccttcatcaaaatatacgaaaaatgtatttgaataattattgattatttttggtccaaaaaacttgaatccagaattattaattggattaaaatgtttttgagaatatttttttgcagatgataccgcccataattttcttaaataagtttttgattggacttcttttgtctttcacaactcacaagtgagaaagactaatatcatagttcttttaataatcgaacaaaaattatcagaagcgaacaaacaggaaacattcgcaagaacaatgagtaaccaacctcatgatacaatcatctcacgaagcacacaactctcgcaatttagacagttcgtacataagataaatttatagactgccacaatcatatcgagtatgaccaatttgatcacgaaacagaatcatcaacataactacaagcaatagcttcctaaccggcgaagaagctgctattaaactaccggtaagataagtttgtgtcgaaagccccacgagtctacctcttctttccctaatgtactcatcaattgcttcttctatttgcatccttgaagagaaggaagatacattaattataccgtcttgacctaaatttaacttcctccacaagcatctagccaaaacaacaccgtcctcaagcgcagccgaacatccttgtcctaagaatgggcccattaggtgcatactgtctccggccaactgtcacgggtgccacgtcggaatttttccagacagaacatcccaaggagcacggtaccttaaacggttgatatacaaagagtccatatcacaattcttcaccatctctttccactcttctgagaattcgcggactgatgctagtgccaatcttgcgatatcctcttgattttttaagaagtttgagtctatttataaaacaaattataaatacgttagtgcgttatatgaaaacaatagaagtctatgtatagtatgaaatgtagcatgaccgggttattaattaccttggggacaatttcgcaaaacaacaaaccaaaagacgagtttgtgagttataggaagtcgtccgcttacgacgttgtccatcttgattcttataaactcttgtcggaatccatggtcgttccgggtaatttgtgaaccctctgatggcccgcgaaccgaggtctttagtcgggtttaatcctagaaatctagagactacagaatttgacccatcgcagccaatcaaaacctaaattaaaagaaaagtatattatcaaaatatataagacccatgcatttcatgctaaacatgttgctttcagtgaaaaacaaacaaaacacaaaccattaaaaccgatcacgacccataaatgtcactgtcggctaatataaggtatatactaaaaaaattccactacggcatcacctcaataattgatcaataaatatatctactgttgttaaaacgtgcctttgctttgatagcttctcccgtttttaacgtgcacaatcggaaacgattttgtttcgtcgagcttaaccgacaaaatatggcaaccaagccggagagtgccaagaggaagagcatgagccaaagctcgaaccaagtcgttccttagtacacctcttacttctccataggatgctggtccaaccgattctcttcgtttaatacctttctcgatcaaaacatctcttatcctgttttagtaccataccggaaatcattataactagataaggttagttaaaatataaatatttatatacttactgatgaattgggagagacttaagacgaagctagcttatcggcgacaccaagttgttgaagagcaagccagccgttagtctgaataccaaaatgctgctccttccgatcttacagactctgatctctccaacacaacgctctttatgcccttcctttataatcatatttgtatgtttagttagtcaatagttcatgtatatgttttctaatttaaattaccttataattgagaaaatgaggagattatagtgaacctgtgaagagcaagggaagttgcaagaccagcaatgcctcctcccacgattactatgtccaattcttccattcttctatatttgtatttcctccaaattttatgatcgttatgtcctgcaatgtcgtggacttatatgtgggggttgaagccacatggcaatatggcatgtcgtggttgtaccttgacccgcgtatttttcgttatctatacatattcattcacagcgatttttattggtatttgtcgattcatatatcaattaaactgtgtatcacacagatcgttatatgaaaccaattctgaagagagaaaaaaaagaaaagaaaaatttaagccttcttgtgttagaattactaattttaataatttatttaatatttttactgtattagtgattaaatgtataatttacttaatcttagaagtatatatatatatttaaaacaattattttcttacacgttatacaatatttgtaattaattgtatttatttatattagaaatatatatacctttttctaaaataatatatttttgttttgtcaattgcccttataatattagtaattcattgtatgatttccttataatatttttacacatgaaaaaatctctaactaaacatcttttcaataaactacatgaactatcaaatttgttataactttcagttatcctccaaagtccaaatattcaaagtgaattattcatgggttggatttaacaaaaataataatttcgaggttgaaatgacaatagatatttttaaaacaaaggaccaaagtcgaaataacaaaactcatcggccgcattaggtttggtcctaaatccctaaaaccctaaaaaaacacaatccctcttagaaacagagagcttctcttctttctccattattcatcactttcttccccgaagatg

SEQ ID NO: 24310 - DNA, 3003 bp, Unknown; identical to SEQ ID NO: 24309
  misc_feature (1)..( 3003): 2750-1469P.txt file - cDNA_ID_2173579; gDNA_ID_2926164; Annot_ID_198980

SEQ ID NO: 24311 - DNA, 3000 bp, Unknown; identical to SEQ ID NO: 6811
  misc_feature (1)..( 3000): 2750-1469P.txt file - cDNA_ID_2173637; gDNA_ID_1621107; Annot_ID_55987

SEQ ID NO: 24312 - DNA, 3000 bp, Unknown; identical to SEQ ID NO: 6818
  misc_feature (1)..( 3000): 2750-1469P.txt file - cDNA_ID_2173637; gDNA_ID_1621107; Annot_ID_171621

SEQ ID NO: 24313 - DNA, 3000 bp, Unknown; identical to SEQ ID NO: 6811
  misc_feature (1)..( 3000): 2750-1469P.txt file - cDNA_ID_2173637; gDNA_ID_2926154; Annot_ID_139445

SEQ ID NO: 24314 - DNA, 3000 bp, Unknown; identical to SEQ ID NO: 6818
  misc_feature (1)..( 3000): 2750-1469P.txt file - cDNA_ID_2173637; gDNA_ID_2926154; Annot_ID_198288

SEQ ID NO: 24315 - DNA, 3003 bp, Unknown
  misc_feature (1)..( 3003): 2750-1469P.txt file - cDNA_ID_2173803; gDNA_ID_1621099; Annot_ID_171297
actcttttccttttgcctttgcctttggagtcacattcttatttgtggaaactacttttacttcttttgacctgatattaccattacccttctgaggaatcgatgagatcatagccaatttagacacacgtgatcttgagggctttgcaggaaccgtgttaggacatttaggatcaacactgtaataaaaaaaaagtatgtagcacaatgcaatgttaaacacacattacagtgattaatctctctcgaagttcaaaaacacatttctcaaatagttagaagttcattacctgaaatcctttctataaagagcttttcgaagacgaacacttggactcctagctgccatgacctattaatgttgattaacatcaaattcttaagttaatgatacactttaaaacgaaatcaaatcaaggaagagaagaagaaaaaaagtttggaactttaagctaacccgaagaacgaattttttgtagattgcttccgaatccaaaaattcctcatgcttctgatcacatcctaaatacacattatcaccaggaaaccaaaatggatcaaaacataaactaattaaaaactgttcactaaaaccctaatttagcaattttcagaaaatgttataatcaaatttcccagatctgtggaacattaatgttattagtaatgatttgattcgaattttgaacaagggaaatgtaaaaagagtgaacaagattctgaccaactctagaacagaaccagtaacgatcatctccttcagggcgatgatctggtgcggtgaggtctacaaacttgggagcttctattgtctcgtagaagtcttcttcgttaaactcatccactatcatatgctcaaatgcctccatcttacactaaattagaaattcgcagagagagtatagaagaacagagagagagagaaagagtattgtctaatttggtgcgtgtctgtttagctagctcagacaagatgaaggaacattcacagaaactagccgttaaaaggaaaggattgtaataatggtctcttttcagggttattttcgtcactacagtgattttgattttgagcttcgaagcatctttttcattccgagtaaagtaaatctgaaggaaagaggagacagaagaagcaaaccggttcatttaaaccggtatctatatagaaccattttaaaccctgtttacgactcttaaacgtcaataatcatagaggcaggaatattttttgtttctttccacataatttatgctttgttttcttcgacagattcaaaatccgtatttaatttaactggtaaaagtaattattcggtaatgcacaacatttctctttctttgtttagacgcgatcagatatttcaatatgaaatcaaaattattggtttaattaaagagtttggagcctagtaaatttcaagcaaaaaaaaaacacaggaattgatcagagtgttatgaataaagatggatgcccattataaaacttatcatctaagcccatcatctagatgtttgtagagttttaccttttccttgtactcctatataaagaaccctttcctcaatggaaaacacactcatttcttctatctctttctctggttataacacgttatcagcacgctcttaaaagatagatatagagattcttacatttttttaagaaccatgtttacttatcgactcatggttcatagtacttattttctattattgaaacaaaacaatatgagtcgatcgatgattatagtatagatcggtaaaagcatgttttcaatgattcaataaagaagagaatcatgcttatcatttgtttctataattactatcgcatggttcaatgattctacaaagaaaatcgttaaagaagagaatcatgcttgttaattgttaatttttgtgatttactattacaatattgaatatataaattaccaattttataattatataactaattttgtaactattcatagcccggtggtgggtgatgcaagcatgtattaatgttttagcattccagttttgaatagttgcatctatattcaatatcattttataaatattatattgtctaaaatccatttatgattgatatgatatcccttatttaactcatttgattaaaacgttatacatatcttatcacttttagatattgacttttccatattaaatatttgatttccatatatttgattgtgttattattatttttactaaaaacgttgcaagataatttttctttttataagattccatatatctaaatctttatgttattattatctaaatctttttataagatttccatatatttgattgtgttattattatttttactaaaaacgttgcaagataatttttctttttataagattcttttctctaaatctttgtggtatctaaaaaaaaaaaaaaaaaaaaaattgttcatggttttgccctaattttgcacgaaatcattttacccaaatcttgcacgaattcatattaccctaaataaaagttttgtcaagatatatgtaaaatccagatttttcacaacatagttttattctgattggttttacaatattgcattaaaattgtattgttatataatacttgattattttatgaaataaattgattggtaaataacttaatttaaaggtataatcacttatagaaattttcatgaatgactagtttaatgtatcttaagaagacatcataattttgatggtcaaagttttttcaagaacttaaattatcaccaaaagttgagaaaataaatatggtaaaaaataagtaaaatttctaacttataacgatgaaataatctagtatatcaagtagtataaaatcttattaaaagactctagaagagcatatacattgttttctatgggaatacaaaattaagatcatcgatgcggtatagttctccaaatctcaaagttaatatgatgagatataaaatacatttgcttctagagtggaattcaatacgagatg

SEQ ID NO: 24316 - DNA, 3000 bp, Unknown; identical to SEQ ID NO: 6626
  misc_feature (1)..( 3000): 2750-1469P.txt file - cDNA_ID_2173832; gDNA_ID_1621099; Annot_ID_171306

SEQ ID NO: 24317 - DNA, 3000 bp, Unknown; identical to SEQ ID NO: 6626
  misc_feature (1)..( 3000): 2750-1469P.txt file - cDNA_ID_2173832; gDNA_ID_2926167; Annot_ID_199226

SEQ ID NO: 24318 - DNA, 3000 bp, Unknown; identical to SEQ ID NO: 6543
  misc_feature (1)..( 3000): 2750-1469P.txt file - cDNA_ID_2173863; gDNA_ID_1621097; Annot_ID_171088

SEQ ID NO: 24319 - DNA, 3000 bp, Unknown; identical to SEQ ID NO: 6543
  misc_feature (1)..( 3000): 2750-1469P.txt file - cDNA_ID_2173863; gDNA_ID_2926164; Annot_ID_199002

SEQ ID NO: 24320 - DNA, 3000 bp, Unknown
  misc_feature (1)..( 3000): 2750-1469P.txt file - cDNA_ID_2173965; gDNA_ID_1621097; Annot_ID_55731
gccttaattttcccatttctgctccctcgccgtaagcgacttgtagcgactctcgccagtccagtccaaaatcgggaggtgagcgaaatctccggttgttttttttcagtcatggagttgagatcggattcacgatcgagttcgttttcttctctcctattcgtcgcgtttctcttgtttctatgcggactcgtttctcgtaccgactcggctcagcaacctttccgtcgcgagccaggtcatcctcactggcatcacagtgctttccttgacgtacgagagagtgttcgatccgatgtccgccgtatgcttcactcccgtgccgaggtacaatctccagcttaaattatgtgaatcatcatcatcatcatcagttagtctgaatttagctagaagaagaaggagaagaaatcgttgagtaatttggttctgtagaatcaccgaagtgaaattaaaagcgttcttgttgcttcacgactatgatcatagcttttttcgtgcatatggttgttagattggctgagtttgagtgacacatcgagaattgaatttcacactatgaagcttgttttgtttaggtaccatttcaggttcctttggaagtgaatatagtgcttgtgggtttgaatggagatggaggttacaggtattcagtggatcctcaaaaactagaagagttcctaagagccagtttttcaacacataggccttcatgccaagagacgggcgagccacttgatattgagcatcgagttgtttataatatctttcctgtgagtaattttataaacctttaaccagtcttcacgaattttgtgttgtttatgatttacctgcttcaacatccgatattatatatgtaggataagatttctattcaagttctggattcttgtatttgatttagctgatttgcatttgcgtctcgagctgattattattgtacatgaagttttttgcactcaatattaagttttactgacttctgatgccaataatttcattgtttcccccattgacctaaatgttcatctttgtttttctttctctagagtgggcaacctgaattaatagctctggagaaggcagtgaaagaagccatggtgcctgctggaactgcactagaggttgctgtaattttatcatctcaaatttaactgtttctcataacgaacctaattacatataaaaatatgtcgatgaaaatgtggatttcatagctgtaaaaactacatcttaatgtttatgatactaatcttcaaaaatatttttggatttaggctgattttggaagacacttacctgcctatgacgtagaggcaataaaagtggagtccgcatttaaccagctttactcgtatatatttgatattgatgtgggttctggatcagccgcaacggcagataaacctataccaagtgccatatttgtagtgaattttgataaggtatggcttccagtgctcttcttacttcttgaatcttgcatatggtatgcagattgtccaaatgctttatctgttcttgtattttttttgctttgttttgattgaaagattttttatgccttcttggctttataaccgtcatatttctctgttcttgaagttgatttttttcttgtcatatttgcatttgttcagtaattgattctatcctgctggattctttaattgcccccttcttttctttactcattattcaggtaagaatggatcctaaaaatacagagattgatctagacagcttgatgtttgcaaagctaccagagcttagtgatgcagacaaggagaaacaagaggcagattatatttatcgatatagatacaatggtggaggagcatcccaagtttggcttgcatcaggcaggtaaactcatctttgtttttctattcttgctgcgggaaactatggacaaattactcaaagggttttcccttggtatctctttgttatcccctatgagtgatatgattgtgccatagatgtgatcaaacaaaaaaatttaaccaccttattatgaaagtattacatctatctaggtatcattaatatatgccattaaagtggaagtgagatatcattgtcccttttgttgattatatatagtccataaaaaaaagaaaaaagaaggagatagacactttttattacttcatttcactttggtaatcatatcttattgtagtaatcagctcttttgttcgaaaactaatattcaagatattgttggcgtaactatttctgttcttatctggtataacttttcctctaagctctcaacatgattgtatttctgatttatctccccttcttgatagatatgttgtcatagatttgtctgcggggccttgtacatatgggaagattgaaactgaagagggcagtgttagtcccagaacagtgccaaggatacgaaacattgtgcttccaggaaatgttagccctgttggtcatcagtctacccatgatatcttttctggtcagttagcagcgttggtagctactacaattgagcatgtcatagctcctgatgtcaggtaatatgatatgtgagactttacgtccttctagcaatgaaaattatgcttaaatgattaattctgagtgcattgtgctaacttctaggtttgagacggttgatctagcaactagggtgctggtacctatcattgtgctccaaaaccacaatcgatataatatcatggaaagaggacaaaactacagcataaatattgaagagatagaatctgaggtaaaaacttcttgcgttagatgattgatgttcaagaaatactagaacttgttatcttttgttttgttttctgaatggtgttttcatccttatgagttaatatgattagtaaaaaagacatgttttccaagtttactgctatcagaaagttagcacccataatattttccaaagtacactcaaggatttgactctattggtttacacatactaactgcccggggtctttgcaggtaaagaaaatg

SEQ ID NO: 24321 - DNA, 3000 bp, Unknown; identical to SEQ ID NO: 6555
  misc_feature (1)..( 3000): 2750-1469P.txt file - cDNA_ID_2173965; gDNA_ID_1621097; Annot_ID_171130

SEQ ID NO: 24322 - DNA, 3000 bp, Unknown; identical to SEQ ID NO: 24320
  misc_feature (1)..( 3000): 2750-1469P.txt file - cDNA_ID_2173965; gDNA_ID_2926165; Annot_ID_139873

SEQ ID NO: 24323 - DNA, 3000 bp, Unknown; identical to SEQ ID NO: 6555
  misc_feature (1)..( 3000): 2750-1469P.txt file - cDNA_ID_2173965; gDNA_ID_2926165; Annot_ID_199064

SEQ ID NO: 24324 - DNA, 3000 bp, Unknown; identical to SEQ ID NO: 6614
  misc_feature (1)..( 3000): 2750-1469P.txt file - cDNA_ID_2174046; gDNA_ID_1621098; Annot_ID_171175

SEQ ID NO: 24325 - DNA, 3000 bp, Unknown; identical to SEQ ID NO: 6614
  misc_feature (1)..( 3000): 2750-1469P.txt file - cDNA_ID_2174046; gDNA_ID_2926165; Annot_ID_199084

SEQ ID NO: 24326 - DNA, 3000 bp, Unknown; identical to SEQ ID NO: 6585
  misc_feature (1)..( 3000): 2750-1469P.txt file - cDNA_ID_2174083; gDNA_ID_1621098; Annot_ID_171195

SEQ ID NO: 24327 - DNA, 3000 bp, Unknown; identical to SEQ ID NO: 6585
  misc_feature (1)..( 3000): 2750-1469P.txt file - cDNA_ID_2174083; gDNA_ID_2926166; Annot_ID_199125

SEQ ID NO: 24328 - DNA, 3000 bp, Unknown; identical to SEQ ID NO: 6609
  misc_feature (1)..( 3000): 2750-1469P.txt file - cDNA_ID_2174090; gDNA_ID_1621098; Annot_ID_171199

SEQ ID NO: 24329 - DNA, 3000 bp, Unknown; identical to SEQ ID NO: 6609
  misc_feature (1)..( 3000): 2750-1469P.txt file - cDNA_ID_2174090; gDNA_ID_2926166; Annot_ID_199129

SEQ ID NO: 24330 - DNA, 3000 bp, Unknown; identical to SEQ ID NO: 6608
  misc_feature (1)..( 3000): 2750-1469P.txt file - cDNA_ID_2174100; gDNA_ID_1621098; Annot_ID_171202

SEQ ID NO: 24331 - DNA, 3000 bp, Unknown; identical to SEQ ID NO: 6608
  misc_feature (1)..( 3000): 2750-1469P.txt file - cDNA_ID_2174100; gDNA_ID_2926166; Annot_ID_199132

SEQ ID NO: 24332 - DNA, 3003 bp, Unknown
  misc_feature (1)..( 3003): 2750-1469P.txt file - cDNA_ID_2174128; gDNA_ID_1621098; Annot_ID_171212
acgctttgaaacaagagaagcagaatgacgatccacaaacaaagacttagaacctaaactcgccattgatttacacggatccgaaagcaaaagatcaatgtgatatccacagacctgaaaggccggaccagatacagaaggaacagagaaagttcgagaaacagcaccaataacagaaagattcctcctttcgttaatcaacaacaaatcagagctagctggttctaaaaacccgttagggttagtaaatctagtgtacaatcctctataaccaccaaaccctaaattccctaatccaatcaaaatcttaacttgtttctgaagactttctctcacaggtaacatcttaagcacaagaatctcgaaacccagtaataaccagagatagagaagatcatatcttccaaagcatcacttttttcgtcgatttaaacgctttcaccaacgaatctaaagattgatccaacacaaacccttgaaactcagagctcaatcaaatacgaattcggaacttaccaggacccacaaattctcttttcacctccttctggagaagataatgtcaaagtcacaacagaaattggctagaatccagataagtttctgaaagaagagatgacaaatttcacgaaagaaccctagccaaatctgatctttaagacaagaaacacaaaagctggtggtcaaaagcaactcgcttttttcttttgttctaaaaaaaacaaaaccagtgaaattttgggatgtctcaaaaaaaatttctgtatttgaggtttttgtgcgatgggtacagattatcagaaattcagaatgttcctctcacatctttttggatataagtgattttcagctgttggatcatacatttaacaatctcagccgtacattttctgtttttataaaatagactaataacgagaaaccgagtcgtggagattaatgggcgtacaaaagcccattagagtagcaatcaaagcccatgcatcggcatcaaattgtttttgaggatcatttgtcaattgtcaacgagtagagccgtgcataccatacaacataaagggaaatagccatagctaggccacaaaaaaaattctactacttaaaacgccacattttttatacaaattatttgatttttttggttacactaagacttttttccactaaaatagattacttttacattagaaatatgttataaagttgtaattttgtgaaaataccattcctataaatattttaagatgcttgaaaatcatattttgtcaaaataatagaataacgtttctaacgataattagaaatcataaaataatatacatgttaaaataaaataaaataaataagtagtcagtacaaaagaaagtttacacgtataacaatttgccataggcctccataaatccatcatatcagaccactctaatgtttttacttgtaaatatttgatggacaaaaacaaatgctgggcctactatagctactatcatatggatgttacatgcagaaacaaaacatgcttttctctctgaataacgaactaaacatgttatggattaggccctaatagctagtccagttaggattttaagattttccgatgtatattaagtgtcaatgtgtcatacatgagcctctaataaacacacgcccaaaatcaatagaactaactaaccctatacaccgaagtaatatagaaccagcacgaactctagatctggaaaatataaatacaaaatatcttttaaaatgttttctaaatattattgtaattatcatatgaaaaaaaaactattcataaaaagtaattatcaacatatgtaatctttcaaagatgcacttgatgtgtgtatcttgttggttagaattttaatttattaatcgataacttggaaggcaaataacagtaaaaataataatctaactgtagtaaatatctccccacacgtcattttttttatttttttttattttttattttggcaactcacatggtttgattcattgataagtcagtttcaattttatttttctcaaatttaaataattctccatttctaaaaataaaggggcaaggtattggtacgcacatgagactaacattcatacctttttatgaaataaataaaacaaaaagggacacaagaaggaacgcaagaattttaaactgaaatgattgtatctctaaattgagaaaaatcccaaaaagaattagtaacaaattaaataactaagcggtgttgttttattcggaggtaaaatatatatatggagggtatagcgtcaactcgcttttttactacattttgatttctctcccaaagttctttaatttttgtttgggtatcacatttgtagtcagaaacaaaattgttgaatgaattatcgacgactattttcactcgttggaatagtcgggattcaatttattaaaccgtcgtaaggaagctaaagatgtaaaaatgatgatatacagacaatttggctagctcattcactttttaaatgggcaaaccaatcatgaatgctagtttaatttatcgtgtgattgattttttttttatataaaaaaatagaagtaaaattgtaactttttatgaaaaccgtcgtaatcgtacgtcactaagctacaaaaatacaacaaacagtgactaataagaaaatgtagagtgatattagatgaatttaacacgtggaaaaatcatgaggaggagatgattttttctgttgcattcccttctgtggttaccagctacgataacgttcacgccctcctccacttaaattagaatgtgagaaaataaaatagcaagaaattggagatcacaacagtattgagtgtaggacatattacaaaggagacaaaatcagtcaatagtaaaaaggtatcacaataaaaaaaaatgtcaataaaaaggggccattgtatgacatgaaagaacaaaattaagtgatcatcacttctcctcctttatcgagagcttcagttttagagcaacaatg

SEQ ID NO: 24333 - DNA, 3003 bp, Unknown; identical to SEQ ID NO: 24332
  misc_feature (1)..( 3003): 2750-1469P.txt file - cDNA_ID_2174128; gDNA_ID_2926166; Annot_ID_199142

SEQ ID NO: 24334 - DNA, 3000 bp, Unknown; identical to SEQ ID NO: 6598
  misc_feature (1)..( 3000): 2750-1469P.txt file - cDNA_ID_2174182; gDNA_ID_1621098; Annot_ID_171239

SEQ ID NO: 24335 - DNA, 3000 bp, Unknown; identical to SEQ ID NO: 6598
  misc_feature (1)..( 3000): 2750-1469P.txt file - cDNA_ID_2174182; gDNA_ID_2926166; Annot_ID_199167

SEQ ID NO: 24336 - DNA, 3003 bp, Unknown
  misc_feature (1)..( 3003): 2750-1469P.txt file - cDNA_ID_2174315; gDNA_ID_1620812; Annot_ID_57892
caagtaatgaagcaaaaagagatttgaaccataatacatctaatcagtttaagaaggagcctttttgattattaaaaaataaaaagattgttttcatcaaatatctaaatagaaaatgatataatttactaaaaatatgttttacataaagatggatgtcatttaaaaataataggcttgggaggagtctaaaacggttgttttcacttggctatccctagggcccgttacgtatggtccgattgtttcgtctaatttgcaacatgaaattggtgcacattatttcttcatatggagtttgtaacaaagcaaaacataatattcacgttaacaaaaaaaaaaaagattaaccacgattttagtataaaactttagaccaaaaaatataacatttattattggtcttatctggcaaaaggatcttatgtcttttattttgtgatcaaaatcaatcaattcttcttcttgatcattcttatctcagctttggttgctccaatgttaggaataatgtgaaaacatattgttgaatgacgacgaagacaataaacatctcctacttgtatgtgaattttgagttttgggcattgagctggtcttatttcgtattgtttgaatcttgcatatgaacaacgcgtaacaaattggaagagctaatggtcgaggtccttgtgaattgtgagtatagtggagatgtacgtaaaatctgagaaggatatgcagaaaatgaagaagggagcctcatgctcttattttcgataattcgatttataatcactgtaaaaaataaaaataaaaatgtataacgagaaatctggagccaataatcacgtgttagatgtgacacacacgagacatattttgttataaccctggactggacagtgaacggtgcttactgcttgcttagcaacgactcttcggtcgataatgacaccatctttacgtgcgatcgtattattggtcgtttaactatcgacggggaaaattaacaaaacgaattaattatggacgcgtccaactattggattttcttggattctcatccaaaagagctttcactcttttaggccgtgaaatctaacggtcgaacgtcagacaaactttgcgactcactctcaccatcaaagtcacatcacagggcagttggatcgctgttcttgttctgtatttcgaagaagtttcgtttgccacttctttttatgtcggtaatatattaactaaaattggaatttcgtattgctcttcttgtgctagatgagatgtgaatcaaatgaagcatggggatattattattattgtgagaacgtcaaaaataccttttgaaatttcttaccttctaatttgttaaagacggaatgtcattgtctgtaattttctttttataagtatataataatttagtacatcgatctttcaaatggtaatatttctaatttatatattcaatccaaatgaaaataaacaatcaaatcaaacaaacaaagtttacgtttatataacactgttaactatatatgtgtttgctctttcgagtcaagcaaccattataacatatccctttttaagaaatcatcaatgagatattaaagaaaaacctaagagcttttttagatatatcaaaagggtaagatccgaaaatgtaaggataatatctgtggtttgagcagtagtagtattttcatcattgctgtaagcgaaattagtagtggtcgacaaagaaaaagattaaatagtaaagagtggatggccacttgggacgagtcggagtcaaatatacgacgacagttggagaaacttgacatctaccttggcccgttcttacttcttaactcttaaaaataccttagtgggtttctgccgtcagggataatttttattatgaaatccttcattttaatccggtgacataaataagatactagatcatttgaaagataaataatgtatcataataataaaaatagtgtttttgcgtttttggcgatactcatactatggattaatttgttttgtggtaggatattatttaatatgagtaaaatacttaacaatttaattattttaagaaaagaatttaatgtcattttcttgtaacatcttatcaactagagattatacactataaacttttgtatcaagccgtttttaaaattatgtgagattttactttttctaaaaacaattcaatgatatgatttctcttgtttttacttgattgtccttatataaaccaaccaaaaaaatactatactttaatacttgttaagtaatattaaatatccatcttagatattttacaactctttttaggtaaagatattttacaaccttttcttttctttgttttgcaaaaggtttttaacaacgctttacatccaatgcagtttgtaatctataaaagaacatataaacttatactccgtaaagtaattagttatgaattcgctcaaaacattattctcgtttgtctaaaattaacataaaacccaatataccggtaaaagtaaacatacatgcaaggctaaaagacgtgggcataacgtgtgattgggaaaccatcggaaacaaaaataaggaattataacgaatggccatactaggttgactaataagagaattattatttgacgtatataagataataagacaattatgggataaaattaagagacataagtgtggacacgtgaagcttagagtacgtgtcaatattcaataagacataaacaacaacaaaaaaaagggtttattctctactcttgttttgtttatacaagaggatgcatctactgccccaaaacaatcctgaccgttcatgtctctattcttagatccaacggtatgtatcagctatctcattgtcccctctcatagctttctatataaaccgaaagaaagaataatagagtcagagctaagacttaagagcgtcacaacaatatcacactcagataaatatcaagagatagagagagtaacagtgatatagtcgagaaaatg

SEQ ID NO: 24337 - DNA, 3003 bp, Unknown; identical to SEQ ID NO: 24336
  misc_feature (1)..( 3003): 2750-1469P.txt file - cDNA_ID_2174315; gDNA_ID_1620812; Annot_ID_169105

SEQ ID NO: 24338 - DNA, 3000 bp, Unknown
  misc_feature (1)..( 3000): 2750-1469P.txt file - cDNA_ID_2174521; gDNA_ID_1620832; Annot_ID_169701
taattttaaaatttgttcaaagtacaacttgcctttttgaatgatctcatctgttttttttttctttggttgtgtgctttatttaaccatctttttctttcacctgaatgaaatcataaactaataaagaaaaaagaagcttacaattgttagacaatattcacatgggatgcgatgttatctactagtttctcagttcaatcacatgcttggtttctttcatgttgatctgatttagtaatacaagttgatcacatagacttttgatttctcacttcttggttgttgtgatacggtaatgcaacttagcgaaagcccttctttggactagctaaaaaagcaacacattcttttcttctaatgcgtggttatcttgctacttagagtggatggtctcttattgacttttatagtcaacatttgtcttgttgcatgcaatatcatcaatgttacatgtttgcatatttgatctagaagataagaatactgcaacgagaagaataggaacatagtgcatgattagcttgaattagaggttcttttggtttttgttataaagtaaaaggtggaaaagtcacatgggactcccgtggattccgctaatgaccccaccaactttctctcctaagattttatttttgatttggttattaaaaaaaaaaggagacatagggttctctacacaccacaatcaaatcatctataagactgcgactatgcttcttctctatctttctcaactcttttgccatgccctctggttgcgttgttcccttggtgggtcgtattatgtctctctgaggcacgctactagcacgtgtctacttgcatgttaccttcttcagtgaaccctattttcaaagcagtcaatgcattgctgaaaatgtaaataataatcccaaccatacaaactatcgttttttgccattaaactgttaccctaactactcatatgtgtgtaatgtgaacgtaatggtctctataatatatgatcagttcatgttttatgcattttagtatatttttattggcctatttaacatctctatttccttcataattactgtggctgctgtagaaatcttttaacttttataatatgtttataaaactgactgaattgcgtgaattataaattgactgaaattaccttggctgttgtagaaatcttttaactttttttaatatatgtttataaactgactgaaattgcgtgtatatattatgtagtccagtattttgtgtgactgactaaatattttgactaagcacggttgcttggtccgactatatattctgtcacataggcaaaactattgtaaaatcaggtaatgttcttgaatcgtctttgggttgagttttggtgtcagagaagctgggtaagtgggtcagtagagtcgttggggcatatatataaatgtccaaatacattaaagaaagagagagagaaaaggaaattgagttttggggtatcgtggagaacataaatgagaggtgtagcgttatttccgggggttcacacaacctctaaatggtatttacacgtgtcatattgagattgggtaattagtaggcctaaggggggatgtctcctcatggggacaagactattagtcctctcctgacaaatgacaatggaggtaactattcactgcggcggttttttgactgctgcactcaatcgtgtgcgtcctcgatattctctaccccttaccactctttcttctttcccttttttgccctctttagccacttagccgttttagccgagaaagcccatttaaactttttcatggtagtgaatagtgataattctgttacatttacttgctataacctataaccattctctgtctttgatgtctttgtatagtgataattcttgtgaatttggtgtaacagaggatggtgtaatatcatctgacgaggaactgagtggaggtgatcatgaggtagcagaggatgggagacaaagatgtgaagaccgggacctcaaagataggttgctacgcaaatttggaagccgtattagtactttaaagcttgagttctcaaagaagaagaagaaaggaaagttaccaagagaagcaagacaagctcttcttgattggtggaatctccattataagtggccttaccctactgtaagcaaaagcaacacttgcatgttttccgacataactaaccactacacttatatataaatgggtggtatgaatgtgtgtgtacacaggaaggagataagatagcattagctgatgcaacggggttagaccaaaaacaaatcaacaattggtttataaaccaaaggaaacgtcattggaagccatcagagaatatgcctttcgctatgatggatgattctagtggatcattctttaccgaggaatgaatttatttatggtacttatttaacgttgattaaaagatggatgtataattctgccttgctttgccgacaaaggaaaaaaagaaagaaagagtgaagcatggacgacacatgaaatggatcttacactcactcacatgtagtagaaggaacaagtcaaaatgctttgtaactattattatcggtgaataaaaataacctcttttgtcttctccggacctctcgtgatatagcttttaccctcttattggcaaaacgttgaacaaacaaaatacttagataggttagatttgtttattaactatgtgtttttcaaaaataattataaaatatcttgttatttgtgtaaatcacactaaattaaacacattcttttattgacagtttaatcatcatgtacattttgctaattgtagccaaaagtttagctatctagcaattggaaccttgtgcccataatccaaccatctctgtttaaattttggggtgggtttcaaattatccttattgggcctaaaatcggcccaatattaaactgaaaccagacttttatccaatccgagtaatcggaacaaaacaacatgatcgtgtgaaccaacggccaaaaaatg

SEQ ID NO: 24339 - DNA, 3003 bp, Unknown
  misc_feature (1)..( 3003): 2750-1469P.txt file - cDNA_ID_2174682; gDNA_ID_1620818; Annot_ID_169337
aaacacttttttttctttttcttaaacacttctgatggtcaaaataaagttttttgaatagaacctttggttggaaaaacaattcgtataaaatatcgacatccggaatacaagctttcttttcaattatgtgctgcatgcggtattaacaaaaaaaattttggatctatatgtttatcatatacttcgtttttatattactaaatagaaaacatacgattacgcgcgatattccgatcgttataaattgtttcataatcacatttcaatctattagggaagggctatattatattattactactataatatgagggatacattaacagtcgctaataaaaacatgttggtatggaatccaaacatgcctagtgattttaaaaaaaaaaagggttttaacatatctatggctagtggaagtgaagagagagatcgtatatgcatcccttttctgttgtgtcggccgtttagatctttttatattatggttcttttttgtatttattttaagaacatttgcttctctatgtacaccatacggtattcaaattcaataaggttatacacatatatttctttcttttgggtgaaattgtctatacacatatctacaatttgtgtatataaagaaacgccccctacgtattattggcccttcgcataaaccaagagccaacgaagcaagcatcttccaaagaaaaaacgttgccaataattgcttccaagtttcaagccacgtagtattttgatcggtccactcaaataaaataataatatggatatttgcatatatataagtctaggtattgcatgtaagacttcacaacgtagagcaagatatctggatacgcggaaaatagagagaagaaatcaaaaagcatatttttattttatctttgaaaagaagattattgtttttagtctacaatggtgactctaaaaatggagatttgcatcgagttgttgaaattgaccgtagatttcgtcgccgccgttgcagaatcaatcgaagtagctttccgccatcgtcctccaccggtgattcaatattcttcagtgatgtatggtcgccggagtaattacaccgccgttcccattcctctcgtggggtttctgtagttaatatattcttcttttgtggttcttttgttttttgttcattcttgttctattataattaccttcttgcctcggacaaaaaggtatatttcttatgaaagaacaagatgtgttttgtgtataaaccaaaaaaatcacgaaaagtttacgtaacccgtgaatatataaaagtttagacgttcccgattgtatatatttttttcgatatatatattttgtttattcataagacccttaaattatatgtttctattatatcaatgtgttcacactttcatggtagatctgatcttgaagagggcagaggttgatatatttgggtcatagtcgaataatgatcgtggcgatatttttttaattccactagacaaatacaaaacctattatcttatccatgtttgagatttaagattagaattgttttttgggtggtgtccacaccaagtaacgtgtcggatactatttttggaaaatttgttttgttcttgacgaatcgtggcccatctttgatccatcttcgatgcaacaccgaaacagcaactgatatgtagctatgaggaacacagatttgtggtacttttgtatatactagatgagtactcgcactacgtgcgggtttacatattactatttacaaattattttatataatatttgttcatataaaataaagttgaatgcatcggtattgaaacataaatatgatttagaattgtttttgaaaagtccaactatattagttcatctgaaaaacgaatgtacttgagttgtttttttattgttgttttagattctcagtttttttttttgaatttatatatccttgtttttttgttatatgtatagattatgagacgatggaattttagaaaatttatttcttacacaaaaagataacatgtctttattaaccatgtctctgcatattcaatctaaacatattcaacttgatattcttggaaagtttagttaagttcttgttataatcttatattttacgtattagttataaggatagctcttcaaacatttttcaaattacttgttttcttagaataaatctcgaaaagcttatatatatttaatctgcatattcatttagtttttttcataataatcgtctaatttttaggcaagaaatatgtgtaacatgtttggattttatcatcattttagcctcaaaattaaagaggatatattgaattaaaaaatgtaaaaagagtgatggttcaagttctcattaattatatcctcttattttagttgttatgttgaattaattactaattatgtattacttattttatgaagtataggtggcaaactctcatgtgctgatgtgtcaagttgtggaagagagttaaccttctttcatatatatgattactgttcaacaatatgctgttaaataacatgaatgtttttgagtttatgataccatgatacattgacacaatattatttaaaaatatctgagctttgtacctccaaaattcggggacgatatgtttaagcttgtggcagtactaggaagtgatgtttagcattatttagagctatcatatagactgtagaaaatcagtcatcacatttcaagtatggtaaaaccaaaaagttgttgacaacgtcaacgacctgaattagttattatttcaattccaaattagcaacattgatatactatttttataatcttgaacaaaactaattttacatcttctaattatagtctcaaaaaaaacacatgtaaaatctgtaattatttttactttctcttataattaacctttccttcattcttagccttttttccctcaagactcttctattaagcagccttgggtctttcccaaggtttttcataaaatgattaaaacaaaaatg

SEQ ID NO: 24340 - DNA, 3000 bp, Unknown; identical to SEQ ID NO: 20842
  misc_feature (1)..( 3000): 2750-1469P.txt file - cDNA_ID_2174723; gDNA_ID_1620818; Annot_ID_169358

SEQ ID NO: 24341 - DNA, 3003 bp, Unknown; identical to SEQ ID NO: 18347
  misc_feature (1)..( 3003): 2750-1469P.txt file - cDNA_ID_2174764; gDNA_ID_2214458; Annot_ID_182710

SEQ ID NO: 24342 - DNA, 3000 bp, Unknown; identical to SEQ ID NO: 2834
  misc_feature (1)..( 3000): 2750-1469P.txt file - cDNA_ID_2174902; gDNA_ID_1620606; Annot_ID_161790

SEQ ID NO: 24343 - DNA, 3003 bp, Unknown
  misc_feature (1)..( 3003): 2750-1469P.txt file - cDNA_ID_2174947; gDNA_ID_1620604; Annot_ID_161723
tagttgatagtataatatgatatcaatatcatagtagtgaatcaaagaagaatgtacatatgattaaagtgagtaattcttgtatgagtggaatggagatatcagatatcttctaaaagtgatttcgaatcatggacttgtaaaatttttcttaatttttgactttttgatgaccaattcctctatttatttatttatttccacaaccgaccaaatattttcagataatatactctgatgggtccattgtattttgggccaaaaagcagtcctctattttatcaggatcagtgggaattgactcggttttgttctacttgtaatgggttatgacaaactgagaccaaaccagccattttacccctgcattcttattacaaaacggccaatgttatattgtcaactgaaatagttgagaaatacagtttacaaaaatttggcacctaaaaagagattgaaacattctacaaagcgataaaactttactttatctttgaccggacaataaatgataggcatttctagaattttaggaaaaaaatgaaaaaaaatcaaaatgtgaacgttgatacaataagaaagtcggtgaacaaaaaaaagataatataaaagcataatatagacaatataaaaattggttcgaccatcccaaacactacggaggacccaaaatatgagccaagagacagcgatagcaagcttcaagaaattccaacagtcatggatcgagcagctacgaaaccacctgaaccacctccgctccgcccaaaaccatcaccggaactctgctaccggtgatgaggaacggttaagggaggctgtggacagagtgatggaacactttagagaatatcacagggccaagtgggctgcgacggataaagacgtcatcgaagttatggcttctccttgggcttcagctcttgaacggtcgcttcagtgggtcggtggttggcgaccaaccaccttgttccatctggtttacactgagtcgagtattttatttgagtctcgtatcgttgatatacttcgtggctttcgcaccggtgatctcagtgatctctccccttctcagttcaggttctacacgaacccctaattagctactttgtttactaatcacaactactagtaaagatttttttatctaatttaataaaatatccttaagttacgttgtaatttgattgaagtaatatcgtgatttgcgcgtgttattgtttaccaaaactaatacaggttcactcctacacctagagatatcaaatatgtagattagtttagaacatacgatgtttatttgtttacttttcttaccaaaaatgttttagaaagtgaaaaacacatttgagggataacaataaatttgagagattaaaacacttattttactttcttttttttcaatgtgtaaacaataacatatggactaactaaacatattttgattacttaatatttaatatttagggttccatttgtcaaaggcaggacggtaagtgagctacaatgtgagaccgtgaaggaagagaatgcgataacggaagagttgtcggagtggcaagacgatgcgagtgaccttgtcatggggacatcgtcagatcccgaccagaggatccgacggctagcagaaatcgtccaccgaactgatgatctgcgactgagaacgatcacacgtgtggtggaggtcttgagtccgctccaacaagcggagtttcttgtcgctgcggctgagcttcgtacaggcgttgctggttgggggactagccacgaccgtcgtcgaagttccgaagtttaaagctaactaaaaccggtctaaaggtaatgagaatcgaggaagaaaaatagtttttggatattaattatatgtttttaccatgtttttggttatccagactgagtttggttttacatggttatgaaaacaaaaaaaactcatatgttatgtctctacggttgcaataaagatcaacccacgtgtggtgcttgttagtttaccttttttagttagaattttgtgtgtttgattttttttatgaggtaattatcggaccttattggggcttctgatagtttgtatataaaaaatactaaagacagagaatcggggacatgggtcattgttggtttctatagaccaagtggataaacagaaaacaaaaagtcagctacagaaaaagacatgaagtgaacgtggcactgccatgtctcttgaagacatgcaagaggacacttggtgtggtacgcgtcctcctatcacggtgtcgattccaaacattttgtttggtttagttttaagattcttcttcgaaagaatctcatttttaatcgaaagatatgatgacatgacaaatttcttcttacataaatttgctcttataatgtttattttcgtgtaagttttatatattttctaaaatattgaacttaaactagctagaccctttataaaaatactatcagcccttttatataatgctttggtgacaacagaacgacaagaaaaactgagaagagacctaaaaacgattatagcggttttgattggttgaagatgtgtcacaattttttttgtttatttcgtttcatttttatttaatatgctagtaaacctgttttttttttttaaaactgtattataaaaacgtgtcttgttaggcctttaaagcccaaataagcccaatgaaagaggaaaagaggagacactgagatttggcccaaactaacgcatatatttgtgttttacatttatacccctatgaccgacatcaatttaccgacagactctactttcgagaatggcgggaacgtgaactgaaccctaatcaccttttttctcgattccccaccaatggctatatgattacagtagcccccttcgtgtctcttcgtttccagttccctctttatataataaatcgctccactctctttttccgagaaagaacacagtatctcgtctacaacacctgtcacattttgagaacaacggcgaaaacaatg

SEQ ID NO: 24344 - DNA, 3003 bp, Unknown
  misc_feature (1)..( 3003): 2750-1469P.txt file - cDNA_ID_2174959; gDNA_ID_1620604; Annot_ID_161726
gtgactagacaagtgcctacgccgaagaatttgctgtttaagttttgtgaacatatgtctgaatctcttaaacttggtgcaggaatgagagaaaaagttccatgtctgacccttaatcgatgctagagttggtaacttgctatgagatatatgcgaagctgtccagtttttgtttggcttgcttgaggatttccaatcttctggaccaagctctgcttaacgtttaacaatgtattgagttgctcctaggcttcaaatgttgctgcttcttttggagatatgactctggttaaagtttaaccaaacattcatttatctggttaatctcaaacctttgctatgtttgttatcccacttttttcatatggttctttctagatctctgtatctggtgtgtcttctctcgtgatctcaacattcgatgtgaaaccaggtagattgtaatattgtatcatagactgcaaaagataacgcaaaagagaagtctctgatctcaacctgaatcagacttgttaggagtccctcttgtttggtttaattcaattttccggttcggatttctggattataaaccgaattaactacaaacggaaaaacgtaccgcgttattgcggtaaccagcaactttaattggcctatagtagaatcaaatgaaaagaaaagagcaattttttttttttttttttggttttttggttaaagaagaaaagagcaaattggaaaaacaaatagataagataatttatatgatttaaaagtcaaatgtaatcacaacatataaattttaacttataaaatatagtcacaccattgcctcatcgtatttgctttcatgaatcatcccaccacttgtaagctttattttattaagaatgaaaacggagaaatataaattgaacactatatactattgtcgtcaccctccccgaatgtttctgataaataatgttaactatcatctaatacgtcaaccggattatcaccgacactgaccccacacctaaccactgatgcacaagtttatattagtgtaggtatcatccacaatatattatccaataattgaaccttgttaatgtctttggttcataaagcgatctataatcaattcagcattattgctaaaattcaaattaagaagacggcatgatttgttaaaaccataaagaaatacaaaagggtcaatgataaaactgtttaaacgaatcagtctacccaagagccgtctctcgaatactagttttaaattcataagcgtatagagtttagtgattccagaacactttacaggccaaaatctaatatttcgatattttgaaacgacatttttagtcctataattaaatttgcaacgtattagattacttttaaaatgtgatactgcgaagaaaatgaatcaaaagattgaatcgaatattcgaacagacggacaagaacccacgaagcgatacagatcagaaactctgcttctttttttaacaagagatcacaaacttggttgacttgagttcatattataatgacgtactcagtgattcgaatattccataaatagtcgtaagaataaagaccttaatgtatacattgttcatttcgtatgccacattgacgaagatcactgatataaatttcaattatataaatgtaaaataacaaaacaaaaagttacatgttatcaaatagtgtcattagctaaataacatgttacttggccaccacatcacttttgttgagaaatttctaaaatttggctatttagtgcatataccctttaaaacttgttgtaaaagcaaggaagaggaaaaaagattgaacctatagcaaaggaaaaagaaaagagagtacatattcttaagtcttgattacaatattttgttcttcaacatattctcttagagttgagataacataaattataatatagatgctctattgggtagcagtagatagaagaacatatgctgaaaatcatttttatagatctagcaaatcacctttataaaggatccagatttttttttttttaactttttgaaagtcaacttgatcatatgtgaaagttagagtcagagatttatgcatcttcgtgcatagacaaaatgcatgcacgagctcacacgatcctgtttttttttcttaatgaggtaattttcttgctgtcatttttttttctaaagttaagattcatataaaaaccatatcaggtaattccttaattttgtgtaataattaagaaatcaggatcattagatctttgaccaccaaaactcaaatttgttcccaaatacactcagttaaagtactatctttaatcatttcatattcgttactttgtaaattagtacaaagtaagtaacaaattttagtttacccaatgaaatggaatgaagttaatgaaaatattcgttcttttagaatattcttctgctcttgacagtgtttaattatttaattttcttacttgaaaaaataaaattgaccaacaattatttttcttacctcatgtagataacttacaaaataaaacatatatatatgtatatatatatttattttcaactcagaaataaataattctaacgaaaaaatatgaaataataaaaaaatctgacttaaaaagcgcgcatcgctcatgccaacacactccctcgtctataaatacttcactctgctttcctcaatcacatccatctctgaatctgattccacatcttaaacccttattccctaaacatcgaatttggttccttctcccacaatccgcagagatttcttcttttcaggtttgtcaattcattttttttttcagtttgagttttgttttgttttttcgtgattttcggtcagtctaccaaatcccctgtttttccggcgattcagttgtcaacagattttgcttttctttttccctttttgtgtaaaaaaactcatttcctttttgatctgatgattacagaagaagtaagagggtggcgaagaagatttgattgatcggcgataatg

SEQ ID NO: 24345 - DNA, 3003 bp, Unknown
  misc_feature (1)..( 3003): 2750-1469P.txt file - cDNA_ID_2174980; gDNA_ID_1620604; Annot_ID_161731
ttattacctgaaagcttcactctcttagctttagtgttaaaatctgaaccatctcttgaagcagatgcctcaaaaccttgtggacatgcatatccactagttaccacagagttggaactcagagaggaattgacattcttactggaatcacattcgaagttaatggctccagtaacgagacatcttttagtagtatttccaggatcacttccaaagaaaacttctctgaatatctgatgatcctcatatgacccttcaaagcagtcacctcctaacatctcaatctcagctccgggaagcatctccacaaactaactgcatattccacttcaccttaacttaaaaggaaggttgtagatagatacctgcaattatataaagtaatgaataaactcacagaacccaaaagtttggaactcgacatcctaatccaaaacacatacccataagcggaagcggattcaaaacaagataaaatcagagatccttctagaaaggccaaaactttgaagcctagagcaaaacgatagaccagatttcatgaaattgagatgttataatgactaattacatccaaaaagaaagctcaaaaattgggaaatgcaggacattaccagcatgcagaatgaaatcagagctgtgaaatcggagaaatggcttcttctcactgaaatagactcatttcgtcgcccttatcctctccaaccgcaagtgggaaacgcattttcattccatttcacgttctctgcactcacacactctctctccttgatctctatctcacacacagaaagaacaacaatttgtctatctttttagctttttctataattgtggaagaaacccacctctgattcggtgttaaatctctcaaccaaaattcatcagatagataaattctgacgaactttttttcacctctctgaatctgcctctatcactttgttgtgcacagtgtgtgtatacttattattggctatttctttctcttctcgttttttttctttttttcttttctataaattgtgtgctgtcaccaaaaaggcatcttcgtgtttttattttatttttccttcgttatactgaaaaagtcattcttcatttttcaccttaagattctgtctcctctctgataacaacggaccagcagttatagtatatggagtacttaaattcgtttaattacacaaattaaaacccaaatattcgtcgtttttttcttctgttatcaaattcttaatcctgttaatgacgatcgtatcactataagccaatattaatgactatggttttaagttcttgacaaagtttttttttactaaattcgccacagacaaaaactgttctgacaaaaataacagacaaactaaaatgaaaaaaaaggttagcatatttaattgccaggtttctaactgttcttctgttgtcgttttaaatcatttcagcttatgtttttgtcctttaaaattcagtcatcaccgattgtaacaggttttgtcttaatatgtataatcaatatctgttaagtggattggatgctttgtaatttgcgcggggaatctttacgtgtcttaacgataacaaatactgtactatcaaataggtgcatgcgatgatggacataagtcgtattttaacctattttgttgtgtgaacagattagttattgcatgttttgtattaactatatataggaatacggctctgaatctttgtttcttcttattcgattttgatatatgaaaattccaaaaagtacatgtaccagtacgatgaaaacgactgtgttatgtgaaagtatttgtttttaaaaaaaaaaatatttagaggggatcaattctagatacttttttcatttttaaggtttaactatggttaaaaagaaacgattcttttttaaaagggtagatggtagacctcatttgctaattttgatccacataagtcaataacaaataattcggctcgcttgcgaagctaatgcatgagccacgtgttttgctttatatttggctttctgtattgagacattcttcttcatcctaattgtgaatggaatatgttggacccaacgaagccatcaaacatggttaaaacacacaaacatgtgatttaatctagtttaatttcgtctattacaatataagtgaattttgacacacatccttggattatatctaaaacgttaagtttgttaaaaacactttggaccggataatgggtattgatcatttattgtttgttgcatgttgggttagaaattagagatcataacaaaaatcatgatttcaggctgtccattttgaaaaatgtgtgtgtttgtgttaatttgaatacaccgattcatccaaaaaccatctgaacagtctcttaattagtttaccgtgtatatatatcatatttatgggatcatatttggttaagtttaactagtagtttcaaatttcgcgttaatagctatttgaaagggtaggagtactttttcgaccggttaacactcccatataaagcccataaattattggaacgctacaaaattaacaaaacatctcttcagaagttcgtccggtttactctactacaaagtacatgtatcaaaaacgacaacacgtgcttccacaaaattaagaaccaggacgtgatgtcgttgttgtaatacttttttctcgccaacttcacgccgtcttagtttaccgaaaccaaagtggctttttctgattttatccaatacaatgacgtggaaagactcaaaagaagctttcgccacgttccaccaatgaatgttcgacacgtatcgtcgagtttctttttctttatgcttacgtcatcgcacacgtctatcttcttttggttaaagtgataaaaaggaaagtcgtaaatggcttcgtcactgagtctttcctactattttaaccccattagtgacactcctttcttctccactacactccatttctctttcttcttgactcgaccatcgtttctctaatctccgcaactatg

SEQ ID NO: 24346 - DNA, 3000 bp, Unknown; identical to SEQ ID NO: 2819
  misc_feature (1)..( 3000): 2750-1469P.txt file - cDNA_ID_2175004; gDNA_ID_1620604; Annot_ID_161741

SEQ ID NO: 24347 - DNA, 3003 bp, Unknown
  misc_feature (1)..( 3003): 2750-1469P.txt file - cDNA_ID_2175013; gDNA_ID_1620604; Annot_ID_161745
cttagattcagatcaagaacttgaagtgtctgtatagactttccaaagggttcgtttttatttggattttgtctgtgttgcaaactactaagccaagtaatggaaatggtttagaaagatcatttttgttgtcatctattacttggaatcttaccagtactaacaataaacataacaatcacatttctgatactcttcttgattaaaattgaaactattacttgctatatagttaaaccccagatctaacgtgagaaaactgtaaaggtatgagagaacgtagatgtaacctcaattaattgaagacatgcttatagttgctaaatgtgtgacaccaaactaaagttgatcacatgatcgaacaaatcccacaaaatcaaaatccaacctcatagaaatagcattctctgtttcttacttgattaaattatgtttcaaagatcataacatgtaataattaattaatttttaaaaaggtctggaagtgtcattaaaagcataacatgcagtttaattaagtgattaaatgtatgttttgtctggttctcgtcctttaatggtctctagtcaaactcatctctcctctaccagatcaacaaacaactgaatcctttttacgcgccactctgctgcgcgtgtacttcacagcctgtcatagtaactcctagcgacgtcagtgagaactgagaactttctccttctttcctaaattccaagtcttgaacacttttttctgttaaatgttagtgccgagtctacgaaatcgaaaccttcttaagttctttaatttcttctaaatatctctagcaagatcatactatatctacgtacttattatttttgggggaccaatgagcacatgtttatatatcaatcatattaattgtcagtaaaagcacgtagacaccttccatctttgtaatcaatttggcatttattatggataattgtttgtttttgtatacaacaaatgttcttgctgttgaaaacgggattattacatcttatagtaccattctggtcatagtaacaacagtataatataatttacaaaatctatttattttttctgaaagttgtctttgtaacaaattaaattattaatatagcagaagaaagtatgcatttagtatttactatatatggtttttctagcatttagaaaaaataattagtctagttgaaaaataaaataaaagtagaaaaagagttattaaaagcatgttaatgctaatatgagggtggtcctgttagtcttataatggtctggtcaaactcctccttctcacgactgccacatcacacaacccatcttcttccattttctgtttagtgtgaccgttgcttcgcgccttcgcggttcagtgagaagctcacgcgcgttttcttacccgcgtgatttttcaccccattatctcctttatgtgattcttctgttaaagttccggtttatgtatctgatccgaatatctcctttatgtgagtcaaacatatgtgtatgagtgagtttatgtatctgattatttaattttatggcttccttaattgaatgatttaagattaatagtatgtctctaactatttggccaccatactcacattcggaacaacataaatgataaagaagctagcgaatgggtccgactccttttaagtgctacaaaaagcgacacgacgtccttagtttcatgcatccatccacacgaaaatgtaaagtgagaagaaaactcaaaaactaataagaaatgttaaaattaataagaaaaaacaagggccatgtcgaatcattaccctatctctcggtactccgatcacgtgccaactttgggttctataatgcttttattattcatatttaatgtatttttttctttaatttcttttattatctgtcttcgaccgtatttagtccaaaccatgtgaagatttccggtctactgtttttatcattatgaaaaagaaaaggaaaaaagctatggtcctctctaattagagttgattaaaaatttgaataagaaataattaatttatttcactctctccagcttgttctttgtggtttggcttatactgaaaaattgaattcccaaatgtttggtcctattgagtaaatatcatccatttatctaaaatgataatcatttcaaacctaaacacaacaagaaggattttaaaacaatagacctgaactcaatcttactaattcattggttaagttgtcacgacatgtatatgttgataacaaaaggattggttacaatatgggtgcaaattgtggttgtggcttaatgtttttaaaattcacaaattttcaaatattgtctaaaagtatcccacttgtcataaattaccatccaagatccttccaatctctacatgcatatatgtccaataaaatctagctagagtacgagaaaaatatccaaaacttttgaatttgacaaaaagtcttatctttccaaaggaaaataaaagtttgtattatttatttccaccagaaaaaaatctactaaaaaaaaaagaagagactacgaaaacaatacatgcaaaatacacaagagacatgcgtgtctgagtgtttgtgtttttgggaaagccaataataccttttccctttagtgtgcacatgtgtgtatccacagaagcgtacgaaccctttctttaactcgtttcactctcatgggccacattactttcaccatcccctaaattaccacttcacccttcttccatatcattcacacaactaatcaaattacctcaaaaacgcaacaaaactaaatcgtgatcagtcaaagatgattacatagatttaggaagaaggaatctcttaccctaactagatccaggggtattttagtaaattatcataggtacccctaaaagtctctcgattccgttacactctcaatatctctccaatggctatggttactactacactcttcttcttcttcttcttcttcttctccttcttctcactgtaaaaaagaaaaaaaaatg

SEQ ID NO: 24348 - DNA, 3000 bp, Unknown; identical to SEQ ID NO: 5943
  misc_feature (1)..( 3000): 2750-1469P.txt file - cDNA_ID_2175025; gDNA_ID_1620834; Annot_ID_57919

SEQ ID NO: 24349 - DNA, 3003 bp, Unknown
  misc_feature (1)..( 3003): 2750-1469P.txt file - cDNA_ID_2175025; gDNA_ID_2684203; Annot_ID_191285
aacaaaaaatgttcctgagatgtgtttcagagctcaatctctatctgtacaacttttcctaacctcgccgcaaatttctatttacaatcggagactgtaacctatccccaggattagaaagaccaaaaatttctaaaaaagacaaaacaaaaattaggattcaacgagaacgaaagaggaaagatttcagaagccaaatctcaaagcaagagacgacggcattttttgcgtctgtggaaccacgtcttcgatccaaaacgatcaccaaaaccatgcggatctaactctaacaacaacatcttcgaaaacagaaccgattaatcgaccttaccgaagaaacgatcatcctcgccggtaagcgataaagaaaaatctaaccgcgaaactcgtttccttcgccggagatatccaataagcaccaatacaagaccgatgttagaagagagagagagagctcaaagagagtaatcgcgacgagagcacacgaaaatgagaccttatacagttatactgttacgagcgagtctagggttccggtttttttccccctgtaaatataccaaattgagataccggtatagattataaaccggcttgcattttccggttcgattagctgatttctctatgtaacaaaatgccatttacagttttcaaatttaccggttaaaattgacctaaccgaaacaaataaagtggaaatgttttagtttttgattcaactaagtgtatcatcaatggattttatattgtttccatattgtgcaaaatgtaatcagaaaatgatcacgatgtgcaaattggtttgcttaatttaagattgaattacagatttttttttatcgaatattaaaggatttattaaggaaataaggaagatctggtaaaaatcagatgctggcaggtgacacgtgtcactcatgactaaggtcttaaactcttacggataaagaaagcgacaaactgggagcactcttagaagacgaagaagatcgacggcagagatagaaaaaagctaaaaggtcgtcatcgaaaacaacggctaagatcttgttctcggatcagacccaacagaggagagagaaaatggatccgcttttgtgatttggataagatgacgtggcgtccatatccttgggtcgttgggcagagaagagagcagaaggcagtgtgagaggcacgtgatctgtcacgtgatttttgattctttttcactgttacacttccactatcgttcgagctatatttttttttatgaaaaaagaatctaaagatttatcagagttcctcctagagatgctaaatttataggaacagtggtggtccttggacaatagtatgatactaccaaacaccaacagaaatcatttttctgtcgttgtatcatttactgacataacttgattacaaaaatatagtattaattagctttgggagtttcacatattttagtatcaaatcaaatatacaacagaaatcaatactatagtatttggaaatgcccactacctaaacatatactacatttctttttcggtccacgcttacttattacatcgttaatccttatcttcaacagattagatgttaaagtgagtagacaagcttagactgattccaaccatgtgatttgattccaaaaagaacattatagctgtgatgggcttgagtgacgaacaacactgttggttctgtatcaactggtgatgaccattatttcagcccacaacttggagataaaagaaccaaatcataagcagtttccacagactaaagcaccaacaaaaactatggaaagcttttatcgagcaaaagatcacgagtcacaaacataacaaaaaagtacacgaatcatgaaatcaaatttctcaagttccctatcaaaacgctttaaaatacagaaaagggatcccttctcatttattgtgtcgttctctcccaaaccccaaaacactattacccaaatttagagagaacacacaacggttagttgaggtattcagagtttgaatcaattctaattcaagtcttttatttgaagtataagcttattgggctggtttttcacaatgactgtatatttgacccaatccgcccaatgtgacgaaaaggaggacccataactagtggtgtcctttactttctttttcttttccaaaaacgttaagatcataaactccatacctatatacattaatatgaactatgaagtgtcgtctactttgtatgaatgttgctctcatagtctcatctcattatttatttttgtcctttaaaatgacaaaaagatagtgacatttattatttattttttgtttccgtcgcttgtaatatatttatttgattaataaaatgggacgaaatcacaaatatatattagaagaacaaagaacaatagatacaaataatagtaacattatattttactcataagaatatacttcatgtgtggcacatgtctcatgtagtccatacattcgtgtttttttttgttgttgcatatttgatatcttaaacactaaaatttacacatgattcatgaatgtcaaagattcatttctccctagtgcttctttctctaccatcaaaagaaaattcatgactaataatccatacaaataatagtaacattttactcataagaatatacttcatgtgtggcacatgtctcatgtactccatacatacgtgttttttttttttttttgcatatttgatatcttaaacactaaattcacactagattcatgaacgtcaaagattcatttctccctggtgctttctctaccatcaaaagaaaattcatgactagagagatatatacataatttggaaattggaatgacaaatgaaaaacaaacaataaatgaatactttcgtcccaatatttattaggttataaataaattacttgtgacttgtgactaaaggtgtcaacaatcattcttctatccaatcaatatcatcaaactcttcactttactctctctctcactcataatg

SEQ ID NO: 24350 - DNA, 3000 bp, Unknown; identical to SEQ ID NO: 5943
  misc_feature (1)..( 3000): 2750-1469P.txt file - cDNA_ID_2175025; gDNA_ID_1620834; Annot_ID_169778

SEQ ID NO: 24351 - DNA, 3000 bp, Unknown; identical to SEQ ID NO: 5972
  misc_feature (1)..( 3000): 2750-1469P.txt file - cDNA_ID_2175081; gDNA_ID_1620834; Annot_ID_57949

SEQ ID NO: 24352 - DNA, 3000 bp, Unknown; identical to SEQ ID NO: 5957
  misc_feature (1)..( 3000): 2750-1469P.txt file - cDNA_ID_2175081; gDNA_ID_1620834; Annot_ID_169810

SEQ ID NO: 24353 - DNA, 3003 bp, Unknown
  misc_feature (1)..( 3003): 2750-1469P.txt file - cDNA_ID_2175085; gDNA_ID_2214462; Annot_ID_133013
cttctacactatcctcgcctgaaaaaacccaagagtttccagcagaagatttctgagaggttaaactgttactgatccaagactcatcatccgtaattattggtttttcatcaccaagagtagtgtctgatgtcagattagcatcacaatgctcttcgagcaatggagacttagagagtatttcttcttcagaaaatttctgaggggttaaagtgttagtgattagagactcatcatcggtaactattggtccttcaccaccaagagtactggttgatgtcagattagcatcacaatgctcttcgagcaatggagacttagagagtatttcttcgtcagacaaggaggattcaactctaacttcttgtacactttcctcgcctggaaagacagaagagttttcagcagaaaatttctgaggtgttaaagtgttagtgatctgagactcatcatcggtaactattggttcttcaccaccaagagtactggttgacgtcagattagcatcacaaagctcttcaagcaacggagatgtggagagtgtttcttcaccatccaaggaggaggctgatgaattctctccgtgagctatattctccactaaaatgtcaccttgaactcgttcctcaacccgaacatgtcctaaaatgtcaaagttctgacatggcggtgaatcagaaggactattacaacttggtgaattagaaagacttttagtgatatgcgactctttatcagtaactattggttcttcatcaccaacactagcggctgatgtcagattagcatcatgatactcttcaagcaatggggatgtagagagtctttctccatcaggaaatatctgagactcttcatcagaaactaattgttcttcatcactaagagtagtggttgatgtcatataagcatcacagtactcttcatgcagtggagatgtagattctatttctccatcagacgaagaggaagctgatgaattatcctcaaaactatctctttgaactacattctctttcaaaatatcgccttgaactcgtttctcaaccaaaacatgtcctggaatgtcaaagttctgatgtgacggtggatcagaaggactttcacttcgcggtgaagcaacacgatcatgacgtccttgtacattagaagaatggtcctctgcaacttcctttgattcacctctaacatattcgaatctcggaggttcacttgatttcaaacaaagcgtgctctgtgccaacataagaaaaccatcactcattctctctattctttagacattattagctaaaattgataatgacaatcaaacaatggactaacctgagaagtgaaagagtcaacctcaacaagcaaattttccaacttgttgtagattttactaaaccatgctcgtcctttagattctggtcccatgatggctcacgctatacgaaaattatgcagcaaaaatataaactttggttaggcaatatcatcagaataataaagagttgaaaaatatcatgttattccaaacttgatcgcaataagaagatgaaagtttcaaacaacaaaaacaggtcctcactaagaaacagctcaaaaatcctgaaaattttgccatcatcactaatcactaggtctagattttatcgaaactcagatgcttaatcggaaaagatgaataatttagaaaaactgtactatacagctatctcaaatttgtgacccgagcacgaagatcgctgaaaaagagaaactcatagacgcatcgaattacataaaaaaacgagactttgagatgaaaaacagagaaagtaatcaaaaggagataaaccctgaaattcaaagtaaacatagatgagaaaaacaaggaaagagagaagaatttacctgagaaagtaagaaggaaagtacaacagaggaagaaacgagaaaaaggcctcaacataatcatcatacaacaataaataaatactaaagagcttatttaagatttttttttatttttttattttttattttttgagaaaaggattctaatttaggattacaaccagatccataataaaaattcaatttagagaattaaaaaaagaaaaaaagaaaaaagtagtgttattggtttgtgatttaaatagtgatttaatgactttaaatgttactagaatctattgttattcaataataaaagttaattaagagtttggtgttattagtttgtgatttgtaaaaaatctttataactctaggttattggatttagaatttgataaagttgttgaaaaaaaaaactttgggttattcaactaaaacaacataattttttttattattaataaactaaattattatattattaatttataattttatacattttcgtcataaaaatatcgtcaaaatagagaaattattcgtgaaactttacaaaattacgaaaaaaactaattaacaaaattatataatactctctaccaatttctcttcatttatttactttatatgattttaaatcatcaaaattctttttaaactagaatccaataccagcccaaagttacatatagattccgggcttttattgggctacctatctaaagttaacgggcttataaaatttagtaggcccaatagaaataaagtagtccgaatgggtcatgaatcatgcacgccacaagtgaccaaaacatgatcatgtgtacgcatacgttttgaagaagaatgatccaaaataagaagacgtggattatgccacgtggaggggaatggcacaaaagaggcatgggtctgacgataaatctacctcggggagtgtgcatctggatgatccctctccatcattctttccatcccaaattctttatcttattttaattttgttgaaattccattcacattttatgatgtctcatgtatatatatgcaactctctcaacaaacacataatataaatatatttacctacatcagattcttcatacacattgtaatcaatagaccatagagatttacatg

SEQ ID NO: 24354 - DNA, 3003 bp, Unknown; identical to SEQ ID NO: 24353
  misc_feature (1)..( 3003): 2750-1469P.txt file - cDNA_ID_2175085; gDNA_ID_2214462; Annot_ID_182819

SEQ ID NO: 24355 - DNA, 3000 bp, Unknown; identical to SEQ ID NO: 5956
  misc_feature (1)..( 3000): 2750-1469P.txt file - cDNA_ID_2175085; gDNA_ID_1620834; Annot_ID_169811

SEQ ID NO: 24356 - DNA, 3000 bp, Unknown; identical to SEQ ID NO: 5969
  misc_feature (1)..( 3000): 2750-1469P.txt file - cDNA_ID_2175089; gDNA_ID_1620834; Annot_ID_169814

SEQ ID NO: 24357 - DNA, 3000 bp, Unknown; identical to SEQ ID NO: 2847
  misc_feature (1)..( 3000): 2750-1469P.txt file - cDNA_ID_2175122; gDNA_ID_1620608; Annot_ID_161839

SEQ ID NO: 24358 - DNA, 3003 bp, Unknown
  misc_feature (1)..( 3003): 2750-1469P.txt file - cDNA_ID_2175214; gDNA_ID_1620610; Annot_ID_161872
taaaaaagagaaagtaatgataagaaagattaagaaattaaaaaagagtgaattttacagttcaaaaggagaagaatcttacgtgtgttttatgttaatgtgggaacattagatggtgaaagtgggtaggctgcttaggctggcctctgtaatcattggagtgagaataagagagaagaaagagagagagagagagagcatgtgcatggcagagacaggaaagttgtgggagagaaaacaaacaaaaggataaaattgtttttaattatcatgtttgattattcttggttaagagactattttaaaagatgatggtacttaccaaaacatggtgtcaaaaaagtcaattattgacttgagaaggttttagacttgaatttgatgtattatgagttgtttatgttaatgaagtttataatgtgtaactaaaaacattgagtatacacatatattttcataggtttgtgttatgtgtgacatataatgatgatacaaatgaatttgcatttttgccttttaagaatatttctgaagtagtctctgctccacttgaagttacattggcaagagtttgagatgcatagagctgaatatagtggctgagtatcaaaagtcttttttcgggttcttaggggacgcgttctagtacatgctgaagcgctttcttgattcctccttgttccagagacgttgtcaagtgtatctcttgcacctgtaatgttaatattttacttaaaatcaaaccaagaatctctctatctatggccatataaatgggtagcttctgagatttacctgtcttccagcacgggcaagaagaacaaacttcccatcagaaggcggtgtctgcgtgtgaacatgcgcatagaatcagaattttcacagagcagagtttattcttacgggaaagtaaagagaaacagaactcacatttgagagccaaagttgtaggtcttgtgaaaccactcttttctcaaatccttgccggttgattttcacagcttctattctgcaatatagaaatgaatattagttacacactggaaccaaaatgttatgcctgaaacatagattctataagtaatgcaattaacaatatccaactcatcatgggttcagaaaaagtatcagccagcaatagctattgacatgtatatattcaatcgcaaatcgaggagtgaacaaatctagtagagtagaggtgatcctagtcacttataataagcagatattatgcaaagagctgactaggactgcatagtaaatttaaattataaaatgatattgtctatatacccatcttcctttaaaagctcttcaagtattgtttctagccctggaagaggttcaattgtatccccattgttcgagcttagcgaaggagatccagtagaactgtcctgtaacaatattcaattatctattaaaaatcactaagacccacaagagacagaaaacacattcattcacattgttttaccttcaaaatcactttgtctaatgtttctagaagaggatcatcttctagttgtttgatggatagtgtaatccttgatttctctctgcattggaacaacttttgattaaaaactatatcatgagtcatggctaataaatttcagtaaccaaaataagcaactcacttgtcaatattcgtgactataacccgaacctcgtcaccatcgcgtagtacatccctaacatcttgaacgtaatcccatgatacttcggagacatgcactagtccagttaaatgataaagacctatacaccaccaccccacataactgacatcaatgtcataagctcaaaacaagaaaaagaaaccaagaaatttaggtaaaagcaaatataccatcatcaaaacgcaagtggataaaggcaccatagtcctcaacagaacctactcttccgttaaacacatccccaacattaacgttttgtgaatactttggccataatgctaacttctcagataaaatcaactttctattttcctcatcagcttgaacaacctaatataaagatttacctcaaattataaacaatatagagatcacaaaacaagccaaaggagaaaactttacctttacaggaagtttagaaccaaccaaagtcttagctatctcatgaatacttttctgaggctcttcataaagcaaaacacaaaccatcgatcaatgtaaaaatcgatactttaaggacataaacatagaaccttgtgaagaagagagagttttggttacctttacaagaacgggaaggacttaattgtggataaggaagaaaacccacaagagaatgaaaacgaataagtaagccaccaccattaaagccttgaacttcaccttcaaatgtatcaccacttttacaataagcttttgctgttttccaatcgcttggtcctgcagctgaagcttcgtcggaggtatcacggagaagagaattggaagcggagaggactgaggaagaggctgattgatcggagtttctatcggtatctgctgtggcggagcttgagaaggatttgactatgcagacgagagagtttctattggaagaagaagaagacgaggaaggaaggagtctaagtgggcaagagaggaaagtggattgttggtcgaagagatgagaggcgaatgaaacagaacctaaagtagtagcgccactaaaaaccgccattgttgcgcggtagagcaaaaaagccacggagattgaaggtaatgatggttaatggattttgccattttggataagaaagtgagagactggagatgaaggtgacgtggcatttgtcagctcacaggtgctatattttaaaacatataggatcaatttgtaaacattggataattagagggtttctttacaaaaacaattctaattcaagcaaagagatcaaatctttttcctcagtgtcgtcgtcttcttcgcaaagcctttcaaaaacccttcactactctttctcagagtctcaagcatcattttcccgagaaaactatg

SEQ ID NO: 24359 - DNA, 3003 bp, Unknown
  misc_feature (1)..( 3003): 2750-1469P.txt file - cDNA_ID_2175236; gDNA_ID_1620610; Annot_ID_161880
gatgcatcgtacatgcatgtattgttatatttttatataaatatcgttgaaattggtattgtgtcgtgtaaaggtggttataatgtataataattcaaaatttctcttcggtaatgtgatcatttcttttacttaaaaacatcctcttgttaaaagtgtaagctcgtatactcaatcaatagggcaatacttctattgtcgacaaaacaataactattttgggttttgggacacccaaaaaagggaaaagttcttacaggacatgcagacacgagaacagactgtcacatgcaatgctgatcgtcattctcattcatcaccaagtttctcacgtccacatatgtaaaagcagataatgcagtttcatcatttttttatatatatgagaagtgtaactataaccatatcgtataaaaaatctctatatatagatagacatagatttaggaaatatttctttcgattttcttccaaaatccagcagcgccgtcaagattcttaagaatgatttagtcacagctcatcgatgtattaaatgattataaaacaaaatcacacagctcatcgaatgcttttatgctcaagtgctttgtctactttacattacattcataaaacgaaaaaaaaaagataaagataacttcttcttatgaattctagagttttcagtttttggcatcttaaaaatattaagattctgaagttgtaagtcagaaatttttgaaaaagtgtaatcttgtcaacatttgagcatgttatctacacattcttgtatcaccaattctcgatgtagtcgaacttaagaagtagataagaatggcgtggacctcaaacatatattacaaactttaattttcaataaaactacaatattaggttggacgttttaaaatgtatactgtaaaaaaaacgaatgttagaaaattattgacgagatgtacaacaatatttttctaacaatgtattttgtaaacttctgattggcatgacacgctcgatcgcaaccctgctagcgactaatcaaaataaagacgtccattcttttctatttggctttccaaacaacaattaaccattttggaaaatgcattactaaactcacaactccgtcgatcaacaaaatcagaaactgcatctcttctatttgggattaccctcctctttgcaacaaaatgctcatgcaaacgtatttcgcagaaaattacccacgaaaatttctctcaattttgcttatactttctaaatttcgagaaataatatttttcttcatcttttgtaaatgcgcttctttctgttagcaataaactgtaattataataatttgtttgcaaactaaaacaaatgtactaaaatggcagactaaatttaataaccaaatagtgtttattattgtcatgtcatacaccgaatttacgccatgtagaagtaaaagatcaaattaaataacattactgctgaatttttcgttagtataattaaaaagagaacatgtataaggtagactgtatgtagtctatgtagatgttatataaatgattttttttttctttcaactatatatagattagctaggtcggttgtattacaaaattaaatagtagtaatattttattttaaaagaattgtgttgaaaattttgatcgatcgcctctcgctctttaataagccattgactctttaaaacaaaaaaaaacttgaacaaattccatttgtctattattttaataaatacggtgttaaactaaaatagtataaaataatatccaataaactgtatgtttgttgacagaaaagaatataatgattttaaaacttcaaagacccaagtttcttttgaccaaaatctattgccttcatttattataactcgcatactgttttactcatacagatcattaaaaaactataagcaattacataacttgcttacaatcattgaaatagacgcacatgtttgccggaatgatgaaaaccatattggtcacacccttcacctaacaaagggtgtgatcaccaaaaatcacatcacttgcttaatttttcataaaaaccgatatttctaatgatgttaattggcaaatatgataatatatgaaatatttactttgaaatatgagagtaaaaaaattgaaacaacatttcttttgttatctaattacattacgcaagttattttggttcaagttaccccaacattgcatgttatcatgttatcaatcaatacaataatcgatcaagttgcatagcataatagcatactccatttatggaactataattactcaactcgagcttcgaattatggtggaaagctgcagcaaagtattgcaatgaatgcggcatctatagctatgccagtcggtcaacacaatctataagctatagcactactatagtccttgtggtcctactcagccaccacaaaaggttcaaggcttcaagcttcaaaggttcgaccacattcattcacaatcatcatttaacacataaataatctccattatcacctccttaaattatgcttcaaaaactttcttaattaccgaccatactaccaaacacaaattatgattccaatttaatctccattattacaaccaccttccctcaataataacctcaaatcaattaaacccaaatttccattattatcatccatatctttaaaacactacttattacaaacaaacctaatccctttattcatacattattacaccttttatattttcataacaaaaacgcgtagtttctgtttttaacggaacgggacggaaataataatatggttagatttataatagtaatgatctgttgaataagctaagtaacgacacctcactcttcgcttgcttccattcatcatctctctctctctctctcttcccaaaaatcaaaaaacagaaaaattaccaaaccctaccaatctccttcttcctcctcctcctccttccttcttcatcctcctcctctctacgcgccgcgcgtgttctctaatcaatg

SEQ ID NO: 24360 - DNA, 3003 bp, Unknown
  misc_feature (1)..( 3003): 2750-1469P.txt file - cDNA_ID_2175252; gDNA_ID_1620610; Annot_ID_161885
cacttacattgatcaaagtcagcctggcatatacggaaatgaaaagagtttatgaggtttgtgaaccagataatgccctctttagtgtttcatgctacctaataatttggtttaaatgagttttttctgcttgttcatatttctgatgcttggagtcgtcataagtactttgctctgctgttgcagggtctttgtttgacaaaaaatcaaaagcctccaatgtatattgtttcgttggtggattggttgtgggcgagagtagttgcatttttcctatggccattgcatatgttggctgaaaagcttgtacacagaaaaattcgttcgtctattgggataacaaaggtagtattacaacattctacttcattttcagttacttgttttaaaatttttttaccttacaagcaatattgtaagactgacttgcaatctattctctgtttcctccaggctggtgttagtggaggtggtagtttacctatgcatgttgacaagttttttgaggttagaccgccaatattgtttcttgaaattagagataaatgtttttttttgcattcaaacaaagtagtctgtccatatgtaaacaggttagttctttatgcaggccatcggtgtgaatgtacaaaatgggtatggtttgacagaaacctcaccggttgtctctgcgcggaggcttaggtgtaacgtaagtttaaactcacacctcaataacctctccttttgtgacctctgcacagaaaaactgtttagatcttattcatcaattttcctaactttttttatgaaggttcttggctcagttgggcatcctattaaagatacagagttcaaaattgtagatcatgagactggtactgttcttccacctggttcaaagggcattgtcaaagtcagaggcccaccggtgatgaaaggttactacaaggtgatacacactttctgctcttagtttgattacattttgacgacaaagttgtgaaaggatgacacagctgtttttagctatcaaattttctgtccatgagtgggtttgtttgtgaatactgcccttatatataactagattatgtgaactcttttccttcttggtctcatcattaaagcatctcttggaatctacatttcttgcaatctatttcccttttgatacatatgtagactccttgaataatctctgtgttttcgatgaatgcttttagtttggtgattagatcagattaactcatctttctgttgattatctcagaatccactggccaccaagcaggttatagatgacgatggatggttcaatactggagatatgggttggattactcctcagcactcaacaggacggagtcgtagctgtggaggtgtcatcgttcttgaagggcgtgccaaggacactatcgtgctttccacaggtatatcacatttgtactgtttgttgtcagcgtccacataaaccagttcctcggaaacctgaaacaaaattatgtttcctactgtctgtatgataagcatacattttaaacactacaagtcttaacaacaaaatgtgcctctcaagttaaagatgaatccaagtgaattgtaaccgccttgctgcacaaatattgctaagaatatttgatagcagtttaattgttgtaggtgaaaatgtggaaccattggagattgaagaagcggccatgagaagcaatttgattcaacaaatagtggttattggacaggtacttgtttggagactttggtttaggaacaatggtatgggctgtttcacttaattaatcttcgatttggatgcgtccttgatcttttgttctcaggatcaacgccgccttggagctattgttatcccaaacaaagaagcagcagaaggagcagcaaagcagaaaatttcacctgtagattctgaagtcaatgaacttagcaaggagacgataacaagcatggtctatgaagaactaaggaaatggtaatgattcaaaccaagtgtgatcccactctaatataagagtaaactttacctaatcaggcaattactcatatatacaccatatgatgcaggacgtcacaatgctcgttccaagttggaccagttctgatcgtggatgaaccattcacggtaggttcttttattcgctctcactgataatcctttaatatgcaactcaaagatttgaacctcatgtgaacgttctatgaatatcgttacagatagacaacggtttaatgacaccgacaatgaaaataagacgggacaaggtggttgatcaatacaagaatgaaatagaaagactctacaagtagactagaaattttagcatcctctttattttacaattatcttgttaaggattagcaaatgtgaaccagttcttactccattgttaatataagctgcatatatctttgttcatcaactagggatttccaagttctgcagcactatggatacttattgagtctaatagaatcaataattggaagaagcagttaaaccggtcaaaagacctaagtatgttggagggtttgagatatcttgacattctgtgtttagaggaaggctagatgttgatacaatattgtataatttgcataattatattatccgttcaatccaaaagcatttaagtgcgatgtaaagtgatggttttttctagtttatgttaaaacaaatgattagtctcactctctagtcgatagaatattgcaacttgtttataaatttgattaggtgagctatgattagtagtgcataaatacattatctatgagacaaagaaacgtgataggttattgttttttcttgtttgcgtctggcatatgtatgtataaaaccaaatatcaagcagaacatatgcgattttcaaaatgtgggcggtgctgaaaacatatattagtttactccaacttgcagaatatttgagtatattaatgcaaaaacagtaaacgcaagagcaggtgcattactagctaagacagcttggttgagagatagagacgaaaatg

SEQ ID NO: 24361 - DNA, 3000 bp, Unknown; identical to SEQ ID NO: 2849
  misc_feature (1)..( 3000): 2750-1469P.txt file - cDNA_ID_2175270; gDNA_ID_1620609; Annot_ID_161844

SEQ ID NO: 24362 - DNA, 3000 bp, Unknown; identical to SEQ ID NO: 2855
  misc_feature (1)..( 3000): 2750-1469P.txt file - cDNA_ID_2175274; gDNA_ID_1620609; Annot_ID_161845

SEQ ID NO: 24363 - DNA, 3000 bp, Unknown; identical to SEQ ID NO: 2854
  misc_feature (1)..( 3000): 2750-1469P.txt file - cDNA_ID_2175293; gDNA_ID_1620609; Annot_ID_161850

SEQ ID NO: 24364 - DNA, 3003 bp, Unknown
  misc_feature (1)..( 3003): 2750-1469P.txt file - cDNA_ID_2175313; gDNA_ID_1620609; Annot_ID_161858
catttgtggttttgaatgtatatgtaaacacattcactatcagcattcagcaatcggataactaaacaaaaacaatttgatgatttggagatttggaaatttacagagctaaaagtgaaaaatgccagtgattaataaaagaaaagataattaaggtcggttagtaaaaagacgtaaatataaataaaaggcttgtttttttatttttcactttgttctctctctctctcgtaacacgcctgagagttctcgtcgtccttatctcgatcttggttgattcgctctccgatcggaaattagggcttttgttttctgaagatgacgactgcagcacgaccaacctgggctccagctaagggaggtaacgagcaaggtggtgctcggatctttggtccatctcagaagtattcgtcccgtgatgtcgccgctcacacaactttaaagccaaggtaagatttcgaaactggttctcttcctttaatccgacgcgaattagactacctgtgaattcgatcgaaactttagctgagattgatgatattgtccagaatctagggttaattgcaatagcgtgctagggattttgacatacggtgattcagaaaaggcctgtgtacgttgtctttaggttgctgaaatcggtagtattgtggcctgtttatttcttaccggttttcttgttgtagtttttgaggatcaatagtttctagggacttatttgtgcttgatatttgaaagatactggtttctatttaagcacatatgtctcgttgtttattggattctctatactcacgtacgtctcctacttattgttgttttggcaggagggaagggcaacacactcaagaggaactccagaagataaatcttcgtgatgagcttgaagagcgtgagaggagacatttctcatcaaaagacaaatcatacaatggtaagataataaatttcaagccttttcattatgatttggactaatgagttttttttttctatcattagatgatagagatcgcagaagaggaagtcagcttttactggaaggttagagaaattcatttatttatttatgatcgttatttgtgtcacattagatagtttgatcgtgtgttttctaacctttataccctctatttagactcgaaaagggatcctgaagagcggattattcctcgcagtgtagatgctgatgattctgatgttgatatcaaaagtgacgatgataggtaccttttcttcatctcttccattcttttcttcttctttgcagttttttatatgttgtgctttaaatttggctaagactgtcaaggttgggggctgatacataagcctaactgtacctcattgcttttcatctagaccatagtttgggaaaaatacaattgatattggggaaaatgtttaactactggcgttccattctcttgtcgagtttttgttgacttcaatactctagttccttcaaaggtatcttacaatctatttatctttgttagtgatgacgaaagtgacgatgatgatgaggacgacactgaagctcttatggcggaactcgaccagataaagaaagaaagagtggaagagaggctcaggaaggtaatattgctattgtctgggatgtttctgctcagattgctattagaaatgactaggataggttttttaaaacatattgacataacaaagatttctcttgtgactgtactaatgtttggtaacatatatgtatcatgcaggaaaaagagcagcagatggaagagctaaacgctaaggaagaggaacttctcaaaggaaacccattgcttaatactccaacgtcttttagcgtcaaaaggaggttagcagcttttgaaatcttgtttcttcgtgaatcttgggattatattaattgttggaagcagatactgaaaattactcgtctcttttcaggtgggatgatgatgttgtattcaaaaaccaggcacgtggtgaaatgaaagctcctaagcgcttcatcaatgatacaatcaggaatgacttccacagaaaattcctgcatagatacatgaagtgattgtttgtcaagagtgttattgctacttctttgtatgatgattatgactaaaagcttttattctgtctggaattacgatgtctctgtactcaaacaacaaatgtttttaagctttatatcaaaaacttatgcatttgattttaatgtaatatctcacagattcctgattatctcttattcatcactaacacaatgagacttcaaaattcgaaacagctgtgtgaacttgcatcttacaagtacaagtatgtgtctgaacatcatcaaaacttcaccaatcacatgtttgaagcaagtcttcgagttttattaagagacgccggggatcagacaataatggatacacctaatcaacagcaaccatgttgagcttcagagcacccatggaagtgaaaaagttctgaacacactcagcgacagcagaagcagagcttgaagtagaagccattgtagcgcacctcgatgttccacagtaggaatccatctatgtatgtttctgcgaatctctcaatgtttgggaccatgtctttgaccgttgcagatagtttcttgaagtggaagacgtactcggtttcatattatgaccttgtcaagcttctcagtagctgtgatgatattgatagcgtatcgctctacgaaattctcatacatatctctctcacccttatcgttcaataacttgacctccatctgttaaaagctgaagagctgtatcaagttcaaaatcaataaataccaagttaataaatcacgttaaggttaaggaaaaagaggaatgcagcttaatcatcatatcacaagacatggataatccaagtttccataatttttgtattaagttttgggcctttgaggcccattaacaacattatatttaatgcgtatgtcacgctgtgttcaaaatcctttttcttccctcttttccaaaatcaaaacgcgatttcatg

SEQ ID NO: 24365 - DNA, 3000 bp, Unknown
  misc_feature (1)..( 3000): 2750-1469P.txt file - cDNA_ID_2175355; gDNA_ID_1621090; Annot_ID_55479
tttcattcacttgcttcttattttagtgtctccaaaattattatgtctctagtaataaacaaggtttttgaatgatgtgttcactgtttgttttactcgtactttttttttgttttccctttagtcttctctctctctctcgcttcttcgtttaaaactttaaactaaagtatcgaagaagccaactctggatgacgcaaaagcttctctcagaacggcattgtagaattctccggtgaccaaataatccgattgcattagtagggaatctgttattttgatctgatccgtcaaattggcggtaagaacaatggacgattatacaagagagatgatggatctcaagaccttagtcactcgaaccctagagaagaaaggtgttctcgctaagatccgggtatatttgtttttctcttgccacgattcctctggttctgtgacatacttcattcaaattccgtagagagatttgagtacagagaagaagagaaaacatacattgcttttctagggttcgtgcttccagatctactttatgcatctggaatcatgtgaattcccagtttttgtcgtactttgaaattgagtctgtgaaaaaattgtaccttctcagctgaattggattctttaacatttggtttggagattgaagatttgtttttttttctctatattcttctgctgaaattttagttgtttctgtaggctgaactccgtgcaagtgtgtttgaggcaatcgaagaagaggatagagtgatagagaacaatgaaggactgcctccagctttgttgggaagctgcaatgatcgtgcaaggcagcttcatgcttctccttcaggtctttctcaatttttatccttcatatcttctcttcacttttacccttcagagaccttttctctttgaatggtatggttctaaatggcatgtcttggtttggaaatgctttcttgatacttagatatattcgcttgttcgaaatgtgtctccttgtttttttcgggtgaaactttgcttgcttctattcttaggcgatatgaacattgagattttgtgtagttgagtaggtcatcttgatcactttataaaatgttaaaatgcaggcaggttgctatctgcattgatttgtgaatatttggactgggcgcaattaaatcacacgcttaaagtttatcaaccagaatgcaattcggtaatcaatatatttcattttctttgaacttctgatatttcttttaagtacgttgaagatgaactttctaactgatgctgtgatccctgaaaacctatgcaaaggcaaaagattcttggaagtctgagatacgtgactttagtatcaacaatggttatgagctcaacagaaatgaagatagtagaccgcttcttctggatgttcttgaaggattcttgaagttcgaggtatttcttctgctttctctctgaagatgtttacacatacagtatagcttttttttttttctctgtttacaagctttacaaccatatttgttacacattacaatagtccagctatggtacatgatttcagggcgttaatgtttacagttcctctattctctaagtgaagatgaccaatacctgttggttacatcgaagctttacaattaccaaattagttcaaatcttgttacattgtgctcacgacctcacattttttccaagtaaataaagtgtcttactcaagaaaagaatttttcagagctttgaataagttcggtgaattccaagcctacaattcttgtcacacccagggattatgtttccatcctcttgtagtaaaaccattataatttgtctgctgtattcacctcatatttagtgatcaacatttttcttcagaacatgacgcaggtcatgggtggtagttcaaggagagagtcagaaaccgagtcgtcattaagccttgacaccagaaatcctcctcgcagatcatctgcttctgatagcttacctcatcaacgacggtaaatccaactccatgttctaccaaatcaacgatctttaatcttccatgttgcttatgagtctgacatgcttaattaatgggcaggtcggtttctgcatctcaagcatcgggagccgctacctcagggtacagaaaagacgagagcaattggagatatgacactgaagatatgccggaagaagtcatgagagcctcaacagcacttgaaaatcttcagctagacaggaaaactcggaacctaacatcgtcttggaggtaacttggagcgtcatggctcttaccttacaagtcggatagaactgaaaaataatctaatccattggttttggttgtggttcaggaatgtgaaggatggaacaagtgaagaagaagaagggaaagattgataaggctttcgttaaaatccagcttgtgaattagtatctctacatatatatgtgtgtttcttttttcatgtatggttttaaatgttgcaactttgtttcttaagtttttcgtttgtcgtgtttgagaaatccgattggaagtaaagattattgatataagatgtcaactacaattaagccgttaacacaaactcaaaaactttcataaaaattctcaaatattagtgtcattaaaaaagcattgttaatctgaggactgtatacattccaaagaattatcatttcccaaatttatttaaaataattttatgatatctaatcctaaatctttttgttgaggaaaaaaaacaaaaaaacaagtaaaccttgtttaggtttattagggttttaaaagtatttatatttgttttctgctgcagcagactcaaaaagctaagtaaactactcaagtccctcccttttccggcgtcgctattctcagtctcattctgtctcccgtaagtcctaactaagctttctctcttcagtcttcagcctccgcccgttattgttgacaagttttagcctttttgttaattactactttactactcttgttgtgaatttgctgctactgttgaagccatg

SEQ ID NO: 24366 - DNA, 3003 bp, Unknown
  misc_feature (1)..( 3003): 2750-1469P.txt file - cDNA_ID_2175355; gDNA_ID_2926252; Annot_ID_143044
tattttcattcacttgcttcttattttagtgtctccaaaattattatgtctctagtaataaacaaggtttttgaatgatgtgttcactgtttgttttactcgtactttttttttgttttccctttagtcttctctctctctctcgcttcttcgtttaaaactttaaactaaagtatcgaagaagccaactctggatgacgcaaaagcttctctcagaacggcattgtagaattctccggtgaccaaataatccgattgcattagtagggaatctgttattttgatctgatccgtcaaattggcggtaagaacaatggacgattatacaagagagatgatggatctcaagaccttagtcactcgaaccctagagaagaaaggtgttctcgctaagatccgggtatatttgtttttctcttgccacgattcctctggttctgtgacatacttcattcaaattccgtagagagatttgagtacagagaagaagagaaaacatacattgcttttctagggttcgtgcttccagatctactttatgcatctggaatcatgtgaattcccagtttttgtcgtactttgaaattgagtctgtgaaaaaattgtaccttctcagctgaattggattctttaacatttggtttggagattgaagatttgtttttttttctctatattcttctgctgaaattttagttgtttctgtaggctgaactccgtgcaagtgtgtttgaggcaatcgaagaagaggatagagtgatagagaacaatgaaggactgcctccagctttgttgggaagctgcaatgatcgtgcaaggcagcttcatgcttctccttcaggtctttctcaatttttatccttcatatcttctcttcacttttacccttcagagaccttttctctttgaatggtatggttctaaatggcatgtcttggtttggaaatgctttcttgatacttagatatattcgcttgttcgaaatgtgtctccttgtttttttcgggtgaaactttgcttgcttctattcttaggcgatatgaacattgagattttgtgtagttgagtaggtcatcttgatcactttataaaatgttaaaatgcaggcaggttgctatctgcattgatttgtgaatatttggactgggcgcaattaaatcacacgcttaaagtttatcaaccagaatgcaattcggtaatcaatatatttcattttctttgaacttctgatatttcttttaagtacgttgaagatgaactttctaactgatgctgtgatccctgaaaacctatgcaaaggcaaaagattcttggaagtctgagatacgtgactttagtatcaacaatggttatgagctcaacagaaatgaagatagtagaccgcttcttctggatgttcttgaaggattcttgaagttcgaggtatttcttctgctttctctctgaagatgtttacacatacagtatagcttttttttttttctctgtttacaagctttacaaccatatttgttacacattacaatagtccagctatggtacatgatttcagggcgttaatgtttacagttcctctattctctaagtgaagatgaccaatacctgttggttacatcgaagctttacaattaccaaattagttcaaatcttgttacattgtgctcacgacctcacattttttccaagtaaataaagtgtcttactcaagaaaagaatttttcagagctttgaataagttcggtgaattccaagcctacaattcttgtcacacccagggattatgtttccatcctcttgtagtaaaaccattataatttgtctgctgtattcacctcatatttagtgatcaacatttttcttcagaacatgacgcaggtcatgggtggtagttcaaggagagagtcagaaaccgagtcgtcattaagccttgacaccagaaatcctcctcgcagatcatctgcttctgatagcttacctcatcaacgacggtaaatccaactccatgttctaccaaatcaacgatctttaatcttccatgttgcttatgagtctgacatgcttaattaatgggcaggtcggtttctgcatctcaagcatcgggagccgctacctcagggtacagaaaagacgagagcaattggagatatgacactgaagatatgccggaagaagtcatgagagcctcaacagcacttgaaaatcttcagctagacaggaaaactcggaacctaacatcgtcttggaggtaacttggagcgtcatggctcttaccttacaagtcggatagaactgaaaaataatctaatccattggttttggttgtggttcaggaatgtgaaggatggaacaagtgaagaagaagaagggaaagattgataaggctttcgttaaaatccagcttgtgaattagtatctctacatatatatgtgtgtttcttttttcatgtatggttttaaatgttgcaactttgtttcttaagtttttcgtttgtcgtgtttgagaaatccgattggaagtaaagattattgatataagatgtcaactacaattaagccgttaacacaaactcaaaaactttcataaaaattctcaaatattagtgtcattaaaaaagcattgttaatctgaggactgtatacattccaaagaattatcatttcccaaatttatttaaaataattttatgatatctaatcctaaatctttttgttgaggaaaaaaaacaaaaaaacaagtaaaccttgtttaggtttattagggttttaaaagtatttatatttgttttctgctgcagcagactcaaaaagctaagtaaactactcaagtccctcccttttccggcgtcgctattctcagtctcattctgtctcccgtaagtcctaactaagctttctctcttcagtcttcagcctccgcccgttattgttgacaagttttagcctttttgttaattactactttactactcttgttgtgaatttgctgctactgttgaagccatg

SEQ ID NO: 24367 - DNA, 3000 bp, Unknown; identical to SEQ ID NO: 6362
  misc_feature (1)..( 3000): 2750-1469P.txt file - cDNA_ID_2175376; gDNA_ID_1621090; Annot_ID_170670

SEQ ID NO: 24368 - DNA, 3000 bp, Unknown; identical to SEQ ID NO: 6775
  misc_feature (1)..( 3000): 2750-1469P.txt file - cDNA_ID_2175436; gDNA_ID_1621105; Annot_ID_171548

SEQ ID NO: 24369 - DNA, 3003 bp, Unknown
  misc_feature (1)..( 3003): 2750-1469P.txt file - cDNA_ID_2175455; gDNA_ID_1621105; Annot_ID_171554
ttaagatgtctaacatcaaactaatcatcacgtaattttgcacaatttagaatggttttaaagtgacaaaacaaataattttcttattttgaaaaccaaaaaaaaacagaggaaaaatgtattgcctgcgagaaagctcaagaacacgaactctcttggcctgagaatcatcggaacatcctaacacggcaagtattccacacatgttttttttttgaagaaagtgaaaaagatcacgaagaatgagaacagaaaaacagaattttccgaaactttaggggatagatattgtaaaaccccaaaaagagattacaagaaaatgtaataaacagacagatgtccaggaagagaaaggagaaaattgcacgtagaagtgtactatcgatattcgtgtttttgatgtcttggttttctacgaccgattgctctatttatagacactaaacggcgccgtgatgtcgcgtttggttctgaaggagtcgtgtatgggaacaaattatttttttacttgtaaccggataagttaccggataactctgaccagctgtttccacgtgttaattaaccttcttacgacgtccgatgggttcttacttcttagtctttacattctcttttgtccggtttcttccaattttgacggtggggcaaacttccggtttagggtttatccggctgagtcagcaagtggataggtacttatctgacggtgtaaaaactgtccaatgattgttctgattgctttagagccgtacacgtgttatcacgacaatggtgtatttgattgtaggattagcattttatcagaaagtgaacacatttcaaatgaaaatgataagtaaactgtgttaggaaaaattgattggtatttttttccttttgattaaaaatgagaagtaaagttaagacttaaatttaaaaaaaaaaaaacgttaaaaacacatatagaagaaatatatcgtactatagttagtaaataattttctcttcctataattagtaaatattcaatatcgtcaacgaattattatttgtatagtctaatagtacacacatattctcaaccttggaatcgaattataacaatacaaactgtaaaattaaaacacgaccctatatggctattgcaaatggtgatttcacaaactttatcataatattaaaaaatacatttacttcttactaatatacagtaaacaaaagtctttgtgttatagttaagcctattttggatatatgtgtatttaaaaaatatatatagagagatttgccatgtgttatataacaaatatataggagatagtggatcatatgcaactttccgcgaaatgaatatcggagaagtattcgagtgtatccataaatcatgtatattttaatataccggatcacatgtgaattgtaggtataggcatcgcacatgcctcacacgttgctacaatgtgcaagggcgagaagatgaatctcagtttataatctttggactttggataatgctaatatataaatcatcaaaataagaatatgacgtgttttttctttgattggacaaaacgagatatcagccctattcttgaggcagcaagacccaatcgcgacatgatacattgtaaatcgtttgatatttttttcttttttatatgtaaaaattgctggtgtccctatctatctatatggtacaccttcagctataaatgattgaaattctcttacaaagactgtaaatacatatccgaacagtttggatactagtaccaaaaatgataatgtggtgatttaggcgacgtgagtcgtgagtgtagctgttattattattttatcaatacttgagacgctaataattgttaagatccatgccgtgtcatgtttgtataagccagtttcgttatcaaataaacagataacgaagaagattcttatactttgtgaaaggaaaatagaaaaacagatgacgtataacagtttgttcggtgaaggaagcagataaaaacagcctaatattcaaatgtatgccaacgcaaaaattgtgtttaatatacaaaacacacaattagttacaagtaccctacaatgttaaccaaacgtcattttgtaaaagtaaaggactttcaaacgcctcatagtcctcacaaagcgacatcattcgtaatttaattacttccggctggtcataacatacttatatagttggtcaattaatgaattagtaagtgggattgcgtaagagaatatcccattagttaaaaaaataacagaagaagaaaatatcacgtttataataagtttgggcataattaaaaaaggtagcgactcgtcgtctttcatgaggtcacgatcctagtctatctggcaaatcatcatctacgagctacggctagaaagaaatagacgctaccactcgtgcacggccgtgccatgtcatcttcgggcataaggatccgaaccttagccagctggttctccgacttcaacttacattactagtttttcttaaatattattattacattacataattagtttggttaaattgtttttctcttattgaattcatataattgtatcttttgtgagttatgttcttgcaatataaatctgttgatctttttttcatcaatataaaaacaactaatattaccaaaataacaaaatcataatagatacggcaattcgacttttaaatgaatcaaagagttaatatccacagaggattaaaatagtagtttggaaaagaacaaatggtgatgaaactcggtcgcaaggttgcgtagtacatttcgttatcactgttctaaattaaattagaaaaatctcgtcatttgtctgactataattttatttcttaaaagttaattgtcatgcactcatgtccatttctttttttttatcaaacataaatattatccatctaagttttgaactttatatttttctcggaaaagtacgaaaacttttattattgtcattcacacaattcagagaagaaacaaaagttgtaaaatg

SEQ ID NO: 24370 - DNA, 3000 bp, Unknown; identical to SEQ ID NO: 7835
  misc_feature (1)..( 3000): 2750-1469P.txt file - cDNA_ID_2175480; gDNA_ID_1621167; Annot_ID_57206

SEQ ID NO: 24371 - DNA, 3000 bp, Unknown; identical to SEQ ID NO: 7835
  misc_feature (1)..( 3000): 2750-1469P.txt file - cDNA_ID_2175480; gDNA_ID_1621167; Annot_ID_173867

SEQ ID NO: 24372 - DNA, 3000 bp, Unknown; identical to SEQ ID NO: 7840
  misc_feature (1)..( 3000): 2750-1469P.txt file - cDNA_ID_2175516; gDNA_ID_1974075; Annot_ID_180351

SEQ ID NO: 24373 - DNA, 3000 bp, Unknown; identical to SEQ ID NO: 7840
  misc_feature (1)..( 3000): 2750-1469P.txt file - cDNA_ID_2175516; gDNA_ID_1621167; Annot_ID_173878

SEQ ID NO: 24374 - DNA, 3003 bp, Unknown
  misc_feature (1)..( 3003): 2750-1469P.txt file - cDNA_ID_2175536; gDNA_ID_1621106; Annot_ID_171577
tatgctctcagagatggctattcagagcaggtagtggattgttcaagtgtgtctgtgtatggttatgagcataagttgctcttgtgtcagcttctttgcttcatagatttaagctactagcctactgtggtatatatttattacatgtgctccattattatatgacaattgtgttcctgggatgcagatagcagaagctttgctggaaattacacttcctagattttctggagacgtcatcccaaaaacagatgcaggaatggttttggcaataggtgataggtaaattgaaagcctaaagttttgttgtctctcccatttctttctacgccaaacggttcgtcctgtgaacacaaaaccttgtatctggattgcgcggagctaaattgtatatgcttctgatatgataatttttgttcgaatttgtgatcctatatactaacacctatgcttgtccctatgactgtagattggatagccttgttggtttatttgctgctggttgccagccaagttcaacaaatgacccttttggccttagaagaatatcatatggcttagtaagtttatagatattctgatctgaaaatgagctattatgatatgtcattttatggttgcatgaggttatggatgccaagtaatactttgtatgccacaggttcagattttggtcgagaaggataaaaatgtcaacttcaaacgtgttctagaacttgcagccagtgtacaaccgacgaaggttgaggcaaacactgtagaagatgtgagaatcaattgagtggcatcaaatcttgttatcaccatctgaaattgttcgtgacataattaactcttttatttgtttctaggtgtatcaatttgttactcgaagactggaacagctattggttcgtgcaacttttgtgatgtttatctttttcgatttcccagctcttaaaatatcttacgggtccagttcttgaaacaacgttttatccttttttacaggttgacaacggagtaagccctgaagtagttaggtctgtcctagcagagcgtggaaacaatccttgtctggcagcacggactgcatacaaggttagtgacttgtgatatgatccaatagcagttagctagggaattaggtaatagttgagaagcctttgggcatcattctcctagtgaatgttgctgtgtcatagtgatattgctccaaagaagctaacatcgctggtgcttgccttgcagacggaaaagctaagcaaaggtgagatgtttccgaagatagtggaagcatattctcgtcccacacgcattgtccgtgggaaagatgttggtgttggagttgaggtacttgaggtttctgtctgatcaaagagcatttgtgaaaacttgcagcttctaacattgaatgatgcaatcaggtggatgagaatgcatttgagactccccaagagagaacgttgtggagtacttacacctctatcaaagatcgaattcacactggtaactcactttcttccctgctgtattctctcaaacaagctcgcttccaaattcgtctcactaaccttccaaatttcaggcattgaaatcgaggacttcaccgagatatccatgcaattggtggagccactcgaggatttcttcaacaatgtatttgtaatggtggtaagttaaaactttgtccatacactgtactcgagtatcgcagacgagtgaagtttgaatataacggtttttgcaggaggaagaaagagtgaggaagaacagactcgctctgcttaataacattgccaatcttcccaaaggagtcattgacctctcatttttgcccggattttgatctttacttgtttcataatcccactccggaatcatcaattcattgacctctcattttttctttgtttcataacctcatatagttgtgttcactgagcaaaaattcaaactaaaacttgtgcaatggaatactttaaaaacagtttcataacctcaataaaaagatttcaaagatttttagatacttctgattgagatgtgttctatttcaaaattctttttttttttctcacaagtgatagaatttattaagctttcacaatatcatacataggctttaacaaaagcccaaacagcaggtttacagaaatagccaacaaagaccaaatagataaccgacttctgtagaagaatttcaatctaaactccatccatggaaacgtgtcgacaaccggttaaaccacgtcccacgcctgatgagtaatcacaagtttttccggcaacaacctccaccgttgagcgccgattccggtaagaaatcctcgccgataaggaatcgaacgaagactcttatgttttgcaccgaattgaaagcatcgaagctccaattaaagtaacagcttaagggaccatgataagcgacacaagaaaatcttctttccttcaacaaaagagtgaaatctctttgaaatcattctgtaaatccagagtacaaaagaaaaggatccgaaatttatcttgaagagataagaaactaattcggatcggagtaaaactcaaaggacagagacaaagaagaaccaccgtggatatggcagatcaacatccctaatcgtagatccgatgagattattagcaaattaaaaacataattgaaaaattaaagcaaaaacagaatccggccatggccgctaggttagccggtcgatgccgggcaaaagctagccaccgctacttaggaagccagtcggtgctagacgaaagccggccatcaccgttgagaaaaacggaagacgccggacatgtagccggataaccaccggacggcgagaagaagagcgtattctctctctaaaatattcagagagcgagaagagagagaaacactgacgaaaatatagattttatgggctaacaaaattcaaatgaaaacattggattataagatggttaacaaaaatggttgagaaaaaaccatcgagagaaccaaagggagagaaacggagctaagttatg

SEQ ID NO: 24375 - DNA, 3000 bp, Unknown; identical to SEQ ID NO: 4432
  misc_feature (1)..( 3000): 2750-1469P.txt file - cDNA_ID_2175536; gDNA_ID_1620706; Annot_ID_165283

SEQ ID NO: 24376 - DNA, 3000 bp, Unknown; identical to SEQ ID NO: 6804
  misc_feature (1)..( 3000): 2750-1469P.txt file - cDNA_ID_2175570; gDNA_ID_1621106; Annot_ID_171590

SEQ ID NO: 24377 - DNA, 3003 bp, Unknown; identical to SEQ ID NO: 18141
  misc_feature (1)..( 3003): 2750-1469P.txt file - cDNA_ID_2175659; gDNA_ID_1621104; Annot_ID_171523

SEQ ID NO: 24378 - DNA, 3003 bp, Unknown; identical to SEQ ID NO: 18141
  misc_feature (1)..( 3003): 2750-1469P.txt file - cDNA_ID_2175659; gDNA_ID_2926184; Annot_ID_200506

SEQ ID NO: 24379 - DNA, 3003 bp, Unknown; identical to SEQ ID NO: 20999
  misc_feature (1)..( 3003): 2750-1469P.txt file - cDNA_ID_2175663; gDNA_ID_1621104; Annot_ID_171530

SEQ ID NO: 24380 - DNA, 3000 bp, Unknown
  misc_feature (1)..( 3000): 2750-1469P.txt file - cDNA_ID_2175663; gDNA_ID_1620864; Annot_ID_170410
  misc_feature (287)..(287): n is a, c, g, or t
  misc_feature (305)..(324): n is a, c, g, or t
agaatgagacaaaaagagaagacgttacctaaggtcgaagtaaaagcttttgaagaggcggtgtaatggagagagtgttaacggcgttagtgtaggaaacgacaacgtgggatgctgctgtctgtgtcagggagaagagagagagagagttaatgaagatttttgtctgtattctgaaacaaggtcgaatgttggagactaaggaaacaaaaataaagctttttgatggcttatgagtctttgaaatagctacaccgctcctctcaccttagtctttaacctaatangggggggggggggggggnnnnnnnnnnnnnnnnnnnncccccccccccccccccttgtctttaacccaataacccccccccccccccccccccccccccaattttctctccctatcctctcatttttgtagtgcgcactgagagagacaaaaaaacaaaaaaagatggagcctttgtttttaaggttttctttatgttgaggacattaggctaagacaaaaagctctgttttctttctttgttggatttttgggtgttgcttgtttgaagaaataaagctttgagtatctccaaggtttccattacagagacaaaaggggtatttgagcttagtttctctgtttatgtgtttgttgtgcttttaaatcggggtttaaggtttatagaagtggtgtttctggtaacagttgagactttttgaggggatattacagagttcaggaaataaaaaatatagaaatttgtgttttgtgtttaatgggaacaagagcagaacgcaaggaagattttgttggtgggtttggatttggtgttgtagaaaattcgcataaagacgttatggtgctacctcatcatcactattatccatcatattcatcaccttcctcttcttctttgtgttactgttctgctggtgttagcgatcccatgttctctgtttctagcaatcaggcttacacttcttctcacagtggtatgttcacacccgccggttctggttctgctgctgtgactgtagcagatccttttttctccttgagctcttcaggtttcaagttctcacctttttgttgacttctgagctatgaaaaaattgaattttgttgttatgtgttggttttgatgtgattttggtggataaaatccaggggaaatgagaagaagtatgaacgaagatgctggtgcagctttcagcgaagctcaatggcatgagcttgagaggcagaggaatatatacaagtacatgatggcttctgttcctgttcctccagagcttctcacaccctttcccaagaaccaccaatcaaacactaacccggatggtaagatctccctagcctctcacttaaacgtttcccatttttgtcaatttgtcttggtttcatgtgttcttgatctcttgttatcatgtttgatgcaactaaaagccattatgatggtattagaatgtcaagttttttaccagtgttacctcttagtggatacatataggagtggaatgtttagtatttatgctgattacaagaatctgccgttgtctatgtggatgacagtaactgtggcagtggcgacaggaggctcattgcagctggggattgcttcaagcgcaagcaataacacggctgatctggagccatggaggtgcaagagaacagatgggaagaaatggaggtgctctagaaacgtgattcctgatcagaaatactgtgagagacacacacacaagagccgtcctcgttcaagaaagcatgtggaatcatctcaccaatcatctcaccacaatgacattcgtacggctaagaatgatactagccagcttgtgagaacttatcctcagttttacggacaacctataagccagatccctgtgctttctactcttccgtctgcctcctctccatatgatcaccacaggtgcttttacttacattcttgtagtcaaagtattcaaatccttcccctttgaaatcatttgaaagactgaaacttagtggttgatatgtgaagaggactgaggtggtttacgaaagaagatgatgccattggaaccttaaacccggagactcaagaagctgtccagctgaaagttggatcaagcagagagctcaaacggggattcgattatgatctgaatttcaggcagaaagagccaatagtagaccagagctttggagcattgcagggtctattaagtctaaaccagacaccacaacataaccaagaaacaagacagtttgttgtagaaggaaagcaagatgaagcgatgggaagctctctgacactctcaatggctggaggaggcatggaggaaacagagggaacaaaccagcatcagtgggttagccatgaaggtccatcatggctctattcaacaacaccaggtggaccattggctgaagcactgtgtctcggtgtctccaacaacccaagttctagtactactactagtagctgcagcagaagctcaagctaaacaaatggcgctcgagttccggtttagtgattagaaaccatcgttgttagtgttttgtttgaaaaactgagaccttttagctttctgttggtgttttacggttggattttgcagtagactgctcttatgaatggaaaattgtttgagacaacgctttactttcactgctggattagtgaaaagtcagaataatcacttttgctaaacatttgactaattatttcaagagttgaccagaccgacaggtccaagtattgccaacgggaagcttctgtgattttgcaggatacgtgacgtcggcaatgacgcgtgcgaagaacaaattaaaaagcatatatccccttaaagcgacttcgcagcaaaacctcttgtctcgtttatctatataaagaaaatttagtagcaaacttctcgattccttgattcgtgggaaaaagaaagtctagatttttgtggattttgattttgtgattccgtgattgtatgaacttgagccgttttgcttcgagattaagaatg

SEQ ID NO: 24381 - DNA, 3003 bp, Unknown; identical to SEQ ID NO: 20999
  misc_feature (1)..( 3003): 2750-1469P.txt file - cDNA_ID_2175663; gDNA_ID_2926185; Annot_ID_200526

SEQ ID NO: 24382 - DNA, 3000 bp, Unknown; identical to SEQ ID NO: 2874
  misc_feature (1)..( 3000): 2750-1469P.txt file - cDNA_ID_2175689; gDNA_ID_1620611; Annot_ID_161898

SEQ ID NO: 24383 - DNA, 3000 bp, Unknown; identical to SEQ ID NO: 2871
  misc_feature (1)..( 3000): 2750-1469P.txt file - cDNA_ID_2175700; gDNA_ID_1620611; Annot_ID_161902

SEQ ID NO: 24384 - DNA, 3003 bp, Unknown
  misc_feature (1)..( 3003): 2750-1469P.txt file - cDNA_ID_2175732; gDNA_ID_1620611; Annot_ID_161911
tttaggtaaagagctcacacctatctctactctatagtgttatatagtgtcaaaatttaacgaaggcattaaaaaaataaaaacttatataccatacttaattccaaatcgaacaaaacacaaattgtacccgaatcaaacatattgaattgaaaccaaatcaaactgaaaccgaactgaactagtttagaaagttttactaaaacctaatcaacaaataccaaaccaaacgggaaattatgagaaaagtagaaaaaggcccaccaaaagagcgtccaccattacttgattgtgtatgatacatatataaattggtcttatttgtaatacaatcaagtgggcttagcccatccttttggtttgtttacttgtgtgtattgggtcgaattcttctagaaggcctctttttaaaaacggtttgtgtaaaattgtcaacaccattttggacttttgtgttatttccattactaatctctatagtttaggaatttctcgtgttataaaactcaagtacaaaacacaggaatcatatatatatatatatgaaagttggttaatataaatgacacattatcacacaacaaaatgacatatgtcattcgatgtttttttttaaattaataaaactaataaaattaaataaacaaattaaatgtattattaattctatttttaattgaattttccaaaataaaaataaaaaataaaattatgtaaacaaattaaatactactttcattatactctttttattatattaatttttttattatcaataatcatgactaatttttttattgtgttgtagttgtttgctacctaacctcttattagtttattagtttaattttgagtttttgataacattgacattcaagttttttcaaataataaaccttcaaaatattagacttaccaaataatataatacacaatcatttctcttatattgatatatgcaatgacagaagatctaaaagtattgactttaatgatactttaatttttgctttctttttattattttcatatgaatactcttgaaatcttatttagtttatatcaattctatatatttaatcataaacctataacaatgttgttggagtattatatcgggggaataaataaaaccataaatagtttatttataatcaagttgaagaattttcaaattatccaagacgcaatcatttctctaatattgatatatgcagtgacaaaagatccaaaagtgttgacttcaataacattcaatttttgctatcttttttatttttttgtatgaatactctttagatccttttcagttgatatcaatccaaactttaatcatgagtcgatcacaatgttgttgaagtacataaaacaagaaattgatttattaataatcgagttaggaaaattttaaaccacaaaagtaacatagttacacagaattgtatcaaaatattattattgttgttatatgtattcatgaagtgaaaaaatattaaaatcttataaataatcagctttatacacaaaatatataaattaatatatagagtcacaaatgaatctaaccataaaaattgtaactacatattatggatctaatttcattaacaatacaaaaataaataaatagtaaatataattagcataaataacaatcaatgtaattttttctttaacaattttcacaacaaatccacgcgtagcgtgggtacccatctagtttctagtaaaaaaagaaatagataacactcttgcccaacacaatcaataacagttcaactgaacaacatatgaggaaacaaatcatacttgccgttttgctatcgactacaaacttcatgtcgtttttcatttagctagtgaactaaccaagattctagagtgtaataaaatattaaaatctataggcaaactcacatgaccaattaaacaagttaacgattactgtccaattaaacgtcacaagttaattttctaccgttaaaatattgccacgtaggacgcgtacgttaattaactcgtaaaatccgcgcagacaaaatcacattgaccgttagatatagatttggcggctagttcttcaatcaatataaaccgtccgtcaaaaatcagaggtaggcttttgacggtgtagttttattttaaaaacataaaataaattagtgtaagaaacttttttctctctctctgagtcttcgacttcgtttttatctccagctttttttttctcacgcgaaaagctcctgttctttaaaggatttgatcacgagagtttcaggtttggatttcgtagtcaatttccagattctagggttttggttggtcaaaatcttctacttcgtcccgtgtttgtggattggttcacggatctttggagattccgaaattggaggcgatttttattctagggtttcggtgaaatttgtaccgttttttggattaattcttacgttgatcgcttctctcctggcgagctcgcgtttaaaggtttagatttcaagctccgtgttgtctattttgaagctaatttatctggtggaggttgaattttggtttgtgaagaatttgtgtggattcagctgttggagattcaaatggtaagattcgatctatttttgatttgtgggtttttcttaattcgaatgattagaaaaaatagagattcatttgaatttggcatcaagctagggtttgagttttggggtccaaaaacgaaattggacagctaaaggtttaatttttacggtcatatctctcacgtttttgagaatcggaaattcttatttcacattgtttagatctggggttcttgtgtcacaacaagtttcttggcccaatgttatctatcgaaatagggaaaagaatcgtcttagtggttttgaatgggactgtattagtttttgttgatttaagtgaaattatatatgattcaggtgtcttgcaaatgagttgtagaagctagtgagaattatatatattgtggtaagtcttgccaaaacaatg

SEQ ID NO: 24385 - DNA, 3003 bp, Unknown
  misc_feature (1)..( 3003): 2750-1469P.txt file - cDNA_ID_2175758; gDNA_ID_1620611; Annot_ID_161919
ctgtcacttttcaaaggtaacatgtttcttgttatgtgagaaacaaagtgaaatcacattttaaaccacttaggctttgtggtcttcttctctgtggatttacgctcgtgttcaacaggtacagcactagagtcaaccgtggctggctctgatgacgattcaaccggttccacggctttggtcatggcctctaaatctttcagtgacaaaatctcttcattaagataaggagttgaactaccaccatcatctgcaaaaaaaccattgggttttttaaagataagttcagaacacagtcctcttcacaacaaattctttagtatgtaaggggaatcaatattatacctaatttaaccagctttctaagattagtattccctatgtattcacatgatcctaaacttcttatcaaactatttcattcctaagtttgaaagtttctggacaattcctcgtgcagtttagttatccatccctcaaaaagatctcacttactaaatctataatcccgtacatatcgcaatgcaaaaaagttccccagagaaagactatggtattgggtgaaggtaatgacagaaactaacctttaggttgatcgtttgaaaagtagacaatggctccaggaacaaacccagctgagtagaagtcttgtgagaaatcttttatctgtttcttgggaggagttgtatctgacaaaaagatggcacgttatcaagttttcttctcttgacaaatgtaaaatctgaaatctgagtgatggaaacatacacaagtagaaaggaacatctgggtgggcaactactcttttgacaagatcaatcaagccttggatcttttctgatggatgaaatgttgcctccaatgtgtgattatcaggaaaacgaacccggattacagcctagacagtatcaatctatagatagtcagtgggataaaactagttcccaaacatgaaaccaatagtaaaaagaaccttagtgagctttgatcgacgagcagcttcttctgcttcccggatttttcttgtcttcaacgatttatcttttgtataagtaatttaacattacatgttagaagaattaaacaaccaaggtactgatttctttagagcaagcaatacattccgattatgacaaacacagttggatttgatcaaagatttgcaaaattttcatggaaatggctgaagaatgtaaactaaaccatacagattcttcagaacatgttaccttctttcttagtagccaaaaggcggtaaaaatctgcaggtgtgaactcgtagaaatcatcagattcatcgtctgtggaattttcataaacaatcaatcacaagacttgttcaaattcagatcaaatgcaatataagaatcagagatccaaaaaagttaccagcactagaaacttgacttggtctctgtgagatactcgaagtctcgaaaacacgaacctctcgccctaatttctctcgcatatcagcaattttagcctaattttacgaaaatccatcaaataaatattgaattcgactcaagaaatggaaaaaccctagaaaactttgcgggaacccccaaatatagaagaagaagaaacagaaaaatttcggatcaaatgaaaatcgaaatggaagtaggaatcagatgatatagatcaatgagggagaagaagaagaagaatgaagttagacctgagctgaagaagaagcttccatggaatcggtgatctcgagtcgtctgcgtttcaaggtgtgtagagaagggtcatcaacaaacatcagacccggttcaagttattctttacttgctcgctgcaaatccaccgtctatataccggaggcgcttttgttttaggtgattttcaatttaagcacagtatgttttgttttttttacagataagccctctttcttattttcatttttttgacccctctttcttctatctaatttttccccaagtaaaccacaagtcttaaagacttaaactattaaacaaaatgaaatgtatgaaataaactatttttttttgttgaaatgtcaaatttataaatcaacaaaataatttatatacaacttaatccatataacaaaaaaatcaaaaaaaaaattaaaataaaaaacattggcatctctcataatctaaaccaatattaaaaaatctcagagatttggagtctcaaaaaaatatagagaaattttgtgttcttcattttgtaagtgcaagatgtagtagataaatatctgaaatgccaaaataataaaaagataagtgagcaagttaaacaagtgaaatggtaaaatgatgaagtttggtcgtctaatcaacgatcaggtgaattttctagcaaatcaccattattcattcaaaccatatatgtaaggttttaagcataagcaacataaacagctcaagattcagtgcgattgttgaattttcgaaccttatgtctagttttgttatttcgaaactcatgatagattaatgaatttttgagaaatatttattacaaaagagaaaaatatttagttttgtcttattcatttgtaatatataaacattaaattattttgaaaaatacaaagaaataaatgtaatcattttgtacatggcatatcgacaagaaatgttattacataaatatgtgccatctaggttgtacaaaataaaagtatttacccacctgaaattaataaagtaccaaccattaaaaggaaaaaataaaacctttaaagaaaagtattgtgctacgaaaatgaaaatttattaatctgatagcctcttcccacctaagcttcttctttgcttattttaattttatctttttgttgtatccttcttgtctctattaacgctcatctttcaccttcaagctctaaatcgaagcaatcttcacactccacaaaccctaatttcaatgcaatcgcaattcaccatctcaatctctcttcatcttcctctatccatggatccataaatctctgtaacctcacaaaaggtgtttccaatg

SEQ ID NO: 24386 - DNA, 3000 bp, Unknown
  misc_feature (1)..( 3000): 2750-1469P.txt file - cDNA_ID_2175770; gDNA_ID_2926187; Annot_ID_200740
ttacttgcgatcgagacaatagagtagagacgacgatgtatgtccaccaaaacaaatcgattttcatgaaatattatcaactattctttattatttttttgggtatgaatgttaagtaactattatttattttttcaaaccagatcctaacaatctacataaagagctaaaccaccatgtgcataatgagctaacacactttgcaatgacaatatgtgataggacgcatcacacacatcttccgtaaagagaatactaacaacattattacgtctacctaaaattgtgtacatgctttgataggatgtaatagaaaaacttgaccaacaccacacatgttttctactttaaaacaagtacatttgtatggacttaacaccataatgttttgaaacccggtatctgaaccatgttcagtttttttttcttataaatatcagtcttaagaatttttcttaaggattcacaatccaacatgagcataatagagagagaagtaattgctatattctcaataacaacacttgacatatactaatttaagagcatcctcataataacatctaagtattttgttatacaacttctttaagtttccaataatgacttaaatgttagatggtcattggaagacatccatgattgcttcgagtggcttctactaaggatatgctcatctattcaaaagactatattttgccatgattgatgataaaatctaaaaaatgtatattaacatcgcaaatgaaattggatattcacatacaaaaataattgtatattacgtattccatagtacttaagtattatgatatatatattttttctttttctttttcaaagcattagaataaaaacattcaaaatatgtttgataggtttttctatacttcatttatgttactgatatagtgtttaaataatgtaaaagtgaatatccaacttctcaagagacaaagaaaggtaaagggtcgcattcgtacacacgcacgagggatacacgtaaaagtcattacgcaactcaacaaaagcaaaagaagaagagaatgcgatgcacacgtgcgctctcttttagcccataaaacccttctcttcttccctttttcattggcctataaaatcaattttactaaactaacctctcaaatctttttagtcgctttggtttagtttaatcattcacaaatgacaaatgacaaaccctacaaaatccttatcgaaaccaccctcacaaatcttctttgtcgctttggtttagtttaaatgtttaatcattcataaaacacaaaccctacaaaatcataatcgatacatcatcgaagatccgccattactaaagtatggcggctaagagcagtgaaattctcctcctaattctagtctcatgtgtataaaaaaccttaaaaggaaataacaataataaaaagtcaactactggttaggcaaactaatagtatagttgttaaccattttgataaggccgtttacaaattacaaccgttcgattcgattctaaagaatctctttaactctttttagttgactatccactcccaccgtctaataaatcgataatttttagacctctttttacgtcgataatttctagagctaattggtattttaaggatatttaaaattagaaactaatcaatttcgaagatacccatcaaagatttccaagtcttcacatcaaataggtctaattgtgcatctcatgggtggacgaagagacatcttattattggcatttattagaatatgcatattcaaatatatcacatggaagtcattcgattttttctagctaacaaagtatgttataccatcttattatttggtgattttattaatcttattagcattatatgtttagaagtataatttgcccaacaaatatattccatttcaagttcattgagaaatattctcataacatgcaaaagaagctcaaaactgaccacactagaatccaaaatcgccaaagaattgatagagtcagtctcatcatagcttacacgagaatataaacttgactagataaagaatattaactttttcagctgttaaaagctctctagtgaatatattggacatacgtacttgattgtagtagatagacgtgttctttcacatgtgtacaccatgcaaaatagaaacattgccgttttataaattaaaaaaaaaccattaaaagaaatcattccaaacccgaccttagcaataactatgttgatatgaaagctaataaataagttagagaaaaaaactaatgtaagtcacgaggatctcactcgccacccaacggaatgaaatcagcggcgcatttatcttaaaagactcgcaatgctcacgagtttcgcgacgccagccattactgagtggcatacccctgtaattaccacgacaataacgagggtaatcttggtataaacatgttttcttgaagtttattttatttttttaagtcactccaatcaattttgcctttgaaaaaaagaaagccatttgtctgcattggggactcatcacttatatatatgcgttactctcccttttttaagtgttttttttcttttgttcctttccaattatttttagcaataatcataatgataattttaatattttaacacaataatagcgaataaataatatatacatggaagcgcgtgggtccaaaccgtcaaattatgatgacgtggcaaaatctcgtgggaaattgaatgaaaactgtaaaagataacgaccggtgacagagagagagagagaggagaagaagaatagaagaagcggctcatatccataataaaagccatttgctcctttatttattctctcattctttcttcttcattattcatttctctcgttattcgtttcgtattttgtttgtgtttatgattttacctccttagttgctgtgagatcaagaagtggtgaaagaaaagttactaaatctggatgttatttgattgtcgtcgttggtcttgagctatg

SEQ ID NO: 24387 - DNA, 3000 bp, Unknown; identical to SEQ ID NO: 6744
  misc_feature (1)..( 3000): 2750-1469P.txt file - cDNA_ID_2175786; gDNA_ID_1621103; Annot_ID_171494

SEQ ID NO: 24388 - DNA, 3003 bp, Unknown
  misc_feature (1)..( 3003): 2750-1469P.txt file - cDNA_ID_2175786; gDNA_ID_2926187; Annot_ID_200729
aaagctggtgagccttttttttctttctttctttcttctgcctcttactactctgtctttgtggttaacctgaatgaattataataagcagtattgttatccactaagtacaatgaaaaagcgaaattcaaatgcatttcatgaaatccactctcgtcttcattccatccacgagaaggctctggtggactatctccctttggaaggagtactaaacattgaccacattcacctggccacctgatgcagcctgcttgaactttggaaagtacttcagaggaataagatttttagaaaaaaaattagtgtaaaaccgcattttctttgacgcaggatgtgtttgataatcttgggacgcctatactcacacctggccatgaatggaccatagggaaatccatctcttatccctcaaaatcagtcactttccatccgcattagcactgccatcttaattgcatttcattcctcatcactttgcacacttggacatgcctctgcaatggagaaggctctctattttcattcatatccccgtctgacttccacattttcagttgttccttgacatattaattccataatgcaaggtctgtaactgcttcactggtcatttggagtttttttaaggttctaggaatgttcaaaatttaatatgttctaggagttaagttaggcgttgaaggagggaggacagtgttcgtgtatgttgaaggttcttaatctggtccacttcctcactgttaatgtactcagatctttgcttttggctttttcttttttctccagggtttgcttttgtatacatggaagatgaaagggatgcggaagatgccatccgagcacttgaccgctttgaatttgggcgtaagggacgcagacttcgtgttgaatggacaaaggtaggatacttaccccaggatttatttctttccagacttagttatgaggtttgaaatactgataacataaatggttctgtgtatatagagtgaacgtggaggtgataaaagatctggtggtggttcaaggagatcctcatccagcatgagaccttccaagactctctttgtgattaactttgatgcggataatactaggacccgggatctagagaaacactttgagccgtatggaaagatcgtaaacgttaggatcaggaggaattttgcatttatccagtacgaggcacaagaggatgccaccagagcattggatgcttcaaataacaggtttgttctgtccattttagtatctaatcactttcctttcttagactcacgtttcatctgtgttttcattcagtaagctgatggataaggtgatctcggtggagtatgctgtgaaggatgatgatgctagaggaaatggacacagtcctgaaagacgccgtgataggtcacctgaaaggagaaggcgatcacctagtccttacaaaagagaaagaggaagccctgattatggccgaggagctagtcctgttgctgcctacagaaaggaaaggaccagtcctgactatggtcgaagacgtagcccaagtccttacaagaaatcaagacgtggcagtcccgagtatggtcgtgaccgcagaggcaatgatagccctcgcaggagggagagagtcgcaagccctactaagtacagccgcagtcccaacaacaagagagagaggatgagccctaatcacagcccgttcaagaaggagagtccgagaaatggggttggtgaagttgaaagtcccattgaaaggagagagagatcgaggtctagccccgagaatggccaagttgaaagccctgggtcaataggaagaagagacagtgatggtgggtatgatggtgcagagagcccaatgcagaagaggttagattctgaaataggtcgatacttgtttatatattattgatgacatgaatcgtaaaccatttctcttgttgttgcagccggtctcctcgttcgccaccagctgacgagtgataagagtggatccacaatctctatcaaagtaggatgttgtaactgtttgtagtcaacaacgctatgtcgtcgtgattagtttttgtcgtttggtttttgatagattcgaactcggatcacttttattgtcggattgaaaaacttatgtcaagttactacatttccgtttttttttatcacctctcagtttgaaccccaatcatgtaatgctttcccgtgacaataagatgcgaacctcaaaacatcttgcatcgaaacaccttgagagtgacaaaatcgaacgcatcgttaagtaacttaaatggtacgccgaaattatggaaggcaagaacggttctattgacttaattgggtctaaaaactactctaaacgcctcttgtcaacgttcgaactagtccctaacctttgactcaaatataaatattggctacaaatagacttatagttctgcctacattggtcgtctgctttagtatatttgttaccaagtaaaatgctgctgtagagtttaatgatctctttgtctactgggtttctccaattttctgatcgttgggattcgtgcaagtcgagagagtctacttggttgaaactttctgggttttgatttgagttgcccattggatttgaagttttagtcttttgttggtaagttttaccctttgagatatgctcgtctgatagtatagggctttcgagtgttatgaaaaattcgccttttcgtcttctgatttggttttcatttccttcagctaaatcttcgtaatacttggatcctgaatgattaatcatagctagaatccgtttggctttgttatttgggtcagagattctgagaggacgctttaaagagtcaagcttttcattcctctgaatccgtccttgtattggacgtcttgatctctgtatgctctcctggagctatcgaatcgagtttctcattgactgatgctcttggttccgaagctgtatatatgcagaggagcagtggcatcaataatctgcatatcccgacttcgccaatg

SEQ ID NO: 24389 - DNA, 3000 bp, Unknown; identical to SEQ ID NO: 2902
  misc_feature (1)..( 3000): 2750-1469P.txt file - cDNA_ID_2175817; gDNA_ID_1620614; Annot_ID_162001

SEQ ID NO: 24390 - DNA, 3000 bp, Unknown; identical to SEQ ID NO: 2900
  misc_feature (1)..( 3000): 2750-1469P.txt file - cDNA_ID_2175831; gDNA_ID_1620614; Annot_ID_162005

SEQ ID NO: 24391 - DNA, 3000 bp, Unknown
  misc_feature (1)..( 3000): 2750-1469P.txt file - cDNA_ID_2175838; gDNA_ID_1620614; Annot_ID_162007
cttcttccttacagaaccagtacattgtacgccgcccatcttagacttgatatattcaactacggatcaaatgtattacagttataataacgaaaatatatatgttctccttgtttggatctatttttatcttttagtactaaaaccttttgcttgagtcatgtaaccgtcaaaaagtctctagtataactgtataagaccatctctaatggtgagttctcaccaatagtttaataaaaattatgtcaatttgttagataagagcttgtgattaaaaagaaaaaaaaaatcatagtccaatggggggttctcagaaaattttctttttacaaaaattattatatttcacaaatacatgattccaatttccaaatgaataactagaaaatatatccatggactgaataaggacaaagagtgaactcaaatatggttctatgtgacaagatactgataaaaaccatttatacaatgacccatatccttgaactaacaataaccatacctctgaactataaatgataaaggaactcgacaaaacagttttagaaacacaatttgattcaatggaaaaaacagagacatttacttactttgttgcatctgctccggctccaggaaagggcttataggcttaatatgatgagtcctgcaatttgctacggctactttgttgagacataatatgatgaatccaactacatataggtttatccacagcttcttccaccttggctaagagatagaatcctgcaatttcagccaattgaatctagaataaaaaccacaagtaacaaagcttcaagtacaaaagcaaactaaagatatcaacagaacactaagcaccaacctgcagtccatagccaataagtgggatgagtatacattggaggcaatagaatagccatcaacagaatgacaatgcaaggatatcaaaagaacactaagcactaacatgcagcccactcgaagtattcaatgcagaatcagactgaaggcaacaaaactttatctttctatactttatagaattaacccaagaatccttctctcacttcaatcatcccctgagtatattgaatttcattacaacgagattttaacccgcggtacaccacgaggctatattcttttttaaaaataaaaatttaacttgtttagtagatttaaaatatatatgatttaatttgctgtacttttaaaatgtacaactcttatatcttactatgtttaatttttactgtttaaaagtataagaaaaataaaatacagttaattaagttaaaatctagattataactaaataattcaaatttaaattatatttgttttattaatatttttatttttttagtgtttaagataatataattgtattttaatttttatatctaagatttcacctatggtacaccgtcttgtattactatcgacctaaacccgtcatatcatctaatctcgttcagtgaaatcaaacatatctaatggatttcacatgtggtttagcgtctcgtattttatcgatccaaactcgtcttaccatctaacccgttcaatgaaattaaactttattttgttatttttgttttaataatactttaattgaaaaatatataatttaaatcaatttaattgtttttagttcaaatggttattaaattgtataaaagttcatatattataaatattataaacccgtcctaccatctaatcccgttcggtgaaattaaaaactatttttttgttttttgtttaaataatacttttattaaaaaaaatataattcaaatgaatttaaaagttttttcaaacaattatataaattttatagattttacatattataaatattctaaacgtttattctgttaaatattttaaatgtttaattaactacaatattttattttttaatcaagtatatattaataatgtcctaaaatttctcattttttaagtaattataattaatggagatatattagataagaaaatgctactaattaggaatattaatgtcaatggcattccgtgtaaataagttccaactcgaggatttatttcataaaatgactgcaaaaatgtatatgtagatagtgagaagtaaccaaagctaacaaatgttccagaatatgatccttcccttacatgaaacatctcttacaagaaaattcttcaatccacaatttactgcttttatctaccaaatcctcaaatccattacaataaacctaatcccatgaatactatattttgttttgattaggtttaaaaggaataaactaacctcaaggtcgtacctatgcacattgtttccggccgacgcttctccatcctctgcctctataaatcataaagctcctctaacgatgctctcgatttcacattcttctcgccgttctccgtgattttgcttcttcactaaaggatcgtctatgattgagtcttcgatcaacaatttaatcacactggattttagtcccaatcaatgtaatcagagaaatctccgacctaatcgctatcgccaaaaagactgttttttttctttcttgttttgtcaaagaatcgtttttttcttcttcttgttttgtcaaaaaatcgggcaaaacatgacacgtaatagtctcttttgcttttcaaaatctatctcaagagagacagctctctcaaaaaataaatcattctgatatattttttccaacttaaaaacatagaacctatgaagaaagcttcatttttacattggagatgctctaagtgtttttttacgtgtttctttaccaacacaaaatgcaaatatagaaactattgattaatacacaaattaaagaaaaaaagaaaaagataaaaaacactacaatcaatctgagccgtcgaatcgtaagctcactacatccattagatctagggctcaagagatcacctccatatataaactcgtatcaatacattttatcccctttggccgactcttactgacctcagagctcagcaaaaatg

SEQ ID NO: 24392 - DNA, 3003 bp, Unknown
  misc_feature (1)..( 3003): 2750-1469P.txt file - cDNA_ID_2176003; gDNA_ID_1620613; Annot_ID_161977
tggaaggagaggatgtcctggatcaaatctagcttatatgattgtaggaagtgcaataggaatgatggtgcagtgctttgactggagaatcgaaggagagaaggtcaacatgaaagaggctgttaaagggaccatccttaccatggctcatcctcttaagttaactcctgtcactcgacaaccacccttgacttggatatgacactgaatttgcagacaataaaaatagatttctctctattttttgtttatgggtttcccggtattagtctggtttggcatttgtagaggaggatgttggggcaatgatgttgatcttgtttctcgaacagaccctctgtcgtttttacatttaaatggttaaattattttgtaattcagacttgagtgcacttcccaatagacttgctaattgagcgtttctatcttgtgtcacatatgtcatatgtcagagactttaaaacattacatctgttgttgtaaaatctgtttttttttatcttcacatgcacatttcttagttacaagactcattaagatccacgtgtggaaccttaggtgtcggtacgtggggaattttttgatttttgaagattctttttcacttactgaatgattattatgatcacgaatgtcaaggaacagttttgacccgaaacgtttcttgttgaaaaaatagttatatactttcttctttccattttttcatagattattgataagaggatactctgtttcatctgcctcattagtttgagcaacaatggcagcaatgttgactgttgagtttcaaaactgcttgatctttatcctcctctgcatccttttactcctatgttaccctctctttttcaagaaaccaaaggtctcacaagatggatttggtttgcctccaagccctctatctctgccaatcattggtcatcttcacctgcttttctctaatctaactcacaagtccttacagaaactctcctccaagtatggacctctcctctatctccgcatcttcaatgtcccgataatctttgtttcctcggcctcagtggcatatgagatcttcaggggacatgatgtgaacatctcttttcgagggaaccctcctatcgaggagtcccttttggtcggatcttttggatttttcaccgctccttatggagactattggaaattcatgaagaaggtcatggtcacgaaactgctcggaccgcaggcactacaaaggtctcgaggcatccgtgcagatgcgctagaacggttttacatgaacctgcttgataaggcgatgaagaaggaaagtgttgagattggtaaggaaacaatgaagctcatttacgacagcatctgcaagatgattatggggaggaatttttctgaggagaatggtgaggcggagagagtcagaggcttggtgaccgaatcgactgccttgacgaagaagatttttatggcaaacgtgttgcacaagccccttaagaagctcggaatctcattgttcaaaaaggagataatggatgtttccaacagtttcgatgaactgctagaaagatttcttgtggaacacgaagagaaacttaacgaagatcaagatatggacatgatgggcgtgttgttggcagcttgccgagacaaaaatgcagagtgtaaaatcactaggaaccacattaagtcgttgttcgtggtaattgtgtcttttagtaggcagattcgtccataatccaaaatatattgtcctgtctaagaaactttttccaactgcaggatcttgttgttgcaggcaccgacacttcgagacatgcaacacagtggacaatggcagagataattaacaagcctaaggttcttgaaaaggtaagagaagaaatttattcagttgtaggaagaacaaggttggttcaagaaacagatttaccgagcctaccttatttgcaagctactgtcaaggaaggactgagattgcaccctcccgggcctctctttgcaaggacagcccgagaagggtttagtgtcggaggattttatgtaccagagaacacaccacttgttgttaatgcttatgctatgatgagagatcctggttcttgggaagatcccaatgagtttaagccagagaggtttctaggttcaggaaaagaagacgagagagagcacggacttaagtacattccttttggtagcggaaggagaggctgtcctggaataaatctagcttacattcttgttggaaccgcgattggagtgatggtacagtgctttgactggaaaatcaaaggaaataaggttaacatggaagaagctcgtggatcactggtattaaccatggctcatccacttaagtgcattccggttgctcgaacccagattcccagttgctaacactaagctcgggaaacgtaaaccaagtagtttgctttcttctgttagtcatgtttatcgtatcttttaatctgcagagtccgatttggtgacttattgttatctggaagatgggaatttgctttcctatgatgtgttcaacttcatttgttatgtttgaaagtctcacactttcaaataaaatagcagtagaaaatgacatgacacgatttgggactaatcaataaaagtctcctaattgtatcatttatcaccaaatcatgaacagtttgaaaataattattaaattgttcatgatgactaacctacatttaaatagtaatcaacaacaacattaaacttttttgagaatttttctataattgttttttcttgaactgcatcaactattatctctcacctaataacaataattgtttttaaaaaatacagaagaaaaaatcctataacggtcgtgtgaagtagatccgaatccaatgatcaatttgaaactttgaatagaaagaaagacaaaaggaaaggcaaacgaattttataattactctttttccctctctttcaaattttgaatctttcgtcgtctcccattttctcgatctcgcaagctgtgtcatttgagaagccatg

SEQ ID NO: 24393 - DNA, 3003 bp, Unknown
  misc_feature (1)..( 3003): 2750-1469P.txt file - cDNA_ID_2176089; gDNA_ID_1621196; Annot_ID_174737
ctacaactgaatcattgtaacttctatcaaaatttgaaaatggtttaaatttaatcttttaccaaaaagtaaaataataataagtttgaaatgtttcctttttgtaaattaattgtttttgattaattcaaaaaaagacttttaaaatataagaaattttttcatccaaatagatagaaataacatattagttatctcatatcatatatttctctcaaatgttcatcgtattcatttgtagtgacaaccatttgcatcctataaaccccaaaaaataaatcattcgtcaggcccaatcatgtcaaaattaaaatacttgaaaaatacacaatcctatatcatagctgacgcatttatttcatacggcatgccggcaaaaacgtcaacagaaattaaataaaaagaaaagacaaaatttccaccggcaataagctttgaaaattatttcatatagtactaataataataaccaaaaataatgctgatatgaatgaaaaaacaaagaaacggtgtcataatgatgggacaagcagagttgagatctgtgtgagtgagtgattacctgaaaagtcaactcaccggcttaagaactcggcttttgccagctctctctttttaagccttctttaatcaatcatgaaacgatcctcttgtgtagttgcaataagttgctatttttctattgaattttgtattacaaaactaattcaacaattatttacaactaatttcctcaaaagagctattattcagaccagtttgtatatagtgtcaatagaaataagtgtggagttctttacagaatccaattaaatcctgaactattttaaaaattgtctctaaaaaatgacttgacatactaacaacaaaaagtattttaaggtagagattcaaattcgtcaaaagtaaccaccgatgggagatttaattgggactctagtcactgaaagtcgaatctggagatcaagacggcgaagaaattggtttcaagaggttagggtttgattaagagagaattgctaaaaaagaagaaataggttagttttttttgtagtttctcaaacataataagagtacttttgtcatttaccagatataacgcgtttgacgctgactttcattagcatctacaattgttagccgcaggatgctgagtttgctgcagctacttgcgtcaaccaaacgaacatacatactcagttacgtttgccaccgccacaacaacatgtgatgaccaaacgaacacgctaattatacacgacaaggatcctcttattcttcttgcgagtcatgatcccttttacaaatttataaaccttgtgatattatcttcactaatataaaacttcatatgggttgcacaagtttgcaaatatttctagctttcgaccaaaagcccaaaataatctacccctctgccaaacaaagtcttccaaaattttcttatttgcttcccattagaccatttgtagctatatgcattaggttcttttgaaagagaaagaaaaataagagaactgcatcatgttagtcttgatatctattcaattatcgtaccctaaatttaaaatatttcttaccaaaaaataaaaattttggaacgaaaagcgagaaaaaactcggcttttacgaaaaacaaatatctgatgacaaaaaaacaacaaaatacaaatatctttcaaattggtaagcaaactctttaacaattactaatccgagttagtttgttttcatatgtcatatcaacaaaatccatcctacatacctcagatttttagaaaaccgaatccggatttttgtagtctacaacttaaagacactattgaatctacaccatataagtatagtgaactgtaacattaataaacatgttcacctaaaaaagaaaagaaaagaaaagaaagtaaattatcaacaataatgaatacttgttttcttaaacgggcctaagtaacaagaaaagcccaatacgtgaaacataagtatattcactaggctataagcccataaaacatatgttgaatagactcacgagtcacaagtccccaagtctcaacagacggtggatgatgctccgagtctgactccggagaagaaaaagtatatgtgtgggattggtagttgccacgtgagtacgtgaccctgcgtggtagttggctattgattagtatttgttttgatgtccccagtccccacttttgttactgagctcgacgttttctttcttagtaaataattgattccaacctaaagcgttgtctaagatgactttagtttttataatattgtcgaaaacgaaaatatgttttttataaaatgcatgtttgttactagcatagctcatatacattatggtccgcagtaaaacaagattctgtttactctacttgaatttcaaccatttctcatgttgaaagttacttacttgaacttggacattgaacatatatagatgaatatccaaaacttaacacaccaatgattttagaatttcatgtgtctctcttattgcattatttaagaaaatttgccacttatgatatgaactaacaccagtactaattccccaaacatatttattaaccaattattttcacgcatttatttgaagattcgaattatgatttttgtcttttcttttgagtaagtttttttttttttttttgaacaaagagtaagtaatacttaaaaacaattccatgtccataaaattttactttatcaaaaaagaatactattaccataaaagaggtaacacaatctgtgttttaagttccactacttcaggagaccaacaatcttccaaactcaaatacaaaaaggtttgagactttttccaagatttgtctcttctttctttattctacctctaaaacaaaaatcctaatcgagttctctataatattcaataaagattataattcttcttttatcttttgataaaacttgtgctttcatgtgattgtgtttcactttgatttataatctcagattccaaaaatg

SEQ ID NO: 24394 - DNA, 3003 bp, Unknown; identical to SEQ ID NO: 17641
  misc_feature (1)..( 3003): 2750-1469P.txt file - cDNA_ID_2176125; gDNA_ID_2926132; Annot_ID_197004

SEQ ID NO: 24395 - DNA, 3003 bp, Unknown; identical to SEQ ID NO: 17641
  misc_feature (1)..( 3003): 2750-1469P.txt file - cDNA_ID_2176125; gDNA_ID_1621196; Annot_ID_174752

SEQ ID NO: 24396 - DNA, 3003 bp, Unknown; identical to SEQ ID NO: 21534
  misc_feature (1)..( 3003): 2750-1469P.txt file - cDNA_ID_2176276; gDNA_ID_2936564; Annot_ID_194553

SEQ ID NO: 24397 - DNA, 3003 bp, Unknown; identical to SEQ ID NO: 21534
  misc_feature (1)..( 3003): 2750-1469P.txt file - cDNA_ID_2176276; gDNA_ID_1971786; Annot_ID_175494

SEQ ID NO: 24398 - DNA, 877 bp, Unknown; identical to SEQ ID NO: 21532
  misc_feature (1)..( 877): 2750-1469P.txt file - cDNA_ID_2176290; gDNA_ID_1971786; Annot_ID_175498

SEQ ID NO: 24399 - DNA, 3000 bp, Unknown; identical to SEQ ID NO: 6722
  misc_feature (1)..( 3000): 2750-1469P.txt file - cDNA_ID_2176318; gDNA_ID_1621102; Annot_ID_171460

SEQ ID NO: 24400 - DNA, 3003 bp, Unknown; identical to SEQ ID NO: 18111
  misc_feature (1)..( 3003): 2750-1469P.txt file - cDNA_ID_2176318; gDNA_ID_2926189; Annot_ID_200869

SEQ ID NO: 24401 - DNA, 3000 bp, Unknown
  misc_feature (1)..( 3000): 2750-1469P.txt file - cDNA_ID_2176511; gDNA_ID_1971786; Annot_ID_58006
tccgatgactagttaatttggattcggatgttattaatccctgtgatgatctatctaattcacggtgagatttttcattttggtttggaacaaatgaatgaatacctttcatgttgttgttggcctttaattccggtttcatttgtgtacttttgtttattggagcggtttacggaaccatagaataaaatagttatctaatcacgttgaaattataaccataatggtttaatacgaaataaatataactagtggaaattaactatctaataattcgttacaagatgtatcttgtaaaactttgattgctttatctcagtaacggatttctaagtctcatgggagataatgttatccacactctcttatccaatagcctttcagagacactagagttgtgctcattgattgccaaatcttttggaaatttataagtaaccccaaagacaattaattttaagtttttaactcaagtggaccaattctgtttttaagtttttaactcgagtggaccaattctgtttttacggtcgtttttttctttgcatgaatgagccaaaactagattaaaaaggtgattgccgacaaagaagaaaagagagagagagaggtgattttcgattatgtgcagtttatctctataaaattaaaatatgtgacattttgctacaaaatgtctatttttaatgaaatttcagtgttgggttggttttattgctatcgtttagaagaaatcaaagcaagttaaacagatgtgttggttcaatagtatcatcatgtctacatgtttggttgttttgccattacataataatagatcttgaatagtagaacatgcgggagataaatcataaacaacatatcaataatcttcatataagattggtgttcataaaatatacatgtataagattacaaaaaatcgaaaaaataattaaataaaattttgatgatagcccttaaacttaggaaaatcccaatcattgaaaccaaaaaaaaaaactaagaagagaaacaaaaaaaaaagtacagccgtataaggcagagtgtgaggtaatgtgatgaatgataataagatgtgaaactttaataaattgaaagtgggacaacatgattcctataacgtgccttgtcttctccatcatcttcattaacatccctaacatgttcaaacatctgatcagagagctggcctcacttctgcaacctaacatggcccctttaaaggtcaaatccatctctacaaacttttggaagttcatgtacatgccttaataacaaacatcttttcgatacaagacacagaaaaacaacataaacgagatatttatagcccacgagtctataaaactattggtttgataagggaatcattgatctactgtgtatcaaactatacttaaaagtttacataccaaagcaaacatttactttctagttaaaatattgtaagttacatgggtgataggtctatgtaaaaatttctctaataagctcattctgccatataaaaaaaacattttgagtttacgcaatcaataaatgtatatcacaaacttggaactggagaaatgagttggagaaagataaaatgctccttaacacatggcattgcaagtgaagggatatggatcaatggggtttattattacttaggtgacatgtctaagaccatgactgctactgcttttgtgatagtttgctttaatgttaggtctgagaaattcgagtttatttatccagagggctatcatgaagctataatggtaaattaggtttggtttattatgatgataacgttgatgataccgttgagttgcgtgtgtgtgttctagaagactaggagaaacatgaacagtcaaaatatgcttacactttgagggatgataaattctaggatcattacgtttccatcgttggagtgattgctactggtgaaattattttatcgatggcggattatacatctaaacaatctttcctacttcaatcccgataaaaacactctccaacgtgttgaaatttaaagttttgaataatatcatgtagtgttctgactacacgtttttgtagacgattgttgtagattatattgctttgtagaccatgtagagtatgttaacgttaacgacccaaacctcctcaagtcaaacatctatagttttccatacatgaggacaaaagaatcagaagaggaagaataacttcaatttttacatccttcagtacgtgtttcaaaacaccattcactcattgtggcgggaaagaaacaacaggaggtatggggaacaaccatcaccaactgcaacactagtcaagatgatcgataagaacatccgaaaccggctcagcacacttcaaaggggaggtaattcaaagtatgaagaaggcatagtcctttggtttgcaacaagaagaaatcatgtctagaaattccaaatttcttgtaaataattttgaaaagtttttacattcacttgtaatacccagtaactttttcttttgagtataatttaacatcatattcaaaaaaaaaaaataacttcaatttttaccaatttaacatcattttatctttttttttttttttttcttttttaaagatttttctgaacatgaggttttaaggataaattacggccataacataaaacaatcccaaatttttggttggacaaattagtttttttttctagtatttgttttgtagatgagtttgtatgctatattgctataaaagataaaagtgaaatctctaaaaaaaaaagaagaagagattggctacttagttaataatagatatacacactaacataaggattaagagtttatttacagaacaatagtcagtgaattaaaagaagttaggaaagttagggtccaaaagagaaataaagcaaatatatacagaggaagctgcaagaagaaaaagggataaggcaaaaaggatttgcttttacgaacagagagcgagccagagagagtgagtaagagagaatg

SEQ ID NO: 24402 - DNA, 3003 bp, Unknown; identical to SEQ ID NO: 19620
  misc_feature (1)..( 3003): 2750-1469P.txt file - cDNA_ID_2176552; gDNA_ID_1971791; Annot_ID_175554

SEQ ID NO: 24403 - DNA, 3003 bp, Unknown; identical to SEQ ID NO: 19620
  misc_feature (1)..( 3003): 2750-1469P.txt file - cDNA_ID_2176552; gDNA_ID_2926197; Annot_ID_201545

SEQ ID NO: 24404 - DNA, 3000 bp, Unknown
  misc_feature (1)..( 3000): 2750-1469P.txt file - cDNA_ID_2176637; gDNA_ID_1971795; Annot_ID_175612
tctaaacttctcacgtgggggacctcttattaaagaaagtggactcttcagtttggtacgaaatctacattttccttattatagagtttggcaactctatttatcaatggacatagtcaaactttcattggctttaaatcactcaaaatatagcaatgccatacaattcttccaacctctctatttttttttattttttttttcatcacttccaacctctctatttaatacacaattttccagaaaataaagtttttggttaaccaaaagtccaaatcttttccattcatacaattctaaggtaagaaataaaatttctttcactgttaaagtaacaaatatgtatcttgattatgttgctttcttttagcaccatcttatcttcttccgttattttcggaaagatcttgcaaattcttgggtttatttattgtatattttttgcttgttttgtagcaaagaatatgacaaattaaaacagtaaaagactctactacaattttgaaaaaagtgaaattgatagattttctttgattcttcgtgacatattaaaaaatatcaaacagtatagtgtaaaaaggatacaagaattttaattggcatcattatatgtcgaccaagtacggtccacggattcaaagttgtgtcgggtcctatgaaattttgttgttgtgcttacttttacacgcttatgaatacttagccaattatatcaagacacaattctaaaacggtgtcgttttggggttaaaatttttaatctttgaaattaatttgtatgaagaagcagcttagctttctggtttttcttcttctgcaccttaaatatacgcccagaaaattcctctggtcaccaaaccaaaccaaaaccgactctttctttgaatttctgaaaggaaacgataagggtttcgagaaaaatcattcctttttgacttaaaagacgcgtttccacatttttggcgtttcttctctgggtttgttttgtctctagacgaagacgatcacgggttttaacatattcgtgtgtacgcgtgtatctccaattttgcgaatagggtttgaagtaatcgttttgtttgtgagggtacgaaacgattatctcgtgttcttcttcactggttttaaggatctcgttgtgctttctgattgatcccaggttcgttattgattataaaggtgattcctttttttcttgttaggataattctgttttcacttttgttttattgagaaaatttggattatatgagagattttagcctatgcatttggagaattgtcattttggtaccatttacttctctttgatattgaaacattggctctttgagtatttagtcttatggctgcttttgattgatttcgatattcgcgtttgaaaacctcaacattcatggttagtgttctttaatcaaaggtgataattttttacagagtttaattgtttttttgtttctgtcttgcattctaagtaaagtgttctgttttttagtagacgactttgtgattttcatgttctgtgattgattgattgtattgttttgctcctagttttgaggggtttgttttgctttttccaaaggggaagcacatgatttcttgcttgtttgctagcattgcttgcaattgtgatcatcttgtaagggaatgatttaatggtttgttttgacttgtagatatatatttctggtcaatagtttgttattgaatggttggtttagaagcactatattgtattcgtctgtgtaggttctacgacaatgacttgcttttgacaaagaattttattgaaaagtgtggatgatgaccagattttccatttaaagagtggtcctattctgtttgtcatgtgtgtcttcttcttcttggtattggatcttatttagaagcctcatttttcttctctagataacgactcgcggggttacgcatagcaggttcctggcttctctactgtcaggaggggccttgagtctttggagttaccacagtagacagaaccccagtgggtgactttttgaaaagtcttcttgatttagtgctgcacattttcgctgtggagctacaatcagaatattagagaagatatgggaatcttttcacgcaggtcaagatcttgtctctctctttttagctaattagtttggtcattcgagagttgttgcagagaaacttagtcaaattttgttcttgttatttcagttcaattagtaggaaatcaaaagatggaatgaagatcattgcaacggcattttttggagtaacatttggctttctgattggaatatcttttccatcattatcaatcactaaggttgccgaatcaatccttattgtcctatttctgtgtttgattagatttgtttccttatcatcattggaagatttttgttctcatatttcaggtgagtctccctacaaactttcttccttcaaacgatctctcatatatcgaggaaaagggttcgaaaattgcaactccagaaagtcataaagcttggtcatcatcaaagggtaacgatagcagctcatctactccgattgacaaatcaaaggcatgcttctactccttaatttgtttatgacttgggaatgttttggacctttacattatttagacaagttaccgattcctactttaatatgcaactgggattcatcttcaaggacggaagactaaaagtctaaggtctccttaataatatgagacatgtttgaggatccttacgtctgattagttttgtactccaaaacatgagatacgtgctaatgaaataagtggtatagcaaattaacagagaatttctttgtggtcttacaaagtttagttaattagatttcaccttgcccaacatgacagaagctaagaacatgtgtttgttaaccttttctttctgtgattcataattaatggtctcaaatctgtccatgttttcatgtttcatttctgatttgtcgcagatctgggtaccttctaatcctcgtggtgctgaaatg

SEQ ID NO: 24405 - DNA, 3000 bp, Unknown
  misc_feature (1)..( 3000): 2750-1469P.txt file - cDNA_ID_2176645; gDNA_ID_1971795; Annot_ID_175615
ctcagagaaagacgcctaaagaaagtgaggaggagaacttggttcagggctttgtcaatatgagcccatcttcgaaacttcgtcgagcttcactggtcaagtctcccagatgtgctaaatcccaaagttactactacaactcagagaatgaatcaccctcactcaaccgtgaaatagggagttcaccttcaaagtcaccgataacaccgtggaagtctctttgggccaaagcggcttgcaaagagcttgcgaacctggctgcaaaaagaggcagtatggatgatatcacagtggtgataattgatctcaaccattacaaaggctgaaaactcttaacaaatatgtttgtattctatataagtatcatatctctctgagactctagtggttatgtagattcttgttcataatatataatggactaatctcaccataaatcttattgcgttcttactaaattcatatcagtgacttacatttgtttcctgtctaagaaatcatagaaacaaactcataaaaagaagaaaagcttgtttcttcttgttgtcactgccttttacaggccttgcttaaccctggagcaatcttatcgaaaatgaatttgttagcagcctgcgtgaagtgtacaccgtcccacacaacagccttatcaggctcatcgcacggctttccaatgtaaacctctttacctttcacaatcttcttcatcccacatccgatacccttgttgtagttatacttccctccatgtccacaacacgaaaccaacgatcccttaaacccgtgaccctgagcgtgaacaaacaactcatgcttgagagagtagacatctacataagtgatggctgcttcagatagagaacttcttagctcgatcacagcttgtttcaaagcgtgattgaattgttgagctaagtggttcaaaggagaaacacatccatgtgaatcaaagtctgatgctttattcggaaaccgttcaatcacataagctaaacaaccaataggtccagtgttatgaatccagaagtatctccctccttgtccataaatattctatcaccaaaagaaaaaacacatttttatgatttccctttaaacaaaatcagagtcagaaacagagagaccaaccttgatagcattcatgaactgacttatgatctcaggaacttcggtttcaacttgttctacggttttattagcgaagtaacctgctgtgagatcgttctgaccaatgtcaaaagtgtacaaagcttttgagaagctgtcggattcaggcaacattgtcttgtagactcctccacgactacgaacagtttgagatctgttgtggaagttatagaattgtacgaactgtacatcgagtgaaaatgggctgaatccactttgacgtagagtagagttaagagctcttatcggagatcccgcggtagcgaagttagcgccgtggctgaagtttgaaccaacggagtctagaaacgcgcttagatatggtaatccaagactctccgctatgttcaaaacagaagcaaaatcagcaaaaacaaaaaacgcaaacgttttggatagggaagagttagtgtacctatgaagtcaatgacgaggcgaccatcgcagtatcgtcccgcgggtgagccgaagaaggaagagccgtgaggaggaccagcttggccaaaagcagcggagagaccgccggtatcggagttagagtcaccaaagttaaagattgctgggaaatggcattgatgggcatgtgttgatggtgatagtgaagaaagcaaagagagagcaaacaaagaagataggattggattcattggtaaagctaaagatgtaaagagaccaaaactcaatcacgggacttttatcctcaaaagaagagaaacgttacccctaccagaaaaagaaagaaggttggcaaaacacaaaaatcagagatttgtgatatgtttttattgagatagggttagttataaatcaatacattttgaatatgtttacgaaaatacttgtaagtttaccatcatacaaatatgctttctttctttggaggattctcttcttatttctttctttttaagtttatatggtagctttccattttcatattttattttattttcgttgtagatatctagtttttttaatttgttgtctctattttctatcacgttttttttctcaaatcttcttttatctttttttgcatgagttgtcgtgtatacactctcacgattatcgcaacattaatgaaacagggttgtgagattgttgtgtggtttcgttcgtagagatgattgtttggattccaaaatggttgaaacatgcttgtttggatttgttcaactggttgaaaagggctttgcttcgtttgattggctatggctacataaatatgattaatagtaagctcactgattgaccatctaacattttcttggcctcttttagctatggggaacaacatagtgttttcttactttaatagatgtgttaccattctacaagtttggaagaacgtgtgtttaaacattagtagaaacatgaaaatttaagaaaaatacccctagttgttaatagaaatgtattgttaatgccctactaatatttttttcccagtgaattctgttcaccagtcatcacaactttcgaagtgatgcttaacataaattatcgaaactttgtgaaaatgtttaaacgtcgtaaaaactttacaataatttaaaaacaactgaatgttcttcttagaggttaatgtatcagatggcaaaacgtcgccgttttacattcctctcatctgaaactgttacaagtctgttaatacggtgccgtttaattgtagttgttttttgtgtaaactataattacaagtctgttaatacgatgccgtttagttgtagttgttttgtgtgtaaactataatcgtatatcgatcgtcttcctcgcgagagtttcagtctcagccacaaagtaaagactccactgtcgtcttccgtagtgatg

SEQ ID NO: 24406 - DNA, 3000 bp, Unknown
  misc_feature (1)..( 3000): 2750-1469P.txt file - cDNA_ID_2176655; gDNA_ID_1971795; Annot_ID_175619
aatatatatcagtaagtcgctttcaggaggattatagcatcgccgtgaaatacaaggaaattctcaaagtttttccggcgagaaatgataaattaagggaagacccaattcggaaaattacaggaaacaagggctttacgagttgactggttcaaactaattgagagagtcacagagagagagagacgttacctgtaatcgaatcagcccaaggatctcttgtgaagttgatttttttaattcaccaattgtgacgtttatatacgtatccatttcacaaaaacaaaacaaaaaataagggaagtaaacttatagtaattaaaattttagtttgataattaaatttttgggggatcatataccataagaaaaaaattaaaataaaattttacaattacaatctatgcatatttttatcctaccaaaaaaatctatgcatatttttatacttaatttattaattttataaatatatattttttaaataaattaagatttcttgaagatatggaaaaacgaaattgaaatatacagtagaaatattattttatttcttacatgattttcaataatttatttatatttattattttcttgcaaaagataaattatcacattttcctttgtttttgttaaaattttatcttcccctgcataaaagatttgactaaatgctagatacagttcaatatattactattaagttatatactatcatccaacaagaaaagttgaacagcaactccacaaccaaataacccaagctatgaaccttaagaaatttagacatgaaaagttgataaacacttatatctttattttattgttaaacatataatgatataaatcaatacaatgtgttaacttctcattatatgttatttaacacattgtattgtcaccacatatctctgttttcttagttacgtttttttgagttaatgataacatcatagatgtaaatgttaagtagaaacagtgtgtgacagagcatgatacaaaaagtgttttatttcaatattttacttttcttaaagttcacatttttattctataacacacaatacatagatagaggcacaaagacttgcaagcacaaacgaaagaagagggagagataacaaagatataagagaagaaaaacacaccgaactacagaagaagaattttgttaatctcgaacccatttcggttctttgatcacgataagtggatttacgctttcatcaaagatgcagttagatttttgcctaaaaccgcgtaaaccgagctccatcctgcctgagtagggtgaagtacatcccagaagaaagtagacttaggatcatcgcataaggtatagttcttctgacctttctcgtccacaaccccacaaacacctcctcaacattctttcaacggagttttaaaccgcgtactccctacatttccataaccaatcacacaatatataaaagccttgaaaatatggatttcaagaatgttgtgttttactttttcttaactggagtctctccattgttcttgaaaacggtcaagaaggcgttgtagtaatcaatgaacatgaaagtcgaatccttggtctctttgttgagcgtggccagtagtgtcttcaacttgttgttgtgatagatcactagcccgtttacagctataatgcaatccttgactgtggagcctttggagatgaaggggatagttaaataatgttatttggaattttccatatacataatggaatcttcttagtttattatctactattttaagtgatctaaattctaaacacatttctatagtgggaagtatacgaaacgaattatttaagatatttaatggaaaaaagttttagaaacaagtaaaaaattggttttggtcagtacactcaagtgtagccgtaagctatgacgacgaaatgaaaacaactttaaattatttcccaagcctctttccgacagtatggggctctaaaagtatatcactaattcagtagtcgaatcgaatatgcctttgttctttcccttttaaatccataatttatttctaaaataataaaaaggagattgtcactggagaagccgcctcaaatgatgtccatatcgcatcataacatttaacgtcacacgataaaacaaaacatttcgtattttgttttgcaatctatttagtaattgcattattagtagtggcctatctcttttgaagttgaaagtctctagttgacttggtcgtatttgtatcattgtcacatataagtgaaaattaagatggacatttccgatattattagctaaattaaatcattctaattttttttaccagatattcaaaattccaactcatttagagtttcacgttggcatccaagtacttggattagctttcgactaaacaagaaattttacgtttttgcatagattataaaattagtttgaaaatttggttcaaaaatttcctgattaaaagaatataacgaagcattttataatgatgacaatgattcataatttttgtaagtgcttcagttgctacctaactcaaagtcgcaacttatattctaacagtttcatcattttaattttctaaaaaaaaaaaaaaatcaaagaccaaaaaattctaaattaaacctataatagtttcctttaaccaaaaaaaaaaaacctatactagtttcaaggctcgtagaggaagttagattacttaccatttaaaaatctacaatttaaatatataatttttttaaagtattttataaaataacattacaagatagatctttttttttttggtaaaaaataagatagattatatatagatagatcaataaacataaaaatagttttggcgcgttatagaaaggctctatgcatctaatcactatcctctctccgtcgcgtagttcaaggagttctcctttgattatccttaaatatctctcttctctcgttttcttctacctcctcctcccatttcttttcattgcccttgttacggaacatg

SEQ ID NO: 24407 - DNA, 3003 bp, Unknown
  misc_feature (1)..( 3003): 2750-1469P.txt file - cDNA_ID_2176666; gDNA_ID_1971795; Annot_ID_175623
gcgtctcctgtttcatcctataattctgggagacaaacaccgaagaatcttgagaggaagtattcacggattgctgataactaccgttccattgatgaggtttgatgatcactcttgtttttgtttgtttgtctcttaggtcgttgtgtcggtttgtgaatctctctattggtgttttgttgatatttcttttcttttaggttaccgctgctctttcacatgccggtttggagtcctcgaatctcattgttggtatagatgtcaccaagagcaacgagtggacaggttagagaatttatctcaatgttttagtatatgtttctttgacctggaagctgacttgggtgatttgatttaggggcgagatcatttggtaggaagagtctgcatttcattggaactactccaaacccttatcaacaagctatttccatcattggaaagactttatcggtttttgatgaggataatttgatcccctgttatggatttggagatggtacaaaccctgattgtttttatgtagctgttaagttcctgtctagaatagattttaaggttggtttctctttgactatgcagctacaactcatgatcaggatgtcttcagtttcaatcccaatgatacatattgtaacgggtttgaagaagttctcatgtgttacagagagattgttccccagcttcgtctctcaggttgagtgagatgaataatcccttttcttctgcatgtcttctgaatcttgctgtactttttccttatagtttgctgcttctcttacaggtccgacatcttttgcacctatcatcgaaagggccatgacaattgtggaagaaagtggtggccagtaccatgttcttctcattatcgctgatggacaggtaaagattggaacctaattcgactagagaaagtatttcttgtatctatttgtgtttagttataatcattcccagacatttgtgtactgtatagttaccattggagcttttaactatgacaggtgacaagaagtgttgatacagataacggtggattcagtccacaagagcagcagactattgatgccattgttagagcaaggtaataaatactatttcctttgacgaaaatccaatttcaaactgtgtctctctaacttgtggtggattctgttgcagtgaatatcctttgtctatagttcttgttggtgttggagatggtccctgggacaccatgagacagtttgatgacaacatccccgctcgtgcctttgacaatttccaggtaataatatcaacatgtttctacaatagtgtagatagatcccttgtctttttcctggcaaatgtatcaatttcaaaggtttttgttgtctatttgaatcctttcagtttgtgaatttcacggatataatgtcaaagaacattgatccagcaagaaaagaggcagaattcgcgctttctgccttgatggagatcccgtctcagtataaagccaccctcgaactaggcttacttgggtaagtaaattcagatatttgagttcatcactgcagcatttatgaattgatctcaataaccgccaatttcgttccttgtttcgaatttgcagacaaagaaccggacattgtccagacaggattgcgcttccaccaccaacttatgctactcaatctatgcgcaacagcccaagaacttcccgatcaaccagttttcaaaacaaaccatatgataatggtgtttcctctacaccaccttcaactactcataacgagagccaggtatgatttacaaagaaagaaacaacaatgcattgataatcttttgctgctcgtcacatctttttgttggataaacagcaacagttttgccccgtatgtctagtgagtgcaaagaacatggctttcaattgtggtcatcaggtgcatttccactcccgagttacctaagcatcgcacttgaatcaaaatcgttaactttcctttgtttttcttattttgctcatcagacttgcgctggatgtggggaagacctccatgtgtgtcccatttgccggagctcaatctcggttcgtatcaagctttattaagataagtctctcaagaactgaaggaacccgaggtggtctgagatctttcacagccaacaccatcccaacttagatctcatttaccagtgtcctaacatttgtttttactttgaggggaataaccggttcctctcaaaggttttgtagataatctgttgtcaattttgcattctcattgcacatgaaaaaaccacagcagactctctcgtgaataaaggatcctttctctgcggttacacatttttacttaaaagaatttgaatcttgaatggtcctatgacatatgtatcaaacaacacactactatatacctttcttgtttgaaacatctagtcttcaacacagtagcccagatggtcctgctttaacttccataattgacatcttatggggtcgtatctattctctgtcgttaaagattcataattgatgtaactgtcaacgaaagatggcaaaaacacaaaggctattataggtttctatcaaactgatcactttttactgtaagaatatatgcgatatacttttcttggtcttcttccctcagtaatgaacaagatcccaatctgagtctgctattctttcttactcttccacaagtttgtattagttttacgtatatgcggttaagcagtccgggcggtgatcctctccattcattcatttgcttacccagaataaatctagtgtgtgtctttcatcacgaaaagtattaccacagtgataagatgtgtagattttcaaatctgaaaaagagataaagctatgtttcaagtctttgaataagattccagtcatattgctcaacaatctttagtttcagggaccctactaatatttttatcacgcaaaccaaagagacaaagctgttttgtgtttagtaaatacatattcaaagtagagtctttttagaacaacaaccatttaccatg

SEQ ID NO: 24408 - DNA, 3000 bp, Unknown
  misc_feature (1)..( 3000): 2750-1469P.txt file - cDNA_ID_2176689; gDNA_ID_1971795; Annot_ID_175631
aggcatctagaaaacaaccaacttagtggttcactcccaccataccttgctcatctgcctaacctacaagaactgtacgtaatcacaactgatacctcaaatgcaattatccactacacatgacactttaaccaatgttattatctggcaggtctatagaaaataactcctttaaaggaaaaattccttcagcgctattaaaggggaaagttttgttcaagtgagtatgctaaaagtcgacttgtcaaacacaatagtgcacagctttttagcatttgcttggaaagagaaattacccttttatcacagcttttcaacatgactgttggaacgttttagtgtatcagcgtttagaattttcatcttttatggagtttcctcttttagtgctaatgcgcagctataacatgttttccccagatataataataatcctgagcttcagaacgaggcacagcgaaagcacttttggcagatactggggatatcaatagccgctgtcgcaattctgttgctactagttggaggaagtcttgttttactttgtgcccttcgtaagaccaaaagagctgataaaggtatatatgcattgtatgttgatcaaatagctgttacaggttttccccaagtgttctaactcatgtttcttcaggtgattccacagagactaagaaaaaaggtttagtagcttactcagcagtgcggggcggacacttattagatgaaggtgtagcatatttcatatcacttcctgtgctcgaagaggcaaccgataatttttccaagaaagttggaagaggaagttttgggtctgtctactatggtaggatgaaagatgggaaagaagttgcagttaagataactgcagatccttctagccacttgaacagacaatttgtgactgaggtattgtctaatttgcagccattaacttgctgcaaagtttcttaattagacgattgaattaaaccaaatgtgcaggttgctctattatcgagaattcaccacaggaacttggttcctttgattggatattgtgaagaagcagatcggcgtattttggtttacgaatatatgcataatggaagcttgggagatcacttgcatggtatttaccaatttcccttatattttcctgcctaagttacggatttcattctgtgaataactcatgaaatccatcctgttaggttcaagcgactacaagccactagactggctaactcggctacaaattgcacaagatgctgccaaaggtttgtagcacaatctcaagattaaatctttagtgtggctataatatgaatccattggacagacaaaacttcagattattacaggtcttgaatacttgcatactggctgcaatcctagtattattcatagggatgtgaaatcaagtaatattctcctggacattaacatgagagccaaagtatctgactttggactctcgagacagacagaggaagacttaactcatgtatccagtgtcgcaaaaggaactgttggataccttgatccagagtaagtctaacaacacaacctcacaaaagtatccctttttatgaactttgactgatagatgcattcttttgacaggtattatgctagtcagcagctgactgagaagagcgatgtctacagttttggcgttgttctttttgaattactctctggaaagaagccagtctcagcagaagattttggtcctgaactgaatatagttcactgggtaaacacctctaatcttctgtccattttcacctttgaccgtttaaagtactacatgaacaacatcaagattcacaaaccacatatcctctctatgcttttcttgttcaccaacaggcaagatcgctgatccgtaaaggagacgtgtgcgggatcatagatccatgtatagcaagcaacgtgaagatcgagtcagtctggagagttgcagaggtcgcaaaccaatgtgttgagcagcgtggacataacaggccaaggatgcaggaagtaatagtggcaatacaagacgcgatcaggatcgagagaggaaacgaaaatggactgaagtcatcgagttcaagcagctcaaaggcacaatcatctcgtaaaaccttgcttactagcttcctcgagctagagagccctgacatctcaagaaacagcctagctccagctgctaggtgagtcctcttaaagctcgagctctcatgtttaccctttggacttaccatcgtcacatagatgaatacattatatacgtattaaaatgtgtgtatgtgatgtagtgtcaaatttaatctgtatctctttacacacttctgacatgacattgtgtagatgttttagttgatgatagcacaaaaccataatttaattattgaaggtaacaacataatatgctatctatctcctatgctgatgaagacgacaaatttccaaaaacaattcttgcatgtcttgtgtcagggagtagccaattgtcaaaagactcgaaacaaaatgatacaaatgcaccactcataatttcacgatcaaccatttgtcacaaaacctcaagaaatctaaaattgtgtctaaaacaatgtcacactgtttcctatgttttgtttaccacttggtttcctcctctattccgcttttaccatatgaaaccttgttttgtattgcacaattcaccatgaaagcctaaatttaccatttttggcaagtaaaataatctgtcaacatcagaaggtgccaacttcaatactcaaacatcacatgaaaccaaattttaaggaagaagccaacacaaagacaataaaattaatcaaaaataaacaaaggagagagacagaagaaacagagagagtagttaattccggtggttttctgctcatctacttctatccaccttcgtcccttccgccccaaaattcaattctctcttcctttctctctctttctccttaaaaactctaactttactcatctcatctccaaagtctcaacctttcttctctaatg

SEQ ID NO: 24409 - DNA, 3000 bp, Unknown
  misc_feature (1)..( 3000): 2750-1469P.txt file - cDNA_ID_2176693; gDNA_ID_1971795; Annot_ID_175632
ataaatattttttattttttttatcataggtctaaattcatatacaaatttagcatatatatttaaaggtgtgtatatctaaattcttgcaatcaaatttgttttgtttttcgatctaagtggtttgaagacaactctcagtgttctctgattctttctcaaacaaagtttaaccaagaagactatataaaaatttgaagtcgttttcaacttaaaaaatggattggctaaaaggtgaaacttttgagaagtaggggagagaatgaactttatacattcaaacaagcatagaaatttcaaaatgatcctcaaaattattaatattataataagtattaggaaaagtaactaaatggaaaatgcccactaacaaagtactttatcccacaaggagaaattaacaaatattttacgaaaagaaaaagatgtatatgtatgattggtgtccaacaaattagaaggatcaagattaacttcgtccttcttatctttttggcggacactttcgccttcttcttattcttaatttgataaaattatgtctcttaaaatatttaagtttctacaaacacctttaaatatacaatataataaagtagaatgtctatataaaatctcctcctacgatacttcatgttatttgattttcaccattttattctgtcttcaacttctatttttaatgctttattaatagattggtatagatacctgatattgatgtataactcattttactatatatataatactactagacaaaatatctagaaagctcaaatggtgcaaaaattatatatgaaaaagtcttattttgtataaatggtgtactgcatgttttctttctttttatctctttatgaaacttgtttcttacaagaaatatgtagcaagcaatatacgaaactttgatcgatattgtttactttgaggttgataatagaacttaaataaaaaatttagaattataatactttccactccgaaactcatatgtaaatatgttggtaaattcaatatagaagtgtgaaaatgcgtaatatagtgatattgttttataaaaatacttaaaattctctcttaatttccaaaaccattaaaataaaataaaaacataccattatcactcaaatttcatatcaaaggtttttttaaaatcaaaattagtaataaatactaaaagttttaaataatattggaatagatttcgtctgtcaagtccacgagagatctctaaatacttgatcttgaatactaattcatcttagaggccctagaattagtaaaagcaggagtggctaacgcatcagtcatctatcaagatactggtgagcaatgagacttgttatgcacccctctcggcatggtacaaaacacataattatttgattcatctaacatgttcgttcttgtagtgatattatagacgctagtgtgcttatccatcccgtgtatgaaaccggtaaatatatgactacgaataaaacattatacactttatacaaaatctatcataatcggatccccaatcttaggagaatattaatactccatactcataaaactcacctaaacacataaaaatttgttgggtgtctttcataactttctcttgacttaagtgtcggagattaattaaacgacaaaggattgtcctttacgtggtacatgtttatctcttgttcagtgtatcgtccacattcacgagaagcaaacacaatgcagatgtcgaaaatttggcaggaagaactatctttttatattaaacttgtaggagcttttccaaaacataatgtttgtggttttttttgaatatatatattctaaaagtcgatcacaaagttttaaaactaaaacattatttttttgattggtgatatatataattttgtgtccgacaccttaatagtatttagtaatataatggttgtgcgccatatataaattgacaaatgacaccaatattttaattcttacacacaatctatacacataaatctcattcgatccttaccttttccgtagcttttcatttaacaataatattcatattttggattaaaccttcactttactctctttgttaactttaaggaagatgctgaatgttgcaattgtgcaatttgtcaataacatatgctgaacttattgtctttgtatatcacataaaaaacaaactgaaatactatgtgttaaaaagaatattaaacaatttataaaccatttttcttgcataatctatcttttaaccctatattaataaaaacaaaaacaaaactacatacacttttttggtcgaatcaaaactatatactgtacattgtttcatataacattattttagaaaagaaaaaactcttcgaaataagtaactcatgcagataacagtccccaattgggaatggatttgtattttctcaatttaaagattaagttcattttcatacttatactgtatatggagaaaatatgatagagtagattattgaaaatgggcctattagttatgtagtatagacctaatgctataacctgctaataattaggccttattacacttccgttttagaaatgcggcccaatgggttttaaagagggaaacaaaaaaacaaacacacatacctgtaggctgtagtgttgtagtacagcttgaattaaagctttcgagaaattgtgtgcgacaccaactttttccaaaagcaagtagccaaagcataaaaggtgaaactgatagctttaaattttcaggaatgaagaaaaagaaaaagctaattcgaatctcaaataaagaaagacaaattctatgtgaccattgcaaagaactcgactttttttagtaaaagcaattaacaaagttggagtctttgttcacttcactgtctctcatcacacgctttccttctttatctcgtgaccactttcaaagccgaaaagaacttggtatttttgcattgaattatagagatttaagagccatcgatgtgtgtgtgatcttcaatg

SEQ ID NO: 24410 - DNA, 3000 bp, Unknown
  misc_feature (1)..( 3000): 2750-1469P.txt file - cDNA_ID_2176703; gDNA_ID_1971795; Annot_ID_175635
ttgtgaaagaacctttaagtgattaatctaacattcttcatgactcctttgtactgacgcccttcttatgccaggtgatcaggttcctggaggacatttcttccagtttaactgacttggctattagagagttttccattttggaagacttgaaggtaatcgaatgttggtattatataattacaggttatgcctttctcactacttaacttgctgagttttaatatcagaggaaagaagaaggggagattccatttggcgtagaagatcttttatactacataaagagggtagaggagttgcagtttgatcttgattttggagatatccggcaatattttcctgtcaacttggtcctttccgggatctttaaaatatgtcaggacctttttggtgagtttacgtctgtactctaaaatcttttgggggtattaataaatttttgctttgcttctgtggcttgagaatatttactatccatttatttgatcctcgtcatagcttgctggccaacttaatgatttcgccatgcaggaataaaatttgaggaggttacagaagttgatgtctggtatcatgatattcgagcttttgccgtctttgactcaggatctggaaagcttttgggatatttctatcttgacatgtttacaaggtccattagcaaccttacttcattctcctctttacttttagagcctccatttcattttgagttgtgataataattttgtttgacagggaaggaaaatgtaatcacagctgtgtggtggctcttcagaataacgcactgttctccaatggtgcatgtcaggtgacaatcctacatccatgtcggacctttatgtggaagtatcatgcaactcaaatataaatcgatattgtgatctcatgtggatgtattttaaggttttagtattcgtattttggcatttattttgtttctgtctccagattcctgtggcgttgcttattgcacagtttgcaaaggatggtagtggtgaagctgtgccattgggattttctgacgtggttaatctttttcatgagtttggccatgtggtacgtgaatgaaattggttacgtggaacagcagaataaattctgttggtatcttttgtatgtatcaggggatgttattagctgatattccttgctactattggtaaataggtccaacatatctgcaatcgtgcttcatttgctagattctcgggcctacgtgttgaccccgactttcgggagattccttctcagttattggaaaactggcaagtaaactgataattttttcttaaaatctttctgtattaacactaaatcctaatagacggaatataattcttgtatctctaggtgttacgaaagtttcacgttgaagttaatatcaggttatcgtcaggtgagcgcttctcacgactaaattgttgacaattgttcttgtcgtagactagtcataataatttgttttaacctgggatttattcctgcaggatatcaccaagccacttgtggatgaagtctgcaaaacactcaaacgttggcgatattctttctctgcactaaagtcgcttcaggagatattatactgtgagatattaattgacttttaatgatgcttatataccttttcattttgacttcattgtagtttttaaactgaaatatcaattcctcacaatcgttaggacaaatggtttgttagtaagacgagtagattgtggttcttattatgctttagaggaagcagtagttaactaagaagtctactagcgggtaaaatgtggtattgcctaatgatgcttgaaatatggatgatcaggtctatttgatcaaataatatattcggacgatgatgctgacttactccagctaatcaggagtcttcatccaaaggtaaaagcataaactctcaaagcaatctggtctgtttacggcaaagaaattttctcatactagtgtctttctatatataggtaatgatagggctaccagtggtggaaggaaccaaccctgcttcatgtttcccacgtgctgtaattggctctgaagcaacatgttacagtcgtttatggagtgaggtatgattgatttgcactgtggtgatccgtaccttccatgactttagtctgagaatccacctatttccacaggtgtatgctgctgatatatttgcttcaaaatttggagatgggcatccgaatctatatgccggcttgcagttcagagacaaagtgagaagcgtatttgtttgtctttcctttgatttagtagtgtgtgagtgtaaaaggactaaacaagtaacaactactttcttattaggtgttggccccaggaggaggcaaagaaccaatggaacttctcaccaattttcttggaagggaaccatcaacacaagctttcatcgctagccggacaaactatagtttgtagtattttgcacctaacattaggttccagtgaatctggtagctggtgaaaataaacatttctttggttgttagagacatcgtttattgatgtttgttaatgtgttgagaggacctagcggtttaggtggaaactgtaatcattcattcttagtttcttacctttctctgcatcgcaatctcaaattacgaagagttatataacatagtgatcatcattgagcatgtacggtgttgaagataaggacttgtctcgatcaatttacaagacagattctaatattatggttttcttctcttattaagacaagaatagtattgtctttttggtttactttggaaataggattgtaacaggccttaaaggtaagtagtttcagacatacgtaaaagaaaagagtttcagattaccttatgaagtacggttctggttcggtttaaactggtttgaacacgtggcaggtacaagtagataaggtacgaatccacgaaatcatcatcttccccaaaccaaataatctctcgtttctaaacaaactagtggtgagtgaatcttctctggtgagtaatg

SEQ ID NO: 24411 - DNA, 3000 bp, Unknown
  misc_feature (1)..( 3000): 2750-1469P.txt file - cDNA_ID_2176716; gDNA_ID_1971795; Annot_ID_175639
cagaagcggcaatttgtgccctggccaagagaaccaacttagacttttccgggaagttttcggcacactgtcccagaagttcttcagctttagcagccttgttttctctcaccaaaacagcagcttgaagcaatgtaggaataacactctcaggaaacataccgggcagtgtagcacaaagctctcgtgcctgaggtaaaaagatttttttaactttaagcagagtatgcaaagaagaaacgaaagaggaataagctagatttcaagtttaaaggacctgatccatcttatttgcatggagaagtagaaggacgcgattggcatatatagcttccttatgtttatgtgaaagcttagcatcaagttcttgagaaagctgaaaattttgtgagtctttgtctttcagcagatcaaacttcctcaagccatcagaaatatctttggaacctttcaaggcaacaaggttgttcacagcaagagcaagtgattcatcagccagatttcgtttaatgatatctacataagagctctttgattcttgagtttgtccaaggaccttgacaaagaaaaaaactgttattaggaactggaagatatcttaacaagatgtaaaagaaaagataagcagtataaaaaagtacctgttggacatatgctaattgaacagaaattggggctagctgagtctcgatataatcatcagaatagtcgccctcagtgagggtttcctgaccaattctgtctcaaagtaacagtacattttttatcagctatgagtaatcagtagtcaaatgatcaatgtacttgaagtgttgataaagatacagaaaaaggaaataatctagattgatgtggttatataagtgtcagtgtaaacaactattttaccgaatcactgatcctaagctagacgaataattgcatcaaagctagacgagtatcgaaaggtatctcttgagaaatactagtaggaacaatggcctaggagacatatacaatggctaaaacttctcagaaaaagagagattatatacctcatggcagtgagcaaaagttgttcagcatcaacatagttactgttttcgatcaaagagcaagcagtattataagccaattgataagtagtcgtaggtctgatcttcaaactctccaatacttgagaagcttttccggctctaatcaacgccgcgactaaattgacctctatcaatttaatcccggacttgttcagtttctgatacacatccacacaagcatctactttccccaaacagttcaaaatctgagcctctaaaagcaaagtctttgactctctctcgagaccttttaaacacaccaaagcctcatctaacttgttttcacggtataaacaatacgcctatcaagagaaacatccattagaccccaaaaaactttcaaatcttagcaaaattactataccttgtgaaaacctagatcgattggaaacgagttaatgacggagagagcaccattgatcttaacgtctttgattagataatcatcgaacttatcgtcttttatcagagccacaactttgcatcggatcgcatcctcatcggtaggtacaatcgacaaaactgtaaacgaaatcacggattcaaattttcaccaaaccaaaatcaacgagtaagaaggaaggtgagaattgtggaaaccttgatcagcgaccttgacggcttcttcatatttagtatccttgatatgtttgtggagggaagtgaagagatcttcgattgctggagtcgaggttttggggttttctttcgatttgggagccatggctgcttcaaggtttctcagggcacgaaacaacagagaagaaaactggcagatttttgactctttaaaaatcaacagattgatgtttatatactacctgacttcaatcaaggtctgtgaagatgttcctaaaataacttatgggctttttatatgggccttttctgctcatgattcaataatctttttacttgaaagtataaaaagagattaaaaaactatttgaaacccattaagactcaatgcatctaaatttaaaacttttatttattaaaatttaatatatatggagttctctcacatctacaaaatatttattaaaaatattttagaaattttcctttcaaatttagctatatttattattacttatagtaaaatgaaaataagttttgaatacataacaaaaagctaagtataataaataaaatattaacaacgatatatacgtttatttttcctttcaaaactttgttaagttttgtgatcaatatcattgttttcaagaggagttaggaaaggtggataaaagtgatatagagaccctttattgttacagctcatttctttttctcctaatatcttaatttgttttatatctttttatattattgatcattttaaatgttaactatgtattatattctcgttgttattagaactgtactatatattcttgataattattatgtaccatacttctccatccggaacctatatctcaatgtttttgagtttcaaagtaagacattttaattcatctaagaatatgttaaaatccttaaaaatgtaagaatgtttcattgttttgtttgttccaccatcgcgatcttacacttgctagccacgttcgtgataacacttttcaccggtgtatatttctttccttaccgttgtaacaatctttgaattggagtgtatatctttgaaccggagagctcatttggaaaatattactatgagtcttttgtaatgaaattaaactcaaatattaagaaaataaaaatgaaattaaagtcccataagagattgtgattgggcttcatgggccttaaaactttatgaccacattgatggaaaaactaaaacgacaacgaatggattcatcttttaaaaccggcctagaaagaagaacaaatatcttgtagaaacagaaacttgtctggtcttttcgaatgtgatttttggttgatgatgatg

SEQ ID NO: 24412 - DNA, 3003 bp, Unknown
  misc_feature (1)..( 3003): 2750-1469P.txt file - cDNA_ID_2176720; gDNA_ID_1971795; Annot_ID_175640
cctcttcttgttcattgtcctttgtttgagtttattagttatcagtttttctcatgttttttggtaaccaactcctctatttctgcattcctctctgtttttggtcatctgcttagttggcacaaagaatcaacctattgtctttcaactgtcttcacctatttttgcaatgaaaatcatttcacatccaattaatttacagacgatagaaaaccactaaactccaaagagtgaaatctgattaaagagtgttacatcatttaaccagtttcataagtacaacaatgcgtgatctaataagatgaatcatcattctcctatttcatctaaaagaactcgacatgatcagcaatttctctgcatactagttttgattccgcagccaaatttaggcttttagctatggcaagcttggttcgtttatgcgtagatgttggctcatactttttcacctcctcatcctctttccctaacaacaaagcctcccttgcaggaatcacactctcccaccagaactcccttaatacatcatgtatgattctccaatagcttcggtctctcatcacacggaaaaccgtgcttccatttcgtgtccagcagtataagttgacccattcccggtccattatctccatttgaccctgcagctgaggcatgtaatagtagggcacttttttccagggtaatacagtttcggttttccctttgttatatggacatttcacttctagaataccaaagcaatcgaggattccatccggtgaagcgccaagccagtgaaattcctcattggagtgaatagcaaatcccattgttccaacctcacaacccattattcttttgtacctttctatcgcagatgattccatttgtacaccccagttcatagcaaaccgtgcagactcctcaacaactcgtgcatctgaatcataaaccttttcatgccagagctcggcacgccggtttcctttccaaaaccccagcgctgtactgaatgtacttgtggttaacttgtctttccttaaagcaaaccattcttcagatttctgagggatatcagatggggagagaaggcttgacacaattactgatgaacggggatgagcaaatggtgaaatggtttgagtgatgagtgataaagcagtagaagaaaacctctttctcgaagaaactgaaccgcttgacttcggaagatgagtatggaacccagagattgagcaagtcctcatagctgaaagaatcatactgttgagagcaactttattcggcttcaagactctacatacacagactgttacaaaggttagaggaatcatattggaaacaaacataaactcaagtttaataaacccattccactacttcaaatctacaatcagagctactctaataaacactagaaccccagaactaccctggaatctttttcaaaacataagatgaaaaaaacaatctttgaacttcaaaaacatcaacaggattcagaaacaagacaacacaaaaaaaaaaaaaaaaaatccgatgaaatcaactaaacccatatacaggacaagaagcgaacttattatccatgttatgtgatttgcgtttcaattttgtctatacaaccaatgagttcaaaagcactggttcctccttaagaatcaatttacccacaaagcgaaaattaaaaaatctcaagcacacaaggtgttcgatgatattaccagaaccacgcttcaagtagagaactccaccattccgggccgaggaagcggaaatagaagaaatggattcagtggaagatacttgaactagcctcatcatcatcaaccaaaaatcacattcgaaaagaccagacaagtttctgtttctacaagatatttgttcttctttctaggccggttttaaaagatgaatccattcgttgtcgttttagtttttccatcaatgtggtcataaagttttaaggcccatgaagcccaatcacaatctcttatgggactttaatttcatttttattttcttaatatttgagtttaatttcattacaaaagactcatagtaatattttccaaatgagctctccggttcaaagatatacactccaattcaaagattgttacaacggtaaggaaagaaatatacaccggtgaaaagtgttatcacgaacgtggctagcaagtgtaagatcgcgatggtggaacaaacaaaacaatgaaacattcttacatttttaaggattttaacatattcttagatgaattaaaatgtcttactttgaaactcaaaaacattgagatataggttccggatggagaagtatggtacataataattatcaagaatatatagtacagttctaataacaacgagaatataatacatagttaacatttaaaatgatcaataatataaaaagatataaaacaaattaagatattaggagaaaaagaaatgagctgtaacaataaagggtctctatatcacttttatccacctttcctaactcctcttgaaaacaatgatattgatcacaaaacttaacaaagttttgaaaggaaaaataaacgtatatatcgttgttaatattttatttattatacttagctttttgttatgtattcaaaacttattttcattttactataagtaataataaatatagctaaatttgaaaggaaaatttctaaaatatttttaataaatattttgtagatgtgagagaactccatatatattaaattttaataaataaaagttttaaatttagatgcattgagtcttaatgggtttcaaatagttttttaatctctttttatactttcaagtaaaaagattattgaatcatgagcagaaaaggcccatataaaaagcccataagttattttaggaacatcttcacagaccttgattgaagtcaggtagtatataaacatcaatctgttgatttttaaagagtcaaaaatctgccagttttcttctctgttgtttcgtgccctgagaaaccttgaagcagccatg

SEQ ID NO: 24413 - DNA, 3003 bp, Unknown
  misc_feature (1)..( 3003): 2750-1469P.txt file - cDNA_ID_2176741; gDNA_ID_1971795; Annot_ID_175647
tattggccactgaacaaatggcgaaatgaaagtatatatgagacacatgaccagttgtgtttcgaaaatgaaattgtcaaaacaacattggattgatggaaacaaagggttcgaaaaataaagtggtcttcaagagaagaattcgtagtttttggctgagataataatggttctgaggccaccaatgggagctaggatcgtcaatataacaccaactactatgcaaaactgcaattacagaaccaaacaacttgttattgtcaaatatatagggtagaaataaaaacacatatttagtagaagaagatgatgagtaaaagaaaatatacccaattaatacaccaagacaatccatacttctttggtttcttgatacaaagccacatgatgcatggtagctaaacatagtacaatacaaaaggtagatcaagttgagttactagaattttcaaacaaatgaataggcttaattagtgtattgaattacttacatagtaagttgttggggcaaaggcgaatcctccgaaaaacccgagcaatccaccaaaaaatgggatgcatatggcaacgaacatcgtgaaagctgttccattgatccaatgttataaattcatatgttactatctaggagaattgatttaatatgaataagaacttaccaacatatagagtacgagtgatgaagcggagtttgaaggaaggagcgaacatcatcttctttaccaaaaaggtttcgagcatgtcaaagaccggcattgcgtatatttggtagcttccaatgacatggacaaccacgaatgcgttagcaatggcgataagccagatgggtttctccaacgtcatgagaatattgtcgtccacactgtttccaaagatatagtagcaaacaaatgcaacgggaaagtagcatatggcaacaacgatgtatgcaactactactcctttccacattgcaatctttgatggtttctcaggtgttgaaggaatagtagcttgtatctccaacacaacgttgtgacctgcatacgcaaatgccacatctcctagtgcattcaagaagttgaatacatttcctgaggttgtagatgctctagacgagtagtctacatttggatgaactcctttcttcaccgaggttgcccaagcgattgtcgagtagctgcatatattacaatcacattaataaatctcaaatagaccattttttaaaaaaagaacaacaggctatattgattttgagttgtacttacctcaaagacataacggcagcagcaagggagacgatagatatggagttaaaattagggagatgagcaagaacaaagtgtatggaagcgaagatcatgatccaatatgtagttcttatatttttgcaatcggtgcaaagaaggtcatgaatttttttcaatgacttccctcccgtaaccatgtacacaatatccacacctacttcaacgattagttgttgtggcaccacgatccatagtccgagcttctccccaaacgcgtgttggcctaattcgtggtacctgtcgaacctcttccctggaaccatctcgtgcatttgcaccatctgccatagtgtgtagaatgttatcagccatgacattatcattattgtcactccaggtcccctgccatcaaaattgagtgtaatattaatattgaacgtgtatatagagattttctaatgagatatttatatatgtagctagattggatatataccatccaagattagacatggcgtaaggtaagctgagtacaccagccccgaccatggcggtgacattgtgaaacgcagagtaccaccacttggcatttctagaggatgttatcggtaaccaatcgtctacattcttctgctttgtggacgcgtccttggttggagacgattgacttttctccatcttattttggctttgaagaacagaaaaaaatgtgggacacaattagatgatgagaaccaaaaggattcaagagcaaggcaatttctttcctgaggattgaaatgtgccttgtgacaatgattattgcaaagagttctcaatttatatatacaatttcatttcactatttttttttccttttatatttttagtgaatttcaaaaaaaggaatttattggttgttgctttatgacagattagtttcacgctctgtttcacaagatagccatgatcgttgttggaattgttgcggtgtatgatctctaattacttataccacatggcttttttgatatttttggctgatgattatggtataagtcattagtcaatgctcttttgcctaacgtgaaaagtgttttgcatgctattaatgaccaaaatagtcatttcttgattttattttgattcatctattgatctgtttctagtataactgactacccgttatatcaaaagttaatttaggggagaatatagttactgcaggtttacaacccacaccttcctcttttaatgagaaaaaaaaacaaatcttaaaccaaattacttttctttatttatatttttgtataatattttatcttattttaaattgattttaataaccttaagtgttattttaccattttacaaaatgtgagggtttaaaaacccacaaattgagtgtctttttcatgtttttagaaaaagtttggatcttttaacccatttttcccaactttccataatcatctaaagttttatgtataaatcttatcaaatcatttagaatttattttgtaatcatatataaatcacctagatatccttaaatcttaataaaatccctccaaatgtttagtttcaacacaccccttaatagttgactaatcacctaaaagacagatcatggtaaattagcagttttttttttgtaaagtagcttgcaatcattgtaaagtagttttaattttcatgttcaatataaaatcttcgataggaagacatctttgatctccgaaaaaaccctaagcagtaccctcaaacgcaagaaccttagctcttgataatg

SEQ ID NO: 24414 - DNA, 3003 bp, Unknown; identical to SEQ ID NO: 21567
  misc_feature (1)..( 3003): 2750-1469P.txt file - cDNA_ID_2176776; gDNA_ID_2926143; Annot_ID_197566

SEQ ID NO: 24415 - DNA, 3003 bp, Unknown; identical to SEQ ID NO: 21567
  misc_feature (1)..( 3003): 2750-1469P.txt file - cDNA_ID_2176776; gDNA_ID_1971781; Annot_ID_175411

SEQ ID NO: 24416 - DNA, 3003 bp, Unknown; identical to SEQ ID NO: 21567
  misc_feature (1)..( 3003): 2750-1469P.txt file - cDNA_ID_2176776; gDNA_ID_1971793; Annot_ID_175594

SEQ ID NO: 24417 - DNA, 3003 bp, Unknown
  misc_feature (1)..( 3003): 2750-1469P.txt file - cDNA_ID_2176796; gDNA_ID_2926143; Annot_ID_197574
attctccaaatcttaaagttaatatgatgagatataaaatacattatgattctagagtggaattaaaaatgagatggatgaacttgaagtttcatcatttcgaggaggagaagtaatgaatctcacatggataataagtgacatatccagaagattatgttcaatctttgactactaaagatctaaaagttgtataaagcaattcttatacgaatgtgttattagataaaataagttataattagttatttctgaaacttcaagacttgaagtctctttgtgaatataactcacattgttaagagaatatctatgatgcagagatggtaaaacagacgcttaaacttttacgcaagtattgttgtcctgtagacacaatattttgaaagaaattttgagaactattataaacttaaatcgagtgtttttcaaaggctaagaaaacatatgagttatcgatgataagtaatactcagattctgaagtgaatataagatcttacatagttagtcaaatttaatatcgtttatagtagaatataaaattttaattattatctcgttattgttttattaacatatgattgattattaaaatacatggaagtaattttgattataagatctcattaagggagtaactgataaacaatgaaaagtaaattagaagttttgaaagaactagaagtttcaaaagaattaaaagtttcaagagtatatttggcttaaccggattggtcatcctggtttaatgatgatgtgaaagtattgagaattatgtggccattaggtgaaaaaccagaagattctccctaatgatttatcaaatgttacttgctcagaaagcaatatgataatgtgatttttaccagtgtaagtaatttggactttatctattcgtaagtatatacaaggagatgattatgggttgatcacccactatatgacatttagatacctaatggttataaaagatgcatcgattcaatggacgcattgactcgattgttgcatcgacaagaaggtcatatttatccttgttataaactcgcaacatagagtttgcgagattactttcttgattaaagtacaagagtatttcagtgtttatttataataaccactattggatatccgttgggataagtgtttaacattttgaaattcatgttcatacacaaaatggtttagtaacatcgatacgcatcaagccaatgaataattaatagttttccccgttattattggttttgggtcagaaaccaaatagttttcatctaaaagctttgaatgtgaaaagtgctccaccacagcacgcagagatgaaccctcagaggaggataagaatacatgttggatatgaatgataactaagccatcctagaaggatttatataccgctcgttttgaagactatcatattatatagtcagctattccaacataagggggagaatgtatacagctggtgaaaaagataaatagaaatgaattatcaatgatcctcggagtaaagaatgtatattaagagtccaaaagataattcaattacagaatttagcgttgtaattgccagacgcatttgctgacccaaataaagtgatgaagtcacttataccagttgtaaattaaatgctccagaatataatgaatgttctgtaaggaccaatttcaaactgctattgagtcttaagatcgcatgaagcgtaatagaccttggttccaaatataaatatcctcgtaaaagtgaaggagcacaaaattaaaaatgaccaaaattgaggaaataaatattttgatgatctcttgaagagagtgaatgatctctaaaagagacataaacatgacaaatgaaacattcaagtacttgacaatgaagagatctagctagctatgtcatgtcaaaatataatggaatcaaaagcaaatcgacgtcgtaatatatttgcatgctatgagcagttgatattatagacaaaaaggaggatcatgaaagaaagtctattgaaaagtgtacacaaagtaatgattagccaaaaatggaaaagaagaaatagacatataattataatctctagtagagatatttggactagtagtctatgcacatgatgtgtaaaaccagtggaaacaaatgagtctttatgtgaaagaatagtgaaattaatgagattttcacaaagataagaaatgttatgaagagatatattctcttgtggtggatgtaatatttttttaagtatctaaagtctggcaataagagacggaacactggatatgacatttatatgaaattcttgaaagatataatctctgaaggattaattatatgagaattatgttctctagaactctactcgatcgaataaaaagaaatatgtaacatgacatataatcatataaatgtatatttacgttgagtttgtcaaaatatattgatcaaactaatatttgttttgaaaatcattaaaactcctacagagttatcataagtaatacgatgacaataatctatgataaaatatcactagataatgatatttataagtctatatgaaaaccatataattttgatcattaagattatggttattaattccaacgagatattgtatttgattgaaaatcatctcctgaagaagatgtttccgagggggagattgaatgatatgcgtggatgtaccctttttccttatcatagtttttatcccacatgatttttctatgacaaggtttttaacgagacattaaagaacacgcaaataatacacttgatgaatattaagaaattctatcaatcatccaaatgaatattatacactaatgatatttagagaaataaataagatggtcaagatgaatcatctaaaagattcatgagcagaagaatgacgttgtactttatccagaaatttgttcaagagaagatttggcagacttattctcaaatactgtttattctctgccacatcttctaatcatgcagagattttactaattcatg

SEQ ID NO: 24418 - DNA, 3003 bp, Unknown; identical to SEQ ID NO: 24417
  misc_feature (1)..( 3003): 2750-1469P.txt file - cDNA_ID_2176796; gDNA_ID_1971781; Annot_ID_175419

SEQ ID NO: 24419 - DNA, 3003 bp, Unknown; identical to SEQ ID NO: 24417
  misc_feature (1)..( 3003): 2750-1469P.txt file - cDNA_ID_2176796; gDNA_ID_1971793; Annot_ID_175603

SEQ ID NO: 24420 - DNA, 3000 bp, Unknown; identical to SEQ ID NO: 8465
  misc_feature (1)..( 3000): 2750-1469P.txt file - cDNA_ID_2176859; gDNA_ID_1971811; Annot_ID_58110

SEQ ID NO: 24421 - DNA, 3000 bp, Unknown; identical to SEQ ID NO: 8465
  misc_feature (1)..( 3000): 2750-1469P.txt file - cDNA_ID_2176859; gDNA_ID_1971811; Annot_ID_175753

SEQ ID NO: 24422 - DNA, 3000 bp, Unknown; identical to SEQ ID NO: 8465
  misc_feature (1)..( 3000): 2750-1469P.txt file - cDNA_ID_2176859; gDNA_ID_2926175; Annot_ID_140283

SEQ ID NO: 24423 - DNA, 3000 bp, Unknown; identical to SEQ ID NO: 8465
  misc_feature (1)..( 3000): 2750-1469P.txt file - cDNA_ID_2176859; gDNA_ID_2926175; Annot_ID_199778

SEQ ID NO: 24424 - DNA, 3000 bp, Unknown; identical to SEQ ID NO: 8463
  misc_feature (1)..( 3000): 2750-1469P.txt file - cDNA_ID_2176867; gDNA_ID_1971811; Annot_ID_175758

SEQ ID NO: 24425 - DNA, 3000 bp, Unknown; identical to SEQ ID NO: 8463
  misc_feature (1)..( 3000): 2750-1469P.txt file - cDNA_ID_2176867; gDNA_ID_2926175; Annot_ID_199783

SEQ ID NO: 24426 - DNA, 3003 bp, Unknown; identical to SEQ ID NO: 18829
  misc_feature (1)..( 3003): 2750-1469P.txt file - cDNA_ID_2176910; gDNA_ID_1971812; Annot_ID_175780

SEQ ID NO: 24427 - DNA, 3003 bp, Unknown; identical to SEQ ID NO: 18829
  misc_feature (1)..( 3003): 2750-1469P.txt file - cDNA_ID_2176910; gDNA_ID_2926171; Annot_ID_199524

SEQ ID NO: 24428 - DNA, 3003 bp, Unknown
  misc_feature (1)..( 3003): 2750-1469P.txt file - cDNA_ID_2176921; gDNA_ID_1971812; Annot_ID_175784
gcttcaaaatcactccggtactcatttttcttaccatcttttgtttgtattcaaatatcaaatgtttttttttgttgctaaaataattgaataatgcatcgacctaaacgaatagataaagaatcactagactaacacacacctgtggttcttgtcattggatctcatgtgagtgttactatacttttctatcaaaggcttaccctaaattgtgaatcctgtaaaaccacatgaaattttatgtctatcacaaaagaatacatacaccaagattcaagaatatgaaaacacacatataatatagacatttttaagagggtcccaaaaacaggctcttgatctggaaactgtattaatttgtatccaattataacctcatgggccacttttccctggctatgcacattatcataggttatacgattaagttcgtgatggaaaatatgatttattaaagttttcttcccgagtttgcaacgattttcctttcttcaaaatctaaaatttattcgattaacaaaaaaaacaattatcgacaagcaattcaaaggaaaaattgtgaaaaaacaaaagaataaggagagaatatgtcctccttctgtttttttttactaagagagaatatatctttaataggggatgcttcttgctcgaagccatcattgagaagaccttcatacttgcgggagtctatgatagatatctcaagagttaactttagatacttttatgcgatttcattttatttttaatgacttactataataattattattttttcatctaaataattcaattcacgaaatcatcttaattattatttatataaatacatggacaaatagaagtggaagaacaatgtttagaaaacaaatcgaaaaagatcgccgacctttattgatcgaggaagagaattctggtgggattttagagggaggtaagagcataggtgctagagagtgttcggagctcggaaaatgattaaaattggttttgattacacttaattagtttaatcttctagtaacacacaaatatgctaaaataaacacataatacattcatgcaaacacaaaacttggcttaatattggccaataatttgagtggcacaatcacaatcaagccaaaagcagcactgatttctctttttttttttctttctaattagtcttaattcggtccaaaaccaaacaaaaatatctttaaattatattggaacctgacgaaaacaaatcttaaattcccacaaaatgctatatatatagtatctaagtttgaatgccaattccatatttttacggaatttataaaagtacgcagaatctatttctagcagtttggaaaattttcaaaatatttgaaaattttcaaatggtttgtggtctgttgatctactaatcacgtcatactaattttgggatggaatgttacagaatatataatttcaaaacagagagagtattcttttgttttctgtgaactgattttattctaggtaatataatgtatccattttttttaatgacgaggaagaaaaattaaggaacaaaagaatatgcattaaatttgattaggtagtgtcatttaagtgatcccttctccaacacaaaatgtatgattcgacgtcaaattaatgttttaaatatttattgcttttattgatcatatataatttaatatttataatcattattacgtgggaacttatctagtacacattctatgtctttgtgaacttagtacacgagtaacggtttttctattaaattaaaaccttcaaaacaacatttgatgaaaatttcatagattttacaccaaaatttcgtaagaaaaattgttggagttcgtattgttttcttgtagtagatgacattaaaaaaatacattaagatacactaaacaagaattatgcatattgttttttggtcaaaatcgagcctttaccaaattgatcgatacattttttctgatgatacgtttagactagttggataaaatattaatctgtcctcaaaaccaatttgcagtggatcaatccatatatcttctatattattaggatctttgtctaacttccgatgtgtgatattgttattcctaagataaaacaccattgaaaaacagtattttaaatcgggtaaataattcagcgagtcacatatttttgttttaataaaaactcaaatcaaaagtgatcaaaatatggtagaaagcaaccttcgattgtggtccatcatgtaagatacgagaagattttatggtttttaaaacccacttcgaccatgaaagcttgacccaaagcaattgagttgtttcttttataaatgacctaatcaatttccatacatacaagcatacatgtgacgtaaaggaaatctaattatgtactaatttgtaaattttactagtattcaattcagtaattcttactaaacttactttaactcttgctaattaaatatactactagagaaggtaaattacatgcagttaagctatactattttttctaattgcaagaaagaaagaaaaagtacaaaagaaaagaaagcacattgcaagtggatgtatatatagttatagggaaataaatatgaatatggactgtatatacatataggtttctcttatctctatcaaattaccttaaatgggttcataaagatggagatcaaagactacacatcacatgctactctccctcttcttttggcataaccttactccatttatacattgtgctcctcaattattcaacattttttaaaaataacttatttaacaaaatgttagaaaatatctacccaatttttttcttccacatacgagctacaaagatctttatcaaataaaacaagaaagattattaatccatattttgggttaaattttaatccatttagccaattaggagaactattttaacagttagatacttttcaacaaaatttattaagtagtcacctatgtatattcatatagtagtttcacaaacaatatg

SEQ ID NO: 24429 - DNA, 3000 bp, Unknown; identical to SEQ ID NO: 8488
  misc_feature (1)..( 3000): 2750-1469P.txt file - cDNA_ID_2176923; gDNA_ID_1971812; Annot_ID_175786

SEQ ID NO: 24430 - DNA, 3000 bp, Unknown; identical to SEQ ID NO: 8488
  misc_feature (1)..( 3000): 2750-1469P.txt file - cDNA_ID_2176923; gDNA_ID_2926171; Annot_ID_199530

SEQ ID NO: 24431 - DNA, 3003 bp, Unknown; identical to SEQ ID NO: 18815
  misc_feature (1)..( 3003): 2750-1469P.txt file - cDNA_ID_2176935; gDNA_ID_1971812; Annot_ID_175794

SEQ ID NO: 24432 - DNA, 3003 bp, Unknown; identical to SEQ ID NO: 18815
  misc_feature (1)..( 3003): 2750-1469P.txt file - cDNA_ID_2176935; gDNA_ID_2926171; Annot_ID_199538

SEQ ID NO: 24433 - DNA, 47 bp, Unknown
  misc_feature (1)..( 47): 2750-1469P.txt file - cDNA_ID_2176935; gDNA_ID_2926173; Annot_ID_199626
gctctttgaaaattagcaaaaatgatactagtaatggattaactatg

SEQ ID NO: 24434 - DNA, 3000 bp, Unknown; identical to SEQ ID NO: 8485
  misc_feature (1)..( 3000): 2750-1469P.txt file - cDNA_ID_2176945; gDNA_ID_1971812; Annot_ID_175797

SEQ ID NO: 24435 - DNA, 3000 bp, Unknown; identical to SEQ ID NO: 4466
  misc_feature (1)..( 3000): 2750-1469P.txt file - cDNA_ID_2176945; gDNA_ID_1620707; Annot_ID_165322

SEQ ID NO: 24436 - DNA, 3000 bp, Unknown; identical to SEQ ID NO: 8485
  misc_feature (1)..( 3000): 2750-1469P.txt file - cDNA_ID_2176945; gDNA_ID_2926173; Annot_ID_199629

SEQ ID NO: 24437 - DNA, 3000 bp, Unknown; identical to SEQ ID NO: 8529
  misc_feature (1)..( 3000): 2750-1469P.txt file - cDNA_ID_2177047; gDNA_ID_1971815; Annot_ID_175952

SEQ ID NO: 24438 - DNA, 3000 bp, Unknown; identical to SEQ ID NO: 8529
  misc_feature (1)..( 3000): 2750-1469P.txt file - cDNA_ID_2177047; gDNA_ID_2926169; Annot_ID_199381

SEQ ID NO: 24439 - DNA, 3000 bp, Unknown; identical to SEQ ID NO: 8528
  misc_feature (1)..( 3000): 2750-1469P.txt file - cDNA_ID_2177058; gDNA_ID_1971815; Annot_ID_175955

SEQ ID NO: 24440 - DNA, 3000 bp, Unknown; identical to SEQ ID NO: 8528
  misc_feature (1)..( 3000): 2750-1469P.txt file - cDNA_ID_2177058; gDNA_ID_2926169; Annot_ID_199382

SEQ ID NO: 24441 - DNA, 3003 bp, Unknown
  misc_feature (1)..( 3003): 2750-1469P.txt file - cDNA_ID_2177074; gDNA_ID_1971813; Annot_ID_175820
taccagtacgacgtcattttcaaaaatcgtatccatagtcatggtttttgttttcatacgatctatatcattacatttacaacgatgatctctatcaaaaatgtaattttttttctttcccgtcgttaacttactattataaagtttgacaacattttagatcccaaaaattagctttatgtaatggtattgaaaaaatatcatcgtataaagtctgtcgaaaaaagcggttttgtatctggtttaatggtgttggtagatttgacaatgaattcggcattgatggatttgacgtttgaagtcgtatgaaatatgtcactgaaatagcgatgcacttggttgaagaatttggctttaatggatttggcgatgaatttggtgttggtggatttgccgtttgaagtcgtctgaagtatgaacaatgaacactttctttttcccaaatgattatcagatttttttattaaatttcaatttaaggttctttgtcgttacacttaaattgatgatttctatcaaaaatgcaaattcttttttaatttcaattttgttctgttttttgtttttatacgattaattcaataggggaatcaaatacacttggttgcaaaacatttcaagttttcaaagaacaatcatagtatttttttgcccaccaatcatagttatatatatatatatctcaaatttagttggaacataagtaagtaataagtaagtagataagcaagtagataactacaaaacctcaaaagcgtctgatcaatgataatcattttgacaatatttggtggaatcaattagcacttctaaacttttgatccaactattttcgttagtttcatcatctagtgatcatacggaatccaccactataatttttttctttcttataactgaaaaattaatgtgtcaaaactgtaaaattagatacaaaacatgtatcctggaacagtggtactatacgagtcagtagatgtgcaccacttaactagtatcatgaatctaagataatatcggctgatatctaagtgaaaacttaccctaaaaagagaaacagttcacatgaaaagcatcgaataacgacaataagaaatagatacttaacagagctagaaaacacaatacttatatataatttaaaataaaaagaattatatatacgtaaaaacagtataaagaaagaaagacacaagaaaagtagtctgttttggatctttaaccaaacggaacctctgtctgtgtccccgcattgtccttttgtcgattataaaaatcggtcacgccttttcacttccatactcctcattttccatctctatactctaccactttttctagattctctttttcttttcaaaaacaaacaatttaatttccgataaaatagtaaaacatatttttactgatctatattgttcagaatgcattttttgcgatctatccgatatatttaatttgtagaaaaaataattagtgaaaacgtcgaattggtgagtaggaacaagtggcttcttgacaactaacttagtggtatcgaggattgcgaccaggagacaataaacaggggtaaaacaaactttgaaagacgaatagagtttgtgctcgttgtatgattttagacaaccggttgcatactattttggtggctatgtgatatgacgttgatagtcttataggaatcagacaattcatgtgactttaatttgctctatctaccgagaaagcacgactaaaatgaaaaaaaaaaaaaatgtagtatgttgtaagataaaaatatatgtaaataagttggtttttcaacaaaaacgcatacattaaccaaaaaccatgcatttgtcttctcttttattgcgagaaagaaattgttaatatatgcttagatcttgtttgctattgcataaattgaaacttaacaacaagtcaacaacactgtatctcttaaatatttgcatttcatcgacgaaaggagcaaacctgttgagagtacgggtaagtatgagaacatcaccatgaaagtaaataagtaattaagtaaagttgagaaattcatacaaacaatgaagcaactcaagcaagtcaggtcatacataagttatcaaactcttttaaattcgtagaaatttgttttaagcattaaaaaaaaaaagatattaaaaaatcaaatatcctatatctatagtgtaacaaaagaaacactgtatattaacacaaattagatttaattgttttgcttgaagaagaaagtgagggaaaatgaataaataaaaaaggttttaaaaaaaagagaaaagattcttctccctgtcctcgcttcttaaatggcaagaaaggagactctgatgggaagttcataactgaaaaataaaaataagacagaaaacaaagttaaaaataaaataaaaacggaagagagaaaataaataaataaaatcactcaaaggatttccacagtttttctttccatgttgatttagcccattcgtagacttcctccgcgccgccgttagacgccgcctcggaagtatcagcaaccgccgtggtgttcgtcgccttcaaaggctcgtttctctcctctctctggtatttttttttttatttctgggtttacttgtgaagattcggttatacttcggagatcattgttataattcacttgttctgatttagtcctacttgtcaaatttctggattgtcgaaattggcaattcattgtctcagatcgtatgattattggatctgattttgaattttagagttagagagttcatgttggagttttgggattaaaatcgtttctatattcttctggatctaaagcatttttagatcgtggaattgtgaaacagctaatagttttttttttttttttttgcgttttgatgattttcaattgcgattgcataggtttgatcataagatctacacttgattctactcactttatttgttgtttcctctaatttgaaaaattgaaatctgcagagatctgaatttgagatg

SEQ ID NO: 24442 - DNA, 3003 bp, Unknown; identical to SEQ ID NO: 24441
  misc_feature (1)..( 3003): 2750-1469P.txt file - cDNA_ID_2177074; gDNA_ID_2926218; Annot_ID_203125

SEQ ID NO: 24443 - DNA, 3003 bp, Unknown
  misc_feature (1)..( 3003): 2750-1469P.txt file - cDNA_ID_2177130; gDNA_ID_1971813; Annot_ID_175848
catatatatataaacaaaacatcattgttgttggaattaccctagcatgctgaagaagaacacacataacaaacatatctggtttttggaacacaaggtttaaccattacaatttgaaagtgtctgaatcgttgaagcttttcaactgttttcctctgcaaaatcaattcattcacataagaacaaatttctgtttgtatctcataggaggaagcaagaacaaagaaagacagtgatctagaaacataccatttattgctcccatgttgtggtcttctttgtagacccccaaaggagagccatgcacagagagcatcatctctccagcttttggtagcctcagagtctttggagtcattccaaaagaaagtctttgcccattaacctgcaaaatataaaagtttcattgtagagtctctccttgtatgcccaaaatctatcattgaaatgctcattctgcaacagagaatgtaattgataaatgtcgaaaccataaactcaatttcttctctctagatcaatgtacaaacaaaatctcgaaggagaaaacatgctaaagaatcaaacaaagaattctagagtaggtacgagataatttgcatcaagacagaaatagggaatataatcataaatacataccccaggagtctgaaaagcatcatggcctggaagcatttggttctcagatgtcccctgaaagacctaataaccattggaaaatagcaaattagcgttttctacttactgtcctgaagtagttttgcatacttttggaaggccgaagaaaaatacaaggttgacaaaattaaaattgataaaacctaaacatcactaaaagaaacaagtaaaggcactactcagtttggtgaaagcctgcaaaattgataaaagcagatgacaaattcactaaatgttctacaacagttgtatctaatcattcaagtctgttctaataggattaagggaaccaccagaaagaaaatggcaggaagacaagatataaacttacaagattatcgagctgtgggttatcagttcctaacaggttagctttcactgccaccaaagacaaaaataaaagtaaaattcaaagtcaaattcctaacaaaagaacctaagtgagctttacataccgttgtcaggtaaatcatagccaccaagagatgacctactgtataaatcggtaaaacgcatcgacaagcgtttcaaaatagaataattcatgtcaacgccattctcatttccagcaaacgaatcaccattttcgtctctccactttaactcaatctccccagtttcttcgtttctcgatatcgataaatccggaagattctctttaaagaagtctaacacaggagtgtgtagctgttcctcagtaaaatacgaacgaagcaaccgcaatgcagttaacatttgttcaatctcaacatcacggattgctctaatcgcagcaatttgtctttcgactacacaatgttacccaatacaccaaaaatcagatcatgataatcctaaatttctgagttgggtattggaataattgataccttcttcgtcgacgaagtcttctttcttctcttcgattcgaattcgtttctcgtcgttcctatcttcttcagtgagtttgacacactcctttgcttttcgcttcggcattatcgatttctttcgaagaattagatgctcaattcgaggaattgattgcaatttcaaatcacaatctgaaattcaaaaccctagaaacagtgaggaagatgaaaaacccccaaaatcaaaaggggttttgaaaataatattaaataaataaatgggcgggagttacgcttaaacgaaattaaagaaacgaaattacgaaaatatccataaagttgaatacggcccatgggctcaataatattatgatcaccaaataacatttctaaataaagcccgaattgtgatatttttttaaaaatagttatgtttctaataaattcgatgtatttaaaagttgtggtgacaaaagatcggaaaaagaaaaagaatgttctttctttcacggtgtccacaaggctgacaagcatgattaagacgaccactaaagttttcttgacaccaacattgtacttactttagatgctcttcacgagtttgcttcaaatgtaataaaaaaacttcttttagttacatgaatcgagatcttattactgaactaattatgggagaatattccccatttttctaatattaatggcgaggtatcaatctacatctatagccaatttagccacgtgtgtgggccaacttttatccgttgaataagtgcttcaacgtataattaaagacttttgaaactcttatatggacatataattaaatgacttggcctcaacgtatacatcatagttttatatctcatctctaccttccatagaaactcatttgaaacttttgggcagagagtctgaacaatcgctttgttgtcgtcaagaacgatacgtccctataaatgtaagttattttgtttctctaaattcagaaatatcccacctaaaaattcgactgtttggtatttttagtaacaagcttcatgaataatattggagattttcttggataaattattgattttcatctaagttattccaagtttatgaatttcccactcatcatatttagaagaactttgattttttttcttgggtggcttttgggtcaaaacaaaagaatgataaagtctcattattattttgagcttttgttcatgtactgtgtggtcaaagacagtaacataaagtctttgttggctttgagttttagcgtatacgcgtaagactggttttaacattttcaatagttgactaatctctattttcaattttgttttcgggaaagttcgaggattcttcaaaatttattgtttatatgaatctgtttctgtttaaacgttgaacatcattttctttttgtgtttatcctctgtgattaatctctttgtttgtttctctatcaatagtagcaatg

SEQ ID NO: 24444 - DNA, 3003 bp, Unknown
  misc_feature (1)..( 3003): 2750-1469P.txt file - cDNA_ID_2177130; gDNA_ID_2926218; Annot_ID_203152
tcatatatatataaacaaaacatcattgttgttggaattaccctagcatgctgaagaagaacacacataacaaacatatctggtttttggaacacaaggtttaaccattacaatttgaaagtgtctgaatcgttgaagcttttcaactgttttcctctgcaaaatcaattcattcacataagaacaaatttctgtttgtatctcataggaggaagcaagaacaaagaaagacagtgatctagaaacataccatttattgctcccatgttgtggtcttctttgtagacccccaaaggagagccatgcacagagagcatcatctctccagcttttggtagcctcagagtctttggagtcattccaaaagaaagtctttgcccattaacctgcaaaatataaaagtttcattgtagagtctctccttgtatgcccaaaatctatcattgaaatgctcattctgcaacagagaatgtaattgataaatgtcgaaaccataaactcaatttcttctctctagatcaatgtacaaacaaaatctcgaaggagaaaacatgctaaagaatcaaacaaagaattctagagtaggtacgagataatttgcatcaagacagaaatagggaatataatcataaatacataccccaggagtctgaaaagcatcatggcctggaagcatttggttctcagatgtcccctgaaagacctaataaccattggaaaatagcaaattagcgttttctacttactgtcctgaagtagttttgcatacttttggaaggccgaagaaaaatacaaggttgacaaaattaaaattgataaaacctaaacatcactaaaagaaacaagtaaaggcactactcagtttggtgaaagcctgcaaaattgataaaagcagatgacaaattcactaaatgttctacaacagttgtatctaatcattcaagtctgttctaataggattaagggaaccaccagaaagaaaatggcaggaagacaagatataaacttacaagattatcgagctgtgggttatcagttcctaacaggttagctttcactgccaccaaagacaaaaataaaagtaaaattcaaagtcaaattcctaacaaaagaacctaagtgagctttacataccgttgtcaggtaaatcatagccaccaagagatgacctactgtataaatcggtaaaacgcatcgacaagcgtttcaaaatagaataattcatgtcaacgccattctcatttccagcaaacgaatcaccattttcgtctctccactttaactcaatctccccagtttcttcgtttctcgatatcgataaatccggaagattctctttaaagaagtctaacacaggagtgtgtagctgttcctcagtaaaatacgaacgaagcaaccgcaatgcagttacatttgttcaatctcaacatcacggattgctctaatcgcagcaatttgtctttcgactacacaatgttacccaatacaccaaaaatcagatcatgataatcctaaatttctgagttgggtattggaataattgataccttcttcgtcgacgaagtcttctttcttctcttcgattcgaattcgtttctcgtcgttcctatcttcttcagtgagtttgacacactcctttgcttttcgcttcggcattatcgatttctttcgaagaattagatgctcaattcgaggaattgattgcaatttcaaatcacaatctgaaattcaaaaccctagaaacagtgaggaagatgaaaaacccccaaaatcaaaaggggttttgaaaataatattaaataaataaatgggcgggagttacgcttaaacgaaattaaagaaacgaaattacgaaaatatccataaagttgaatacggcccatgggctcaataatattatgatcaccaaataacatttctaaataaagcccgaattgtgatatttttttaaaaatagttatgtttctaataaattcgatgtatttaaaagttgtggtgacaaaagatcggaaaaagaaaaagaatgttctttctttcacggtgtccacaaggctgacaagcatgattaagacgaccactaaagttttcttgacaccaacattgtacttactttagatgctcttcacgagtttgcttcaaatgtaataaaaaaacttcttttagttacatgaatcgagatcttattactgaactaattatgggagaatattccccatttttctaatattaatggcgaggtatcaatctacatctatagccaatttagccacgtgtgtgggccaacttttatccgttgaataagtgcttcaacgtataattaaagacttttgaaactcttatatggacatataattaaatgacttggcctcaacgtatacatcatagttttatatctcatctctaccttccatagaaactcatttgaaacttttgggcagagagtctgaacaatcgctttgttgtcgtcaagaacgatacgtccctataaatgtaagttattttgtttctctaaattcagaaatatcccacctaaaaattcgactgtttggtatttttagtaacaagcttcatgaataatattggagattttcttggataaattattgattttcatctaagttattccaagtttatgaatttcccactcatcatatttagaagaactttgattttttttcttgggtggcttttgggtcaaaacaaaagaatgataaagtctcattattattttgagcttttgttcatgtactgtgtggtcaaagacagtaacataaagtctttgttggctttgagttttagcgtatacgcgtaagactggttttaacattttcaatagttgactaatctctattttcaattttgttttcgggaaagttcgaggattcttcaaaatttattgtttatatgaatctgtttctgtttaaacgttgaacatcattttctttttgtgtttatcctctgtgattaatctctttgtttgtttctctatcaatagtagcaatg

SEQ ID NO: 24445 - DNA, 3003 bp, Unknown; identical to SEQ ID NO: 24444
  misc_feature (1)..( 3003): 2750-1469P.txt file - cDNA_ID_2177130; gDNA_ID_2926254; Annot_ID_204466

SEQ ID NO: 24446 - DNA, 3003 bp, Unknown
  misc_feature (1)..( 3003): 2750-1469P.txt file - cDNA_ID_2177138; gDNA_ID_1971813; Annot_ID_175850
caaagtattgttgcgtatcacggtgcggttgcgacagacgatggacggtgttctgcaatagggacgaatgttcttcgtcaaggaggaaacgcgattgatgcgtcggtggctgctgctctttgtttgggcgttgtcagtcccgcatctagcggtataggcggtggagcgtttacaatgattaagctagctaatggcacggaagttgcttatgattccagagaaaccgctcctctaagcgccactgaggtaagtaacacgttttacagtaataacgtctttctttttactcttcccaaaatgagcattttggataacgtacgtttttgagttatggacagtgtttttttaatcaaagatatttattggctgtttctcttgatgtaggatatgtatggtgataatcctgagcgaaagaagaaaggatccttgtcagtaggcgttcccggggaagtcgcgggtctatacacggcttggacacaacacgggaagttaccgtggaagcagttagtagaacctgctgagaaacttgcagctgaaggattcaagatttcaaaatatctctatatgcagatgaatgcgactagaagcgatatcttagcggacaaaggtctctctgagctatttgtttcaaatggagagctcaagaaaccaggggcgatttgccgtaacccgaaattggctgatacactaagccaaatcgctgaatacggtccaaaagcgttttacaatggcacggttgggtttaacctagtgagtgatatacaaaaagccggagggataataactttgaaagatttgcagaattacaacgttaaggttaaagaaccattatctacggagattcttggataccgattactcggcatgcctcctccttcatctggtggccctgcaatgatgcttgtaagtaaagtatttttgtgaaaatttcacatttcatcaaacctaggtttatcttttggagtttctcttgtgttgcagattttgaacattcttgctcaatatggtattccatcgggtgtttccggccccctcggtgttcatcgactagttgaggctctcaaacatgcattcgcagttagaatgaacctcggggatccagattttgtccctgaagttactaatgttgttgcagatatgttatctccaaagtttgcacaagacttgaagagcaagataaacgatgagaagacctttgatccaaaatattacggtggcaagtaggttttttcaatctttttccgcaaatcttttttcttcgattctggatatctcaatctttttctcctattcgtagatggggtcagatcaaggatcatgggacgagccatttatcgataatagattctgagagaaatgctgtttcaatgactagtacaatcaacggatactttggggcaataatgctgtctccgagcaccggaatcgttctaaacaacgaaatggacgatttctcgatcccgacgaaatccggaggtgacccagatgtgcccccaccagcaccggctaacttcatccgaccggggaaacgacctttgtcctctatgactcccaccattgtactcaaggcaagaaaaaagaaaaaaccctagctcttgtgctacaagtaactctgagtactttaggttctaaacgatggttacttctgtgttggtttacacaggacggtaaagtgaaagcagcattgggtgcgagtggaggaatgtacatcatcgccggtacaacacaagtttacttaaatcatttcttcctcaacatggatcctctctcttccgttgttgctccaagaatctaccaccaggtttttgctattttttgtccttgtacccaagatagaaactttcttgttctttgctaattttacttttgtaacctcatttgtagctgataccgaacaaagcttcgtatgagaattggacgacagtgtatagtgaccatttcgagattcctgaagagataagacttgtgttggagaagaaaggtcaagtcctaacgccgatcgccggagggacgatttctcagctcatagttgaacaatccgatggaaaatccggtggaattagtaagcttgtggcggttagtgatccaaggaaaggagggttcccttcaggatattgaaatttggatttgactttgttttcaattatatatcatcgaacttgtgatgtactagtatgaacctttatattcgatgaatataatatgaaagtaataaagtttgtttgcgataatgttgttgatccagagatttttctttaatcataaattcataatagttagtatggtgaatattggaattaaactactaaaccttttgctcttgcattagtgggggtcgtggtatgagtcgatgaccagtaaaagacaaaattaataaagatcttaatgtaaatgcgttggttgttatggacgacagctctattagcataattaattagcatgacttgatgatccttcgtcaagtgatagtcatgtacacgtctaagaccaaatgtgaaaattgtgataatcttgaaacctatatagtactatttcatattttatatacaatgttaattagctcggagttaggtccactaactaagtctaattactaaaataatacaatcttctaacttaacaactaatcatggtgcacatgcaaaattaaaattaaaaaaaaagatttggaggattaatactccaaagtccaaaccttggatactccgcctctagtcagtgacacgtcatataattagcagacgataatcggaagagatttgttacagtgtcactgtcggttgcttaatcagcaatctcattcaaatggaatcttaatacatgtaggaatctttttcctaagaatcatatttgacacgtcatcatttcttaaaaatcttttgatcctcctacttaagtagcactaatcaatccctcactaaactctagtcttaatcacactatatatatatagtactagtgtgatttgcccaacttgtcatcattatctctatctaataaatg

SEQ ID NO: 24447 - DNA, 3003 bp, Unknown; identical to SEQ ID NO: 24446
  misc_feature (1)..( 3003): 2750-1469P.txt file - cDNA_ID_2177138; gDNA_ID_2926218; Annot_ID_203154

SEQ ID NO: 24448 - DNA, 3003 bp, Unknown; identical to SEQ ID NO: 24446
  misc_feature (1)..( 3003): 2750-1469P.txt file - cDNA_ID_2177138; gDNA_ID_2926254; Annot_ID_204468

SEQ ID NO: 24449 - DNA, 3000 bp, Unknown; identical to SEQ ID NO: 8504
  misc_feature (1)..( 3000): 2750-1469P.txt file - cDNA_ID_2177149; gDNA_ID_1971813; Annot_ID_175856

SEQ ID NO: 24450 - DNA, 3000 bp, Unknown
  misc_feature (1)..( 3000): 2750-1469P.txt file - cDNA_ID_2177149; gDNA_ID_2926218; Annot_ID_203160
gaaaagtaagtaccatttatcaggaaaagtaaaagtaataccatcataagatttgtaaacgtaacatcctgcagtggtagagaaacaaaacaaagcattagccgaaccaaatatctacaatcaaagtgaattttgactatcaccaaaaggaataaatctaatataaactaaaccttagatacatgtatataatattgggatatagagtagacaatagtggatggtggtagtggaaccacttaatgcgatttcacgttccctgtttttctccctttcacacaaaaacaaaacaaaattattaaaaaatcatgtcacaccaaatgtcttatttaccatgataccctatctcataaactccttaaacaaacaatagctccctaaactcaagtatccattctcacctctaaatcaatttcttacgttttctctcgtcaaagtctttttttctttgtcacgagatggagtccggtaatagtagtagcatgcaatcttcaagcggcggtggcggaggaggagaagaagaatacgattcacgcgccgcagatcaatccatttccgccttcttcgaccaccacaacaaccacgtgtcatctatacccacgccgcaacaaaaccatcgcaacctcctccatttcgaccataacaacaacaactctctaataccaccaaactactttaacaacaacacgttcttacccgtaaaccaacaacccgacccgatttctcaactcgacctccgaacctcctccgccacgtcatcactccctcctactaacaatataggagtaatcaagaaaacaaagaaaagatctcgagcatcaagaagagcaccaacgacggttctaacgacggatacttccaacttccgagcgatggttcaagagtttaccggaatcccagctccaccgctattcaacaacaactccatcgtgaacaccacgcgcctcaacactttcctcggcttgtcttcttcttcgccaaacacttacaacaccaacaatctcttgttacgaccgtttgctcaaaaactcactccagcgactcctctcttatccggatcacaaattcagcaatatcaaaaccctaacaacggtttcgaggatatgaatctgcaagctcttcttcaagctcatatttcaaaccctagaagcaatgagcacgatcagtttggtcttggtatgatgcagactccatctactaatcctcctactacaacggcagcggctaacgggaacataaacaccggtgataatggaagctacggtggctccgatcatgaacataataatgacggtacttggttatcttcgtcttccgaccagagaacataaatatatttatgtatagtccaagtccgaaatcaaagctaatctcttgacatgattactcaacaaattaaacatagcacatatagcatgatgaagttactcgtttatatattctatatttcagtataaaccactttaaaacttttttcgtgtagggtttgttaattatttaatacttaattaatatgcttgttatttgttaatcttagttttttccataactatatgttggtaagtattagttagtagatggatctcaccatttgaatcagattttcttggtatattttcttataattatatagaacttttaaattttaatgacaacgatgacttgcgatatgaaattttaatttttcaacaatcaatatacagtacgtggttttgggatcactacggttaatatttctcctaattaatattggagtgaatggtggcgaaatttggggaatcttccacggccgccggattgtggaatatggttttgggaccatagtatataattattaattaattatagacttgtggtgatttgaaatttgataaattactgttctcccatgtgcttattcatttttggtgtatcatctacattaacgtcaatttttattgacttgactctcattttaccataccaacagatttgaaatttgaaaatttcccaagcaaaagaaaaacaggtaatcaataatgataattatacatacattttggttttgacctacttttgtcatatgacaatttatctttatagacacttttacttctattattataagtctctttgtttgtgaataggggcaaatttcatttgaccgcctccgacaaccattgaccttgtcacggctctgaatgtgatgcgtctacaaaattcctaacttttttcagtcttctcattaaccaatcaatcgttagaatattcagcttaatttatatctctttctagtctctagcttaacaacacttcagaatgaaatgtcagttctttgtaagcggggttttcaataatatcatttgctactgtatagtataatagtaactcttaaaaataataattcttgtttttcacaataagatttgatgatggattgatggtcgcaaaacaaataatgacatttgatgaaaaatcttttgcttgttcttgtgtatacaaaagttcaaatgattttgatatttttttgtccacggaccagttacacttaagtcaccaatgcactgtataacctatacacatcacttacataaactatcaacaatgtgcatatatgtgtatctctatctaaatggaatatataataatgggtgatgatgatggtttaatattatggtggtggttatggtggaccatgatatcaagctattgtcgcactgatgggttttctatgtattcagatgatactcggtttcatagttgagtgataactaggtctggccattatcttactatccaaataattcgattcgggttctcaattttgtgggccgattggctccaaaagtttcattattatttttgttctgttgaaaatagaaatccaaaaaaatacgggtgggtcccataatcatatccattgtaccgttgcacactcaaaagacaaaagattcagaccaaaggctctggcttcacgcagataaggaagcagagatcgaaacgaagactcaaagaagaatg

SEQ ID NO: 24451 - DNA, 3000 bp, Unknown; identical to SEQ ID NO: 24450
  misc_feature (1)..( 3000): 2750-1469P.txt file - cDNA_ID_2177149; gDNA_ID_2926254; Annot_ID_204474

SEQ ID NO: 24452 - DNA, 3003 bp, Unknown
  misc_feature (1)..( 3003): 2750-1469P.txt file - cDNA_ID_2177189; gDNA_ID_1971816; Annot_ID_175977
gcatggttgagttaagtatagagatctttctgttggaaattttcatttctgattcattttgcatccttagatgagcaatggaagggtacctctcccaactaaccggccaaatggaacagcttgtcccccctctacatcaactgtgagttatcaaattatgaatttgtaatagttctgtatattcttatggaactggtacttactctgttcatcgatttttcattttaccaacagtcaacaccaccctctcagacccaaaccgttgttgtagaaaaccccatgtccgttgatgaaagcggaaagttggtgagtatttctatcacctgtgttcttcttcttatttaccacattagaggaagatatgacaaagtgactgaaacacacaaattgcaggtgagcaatgttgttgttggagtgacaactgacaaaaagtaatcaagaatgagtgagatcttaaagatcaaatccaaattcttcctctattcctgcgtttggtttgtgcatattacatacgcggaaaaactgtatgttatatatctcttgactcctttttaacccaagagaaaaagcttatcagaatctcttgttactgcattattggggtttattcaaagttgaagacacaaggtttttgctcgaataatttggcattcttttgctccatggaacttgaccttctcttctgtttgttgacttctaaaactccatcggcccttgtggcattgttaatgtatgtatgaatataatctgatacaccaaccaatcattaagatttgggtttgaaatctgtctcttccgtggatgagatatgctacatgtcacaagaactggtcttagctttggtagataagacttgtcttagagcaagtcttgaaatctggaaatctattttgcagtaatcttgtcacaacaaccataacctaatcagtcagtaccctccaagaacattaaagttagatgatccgacaaaacctctcaacaagaccaaactctttccatataaatactctttaacactgacacaaagtttcatcactttctcttgatcactcactgcatcaacaatggccagagagaagattgtggtggctggtggtaccacaaagagctggaaactactcttggggctgagaatatttgcattcatggctactttagctgcagccattgtaatgtcactaaacaaagagacaaagaccttggttgtggccaccattggtactgttcctattaaagccactttaaccgctaagtttcagcacacaccggcttttgtgtaagcgagtaaaaccctatacgaaatcgattcgatacatattgaaagcaaaatgtttttgagttattaacattgattcttggttttacaggttctttgttatagctaatgtaatggtgagcttccacaacttgttgatgattgtggttcagattttcagccggaaactggagtacaaaggtcttcgtctcctctctatcgccattcttgacatggtataaacattggttttcaaatcaatttactggtttgatttcaattgaattagtttgaacgtttggaaaaaaagctaaacggtttcttgataatctaaaaaaacgttggaaaaaaagctaaacgcaacactagtatctgcggctgcaaacgcggcggtgttcgtggcagagctagggaagaacggaaacaagcacgccaagtggaacaaagtctgcgacaggttcaccacttactgtgatcacggcgcaggagcaatcatcgcagcattcgccggagtcattctaatgctcctcgtgtccgccgtctctatttcccgcctcttaatcaattctaaaaacttctccaccaccgccaccacaacctccgtcgtctaaaacatcgtggccaaaaattcagcaacatgtgtgtgaccattttatagatgttgtggcttactttgtgtgtttgtctctcaagtcactagcaaattgtgtaatgcactcctttgttctatcactttcacatttgtattcaagttttcatttctctcttatctttttatataattctaaaatgacaaaaaaaaattcacaaagtatatagtacattgaaacaatgagaaaaatctacaatagatgattagataagaccaattcaagataatttataccttttatttctcaactacttcttctatttatggaaatataattctaatcaattgttagttttttacattaaaatgaattatatcaaccgactaaaaaacaaatcagtattagttctatcgcattgtagttcccatacaacttaatttttgtgttgtaaataatgatcctactgtctctaataaatgtgaatcaataatcataactattgaaatccttttctttttggttagtaaaaatgaagtgtaaatagtataactgtttaatttagttcagatatacaaatcaacaaaactacttaatttgaagattaattcagtttttttttttttttaattttctgtttataaaactactgaattttatttggtataaatggattgaagattttattacaaaacaaaatcacatttggcggcttcttctttttatgttctaaacccttttcttagatcggactccaagaaatctacttgctttaatcgttaacctaataaattcttctctaagttttttttttcttaactcatcaaagaaggaaagaaaaaaaaaaacctctttcacagatatttaaccaaaaggttttagatttatactatacgttacaaataaaattcgagagtcaaattcaatcttgggaaaagcttttgttccgaatcttggccccttcacgaaggtacacttatcatctcactctctatttccagacacaaatctatatgcgttctgggtttttttagggtttcgaaaacggcactgcatttcatcaagtaagggtttgttttttatttaacagatctttgttcttccttaggtcacgggttaaaagtatcgatctttgtgaacttaatctcactgtaaatg

SEQ ID NO: 24453 - DNA, 3000 bp, Unknown; identical to SEQ ID NO: 19836
  misc_feature (1)..( 3000): 2750-1469P.txt file - cDNA_ID_2177193; gDNA_ID_2926176; Annot_ID_199838

SEQ ID NO: 24454 - DNA, 1089 bp, Unknown; identical to SEQ ID NO: 8558
  misc_feature (1)..( 1089): 2750-1469P.txt file - cDNA_ID_2177299; gDNA_ID_1971817; Annot_ID_58271

SEQ ID NO: 24455 - DNA, 3000 bp, Unknown
  misc_feature (1)..( 3000): 2750-1469P.txt file - cDNA_ID_2177299; gDNA_ID_2926143; Annot_ID_197558
atgtaaaacattttatcaacaagaagccattagtcttccatcatcattttataataacatgttactttcactacacgttaaaattcaaaacctaacaaagtttttgtggcacaaactcaaaaaccaataaaacaatgattccaaggttaattcccagatggtcttccttgtgcaccattagaatcttgaggattattgttaccagtgcctcccattgatcctccaaacatctgcatcattgatcgtaatgcacccgataaatcttccggcatttgctctgtgcctccgagatctatgttgatatttccgcctacatgtatctcaggctcatctgcaccatttctggtaccatctccacctgctcctccctcgttattgcgagaatgatttcccgggaatgtgtttcccgccatgttcatgaacatgctcatcaaatcagggtttacaggcattgagaactgagatggtattccctggcctcctcccatttctggctcttgagtgtaaaacgtgctcgtgttctgctgttcacaacaccacaaaacattagttcctttcgtctctcgacttatttacgctacatgagatgactggtcagacatttcaatacctggctacgtctctgtcgttgttgttcttctctaattttctgttcagccacctgtgatacacaccatgtcaatatcagactctcatgtaagttacagaacgatcctttaaataggagaaatgtataaaaaaataccaaccctgatattttctttcacagattcgttatgcggatccaacagcaaagctgccatgagtgtgatgaaaaaggttaggcagaataaatgctagctaacttgaagaagcaaagttctagctctattcttaagcaatcaatcctcataaaggaatatggtaatttctgactaattctaagaagatatacatacctttcttgaaacctttctcgatagcctcggcatattttccttgagcataatatgctaacccaagacgactatacgccttactataatttggatcaatctcaatggatttaagacagtccttgattgcttctgagcacatgttgatctgtgtatatgcagcagccctgataacaagtgaaaaaataactaagcgcatcaaattcatattatgcaggaagaccaccaaagagctacaaactcagtttcgatattaatcaaattacagacttatcactcacctgttgcagtagaaaacagcgttcttatccgtcagtgcaattgcaaaagaataaagctcgactgcctcaagataaagattggactgcatagctttgttacctaaaaggcagagaatgtcacatagaggttacaagcacccaaaaaacaaaccttcatcgatctcattctaacataggcttgtaacaactaaagaacaaggaagaagttccaacgatttcgaagaaagggactacaagcaatcacaagtaccttgacacttgagtgtttccgccaagctattcacatcaaacgtctgacatccagacttttccatttcctgatacacaaacacaaaacttataaccaaactcataaccaacagaagaagtaaaaccgtcaaagaaaatcaaacctacattgacacaatcatgaaatatccttgtagctttctccagctgagcaggatcatcatctccatcaggtgtattcctaaaataccgtactttctcaagcgcaccaaagagttgaccaaacagttcatctctagaagtccctaaaaccagcacaatcccacaataataagttccattactctatccaccactcacattggtccaataaacacgaaacaaaccattacttaccagtaaaactaggctctttacacgtatccacggagacatgagaaccggaggaactaggatcctgagtagtagcagcaacaggtggtggtggtggtggtggtatggtttcattgttgtccaatgaagtaaacaaattaacaagtgaaataggtttaaagctatcatcatcatcatctcttgaagaatctgaattaagtttaaaagcttctcttaaacattctctagcaacctcaagaccttcttcgtcaacacctggagcaacctcaactacaataacaacaacaaaatacatagaagaagatttaaaaaccctaaatatctctaaatcaaaacagaaatgaaaatcgagaaacgtgattggtggtgattaccggaatcaagaaaatttaagaaagaacggacgattttccggcagagaggagagtctgttgttagtttcgccattggaggaagagagaaagagagaaggagaagaatctggtttcttcttctctgcgatgaaagtgttcgttgaaggaggcaattgaaaagtctgtctggatacaaggttattatagttctggttgggtatagagttatattaagctgattaacaaacaaataaactatataattttacgtccttgtcctcatctggttccgctaattttagcctgttggacgtcctcgcgtcccagactgaagaagtgatgagtagggctgggaaaaaaacccgaaaccaacaacccgaatcgaaattggcccgaaaagttggatctaaaaccgaatctgaattcgaagatttattctattaggtcttaaattcttctatccgaaaaatcaaacccgaacccaaaactaaaaatacccgaatattttaattgaaaatctaaattttacctaaaacctgaaattttactcaaaaatccggatatttacccgaagttccaaaatagggcccaaaaatctatacccaaactaatccgaacccgattagatgcgaaccgaaatcgaaccgatattttagatttatccacctgggttctaaacttttctacccgaaaaatctgtaaccgatcgggttttaaccgaacccgacccgcttacccgaatgcccatcccactgacgagtgtatatcacagagattaccactggacttgcccttcttctgagagaaatg

SEQ ID NO: 24456 - DNA, 3000 bp, Unknown; identical to SEQ ID NO: 24455
  misc_feature (1)..( 3000): 2750-1469P.txt file - cDNA_ID_2177299; gDNA_ID_2926143; Annot_ID_139015

SEQ ID NO: 24457 - DNA, 1089 bp, Unknown; identical to SEQ ID NO: 8558
  misc_feature (1)..( 1089): 2750-1469P.txt file - cDNA_ID_2177299; gDNA_ID_1971817; Annot_ID_176048

SEQ ID NO: 24458 - DNA, 1085 bp, Unknown; identical to SEQ ID NO: 8314
  misc_feature (1)..( 1085): 2750-1469P.txt file - cDNA_ID_2177299; gDNA_ID_1971715; Annot_ID_175182

SEQ ID NO: 24459 - DNA, 3003 bp, Unknown; identical to SEQ ID NO: 19767
  misc_feature (1)..( 3003): 2750-1469P.txt file - cDNA_ID_2177362; gDNA_ID_1971819; Annot_ID_176069

SEQ ID NO: 24460 - DNA, 3003 bp, Unknown; identical to SEQ ID NO: 19767
  misc_feature (1)..( 3003): 2750-1469P.txt file - cDNA_ID_2177362; gDNA_ID_2926199; Annot_ID_201721

SEQ ID NO: 24461 - DNA, 3003 bp, Unknown; identical to SEQ ID NO: 16662
  misc_feature (1)..( 3003): 2750-1469P.txt file - cDNA_ID_2177390; gDNA_ID_2926199; Annot_ID_201732

SEQ ID NO: 24462 - DNA, 3003 bp, Unknown; identical to SEQ ID NO: 19753
  misc_feature (1)..( 3003): 2750-1469P.txt file - cDNA_ID_2177397; gDNA_ID_1971819; Annot_ID_176086

SEQ ID NO: 24463 - DNA, 3003 bp, Unknown; identical to SEQ ID NO: 19753
  misc_feature (1)..( 3003): 2750-1469P.txt file - cDNA_ID_2177397; gDNA_ID_2926199; Annot_ID_201737

SEQ ID NO: 24464 - DNA, 3000 bp, Unknown; identical to SEQ ID NO: 8587
  misc_feature (1)..( 3000): 2750-1469P.txt file - cDNA_ID_2177491; gDNA_ID_1971820; Annot_ID_176112

SEQ ID NO: 24465 - DNA, 3000 bp, Unknown; identical to SEQ ID NO: 8587
  misc_feature (1)..( 3000): 2750-1469P.txt file - cDNA_ID_2177491; gDNA_ID_2926158; Annot_ID_198543

SEQ ID NO: 24466 - DNA, 3003 bp, Unknown
  misc_feature (1)..( 3003): 2750-1469P.txt file - cDNA_ID_2177502; gDNA_ID_1971820; Annot_ID_58300
aaatgagatggtggtttgtgtttctctttgttcagcccatattcactgtatttcgtgtaacaatttatttgtgactatagtttggtacattatatggttcgttccatctagatattctagaacaaaacgaaatttttaggaataattaaaaattgttgaggggattcggtaatatgtaaagtgtatagaaaaagatctaaaactatagtgaagtagtttgaaaaggggacataagatacaactttcggctgtatatttaataaacagaatggatttagtattaaggagtttataaaatatatattcgaccgttcagaaggatatatagccaatgaaagcccaaaagcttgtgattggtgaaaatttgttacaattttttggtgaagttaagcttagacaaaagtaaccaaaagtctaaaaggtttattgtgcaaaaagaagagaaaagaaaacgaagagatggagttctaatacatattatatatctgatgaagacggcgaaataaaaagaagaggcaaaagtatttaggagaaaaatgtaaatgaagacttttatatttcgagttaattttcaatgtacatactgttcagatccaatctaacaactcttttacctctagttaaaccacttaacacagctacctcatggaccatggtgagtcaaaattggtgatataaaggtgtgtttacttttggtgatttgtttttagctattaaaataaatatacgattttttattttttatttttttgacggcaaatatacgattttgttttgattgattattttttataaatcaaaatattattacagaaaaaaaattataagacaaactaaagggtcaattgcaaaactagccatatttgataatttaattaagaatatagcatcatatacatataaattaaaaaaatagcatataagggttgggaaaagacaattttgatgtgcaatagttgatgagagatgatttactaacacttcatttagttttcatctatttgtatgtttttgttatatatcttttccaaaaaattgattctaattatgaaatttataagataaaaatttctgcttttttctacatacaacatagtttaaatttttaaaatcggatttgtatttataaaatagtaaaaaatgtttgtaagtaaatttatattgtactatttatgatgtatagaaatagaatgttgtactatactattttcataaatcattcgtaatttagttttaattttagtataaaacaaaatattttaaattaaataaagtaatagtggtggtagtggtggtgagatagtagtttatgttgcaatattacctacgataatcgtaaaagataaaacatagacgatttaaattaccgagttaaagcgatatgatccccattaaaaaactataccctaagagatacaatattgggaacccaagcaagcaaattaactgttgtagtgacggtaatacgattgtagtgacgacaatacggttatagcagtgagccactgataaggataatggtgacttggtagtagaggtaatgatgtaataatataggtgataattgtattatgaattttattatgtgtaatatttttttttgttataatagaatagaaagtacatatagaaaatagaagtaaaagacattaagagagagattaagagatagagaaagggagagagagaaagagagagagggagagagaaagagagaaagagagaaagagagaaagagagaaagagagaaagagagaaagagagaggaagggagggagagagagaaagagagagaggaaaagagagagagggaaagagaaagaaagaggaagggggcaaaattgtgattaatacacaaaatataaagaatatcatctagtttttgttttgatggtactttcttaattataaatttttttttgttagatttataaattaaatttccccaaactaaaaggttagaccaaatataatttcttgcagattttttctttgttttgagcattaatgtattatttttagtgtatcaaggcaattagatggtgatataagtctaagaatttgaagtaaggtaaatggttaaacgtccaactacgaaattcgtgtaattaattataatataccttaactgcctaccaaatactaaattatagtgcaactttactaaagtttacataggttcgagaagtcattagcatttgacatattaggatttcattttacacaagctttcgagaagataaacatgtttgacttgtatacggctgttcaacgactcttgacgaaaactcaatttttggtatttcaaattgcttgaaaatctgatgtaaaagggcaacaactacacgatatgattcaaactactatcaattttctttataaaaaaaaaaaaaaaaaaaaaaaaaaaaaactagactaatttttatttgtgtactgtatacattattttctaaaacaaatgtctagacattatagtattttataaacacttacacaacaccaaatgtttgtcttaaccccgactaaaaaggacatatgtgttgttaatgctggatcaccggtggttttgttagtgtctacccttatttgtatggaaaaacactgccatagcccataaggtaacttataaggacatcaaagcttttggtgtttgactgcttaaatgttcagtctccagattccagcacatgcatttctcgaatacttgactaatggtgaagctagcattttttaataactttgccttaccaatcatggtggttggcggaattaatcatggtggtaagcgagagactttattttatccaaaaaaaaaatgagagacgtaaaattagaactatttttagttataatagttatattttattattttgtctcaattattctccccgcccctctatgtagacgtgtgaatattagagagattgataacgaactcctcacaacatcatatctcaagttcaccacccaaaagaaaaaacacacacacatcttagagagatg

SEQ ID NO: 24467 - DNA, 3003 bp, Unknown; identical to SEQ ID NO: 24466
  misc_feature (1)..( 3003): 2750-1469P.txt file - cDNA_ID_2177502; gDNA_ID_1971820; Annot_ID_176116

SEQ ID NO: 24468 - DNA, 3003 bp, Unknown; identical to SEQ ID NO: 24466
  misc_feature (1)..( 3003): 2750-1469P.txt file - cDNA_ID_2177502; gDNA_ID_2926158; Annot_ID_139591

SEQ ID NO: 24469 - DNA, 3003 bp, Unknown; identical to SEQ ID NO: 24466
  misc_feature (1)..( 3003): 2750-1469P.txt file - cDNA_ID_2177502; gDNA_ID_2926158; Annot_ID_198546

SEQ ID NO: 24470 - DNA, 3003 bp, Unknown
  misc_feature (1)..( 3003): 2750-1469P.txt file - cDNA_ID_2177519; gDNA_ID_1971820; Annot_ID_176122
ggtatatttgagttttgagaaaccttagacttgaaccaccagatagaccgtgaacaagtctaataccatcttaacacatagtggccatatggaatgttgggacttatttgattttttagtcaagatcgatttttatggattttagcttgaggggttccgtatgtatagtaggtcacaaacttatggtcaaatatgaaatcaagtgtctaattaagtcattatcgaaaggttttattatttgagaagttttaaacaccatgattttcatagaaattcctaactgaaagaaacaaataaagaaaacggttatacacaaatttgtacataatttcgttaaacttcctccaaattcgatggaaagaaagagtcatgcaccggatgacaaacccatacatgcgtgtacagttcgatagaattcgagaatgggaaattccattgtcggcatttgttattttgtttacttgcacaaaataaacctttactaagctatttcatttcgatctcattttgtatatttctatctagcttaataagctcacttgtgcatgaatcctattaactttggattctcctacaccatcctcagaaaaatgagttccacattcttttcttttatactcttttagttcccctcttgttttcattaaccaacaagagaacataactaatttcttacagcaaaaatcttctttctatacatgatttgtatacacaattagtttcataaatacgaacgaaaatagtttcggagttacgaatattgcaaacaaagagaaatgataaaagaagtagagatctaagaaaatgacgggtaaaggagcgtgaggagagtcgatgattggctccggtggggttggagaaaggatgcacaagagacataaaagtgtctccctaataggttaactaaagaattgttgcatacgttttcactttcccccacatcttttctaatcgaaatttgttgattttgacatataatgtttataaggttaagaagattaattttaagtatattttgtatcaccatccgtataatgtgagtataaatcatctttccttcaagatcattctgaactttaagctagctctcaatcaggtgagctttttaatttcttcttataatcatatttctaaaccaataattaacaaaaggccaaaacttattaacagtttcctccaggaattacgaaagaagaaaaatcagaaagagtgatttgcatatacagatcaatcacttgtctcatccttaatattcactcaacgaaaaagtttgtattgattgagttgagtattgtataatgtctaataatgatatttacaaaatgtatatttatatatggttgaaatcatgagtacgacatgattgctattatgagatccacaactatatatacaactaattcataaatattttacctgtttcaaaataataaacaaatagaaaatgttatagcatgaattagagttatggaaaaaaaattatgaatgaaatttatggataaatgaacaaaacaaacattaaaacaaaccccccccccccccccccccaaaaaaaagatacatttaaatccaccattatttatgtaacttatgttttttagattgatgcatggactgaaataataatccaacaacgccgtacgtaatttaacatttggcgaccatgcatgatgatgtggctggtcaactagtcaccgtaattggtgcttcagaacaaaccaaaaataatcggaaattgagaaaatactattccaataaatccggcataaaaccagtagtgacccatttagtttccgtacggaacacactgccttttgatgacttggcattttcaagctctctaattcgttaattgcttagttaattttcgttaaccccactaaccaatcacacttctgcgtttcctttctcggtaaacacatctgcttctcctactttaggatagtaataatatattttgtgacaatattatattgtcccatatttgatttaacttttgcttagtgtagaccaaacttgaagtggtgaaaaaataattacccagaaaaaggctgattgtagtatagaaaatataaattttgctaggttgatttggtttaattagccgtttaaaattacaaaatcttcaacgttttattttttcaaacatttgtgtccaacagtttttgcaaggtatttgtttggtttggggtggagatttgtctacattgaaaagaagcaactatcactggaaaaaaatacgtaaacctaaaaatagtaggagtaaatttatttttactataaatgttgagtgacaaagatattgaaaagctttcaactttaattttggtagctaggcgccaattgcaggttctccaatttaaaattttctcttttctctttattttttttacgtctaagacatttttaattttctcctttatcaaaatactgtatataacttatttattttagaaaatgttctcttttttatttatttacagtatcttgaatggatcaagataataatcattcgattaggaaacctaagcaaagttagtgagagtaagtactaagtaacatttgattatacagaaatgtaaaaaatcgatggtttaattcttctacggaacgaattttaataataaggattaataaagaggattagtactttatacacatgagacaagaggcggttacggcagttatgaggatttggttaataattacggcgttagaattaggggaacggaagggatccgaggatctcaacatatcaacggctaagattgtaagatcaaaaagtagcaacaaacatattccgttaagtagcggcgtgtgttaacgttaacgttactttattgcgtatatataaacggagacggtttccttggagcttgtgcacactaaatctgtcactcttcttcttcttcttctacttttctctctcccggttattttcccagaaaaagtgcgagaaaattccgttgagctttagagaagaagaagaagaaagcttcaatg

SEQ ID NO: 24471 - DNA, 3003 bp, Unknown; identical to SEQ ID NO: 24470
  misc_feature (1)..( 3003): 2750-1469P.txt file - cDNA_ID_2177519; gDNA_ID_2926158; Annot_ID_198551

SEQ ID NO: 24472 - DNA, 3003 bp, Unknown; identical to SEQ ID NO: 19003
  misc_feature (1)..( 3003): 2750-1469P.txt file - cDNA_ID_2177531; gDNA_ID_1971820; Annot_ID_176127

SEQ ID NO: 24473 - DNA, 3003 bp, Unknown; identical to SEQ ID NO: 19003
  misc_feature (1)..( 3003): 2750-1469P.txt file - cDNA_ID_2177531; gDNA_ID_2926158; Annot_ID_198555

SEQ ID NO: 24474 - DNA, 3000 bp, Unknown; identical to SEQ ID NO: 8668
  misc_feature (1)..( 3000): 2750-1469P.txt file - cDNA_ID_2177702; gDNA_ID_1971833; Annot_ID_176329

SEQ ID NO: 24475 - DNA, 3000 bp, Unknown; identical to SEQ ID NO: 8674
  misc_feature (1)..( 3000): 2750-1469P.txt file - cDNA_ID_2177714; gDNA_ID_1971833; Annot_ID_176332

SEQ ID NO: 24476 - DNA, 3003 bp, Unknown
  misc_feature (1)..( 3003): 2750-1469P.txt file - cDNA_ID_2177759; gDNA_ID_1971826; Annot_ID_176293
accacgaattcatgagacagttgttaaaaaaactgaagttttgatccctattaaaacagcatattttataattttttaaaattttataaatattgattcaaatacatccaccatataacccaattccaaaataaaacacgttctgtaatttctttacccgttccatgattttttttttaagtagtaatttttaaaatttaagaattatattttatatataaaagttttgcaaattgtatcattctctaatacatttatattttatagtttaattttatatatagtaatattatacataccacataacatttttggttttatataattttttctaaattaggatgatttgatatgtttaatattagtggtcttaaaaaaataataaattaaagatttaacccatattgaaattaaattaaattaattaaaatttagatatcaaatcttatatgttgattttgattggctattatttttggaaattaataatgtatttcgttttttaattaatttaattaattaaattagtatttgactttttaatccttaaatacataaattaatttactctttaaaattttatttctaatggcatacctatgtaattacttacaaaaattaaggttagatttaaaatgtacttcccaaataatatagtaagatatcatcaacttttatttttgatttattgtctcttaatgaaattattcaaggagtgtgtgcacctcacgccactcacaccaattaatacctatagactttggtctaatgtaactggaattggtccaaaaattagagaagacaagacctctttacatgcttccagagctaccaacaaacccaatagaaattttgttgttgcaacaatctctttaattaatgtacaagtttctttcaatcaccataaaccttgatttcttagttttttttcccacaaattctaccaacaatttattgtttttctttttattatgttcttaattctgatctttctttggtgagttttttttttttttaattttgataaagaaaagataagtttgtgagtttaaacactaaccctgttaatttttcttcatcacattgttaatgatgcgttgacataggaacctttttcctataccacaaaaatttttcttttttttttctttttttgtgtgtgtgtaaaactccacaaaaatttaactaagagttaaaactgatgaaaaatcttaattttttggtaagatttatagaaaaatgaaaaaggttttttacgatttgttttaattaactatagataaccaccttatttagatacgacgaccaaattaattgtcgtttggttaaaggtcataagagtattaattggagccgtcagattatttattgacttaaatatacctcactacttttacatttctgcattatctctacataccatatattataagacttaatttcggatatatatgtgttaccaaaattgaaattctctcatttacatatgtttcctttaaaatttaaaacatgattttacccacttgatgatcacgaagaagaaaaggaaatcaaaataagatatgatgtactatatgaaattgcgacttgatgattacaataaaggaaaaataacataatcaaaaactagattaaattcaattttcgcatggaattacataatttcattataaaaaaaaaataacatacaaaacttttaatttaaacgtccaaaaaccctacattattccaaaaaaaaaattgtttgaaagtaagaaagaaaattaatacaaagtgagagagaaatatgtttaggtgacacgagtttcactctcaattccaaagacagaccaatcaacgaacaaaacccattttctctgatcgattaggccacgacgtttcctgaggtgcagggcacgagtcgctcaatctctctcttcttcttcttcttttcacgaattttctccgaaacttggtttttattcctcaaacccataaattagggttcagtttttaagcctccgtcttcttcttcttccgtcgtcgtagtcgaaaggttagttcgattatattcaaatctttactcactacgatccttaaattagtgggtcgttttcaaaattttgatttgattcgattttccttggtagaccataaaacctagaaatatacgattaggttattcaattgctgtcgatttctcgatgtaaataggtttcgtttggtagattctagaaacttatttaatgtctatgatcgttgctaggttttgtatcgtgtagtgattagtttatcaaattcacttttgttttgagttgttacctaatttagttttagctgattttgatgaagtgggaataagaatctggttatagtggtaatgatgtgtttcctctgcttataggtggttttagctatatggatatcttctactgcaaatactcttcaaaacggatgctttgaagccttgatactaatttcatgcgttctatatatgtgcatcgtaaggaagtaatgggagagaatcgtcagattagatcacgttcttggaatagaatgccaactaaaagatgcagtgcaaatggcataatggaagagtttattctggtagatgatgatgatgttatcattcttgattttcctgagtcatctaaacggaaagctccgggtacatccagaaccaggaaggagtccattatgccgagagtgattagcattgacgatgatgatgatgagacagaaaatgttcagaaagctgggagtagttcaagcggtaacttgcaaacatctgcagaagtggataatgacgattgccaattcattcaggagaagtgtgctacttttagattttcaaaatgcaaacagactttctctacaatgccctctcatggtattcgatttggtttaggctctgatacttatagtgacttttccgagagtgactgttctgattgtgagattttagaagggtctcatagagatgtccgcgagcagtgggaacaagcagctctcttgagaaaaatg

SEQ ID NO: 24477 - DNA, 3003 bp, Unknown
  misc_feature (1)..( 3003): 2750-1469P.txt file - cDNA_ID_2177763; gDNA_ID_1971833; Annot_ID_176339
gatactaattaaattaattgatttggaagtgttttttaacttggaagtgaagtgattaattgaattaaatattaatatagtaatatttttcgtgaaagtatagaattttttttttcgagaaattaataacagttcatttaccatactgagaatgaatatggtaatataaatttttcatttcgaaaaatacgaaatatgtttaaatcatttcttagtataatttggtatattgtattgaactgttaaaaaaatgaaggataggatgaacatttttctcaaaaaatcctaggtttgaaattgattccttcatttttgttcttaatttaatagaaaacttgttatagtttttcctgattttaaggttataatttttaaaaatatctattcaacgaaataattcttttaatattttatatttttaattataatttcttttattattatttttaataccaaggtagtaaaacattagtaagttacataataagttaattttgaatgaaagttacaccactcatcctgaagaattagtctgatggtaaaactggatcatctctgattatcaatataataaataaaattgtacagtatgaaagaggaagagaaagatactcatatttatgttttaggtaacattgcattaaatgaacaaaattgtctagtaattgaattttgcaaataaacaaggcgcgatctacggagatatttgcgattataaaattccacgtacatgtttataacaacaacaaaatgcaaaaataatggagaaaatttaataatttcatgataatacggaaataattacgacgatgatttgtcaatgcattcaaccacccataatttttcggcgaaataattgattttctatcaatccaacagaatcacaacgttttaattttctataactctaaaattaagaatcaaagaaggaaccaaaaggatggtattaagtacaatgatggttctattgtattttggctttaaattattttttggtagaataagttattttctaaaattgaaatatctgaagtctgatcgatttcggacttatagctagtcccagaaacattcagtttatatatatggtcagaaaaagaaactagactaaaacaggaaaaaaaaaatgtcgtcgtcgtcgtctctaataattaagttgaatttggcttagctgaatgtttctggcgttgtccaaatgtgggtgcccaacaggcaacgctcacgtggttctttctcaataccccaacatttatatgtataagttatcctcttcttcttaatatacttatgcttcttaatacgcgtgggttagtttatttgtgtcaccaaaatatttttgaaaacgagactagctagggataaaacgtctttgtggatgaataatgaagttaacatatataagaaaccatgggattttaacaaaaaaaaaaaaaaaaaacatggatcccgtgacagtctgcgcgcgcgcgcgcagcatagtagaggccaagagcgaatgttatttgattcacttttgtttggttcttttgtcaacattcactctttatttcgatactcttgcttccgtatcatggatttttttattacgttgacaactagaatatatgttttattttttttgaaaaagatactatatgttttatcgttcaaaaaagatgagtcaagtactacaatttacctatcattttttttttttgttaaaccataactttcaaattgatccaatgtttcaggacacttactttcaaagtttatcaacacctattgcattttattttcttaagatattaaattttctgtaattgtttatctaaagcatggttagtattctgattttttgacaaaaggaaaataacgacaacatcactaatatttcaacgttccttttttttcctccacaaaattcaacgtttcattttacgcgcacagatttttattttttctatgtatattttgtaacgatttttttaaaaaaatatttgtaatagttattagtatatgctaaatattgaatacaattaatttgctaatttcctttgtagttggtcatgacatgatatctattggtttatgctagttttattgttattcaattttaaactcaaataatgcatattattgatgaaaagatatactacaatattaaacaaaagttaacatagttactgaggaaaatggaatacggagaaattaagaaatgatatattatgtgctatattattattagtcgcaatgatatctttataataaaacacctattaaagaatatttgtcgtttccagttacatctaagatatataatatatatttttttcctagcataaattcccggaaacagcatgtgatgaaggaatatatcttgaagtttatagttgttgaccaaaaaaaacattaattctattatttctatagttataaatttagttagagtatgaaaaacaacaccatcttattcatgataaacacaagacgtataaacacgacaaaaattctttaagaagagttttatttcgatatgattcaaaaagtttcaaaagctgttatagttcgatttcggtgtgttatccatataactaaaaagttggacagctttcattgaaatatactactcaaagaataagaaattactagatttattatgttgtctcatcatgtttatgacttatatgagtatcaacgtggatgaaagtggtcgcttcttcctcatcggaaatcaaaataccgcatgttcatacaaatcaagaaaattataatttacaaatattgtaaagagctaattattttataaacataggatatcaaatgtggacctaaaaaagtttgaaaatgcaccactcaaataattaatgcatacagccaagcaagtaaaacattagaaagacaaaaaataaatacttttaaacaatttatattatatagtttttcatctcaaaactcaacaatataaaccctattccaccatcttctattccctcacaaacaacaacattgttaagaataatg

SEQ ID NO: 24478 - DNA, 3003 bp, Unknown
  misc_feature (1)..( 3003): 2750-1469P.txt file - cDNA_ID_2177771; gDNA_ID_1971833; Annot_ID_176340
cctcacaaacaacaacattgttaagaataatggcaccaatcaaagaattcatatccaaattctcagatttcaaaaacaacaagaaactcattctctcctccgccgcaatagccttgctattattggcctccatagtcggaatcgccgccacaacaacaaaccaaaacaaaaaccaaaaaatcacaactctatcttcgacatcacacgccattctaaaatctgtttgcagctcaacactatacccggagctctgtttttccgccgtggcagccaccggaggaaaagagctgacgtcacagaaagaagtcatcgaagcgtcacttaacctaactaccaaagccgtgaaacacaactacttcgctgtcaagaagctgatcgcgaagagaaaaggtttgacaccgcgtgaggtcacggcgcttcacgactgtttggagacaatcgacgagacgttagatgagctccacgtggcggtggaggatcttcatcagtatcctaagcaaaaatctctgaggaaacatgccgatgatctcaaaacactaatcagctcagccattactaatcaagggacttgccttgacggtttctcttacgacgacgccgataggaaagttcgtaaggcgttattgaagggtcaggtacgtaaatagttttactcttttaaaagtttagattatagtattatcttcgacatacgacttactcggtaaaataatgtagtgattatagttggtccataattagagcacttaactcttcaaatacgtacccaaaacatttgttttactaggaaatcttttaatatgtaacagctttataatattgaacggtatcaaaacaggtacacgtggagcacatgtgtagcaacgcattagcaatgatcaagaacatgacagaaaccgacatagccaactttgagctaagagataagtcttcaaccttcaccaacaacaacaaccgcaagctcaaggaggttaccggcgacttagacagtgatggatggccaaagtggttatccgttggagacagaaggcttcttcaagggtcaacaattaaagcagacgctacggtggcggatgacggaagcggtgactttacaacggtagccgcggctgtggctgcggcgccagagaagagtaacaagaggtttgtgatacatataaaggcaggagtttatagagagaatgtggaagtgacgaagaagaagacgaatataatgttcttgggagatggccgtggcaaaactattatcactggaagtagaaatgtcgtcgatggaagcaccactttccactccgctactgttggtaaatactgttcttctttgattttatttttaaggaattaagtaaacagtagtatcacgtaatagctaacaacacatactgacatacacatttgtttgtatgtaaaaagaatgtaataatgacgcatgtgtaacgttttgttggtagatgataacgtagacacgatcgtaactcatttccacggttaaatgatagtactgttttctattgactgtagctgccgtcggcgagaggtttctagcgcgtgacatcacattccaaaacaccgccggtccgtcgaagcatcaagcggtggctctccgagtcggatcagatttttccgctttttaccaatgcgacatgtttgcttatcaagacacactttatgtccactcaaatcgtcaattctttgtgaaatgtcacataaccggaaccgtcgatttcatcttcggaaacgcagccgcggttttacaagactgcgatataaatgcacgcagaccaaattccggtcagaaaaacatggttaccgcccaaggacggtctgatccgaatcaaaacacggggattgtgatccagaattgtcgtattggtggcacgtcggatcttttggccgtgaaaggaacgttcccgacgtatcttggtcgtccttggaaggaatattcacggacggtgataatgcaatcggatatatccgacgtgatccgacccgaaggatggcatgagtggagcgggagttttgcgttggacactctaacttatagagagtatttgaatagaggaggaggggcaggaactgcaaatagagtgaagtggaagggctataaggtaattacaagtgatacagaagctcagccatttacggctggtcagtttattggtggtggaggctggttagcgtcgaccggttttcctttctcgttaagtctttgaaattaaaagattgacttattattttaataaacattgtatttctctatctacatgtatcattaaatcgatgttcatatatgattctcaagttgaaccaagtcaatgcataactcgggctggtatagttttaaggcctaaataaccggactttacggggtttattgggttgattacttgattctaattcataaattaagataaaccgggaatcaaacacaatgttggtgttgtgtcacttgtcggcattaaagccctaaagagatagagatagggacgccacatgttagagacgcacatggccattttaatatttgctaagataatgttctttgttttcttttaatttgtagacattttcatgtgtttttttttggttctctccaatgtgtatgcttgaaaaatataccgaggaacccatagaattgtaaagaatgttcgctttctatggacctactacggatgtagacgactttgacatatacataatacataaaaccattttttgtctttaaaccaaattacaatataatcaagttgattaatcaaaataattacaacgttatcatgaatcttcacatgcaagatcctacacacacacttagacgacaagaagtcaccgtggaacaagcgcgtcacgttcatcattcacatttacttaatcccacttaaaaaggcaaacaacaacatgtcttctctaacataaacaacagaacataacaaagcccaaacaatcttagtaataatcccaaaaaccagaaaaaaaggagctttgcttttgtaggaattaatg

SEQ ID NO: 24479 - DNA, 3000 bp, Unknown; identical to SEQ ID NO: 8672
  misc_feature (1)..( 3000): 2750-1469P.txt file - cDNA_ID_2177775; gDNA_ID_1971833; Annot_ID_176342

SEQ ID NO: 24480 - DNA, 3000 bp, Unknown; identical to SEQ ID NO: 8666
  misc_feature (1)..( 3000): 2750-1469P.txt file - cDNA_ID_2177814; gDNA_ID_1971826; Annot_ID_176300

SEQ ID NO: 24481 - DNA, 3003 bp, Unknown
  misc_feature (1)..( 3003): 2750-1469P.txt file - cDNA_ID_2177841; gDNA_ID_2684230; Annot_ID_192238
aagaaaaagagggcatattttgagatatacatgacaaatagaaaaattattatatattaagtgtacgtaaagtagtggatgcatgaataatgggtagtattaaattgctagatagctagaggagagggtaaaggcaacgctttaaagagtcggagtaatgaagttatacgagcatggaaacctgactaaaccctaatttcttattagctctcttcccttttttggcaatcgtcccatctctcacagtcatagttgatagtccccaaccttttttaaaataaacataatttaatttcggtcacctttttaagatgcagatatagatatcgtctcattatttctagtccacgattaccctattacgtacaactaattaatcttctattttcaactgatcatattctaaatttttcagttacacctctggtctaggatgtttcaagtcaaaatttgaaaatattcacatttgtctcttaatgccaatgatgagatttggtttagttttttttttttttttatgatgcaattttctattgagaaaaatggatacataaataaaacttgaggataatttctcattgtccatagttaaagtttcttagatgcaaattaaagtatcaataaaattttaaaattagatactatatcgatcagagactttgttattgttgattttggaattagactaccgtacagtggtacaaaatatatgtttaaaagcatattaaataaaaatagttagttattcatgttttcttcttgttttttttgtttttgtttttgttgttattaactaaagaaatccatgacttttattaatctatttatgtattagttctaactttgagagcaaacttcaatgtatgtatatattggttctaacattgagaggaaaactctaatcaaataaaattgtaagtaagctaaatatgtgtgtcgaagtaggaaatctaaggaaagtgaagaatgcaaaaaagttagtcactgaaagagacgtgtgattgatcacttgtctccttccaatttccctgtgggggcagtgcatgcacaaaagatggaatccatcctatagctcctcctttcttcactatcttttcaagtttctctttttgaatatattttttttaaattgattttgatttaactcaaagcccacacttcttaatccatcttctctataattagtatgccaacaaatatatatgcttgttctgtctcaaatttcaacaataaagcgtgtatagctcccaaaaagctatgttgatgagttatcactctttttatggattggactaatagtttgtctcatgtcaaaatgattatacataactcagaatccagcagtatagagaacttaacttttatatatatgttaaccctcataacctcaaacagaaaatttgtagtgcagtgtagaaaacatccttaaacataaagtaaatcctttaacaaaaaaaataaatataagtggcaaatcaagagattctgcttttgagtccaatgtatgtatagttggatgttctgaagaagatccattgttttggttgtttctctacagttaaacgatttttatatttaacttattaatgcaattgagtgaaaatttcacgatgaagaaaaaagttgtgaatcatgacaagttttgtcctcagttttgcagtgaaatcattttgcgtgaaaattttatgagagaaacaaaaaaaaaaaaaactgatcaaaagatcaggaaaggaccattcttaatttataacatgtgggcaagtcaaggcttgctggcatcaaacttgaataaatgtaatcatattcacaccatgtattgtttaatatataattttaatatcttaattggtcatctatttttgtctttttgcatcgcatatgtgtcataattaatatctgtacgatgtagaggctagtgaatataaagtgaaaacatagatatatcgatcttaaaccaatggtatcttacaccatatgtatatgcttgtttgaaaatatttattctacgaaagtattaattggattgattgttttcactctcttgagtaattttggataagttaatagttattatttttattacacatgattaaggtgtattgttaattataaatcatatttatacgaagacatggttgaataatgtccaacacagcttattttagcaaaaactaatgtacgaggagtgacatttagggtcttgatatttttgaagcaaaattaaatacgtctgcaagattttgcagagggaggcatgtactatatcatctgcaatagtagcaacatagataaaagtcataaacccctagatccggtccctttaatttaattcatatatatgatttgacataaaattacttttgttaaaaagtttgtttttacattaaattcttctatcttttttctaaatatcagtttaatatacatttgtaatttttcttgcaatccctagccagcttaatgatatcattttttttccttctttatatccagagaaattttatgcggaaacgtagattaatatcatcgaacttgttgatccaatttgttttatcttttaaaacatttacagtgattacaaaatagaatatatagcaagtaaatatccaacgaaaacacataatgtctttaacaaaaaaaaagaacgaaaaaaaaaagaaaacacataatgtcaccattagaaactcgtgtctacaccagaagtcattagtttaagatattcattttttttttttttgataagatgatattaaatgttgttaaaataaacaataaaaatgcaattatggactgcatatacacgtccaacactttgacaatctgtatcgctctctctctctctctatatatatatatgtcatggtctcactatgattgttctataaatacaagcctcctaactcataaaataagcataaccctaactctacaaagttcttctgattctttctctctctctctttctttcaagagcggttttcaatccattcgctaaagaccatg

SEQ ID NO: 24482 - DNA, 3000 bp, Unknown; identical to SEQ ID NO: 8667
  misc_feature (1)..( 3000): 2750-1469P.txt file - cDNA_ID_2177841; gDNA_ID_1971826; Annot_ID_176307

SEQ ID NO: 24483 - DNA, 3000 bp, Unknown
  misc_feature (1)..( 3000): 2750-1469P.txt file - cDNA_ID_2177849; gDNA_ID_2684230; Annot_ID_192236
ctttataaaatgaactaaattcttctgaatttcatacggaaaaacaaaataaacttatttttaacacatctcaagtcttaaaaccatacaacaaatcatatcaactaatcaacatttttgaaccttttcgtcatcattgcatcgcatagccttgccgcgtctacattatctctaacattatgaactctaatgatattagcaccttttagtatcccagcagtaacacaagcaacagttgcagcatctctttcacttgcctcaggacgaccacaaatatctcccaaaaatctcttccttgaaggtcctataagtataggtgcatgagacaatcctatactcttcttagccatctcttccctgatttttggtagctccatgacaatatctaaattatgatctattcccttagaaaatccaattcctggatcaatcataatcctccaagctggaatcccagagagttctgcttctcttactctctcataaagctctgtggcaacatctttgcatatttcattatactccaaattctctttgttttgcattgtacatggatctcctctcatgtgcatgatcatataaggaacatcagaatccgcaacaaccttatgcatgttctcgtctaaacttcctccggatacatcattcaaaatgtcagctccatttcttattgcttctaaagcaacctcagagttaaaagtgtccactgatatgagctttcccttcatctctgccataccgcgaacaacttttaaaaccggaatcagtctatctatctcttcttgactagatattcttgaggccatcggccgtgttgactgtgcaccgatatcaataatatctacaccttcagatatcatagaccggacccgagaaaccgcggtatctaccgattgaaacttacctccatcactaaagctatcaggagtaagattaagtatacccatcacataagttttcttagaaaaatcccataaatgatctcctattggtataaccctttgtataataccgtcttttccaagcaatgactcaccacctaaccgctcccacgcttggaaaattccacctgaatgcattgagagtgaatgccaatatgcaactattttatcattatcaatatcttccgttccaagcaaatctaccaaaggtgctaaaacaaatggtctttcccagattctctcatggggaatgataagtttatcagaaattatcttgtgctttccatagaacaatatgtccaagtcaagtggtcttggtccataccttaaaccattttcttcacgacccatctctttctcaattttcttgagaacgttcaagagttcatgaggtttgagctttgtgacacctcttattgcagcgttgagaaatcttggttggtcggtcacatgaacaggttctgtttcgtacaaacaactgtgtctggttacactgatcccatagtctttcatcaatcgtaaagcttctttgaaattattcattctgtttccaacattgcttcccaaagctatcacgacttcttcgaaagttgttgtttccaaagatgtgaaatctgagtcatatacaaaacatgtttcgaaggtgaaatatgattcaatacttaacagaaattagtgtatcaaaacgtaaacgctgtttttttcaacgaaaatgaaacggatgaaaaagatacgaacccattttagaataggttcctccaaaatatcagtattgtctgcttcgatctgaccttaaagtatacaaaactatgagtttagtcttagataacaacgaaacaattattagaaacacaaaaaatgggttctaatattttaagaaccaaggaagtaaacaatacttatgtatgagagaggcaaggtggtagccaattttcacctactttttttctgaacttgttgtgttatccaagtaccttctgtctttcacgctcgtcaaaagtcagcttctcttttgaattagatatgaagatctagaaaagaaaagaaaaaagagaagaaaactttgtttttagagagattttgaaattggtaatgaatctctcataattttgaaattggtagtgaatctctcataattcttttcattatctattctatcttttaccatttaaacatatatttggatagatgatggaaaattgtgtgttagtctccagctatttcattccatttttaaaaaatatcaaaattttcatagatttgttctgactacatcaattttctttcattccactcaaggcactcatggttacattaccaatagaaattaattaaccatacaaaattctaattattataactccagacgatattattttcactatatagcaaaaaatagccgttttaccataacatatatacagtctatattttttgacgaaaaataaataaatatacagtatatatatatatatatatcctcgtgttagaattgtattaagtttttcatcacaccatctttaggcattatttctatgccaatcaaatcatttactcgtaaatcatcatagtaattatgatttcagttaatcgtaagttttttgtagctttgtgatgatgagccaattaacttcacaacaaaatattttccttgaagtagttttttaatagcaaacgatttcacgaaaaactttacataacaaatatttctacctacattaaaagaatgtcatatagacaatactaaattcactagctttaaagaagaaaaatgagccgtaaataaattatagtagacagaatagggacatcttgacgttttagtattttgatcatagaatgcttgccgtttcgttaaagcgctaaacctcctcctcatcctctcccagctagctcctcttgcggtttcagagcttaaaccccaatctccctcaaaactcataaacatattgctctcctttgttcatttctgggtttacgcttctttcgactttatgggtttcggagcttagttttactacaatttcgtttggaaaagagctcttatttgatgttcatg

SEQ ID NO: 24484 - DNA, 3003 bp, Unknown
  misc_feature (1)..( 3003): 2750-1469P.txt file - cDNA_ID_2177849; gDNA_ID_1971826; Annot_ID_176310
aaactttataaaatgaactaaattcttctgaatttcatacggaaaaacaaaataaacttatttttaacacatctcaagtcttaaaaccatacaacaaatcatatcaactaatcaacatttttgaaccttttcgtcatcattgcatcgcatagccttgccgcgtctacattatctctaacattatgaactctaatgatattagcaccttttagtatcccagcagtaacacaagcaacagttgcagcatctctttcacttgcctcaggacgaccacaaatatctcccaaaaatctcttccttgaaggtcctataagtataggtgcatgagacaatcctatactcttcttagccatctcttccctgatttttggtagctccatgacaatatctaaattatgatctattcccttagaaaatccaattcctggatcaatcataatcctccaagctggaatcccagagagttctgcttctcttactctctcataaagctctgtggcaacatctttgcatatttcattatactccaaattctctttgttttgcattgtacatggatctcctctcatgtgcatgatcatataaggaacatcagaatccgcaacaaccttatgcatgttctcgtctaaacttcctccggatacatcattcaaaatgtcagctccatttcttattgcttctaaagcaacctcagagttaaaagtgtccactgatatgagctttcccttcatctctgccataccgcgaacaacttttaaaaccggaatcagtctatctatctcttcttgactagatattcttgaggccatcggccgtgttgactgtgcaccgatatcaataatatctacaccttcagatatcatagaccggacccgagaaaccgcggtatctaccgattgaaacttacctccatcactaaagctatcaggagtaagattaagtatacccatcacataagttttcttagaaaaatcccataaatgatctcctattggtataaccctttgtataataccgtcttttccaagcaatgactcaccacctaaccgctcccacgcttggaaaattccacctgaatgcattgagagtgaatgccaatatgcaactattttatcattatcaatatcttccgttccaagcaaatctaccaaaggtgctaaaacaaatggtctttcccagattctctcatggggaatgataagtttatcagaaattatcttgtgctttccatagaacaatatgtccaagtcaagtggtcttggtccataccttaaaccattttcttcacgacccatctctttctcaattttcttgagaacgttcaagagttcatgaggtttgagctttgtgacacctcttattgcagcgttgagaaatcttggttggtcggtcacatgaacaggttctgtttcgtacaaacaactgtgtctggttacactgatcccatagtctttcatcaatcgtaaagcttctttgaaattattcattctgtttccaacattgcttcccaaagctatcacgacttcttcgaaagttgttgtttccaaagatgtgaaatctgagtcatatacaaaacatgtttcgaaggtgaaatatgattcaatacttaacagaaattagtgtatcaaaacgtaaacgctgtttttttcaacgaaaatgaaacggatgaaaaagatacgaacccattttagaataggttcctccaaaatatcagtattgtctgcttcgatctgaccttaaagtatacaaaactatgagtttagtcttagataacaacgaaacaattattagaaacacaaaaaatgggttctaatattttaagaaccaaggaagtaaacaatacttatgtatgagagaggcaaggtggtagccaattttcacctactttttttctgaacttgttgtgttatccaagtaccttctgtctttcacgctcgtcaaaagtcagcttctcttttgaattagatatgaagatctagaaaagaaaagaaaaaagagaagaaaactttgtttttagagagattttgaaattggtaatgaatctctcataattttgaaattggtagtgaatctctcataattcttttcattatctattctatcttttaccatttaaacatatatttggatagatgatggaaaattgtgtgttagtctccagctatttcattccatttttaaaaaatatcaaaattttcatagatttgttctgactacatcaattttctttcattccactcaaggcactcatggttacattaccaatagaaattaattaaccatacaaaattctaattattataactccagacgatattattttcactatatagcaaaaaatagccgttttaccataacatatatacagtctatattttttgacgaaaaataaataaatatacagtatatatatatatatatatcctcgtgttagaattgtattaagtttttcatcacaccatctttaggcattatttctatgccaatcaaatcatttactcgtaaatcatcatagtaattatgatttcagttaatcgtaagttttttgtagctttgtgatgatgagccaattaacttcacaacaaaatattttccttgaagtagttttttaatagcaaacgatttcacgaaaaactttacataacaaatatttctacctacattaaaagaatgtcatatagacaatactaaattcactagctttaaagaagaaaaatgagccgtaaataaattatagtagacagaatagggacatcttgacgttttagtattttgatcatagaatgcttgccgtttcgttaaagcgctaaacctcctcctcatcctctcccagctagctcctcttgcggtttcagagcttaaaccccaatctccctcaaaactcataaacatattgctctcctttgttcatttctgggtttacgcttctttcgactttatgggtttcggagcttagttttactacaatttcgtttggaaaagagctcttatttgatgttcatg

SEQ ID NO: 24485 - DNA, 3000 bp, Unknown; identical to SEQ ID NO: 8661
  misc_feature (1)..( 3000): 2750-1469P.txt file - cDNA_ID_2177855; gDNA_ID_1971826; Annot_ID_176312

SEQ ID NO: 24486 - DNA, 3000 bp, Unknown
  misc_feature (1)..( 3000): 2750-1469P.txt file - cDNA_ID_2177864; gDNA_ID_2684230; Annot_ID_192231
ttcttctggtttggatcttgttcttgtgatatgcatcttaaagagtttcccatttttttttggttttttggtttttcttgtaaggtgtagacacgtttgtaagtgtgtgtttatatatatgaagcatgttcgtgcttgcatgtgtattgttttgattcttgatgggtgaaaatgaagagttgagactctcacgttgtgaagctgtacttaaaatgtaaatctgtttgatcgtgatagttttgacacttctgtttttcttgagactcacgaaaatgcacatatgagaaaattggtttaaagtttggattattctattacaaactaatggaaattgattgcctacaaatggagacataagaaagagggaggaacatgggagggcactttctttgagcattttgctactttgactttcaagcgcaagctatttctttacaacgataaaacatattcatcgtatttttcttgtttatatatagatcttcgtcctttgccgcgactgcgatcgactgcgactaagtgttgttctgatcgggactattgaccaatattttaggttgctaatttttaacgatttctcgcgattggttacataatgactatacaaaacgaataatatagcaatcacaaaataaattaagatacaaaatctttagaataaacaagaaattaaattattatttttttataataagttttagaatagatataacaattatattttttattttaaaatataaattctcataaattaaaatcttcaaaacaataaagcgaccaatcacatcgattgttaaataaataacaaaacaagttgctggttgcttgtcggaatcgttggcaactagtaaacggaacatgaccctagttaaaaaccgaaatttatgtaaattttttgatatagctcttctcaattcagaatcgagttctttagatgtacctaactctcactattagtttacttctaagttggttccttgaatcttaatttgtctcttgtctcttatccaagagatagagaattcattaaaataagttatctttttgagattatttacttttttccaaaaagtgtcattttaaatgttcaatgcgaaattttagacaaaattttgtttcatattttatctattaagaagagagatgaaattatataatgtattaagaaagaatataaaataaattttaaatcatcttttttatgaaaacactgtaaaaatttataaatgcaacggaaggaatatacattattcatctactcaaggtagacgaataaagagaccaacataaaaaaaacatgtgtgaagaaataaatttgtgaccgtcatgaatcatgatcttgtgcaaaatttttacaatatatattagattaaaagataagatatgattgaaaatgatgtatactaaattagtgacatattctttcacaaaaaatttttggaatcccatattgagaaatattattaaaaaaaatgattaatacatttttcaagctttgtaataaaaaaatctaatcacgcttatcaagattctttctatatcgtcgactcttctttgtagtcacacttcaaattacattgtagtctcttattaataatttttgtagccacacttcaaattttttataatgaaaattagtgttgctagtcgttgcttttgatcgttgaaccagaaagtaagatcctctttctttaacccctcttaatctaaaaccattgctttctaacgcaagactcttttactcggataatttgtagttgactatgatggaagcaaacggtctggaaaaaccaaaggtggacgcaacaaaactcgggatggctctgcaaatagcatcaagacagatggaacaagactgagaatagctctgcagaagatgacgaagatgaattcaagcaggtcagaagtcgtaggaataagaaaaatgtgaaacccctaaggttcaagcacattgatgatactctctactacaaacaccaacacaagaacacttataatttggagatttcttagaatgcaaattgagattaattttcgacattacagattcaaaaatctttacttttttaggttgccgtcgctaatttcagtcgccagcaaaaaacaaacgaatatgatttaattattaaagaagtaaaaaaagatatttgattgaaaagtaaataaacaatgaatatcttacaagataacaaaagctacaaaacaaataatcttagtattttaaataaaatatcttacaagatttacttaaatatattgatttttatttactatttaggtatctctaactaaattaaacctagattttctttatcttcaaaatttattatcattaactatatatatattcaagaattaaatatattgaattataatattaacataaatacacctaaaattctagaaacttctttttaatatcaaatctggacaagagctatagttcataagtgtcacatggtccgaaacactccgaaccctagtaatacccacacgaacaacttgtcgagtgcgttaagatattcctttttctgatttacctttttaaccctggttaaaaagttcataggtcggtcaactaaaaaaggcaaccaagtcaaagaaaacaatttttactagttgagttcggaaataagaaaagtgaaaaccaaatcctaccttaaacagaatttaggaaaatattatatatttccttcttccacatcaccgatttataccaaaatcatataatcaaggaacctctctaaaaccctattaaatcttctctctttcgttcttcttcttcttctcctcctccatcctccaaatctcgatttcccaaaaaaaaaacctaatctcgccgtactctcctcggttccatctttctctgcggccaggttttttaattgatccgaattcagatttgttttttttttttgtgatctagggtttcggcgatttgattctgaattgctctgttttgtttttgtttgtttggtaatcagtacgtgtgcagatatg

SEQ ID NO: 24487 - DNA, 3003 bp, Unknown
  misc_feature (1)..( 3003): 2750-1469P.txt file - cDNA_ID_2177864; gDNA_ID_1971826; Annot_ID_176315
ggtttcttctggtttggatcttgttcttgtgatatgcatcttaaagagtttcccatttttttttggttttttggtttttcttgtaaggtgtagacacgtttgtaagtgtgtgtttatatatatgaagcatgttcgtgcttgcatgtgtattgttttgattcttgatgggtgaaaatgaagagttgagactctcacgttgtgaagctgtacttaaaatgtaaatctgtttgatcgtgatagttttgacacttctgtttttcttgagactcacgaaaatgcacatatgagaaaattggtttaaagtttggattattctattacaaactaatggaaattgattgcctacaaatggagacataagaaagagggaggaacatgggagggcactttctttgagcattttgctactttgactttcaagcgcaagctatttctttacaacgataaaacatattcatcgtatttttcttgtttatatatagatcttcgtcctttgccgcgactgcgatcgactgcgactaagtgttgttctgatcgggactattgaccaatattttaggttgctaatttttaacgatttctcgcgattggttacataatgactatacaaaacgaataatatagcaatcacaaaataaattaagatacaaaatctttagaataaacaagaaattaaattattatttttttataataagttttagaatagatataacaattatattttttattttaaaatataaattctcataaattaaaatcttcaaaacaataaagcgaccaatcacatcgattgttaaataaataacaaaacaagttgctggttgcttgtcggaatcgttggcaactagtaaacggaacatgaccctagttaaaaaccgaaatttatgtaaattttttgatatagctcttctcaattcagaatcgagttctttagatgtacctaactctcactattagtttacttctaagttggttccttgaatcttaatttgtctcttgtctcttatccaagagatagagaattcattaaaataagttatctttttgagattatttacttttttccaaaaagtgtcattttaaatgttcaatgcgaaattttagacaaaattttgtttcatattttatctattaagaagagagatgaaattatataatgtattaagaaagaatataaaataaattttaaatcatcttttttatgaaaacactgtaaaaatttataaatgcaacggaaggaatatacattattcatctactcaaggtagacgaataaagagaccaacataaaaaaaacatgtgtgaagaaataaatttgtgaccgtcatgaatcatgatcttgtgcaaaatttttacaatatatattagattaaaagataagatatgattgaaaatgatgtatactaaattagtgacatattctttcacaaaaaatttttggaatcccatattgagaaatattattaaaaaaaatgattaatacatttttcaagctttgtaataaaaaaatctaatcacgcttatcaagattctttctatatcgtcgactcttctttgtagtcacacttcaaattacattgtagtctcttattaataatttttgtagccacacttcaaattttttataatgaaaattagtgttgctagtcgttgcttttgatcgttgaaccagaaagtaagatcctctttctttaacccctcttaatctaaaaccattgctttctaacgcaagactcttttactcggataatttgtagttgactatgatggaagcaaacggtctggaaaaaccaaaggtggacgcaacaaaactcgggatggctctgcaaatagcatcaagacagatggaacaagactgagaatagctctgcagaagatgacgaagatgaattcaagcaggtcagaagtcgtaggaataagaaaaatgtgaaacccctaaggttcaagcacattgatgatactctctactacaaacaccaacacaagaacacttataatttggagatttcttagaatgcaaattgagattaattttcgacattacagattcaaaaatctttacttttttaggttgccgtcgctaatttcagtcgccagcaaaaaacaaacgaatatgatttaattattaaagaagtaaaaaaagatatttgattgaaaagtaaataaacaatgaatatcttacaagataacaaaagctacaaaacaaataatcttagtattttaaataaaatatcttacaagatttacttaaatatattgatttttatttactatttaggtatctctaactaaattaaacctagattttctttatcttcaaaatttattatcattaactatatatatattcaagaattaaatatattgaattataatattaacataaatacacctaaaattctagaaacttctttttaatatcaaatctggacaagagctatagttcataagtgtcacatggtccgaaacactccgaaccctagtaatacccacacgaacaacttgtcgagtgcgttaagatattcctttttctgatttacctttttaaccctggttaaaaagttcataggtcggtcaactaaaaaaggcaaccaagtcaaagaaaacaatttttactagttgagttcggaaataagaaaagtgaaaaccaaatcctaccttaaacagaatttaggaaaatattatatatttccttcttccacatcaccgatttataccaaaatcatataatcaaggaacctctctaaaaccctattaaatcttctctctttcgttcttcttcttcttctcctcctccatcctccaaatctcgatttcccaaaaaaaaaacctaatctcgccgtactctcctcggttccatctttctctgcggccaggttttttaattgatccgaattcagatttgttttttttttttgtgatctagggtttcggcgatttgattctgaattgctctgttttgtttttgtttgtttggtaatcagtacgtgtgcagatatg

SEQ ID NO: 24488 - DNA, 3000 bp, Unknown; identical to SEQ ID NO: 8679
  misc_feature (1)..( 3000): 2750-1469P.txt file - cDNA_ID_2177971; gDNA_ID_1971851; Annot_ID_176396

SEQ ID NO: 24489 - DNA, 3000 bp, Unknown; identical to SEQ ID NO: 8679
  misc_feature (1)..( 3000): 2750-1469P.txt file - cDNA_ID_2177971; gDNA_ID_2926180; Annot_ID_200152

SEQ ID NO: 24490 - DNA, 3000 bp, Unknown; identical to SEQ ID NO: 8682
  misc_feature (1)..( 3000): 2750-1469P.txt file - cDNA_ID_2177983; gDNA_ID_1971851; Annot_ID_176400

SEQ ID NO: 24491 - DNA, 3003 bp, Unknown
  misc_feature (1)..( 3003): 2750-1469P.txt file - cDNA_ID_2177993; gDNA_ID_1971851; Annot_ID_58415
gctaaagcagcctgttctttgtacattataaaccttaaaatctactaaacaagtactgatgaccccaaactatattagaaaatctgaagctacaaatttagaaagtattgaacaagaagtgttaccgcagtaagaggaagctcagggatgtcaaaccaagaaggcatcactgcaccatctgcacaagacaaattaagaggcaaaggcacaatatttagcaagtacataagatttctcatgaaaaagtatgaatctttactcaattttgtccactgcatttaccaatgagggaggatttagatgactaagccataatttgataaatgaatcacacatcaaagcactaaatccaaaagaaagacacactagtatcattcctatagtaaggactagacctaaaagttcgaattatttaggagaatgcaaatttgttcagctcaatcaattcaaaaacgatgatcaaagtcaacgcctagagaagaaagaaacgaacaacaccaaaatcagaaagtaaagggcaatcatacaattgcaagagactggatttggtggagcagaagggaagagccacttagtgtttctaaactcctgggacctgaaaagtgttttgatgggttcgttggcaggtccggaatcacctagcccgtgaagccataagatgaaggttcgagccatggagtctcggttccgtaaagcagaggtagatgatacgtcagatttgtttaggaagaagaatgcgaagaagaagacagagctcaatagtgcgatagtgagaagaacaatcggcttcttcagtctacttgttcgcatgccttcaccattttctctcgagatcgatctctcaaaaaatgttttgttttggagaatgtctaaatgactaaaatgccctcaatgttaaaagattatcaaatttgttggctatgttttatgttctcatgttcacactcaagattgcaaatgtattccaatgcttgcatatacataattcaaatcgatacaatcatactagaaggacacagcaaacaaaaccatacgaggagcttagaattgtcaatcttcttcttcttgtcttcatagacgacatgtaggtattattattaccttcagtggaacatttctttaagacaattaagttggagacaagtagacgacgaacctttcaaccgtctcttgatccatgactctatatacttcagctccttattgctgatcgagtgcccgagaccaggatatgcctgcagataaacaaatcaccttagaagtataaataattgtacattggagttctatcatgcatttgtctcgaaaaagagttttgatttgaatataccttgaattcacaggtaacaccggcttctttgagaaaaggaagagcagcttgaccagcttcaaagagtaccattctgtcatcagtgccatgagaccacaagattggtgtctgcatattgcaaagtctgaagactcagaaacacaaaaacattgatcaacgtttataagaaaacataagtgaggaaccttcttagcctcttcgggaaactgactgatgattgaagaagtgaatggaacccatccacttaggacggcacctcctccaagagtttttgggtaaagcagaacactagccaaggttaatgctcctacaagaaaattcttattaggcgccacaatgcaaggttcttaagacataagtggattcagaccgatataaaaaggtctctctacaaagaatattgaaaagacaaagaattcatgaaaagagaaacaacctccttggcttaatccacagataaacacgttttctggattagttccttctgcaatctcctggtctataatggcatgaacattcttaactgcttcaagcacgctgctttcatcaattggagagccctaacatacataaaagttgcacacttattgtgatttcataaaatctcttgaaaatgcaagagtgctctgctctttacacaatctgctgaacaagtgttgattctagataatgcgtcataaggtttaacaaaccaaaaggtgctaacttggagctaccagcccattaactatttgccaattcatactataagaggcgttagatagatcaagagtgaagtgaagtaataccactttaaaaggaagttcaggaacgtcaaaccaagaacgcatcaccgcaccatctgcacaagaaagtatagaaagacataagcttttttcagacacatatggattaagagacatgacaccaacagataccacagagaaatcaaagataatcaaattgtgtacatttgactaaatgtctttcaaattaacagaatgtgacaaatctccttcacatcacagaggcaaataataacgctaaatcaaaatggcatgaagtggagaccgaaccctgtagcccaaatcaaaccataaaccatgaacaacgaaatcaatgaatgcaaatcgaaaatagaaaaggaagaacgtactgttgcaggtaaccggattgaatggagcagaagggaagagccaactagcgttacttaactccgaggatttgaattgagtttggatgggttcattagcaggtccagaatctcccaacccgtgaagccacaagatgaaagttcgagccatcgtgcttgagttccgtgaagaagaagaaagaaagataaagaagatgaaaagtgctcactatcgataggcttcgtctgtgtattccttcgcatgttaaaatcgcctgaaactttgccatttcaatggcgattttgtctctcaaagtcttcgcgacgactttcaaagtagaaactacaaagtccactaggacaagagtgaaaagtaccaaaataccctcggttgtcgttttatgtccgaaacgacatcgtacatagctgcagcccttttttgttagtgttttaagccagacagggagagagaagggagaagaatctcgcgagagacagaaagggacgattattggttggtgaaatttagagcatttttgggaattgggtaaacttttcgatg

SEQ ID NO: 24492 - DNA, 3003 bp, Unknown; identical to SEQ ID NO: 24491
  misc_feature (1)..( 3003): 2750-1469P.txt file - cDNA_ID_2177993; gDNA_ID_2926180; Annot_ID_140500

SEQ ID NO: 24493 - DNA, 3000 bp, Unknown; identical to SEQ ID NO: 8687
  misc_feature (1)..( 3000): 2750-1469P.txt file - cDNA_ID_2178004; gDNA_ID_1971851; Annot_ID_176408

SEQ ID NO: 24494 - DNA, 3000 bp, Unknown; identical to SEQ ID NO: 8687
  misc_feature (1)..( 3000): 2750-1469P.txt file - cDNA_ID_2178004; gDNA_ID_2926180; Annot_ID_200162

SEQ ID NO: 24495 - DNA, 3003 bp, Unknown; identical to SEQ ID NO: 20423
  misc_feature (1)..( 3003): 2750-1469P.txt file - cDNA_ID_2178054; gDNA_ID_2096290; Annot_ID_195345

SEQ ID NO: 24496 - DNA, 404 bp, Unknown; identical to SEQ ID NO: 4843
  misc_feature (1)..( 404): 2750-1469P.txt file - cDNA_ID_2178054; gDNA_ID_1620735; Annot_ID_166225

SEQ ID NO: 24497 - DNA, 3003 bp, Unknown; identical to SEQ ID NO: 20423
  misc_feature (1)..( 3003): 2750-1469P.txt file - cDNA_ID_2178054; gDNA_ID_2926170; Annot_ID_199416

SEQ ID NO: 24498 - DNA, 3000 bp, Unknown; identical to SEQ ID NO: 8721
  misc_feature (1)..( 3000): 2750-1469P.txt file - cDNA_ID_2178077; gDNA_ID_1971868; Annot_ID_176524

SEQ ID NO: 24499 - DNA, 3000 bp, Unknown; identical to SEQ ID NO: 8721
  misc_feature (1)..( 3000): 2750-1469P.txt file - cDNA_ID_2178077; gDNA_ID_2926209; Annot_ID_202475

SEQ ID NO: 24500 - DNA, 3003 bp, Unknown
  misc_feature (1)..( 3003): 2750-1469P.txt file - cDNA_ID_2178096; gDNA_ID_2096290; Annot_ID_195335
tcactacagaagttagttctttgatactagtaagaagatgtgaacctttcggacaacgatgtaatctcctttgtccaagtctaactctttctctgaagcagcggaaaatggatgaatcacctgcgagagaacatatatgttgcttatggagagtctttttctttctgtgagatatgcgaggataatattacggaagataaaacttacttcagcaagaaagtatgacgttttctctgagccgttctctgttggaatcgcaggaggagcagattctttgtgttgtttctcggttaccatctacgcggtaagaccaaaagtgtgagcctttgatgagaaaaagatgtgggaaagattcatccaatactaacgtcggcttcaatgtcactgaggatggctgctattcttaagtgataattcttctccccttcaacctagaataagcgataaggtaaatagtaatctgcatatgacaaaaaaatccagtgtgtgtgtatgtaaaacataccatagccacaagcctctggaaagtgagtctatgttgctgtgattcaacagcggctaatgcagcagttgcttctttaccaaggactgccatatttgcttttagctcttgcatttttgcttccgctagttgaagctttgctacgttttctggaatcggagcttctcttacacgtgcttgccgtctagagacttccgttgcctgttttgcttttaagttttaacttacattacaaaataaaatagccagcatcctcatataactaagatcttaagatgattacatgtgtctctgcttcctgtctcatgcggctgtaacgttgagcaagatgacgagcatcttcaagaggagaaccggcaaccatagctcttagaggatccaaaaccttaacggcatttaacaaaaaggttttctcttgttatctactagatttaattctacgtaaacatactaagattaaacacagataatccaagccgaacctgagaagccaaaagcttgttgaagtcttcttgttctttgtctacatgtttccgtgcatcaccgtatatagctgcagccttggccagtatattctcatcaatgttctgactattttcgttcccatacctacaacagtcttcagacaacttggttcctgaaattttaaagaatattaaaagaaaactcacaaaagtatcatagtataacttaattcaatgataggtaacacaaaacagacactcataagtagttaagtacctgcttcaatgtgtctgagcccgatcgtggtaaatgcctcagctgctttaacaatatctctctggaactcctgaaagtgacaataacatatgtttgagggtattgtgctacgatgaatcatactgataccttctcccccaacaatgaactcatataaaatgtgacaatgccattaggtcaatatcagtcaaacctttgcagaacgagtagagcggtaaagtttatcgagttgatgatgcctttgcatttcaagctcatcaatcaccattacatctgagctttcataaccagtcccactgaattgctttatcacagcctacattccccattaccacacatcaatcaacacatcatcacaaccaagattgtgtaactctataatactcaataatatacaaatcaaaacccatcaaaaagtttccattttttttaatccaaattagcaacaaagaacctaaattgagcttcgtttcgctgaatcggtaacagtgaaactagttgcggcgatgaaaaggaattaccagttgctgctttgcgacttggtctctaagcttactcgcttgtcttctaaacgcatccattgtcacttctcctcttgatttccccaaattgattcagagataccaaaaagagacaagctttaaaggattttgagtggaattgagaaatctcaattagatcagaacagtttaaaaactgacaaagcagatcagatctgattcagtagaaatgtatgttcttcttcgactcgatgtgtcactgattatccctctgagaaaatcagtcaatcacagagcacacacatcgatctaagcgggtcgggtcgattcgattgattgaaccaaaccggtccggtccggtctgattaaaaggagcgttcgcgattgaattatttggaagcagacgaggcttttctactaaaaaccttacgttacgacttacgattattattgagtaattaattaaaattagctaaatccgtttggcataaactgagattaagttaattaaaacttaaaagtataggtattaacaaaaaaactgacatggacaactcataaccacttgttatttgtccccactcctcccatatcattttgtcctaactgccattacataattataatctgaaaagacaacctatatactttttcttttattttattattaacgttgcctttctcagtatagtatagattcctactctaccgacttaaaatttcagtgagatatttcattaaattccatgttcttaaaacagggttctattgttgatgtaaacttaaatcaaattatagtcaaccaaaagacaaatgtatattggtatctaaagtactgaatgacaacatttttttgttttaatttatctataacacaatcaagttgtaaagatgattttgtttgaacaaactttacaaaaataatctctatccattatactatttcgttaatagctaaattagtaaaccaaacgcggaaaataaacgaaacaaacgcggaaacaaaattacaagaagatcaattagtgattttacagttaaaaaaaagcaataaaactcagaaaccctttcacatgtatgtataagaagaatctaaaactttcccacttccaccaatttgagttttgaaacatttacggctcgacagaaaagaagacgccattatattttaacagagagaaatcaaagagacaaaagccacgatccgccatagctgtttttgagatcgatccccaccaaaggagcctagcctaaatcatg

SEQ ID NO: 24501 - DNA, 3000 bp, Unknown; identical to SEQ ID NO: 8701
  misc_feature (1)..( 3000): 2750-1469P.txt file - cDNA_ID_2178122; gDNA_ID_1971862; Annot_ID_176439

SEQ ID NO: 24502 - DNA, 3003 bp, Unknown
  misc_feature (1)..( 3003): 2750-1469P.txt file - cDNA_ID_2178224; gDNA_ID_1971869; Annot_ID_176543
tcattgacaattcccagaggaaagaagtttggtaaccgctgtcgagctagattccggatccttggatcactatgcaagaagaaacgatgagatggaggagaagggtgggaaaaatcgtggaatagctcagtttgctgaaagccagtcaagttatgatttccgctattgctactacttgccacagcactgctttgtttctgagctgtgctagtcgtcttgatggagataaaatagtcctgacaaacatcatcgaaagctggtgtctgaatcttggaacttgccggggaaaaatctttccacagatctttaatacaggggatagatccaggttcctttctcttcggtttacttgcaatagatggttgattctttgagaatgaatcatgttttttagttgctccgcttaaatctctgctggtggatggatggtcatcttcagaatctgaatctagtagctggaaccttcgtagaggactacgacttgacatctgaaacaacgatgcaacagaactaatcccagaggcagcagatgcttgaacatccgactgctttctttttccccgagagatagaaggttgattagataaaaccccagaaccatgaagtggcacccttgagctgcaactagaaaaatgacttcttgttgaggccggtgcgtctgcatgaagcaacacaagttttataccaagatgaaaccaacacaatatggatgacttaaaatattacactaaagaaatccaaaagaaaccagtttgagtggaatgaagcttaatcaatgtccttataaataacaaattctcagcctgaaggctccaaacccactctagtctacctattagtgtcaacaactgcaatcaagttttcatctttgagccacaacaaactgatcctgatatctaaatagaagagggtttgcatcaggcttcctaaatccatcagttttaagttctctatgataaactaagggatggtctttctatcaatgtgttcacgatccaagacgcctaatgaatgaaagataggctaatcagctcattgacgtttaataagagatctaacaatgctcgattcctattccagcagtttaagtaagacccatattcgaaaagacgaagcagaagctcaaaattgtaattacccgtaggaaaatcctcaggagaagagaactcttcaatgtcatcatcccgatcctctacagctacgcttctatcatctttcacagaacacttgttgggattaatccctcgtcgcaaccgcttgagaaccgggcttgtaaaatctggttcaagctcccgatcggaatctgagacagtaagtcccaactctggctcgttatcgccgtccccgattaattggtcgccggtggagctagggttttgatggatttccgattggagatccgatgcagcatcaagatcaaaccctagcgaaaacgatggtggctcaatcgaatccatgagaatgaatttagggtttggactaggagatgaagagacttcaaagacatggaattggcgccttggtgtgccgaagaagcttgagatttcgtaaaaattccccgcctagcgcacaatccatgattttaaaaaaatttcaagtgattctcaatttctcatgtattaattttcgtcgggatatttaccgccgcagaaaataattattttggaaagaaaaaaaatcagaatgggccgtgaaatttcaaagttggataaagcccataatttaatttggtgaacggtcttcttttttttttttcccggcaaataatttcattgatatcaaactgaaattacaaagtcagtatacagaacattagaaaacaaattattacataagcagatatatgcgccatgtagtgagaaagatgcacaattgggaagtgaatttgacgatgctttccttagagaagccttattcgctaatgaatcattagattcactattttccttctccatttctgatcttcctctaatgcgaaatgtatgcatccatctactctaatgttgttcttaattgtataatcaactaatcttttttttttattcggatttataaattctgatgatgatgacatattgacaacacttttattattcgattacaaatactaatttcaattaattatttacaaaatttcaaaatcatgttaaatattttgtaatgtataaatacattatacatatcgattacaatttttttattattgtttatttctatatctattgcaataatatgttttaagacaaaaattggacatatggaagttcttaattcacgagttattcattacaccgaaaataaatttgattggtgacacgatcacggtattactaatttgacatatgaacacattttatcataattgttcacacttaacgagtgctcgaactcgaattaccaaagacatcattggccttaaaaagtgtaaaataaagatgttttaattacgaatccaatgtcatcttttatttttgtatcttgtttttgttggtcgactttgtcatttatttttgttttatcttcattcattgcttataagttaaggcttgtcctccattttttgtcatttgctctcgtgacagcatctcgattcaccgtttttactttttctctaactttctatttttatttatatcattttacttcttcaactttattttttcatttttttgttagtcattcttggattagtgttttctttcattcttggaccatactaatattcagataatacttcatacattgcaaaaaaacaaaaataaataaaccaaaattcataaggtatcataagaaatcaattataagaaaaaacaaaaatcattggacaagacaacagactgaattatcgttttatccttttaaaatgaaaatcaacacattcatacgagatatggtaaggacaatttagtcatttagacacgtgtcgtgcccgcgtcgcaaaagcctataaagaatccatttaccttttctcactgaatctgaaagaaaaagctcgcagagatg

SEQ ID NO: 24503 - DNA, 3000 bp, Unknown; identical to SEQ ID NO: 8731
  misc_feature (1)..( 3000): 2750-1469P.txt file - cDNA_ID_2178264; gDNA_ID_1971869; Annot_ID_176552

SEQ ID NO: 24504 - DNA, 3003 bp, Unknown
  misc_feature (1)..( 3003): 2750-1469P.txt file - cDNA_ID_2178466; gDNA_ID_1971874; Annot_ID_176671
ggccgtctcatgtggtagaccttacttcagtgtgactgtgctgatgaaagagcatgtgcctctattaatgacatatatataaattatacatatggttctcgtaactaattctataacataacacaaatacaattcgaaaatttgtttgtaggtcacgcaattaagaaattaaaacctaataaatgcttagtgggaggaatccccatcagcaagaaaactcaaaatcatcaacaaaaaaaaggagagattattcataaaatttgtttgataaaaacagatatgaataagtagctttagtaatgctataaatctgtaactcctagtcttgtttgtaatgttataattatggtgcaagagaaaatatgttttagatattcaaaatcagattgatgaactattacatttacagtttaccagctcaaacacgttttagatcaaccgctaataaaaactggtcaaaatataacacctaatcacaaaagcatcataagtatgtcataagcgaccaaaatcaacttaataaaaaaacaaagtggtaaaacactagggcctgataacttgtatagctgtcttgtacagtgtaataatcatcatatatattctcttcttaagtctaatgggttattcaacatttatccaccatctatttcagattaattaatagctgccgtcaaaaataaaaaggataataataatgttgtgatataagatattatagaatatatattttaatataataatattttatgttcgtaaaatagaaacttcccatgtgattttcttctctcaccgccggttacggttattgtctttttcttagacttgaaaatattaaatctttttgttatggaattttactacacagcttgtattcatatagttttgggttaatagttaaaacataaaacatatatcgtgattatagtttactcacattttacatgttgttacactgtcgatatctatcaaatatattactgttgtaatttcttttcaaaaatactgttctaatttaatcctgcatccaacaaactttttgaccagagagaaccaatatatatatcagtatgtctataaaaaaatatgataattgtgaaaatgagatccatatttttgattatatatataagtgaaatagatttgatttgatttactttgcaacgtcttgtgacacaagcatgacataatcgaacccatctaacaataacatgcagtatatcgttgagcttctagcaaaatcaacaaaaatctaaaatcttttagtaaaataatattaaaccttttatcattaagaatttttttaaaattaacaataaacccatgacatttgtctaatctgccatagagttgaggtgggacttctaacatgctctattatctcttgtactccgttgatcatcgatgataaatcacaagctaaatgtttgtgaataagtgaaaatttatcttggaaatgaaaaattatccaaatcaaagggttacagtaactggataattcatttaacactttgaatcaacaagatcaaataaaaaaagttggaagacagtgaagcgacaacatagtccattactttgagttaaagtaatattataatttagtaaagttgatctaattacatttttataagtttaatctggtcatcgctggaccaagttgtcatcctccaaattccttaccaatcatacaaattgatttttggccttttcttggaatcatctcttttttttctttgtgtttttcttctcattcattttgtttttctttaatacacacacatgcatgtataaacgcagttttatgactggacatatcgcgtaagatccataagccaatagctttttttaagtaaagtattttcattttatgggtataattataaagatgtaaatttccccaaaataatataaacagcagtctctctcctacttaatcaaatcactagacgcggatttgcttaacaaagtaactttaaaccaaatcgttccacctaaaaggctaaaaccattaggattgattttggtcaaaaaaatcggttactattttttaatttacttagaagactggcaaaaaaaaatgattccaaactactaacatataagataaaatgtatttaacatcaaattaaaattttcacgttaactaatataaaaaaatgatatgaaagaaaacccaactaatctttgattatatgcgttagccttcttcattagccttctttaaatactagattagtacttgataaacttttattgtctatacaatatatcaaaaaaaatgcctctaaattaactacataaattagtaatttctgaaaattaataaaaaaaacacgtaaccataacttccgagtatgtttactttaataattttcacgggattctgaactctaaataaagattgattgataaaaaaatattaaaataaaattcacgggatttacaaattagttatcatttgaatcatttgttatagaatctaaaataaaatagtaaattgatcatatagtaagaaatcaaattttctttttttgtcataaataaatataatttgttctttagttatgcacgctggaaatagatcccactaataaaaattggacttttcaaacaaagaaaataattaaataaaatcttcctttacaaaaacaaaagaggaaaattcaaagaaaggagaactctcttcttcttcttcttcttctcctctcctctttatttacttagttggttcacttcagcacatgatcctcgtctctctttctttctctctctcaatcacaagtttcagttacacagctgaacccaaagtatctcacattctgatctaatcagaacactgttttgtctgtgtaacataaacaaacgatcctgtttttatggaaaatttaatgaaacagtgacgattcttctacacttctttataatgacaaacatttcatagtaccaaaatacacaaataccttttctttattcttctcacccttctctgtttctttatcattcatg

SEQ ID NO: 24505 - DNA, 3003 bp, Unknown
  misc_feature (1)..( 3003): 2750-1469P.txt file - cDNA_ID_2178493; gDNA_ID_2685559; Annot_ID_193430
atgcacacaaacctttaatgtctctgtggatctttccctcattatgcagatattcaacagcatgaagcaaatcgcgtgtgatacaagcgattgatgtttcatccaacggattattagattgaagctgcaaaagatatatcagtttaaggattataagttgcatcaaagagaatataagtgcaggacaagatctccaccatgcgtgcatgatcacacacaaagttatacttccaaattccaagagttctgagctacaaagtagtgagttaacatacaagatcagcaacagagccaccggccatatattccatgatgatccacaacttggtctgatgaaggtaagaaccatagtattcggtgatatatgggcaacgacattgtgacaatactgaaatttcctggggtcaacaacaaaaactgagcatgacaatcgccacacaaaaatataaagcacagaaataaacgtcaataagaaataccttctgaatatcttcgatctcatcttctctgccagatatcaagtaaaaaggttagttagaaaattactgagcctgatggtattctcaaccaaaaatcctattcgtatagtggaaagccaaggaaaggttactgtcccttagcctttgagaaccgtgaacaagtaacattcatagaatcataattgtagttactcaacttataagacgataaacgttatacaactcaaaatcttaagaggagaattgcatatatgatgagaaaatactaaaataaaaaatatactcacgattcttccaggtcgattactttaatggcaacttctttattgaggtccttatcaaacctgataagcagcagcagtagttgttcagaatacaggtaagatagacctcttatacaaatgttcagaatagcataattctaatcagatatattatatacgagtataatggacgaacagaaaataaaaaaaagtcaagagtgtgataaatacttacgctttatagacatcaccaaaagagcctcttccaatcaactcaatctggctaaatctggctccagctgcctcttgtaaacccgcaacatcgtccatctccacatacaaggaaaaaccaccttctctcccgctccaaccactatattacgaagataacaacagagtcagaacaaactataatactttttaccactccctccccttttcattacatctaaactctcccctcataaataagtacccagaagaaagcaccaaacttaaactaaatcccttatactcaaagcaaacaaaatcagcaaaaaagttaggtggattggagcaagtgacagctgaccaataaaaatttgcaagtagccgagaatattcgtcactctaggacactgaagagaaacatcttcactgatgtttttctcccgttcgatcaaaatcagacttaaacgaaaataatcataatcaaattctctaaagttcaagggatcgatccaaattacctggtaattcgacagagaagacgaaatgggatactacagatctctctgttgctctttcctttcgtttgctatgtcattttgccagaaagcactctctcgagcaccaaagagatcgacagaaactgtttgggagatgaagtcgaatttatttttcatgttgtttttccttccaagtttcattatggaaaccatttgttacgaagaacaacccaacccaactgttaaaagcactaaaagcccaataagctttgaagctcatttaacggcccatatactaggaagtagaactagaaaccaaccattgtttcggcctttgcagcaattaacatgatctcatattcgactttctttacccacaaattgtttttctttttcctaataaacggtgggtcccgcaaaagaaaaattgtaagtaaagaacagagccggtcaatgcggagctaagactcgtcagggtttcagactgatgcaatccagaccaactctctgttactcctgtcctatttttttaagtttacgtcactcacacttctcactcgccaccctttggtgtattcatcagacgattttgtttcttcttcctggtttgtctctgtgtttctatgcgtagtttatacgcgccacgaggtcaaaaccagacgctgggtcatggttgatgacaaagccactcgagtcttacacacggcacgtgcacacgtgactcctaaatctcttcttcctatatattctctttgtcgtgcccccttaatttgcgtgcgtgtcacacccgtagtaatatgaatcttggtcctaaaccgaatcccaagtttgacgacaactaaataaaagcctttttcttcttaagaaaaaacactttcacatttcatggttttaattgtatcactagagttatatataatactaaaactaaaagactgtgttttttagtggataaaaatgtcgactgactaattatgtcattgtaattgtatctttaatcataacaacaacagtttatccactcgaaaccatatgattatttctctttcagaaaagcaatatgaagtatagaaaatcaatggttgataattggattccattcaaacaaatataaagcgaactaaaatgattttttcaggaagattttcaagtatctttgactttcttggcctaagagataaaaaacttttacatgcaaaaaactttaaccttgtgttcaattggttctctgataattaattatatattacttattgttaactataccaaaccccaagaaattcgtatccttgccacaagattgtaagattttatcaaaaaagtaataagaactaaaatagcatattattgtgtagacaaacagtaaatgttggtttggtaatcatataattagtctaaattagaaaaaaaaattataaacattgaaaataaaagaaatttagaacataaaagagtccatgagaagcttgagcaaggaaggcagcaaagaaaacctagaaggccaaaactagaggagaaacccatataacacacaccgacatattcatatagatg

SEQ ID NO: 24506 - DNA, 3003 bp, Unknown
  misc_feature (1)..( 3003): 2750-1469P.txt file - cDNA_ID_2178493; gDNA_ID_2685559; Annot_ID_138158
tacgagtataatggacgaacagaaaataaaaaaaagtcaagagtgtgataaatacttacgctttatagacatcaccaaaagagcctcttccaatcaactcaatctggctaaatctggctccagctgcctcttgtaaacccgcaacatcgtccatctccacatacaaggaaaaaccaccttctctcccgctccaaccactatattacgaagataacaacagagtcagaacaaactataatactttttaccactccctccccttttcattacatctaaactctcccctcataaataagtacccagaagaaagcaccaaacttaaactaaatcccttatactcaaagcaaacaaaatcagcaaaaaagttaggtggattggagcaagtgacagctgaccaataaaaatttgcaagtagccgagaatattcgtcactctaggacactgaagagaaacatcttcactgatgtttttctcccgttcgatcaaaatcagacttaaacgaaaataatcataatcaaattctctaaagttcaagggatcgatccaaattacctggtaattcgacagagaagacgaaatgggatactacagatctctctgttgctctttcctttcgtttgctatgtcattttgccagaaagcactctctcgagcaccaaagagatcgacagaaactgtttgggagatgaagtcgaatttatttttcatgttgtttttccttccaagtttcattatggaaaccatttgttacgaagaacaacccaacccaactgttaaaagcactaaaagcccaataagctttgaagctcatttaacggcccatatactaggaagtagaactagaaaccaaccattgtttcggcctttgcagcaattaacatgatctcatattcgactttctttacccacaaattgtttttctttttcctaataaacggtgggtcccgcaaaagaaaaattgtaagtaaagaacagagccggtcaatgcggagctaagactcgtcagggtttcagactgatgcaatccagaccaactctctgttactcctgtcctatttttttaagtttacgtcactcacacttctcactcgccaccctttggtgtattcatcagacgattttgtttcttcttcctggtttgtctctgtgtttctatgcgtagtttatacgcgccacgaggtcaaaaccagacgctgggtcatggttgatgacaaagccactcgagtcttacacacggcacgtgcacacgtgactcctaaatctcttcttcctatatattctctttgtcgtgcccccttaatttgcgtgcgtgtcacacccgtagtaatatgaatcttggtcctaaaccgaatcccaagtttgacgacaactaaataaaagcctttttcttcttaagaaaaaacactttcacatttcatggttttaattgtatcactagagttatatataatactaaaactaaaagactgtgttttttagtggataaaaatgtcgactgactaattatgtcattgtaattgtatctttaatcataacaacaacagtttatccactcgaaaccatatgattatttctctttcagaaaagcaatatgaagtatagaaaatcaatggttgataattggattccattcaaacaaatataaagcgaactaaaatgattttttcaggaagattttcaagtatctttgactttcttggcctaagagataaaaaacttttacatgcaaaaaactttaaccttgtgttcaattggttctctgataattaattatatattacttattgttaactataccaaaccccaagaaattcgtatccttgccacaagattgtaagattttatcaaaaaagtaataagaactaaaatagcatattattgtgtagacaaacagtaaatgttggtttggtaatcatataattagtctaaattagaaaaaaaaattataaacattgaaaataaaagaaatttagaacataaaagagtccatgagaagcttgagcaaggaaggcagcaaagaaaacctagaaggccaaaactagaggagaaacccatataacacacaccgacatattcatatagatggtgggctcggaacatcatcaccatcatcaacaacatcatcatcaaaaccatcagcagcagcaacaaaggagcaaagaagctttagggatggtggctctccacgacgccctgagaactgtttgtctcaacaccgactggacttactctgtcttctggtccatccgtccccgtccgtacgtatctctctcctcagctcctctcttttttttttattgacatgatctatctatctctcctcaaaacgatgtcttttttgttcttcaggagagttcgaggcggtggcaacggctgcaaagttggcgacgacaatggaagcttgtaagttacacttcttacaaaaaaaaattaggttacccgtatagtcaagagacttagcgtactatagttagtctttatgaaacatgattaaaaagtcaacattttcccttatggtttatcgtattatagtcaccggaaactttccccggaaagaaactaactagacagactagtattagtactctaggcttgaattaacaaaacaaaacaaaaatccaaaaaatgttgcatggagatcctagacatgatcatgatcacgtagctctatgcatctatatatatgcgatgagactgtatctaccattcgtttaagttgtgaatcatgatttgctggaaaaaaacacatcaagtcatctcttttagatgatcttgtctaataaccattgcttcctttaattaataaataaattaatgaaaatgaaaatgaatgatttatgatgagtagatttacaaatatgcgctacgtattgatatattgatgtttggggctacaggatgttgatgtgggaagatggatactgcagaggaagaggaggaacagaaggttgctatggagacatggaaggagaagatcctgttcgtaaatctttcagcaagatg

SEQ ID NO: 24507 - DNA, 3003 bp, Unknown; identical to SEQ ID NO: 24505
  misc_feature (1)..( 3003): 2750-1469P.txt file - cDNA_ID_2178493; gDNA_ID_1971872; Annot_ID_176613

SEQ ID NO: 24508 - DNA, 3003 bp, Unknown
  misc_feature (1)..( 3003): 2750-1469P.txt file - cDNA_ID_2178537; gDNA_ID_2685559; Annot_ID_193441
tgttggaaaaaaaatgcaggaattattcaaaaatttccgtatttattaaagtatcttgaaaatgttttgatgataaaaatgaaacatttagtttaaataaatttacatgtcctgatatatattaaaattctattttgaaaagtacaaaaccatatcttcatatcttgtcggatagatggtttgtaatccgccgacattgcaacttaaatttaaatagaaattattaaactaaatagaatgttttaacgataaaaatgaaacatctagtttaaaataaatttacgcgtcacgatatatatcaaaactacatttcgaaaaggacaaaaccgtatctctgtatcttgtcagatagatggtttatacttcgacaacatcacgacacaaaaaattaaatgtaagttataatgccaaactagcacaattgacacatttgaactagccatttggaaaattccgttatttgatacgagctataatttatgagaatccgacaaaaacgatttcattaaaaaagaattatagaatatagtttatagtccgaaaacatagcgacacgtaaaattaaatggaagttataacttcaaactaacacaattaacatatttgaatcagccactgaaataattcgttatctaaatgcgaactactccctccgtcccataaagataaattttttaggaaaaatatttgtcccacaaagatagaagttttatatttccaatgcaaatttttaaactgttttcccgttttacccttagataaatatttattattatttttaaagtatattaagaggttaaaattgtctttatacaatatttcttaaagaatgtgaaatttaaaaaaaattcatcttagtgggacggagagagtataatttatgagagtccgaaccgtttttcactaaaaattaaattatagaacaaaaaaagggcacatttctcttttgtatacatacatattactttttgactttgaaggatttttttttccacagattttgaaggatattatgacctaacatttaagcatgtatatgtcccgccacactgtcttttgaaaaagaaagggattgaaagtctagtttgttgggcttcagtcgacgtcaagaaatacactgttaaagcccatcaaatctcaacagtgaccgatctcgtgatagaacaaagttacccagagtcactgaaagcccatcaaatctcaacagtgatcgatctcgtgaccactccacgcgcttgttggcaactgtcaacacgtaattagcgcaacatacaataactttaagattataaagtcgtattcgaatgccaataatattcaagctactcatgtgtatgaaaccaaagatttctcgagactcctgctgtggacctcacttaaaataattgaaagcaacgattctcgtataataataattttcaaattttacgaatttctatgactatgactatattgtcttttcgttaaataaaaaaaaaatcgtctttaactctttacaatttttgttttaaaagattcgagtgaaaatacagttacattaccataaattcgtcaagagagcatctttttaagaaatgtaataaattatggtaagtgtatgtaataaagaagtatgttgatgttgctatcaacattaccatacgtgtctgttactatactagccccaatgactacgcaatagatatgtttttttcgaataaggacaagagctcgtaatcagctacacgcacgtccacatatatacttcaatttcatccattggatctgattatgattacgttttaaccattggatttattaatcatacaggtcttaacataaacgagaagtaggtaataaatactagaagctaccccagtatcttaaaactctgaaaacgtgtcagccaaacggtttctttttaacacttcgtgtaattaattaatgggattgaaaacttacttattaaaaatcgttatagattccagaaataaaggaacagagagacacacacaagataaaaaaaaaagtaacgaaattgagagctgaatgaaaccaaagatttggaatttttctttgtatagtttttccacgaatcggagtatcacacacggtcttggaattttccagcttaatttctaagatttaaaatcgtaatttttatttggaatttcactgtctcttcatgttgtctatataacttttactcggaaacaggagtgtcccgtgttcttgagcacaaacaaagtagcagaacaaagcatatacaaaagcttcattgcctcgagattaaacagcatcaagacaacatccaaaaattacccaggtttcttcattttcttaatatatcgtttttgtttctggatctcctttctaaatctgtagattcaggcgtgtgtagatttagtttttttgttattgtttggatgagtaaagtatgttctacaatgcactagatctaaatctcttcgagattctgatggtgtgttggtgttgtattaaattgattttggggataatctacgacaagggtttcttttaatgttccttaggaaaatggtaatgtaacgtttaaagggttttaagagttgcttaatatagctgttgagatgtctgattgattatgaatcccgatccaagagtttttttatgaatagaagagccatgtcgttcttgattgaattaatcttaatcatactgtttcgtaattcttaaactttgagcttgatgttgcgtgagaatctgggaactttaaatgtgtcggctgggttctctagtttgcttcttctttctgtatttggctctgagaaacttactagagctctaacatttgtgcttgctgataggtttttgtgtttgaaactcgaagattgttgcggattcctgaaagattaaggcttttagctccaagtttccaagagtgctgtgaatcagctcccactctgtctctgcatattgcaagacaccggttttgtttcagaagtttgtttcttcttgtctcatgatcactagttttcagcaatg

SEQ ID NO: 24509 - DNA, 3003 bp, Unknown; identical to SEQ ID NO: 24508
  misc_feature (1)..( 3003): 2750-1469P.txt file - cDNA_ID_2178537; gDNA_ID_2685559; Annot_ID_138169

SEQ ID NO: 24510 - DNA, 3003 bp, Unknown; identical to SEQ ID NO: 24508
  misc_feature (1)..( 3003): 2750-1469P.txt file - cDNA_ID_2178537; gDNA_ID_1971872; Annot_ID_176626

SEQ ID NO: 24511 - DNA, 3000 bp, Unknown; identical to SEQ ID NO: 8742
  misc_feature (1)..( 3000): 2750-1469P.txt file - cDNA_ID_2178541; gDNA_ID_2685559; Annot_ID_193442

SEQ ID NO: 24512 - DNA, 3000 bp, Unknown; identical to SEQ ID NO: 8742
  misc_feature (1)..( 3000): 2750-1469P.txt file - cDNA_ID_2178541; gDNA_ID_1971872; Annot_ID_176627

SEQ ID NO: 24513 - DNA, 3000 bp, Unknown; identical to SEQ ID NO: 8741
  misc_feature (1)..( 3000): 2750-1469P.txt file - cDNA_ID_2178556; gDNA_ID_2685559; Annot_ID_193446

SEQ ID NO: 24514 - DNA, 3000 bp, Unknown; identical to SEQ ID NO: 8741
  misc_feature (1)..( 3000): 2750-1469P.txt file - cDNA_ID_2178556; gDNA_ID_1971872; Annot_ID_176631

SEQ ID NO: 24515 - DNA, 784 bp, Unknown; identical to SEQ ID NO: 8759
  misc_feature (1)..( 784): 2750-1469P.txt file - cDNA_ID_2178622; gDNA_ID_1971876; Annot_ID_176713

SEQ ID NO: 24516 - DNA, 3000 bp, Unknown; identical to SEQ ID NO: 8760
  misc_feature (1)..( 3000): 2750-1469P.txt file - cDNA_ID_2178639; gDNA_ID_1971876; Annot_ID_176719

SEQ ID NO: 24517 - DNA, 1008 bp, Unknown; identical to SEQ ID NO: 562
  misc_feature (1)..( 1008): 2750-1469P.txt file - cDNA_ID_2178651; gDNA_ID_1591961; Annot_ID_151760
  misc_feature (9)..(9): n is a, c, g, or t
  misc_feature (18)..(18): n is a, c, g, or t

SEQ ID NO: 24518 - DNA, 3003 bp, Unknown
  misc_feature (1)..( 3003): 2750-1469P.txt file - cDNA_ID_2178651; gDNA_ID_1971876; Annot_ID_176722
atccgatatattctgaagaagcaagaagatggattgtggaaattctgccaaagcgatattcaaatacagaagtgaaaatcccccagaaaaaaaagctcatcatctaactaaaggttgtagcatcaacagtagaacatgggatcatttagctaacggttgttcttgtttacctaacggtgtaggaaagtctcaggtttgtttctttattccttagtaacccacaggatttgtctttgtagattcttttgatttcaatgtgtttatggataaacaaacttcttgagtattttttttattattattgtaaagcgttactgatcaaatcaaatgttttcttaaaatagttaaaaatattaagggatctcaaaataattgttaattatggagggaaaaaaaagaaacgtcttttaagaagcccatacctgcttcacgtatcacgatggaggcttactcagaccttccactgttgagaatttgaaatttcaatttgtttgattagacacaatgattaagatttttattacataaaaagaaaaaaaaaattggagaagtataaacacatacatagcggtgaaagaagaaacccaacggtcactcaaaagcgcattgaagagtcaagcaagacttggatctgtctctttcgtttctctatctctgtttcggattcctaagagaaatggtggaatcggagctaagctatgaacagattcgtttgaatagggtggaagagaacaagaagagaatgggggagcttaatctcaacaagcttgctcaatctcttcgtgtctcttcttcttcttcttcttcttccaagccctcaccagtaacgtttcctttctcttctcttctcatttcttcttttctttttctgaaattaaccaattttttttatggaaatgtaggcaaagccaagaacgatgcgtattccagtggatttctcggaggtcaggagatcaagccgtgccaaaggtccacctccaagttataaagaggtcttttactaccatttatctttacttgagtttccttaaggatttcttaaggattttgtatgagatatgaaatttgtgggtttgatctttttgtgcaatttttcttagttataatttgcgtgagttgtttctcttttttttgaataaaaacgtgagttgtttctcattactcattatcagagttatctgatccttactcgcagtttgggctagaaccactggagaggaggccaagaaggttgaccaatccacactctctatgaatacattacttctcttacactatttgatgtttgttttcacttttcagtataagttatgtgttttgctttgcaggagctctcgaagaagagatttgctgaatcgggtatatgcttcggacgacgcaagaatgtacgcattcgacagggcagagaagctccagtcaagcttagattcagaatatgcaagctttaccaaaccaatgctccaatcacacgtgaccggaggattttggttggtaagtgaacaacttgaacattcaaagatgtctgaaactcagccatagtagtatgtaaaagtccactgatgtcatatgttttcgtaaccagggtttgccgcttcctttttgcaaggcacatatgccaaaacgtgatgtaataatgactttggttgacgaagaagaggaggaatctcaggcgaaataccttgctcagaagaacggtcttagtggaggctggcgaggtttcgccattgatcaccagttagtcgatggagatgctgtagtgtttcaccttatcgctcgaacaacgttcaaggtaaaggagttttacttagagatcttgaaatacaccctggtagagagactttggcattgatgttgaaacatattgcttgttccaggtgtatatcattagggtaaatgatgatgcaaacaatgattcagatgggaatgaggtaaatgatgatgattcagatgggaatgaagaagatcgagataatgataatgaatcaaacgagaaacagaaggaaactgtttcagaaggtagacagttgagaagcagtggtaagaggaaaagacgaggtaataatgtttcaaatctatttacctcttgactcttgtaataatatctgttcgataagataaaactaaatttgttgattgatgtgtgcaggaagaaagtagagtttgaaggtttaaatgggacttctagttctatggaaggagtgggaagatgaactaaaacttaacataacagctttttgcgagttttttggctgaacagtgaagttgtgcaatgaggggattgtttttgtgtcttgttatggagacaaacatggaacgttacggctaaatattttgattttggtaactacgattatttcatgatattttatgatttggataagggaaagagaaacaaactttaagaaaaaggttgaaagagaagtcccaccaaaccaaaaaataaatcgtaatcacacaaaaaccaaaaaactttataaccgaactaaaccaaactaaaccagataactaaatggccacctacagatttgtgtagtggaatttaagccattaaaaataaacagttttaaaattatgttgataaaccctggcttgatataataagataagggattgaagacataattcgttgagaattgacgcatttaccccttaatttatgatgtgatcaactaactaattagagcccaattaggattgagaaccggtttttgagtaaccggtacaataatagatccggttaaggaagaaagaatagaaagagacggcacttattcctccacacggtaaagcaaaagcccgtaggacgaagacgacgacgacgaaagtctactcaacttttttgcttccttctgattctctctctctccgcaatccaatcacgagaaaccttcacgtcaccatcccttagaaaaaccctaaaatctcatcaaatcccaaaatcagggtcttcgactagagattctctaatcccgcaggggaagggaacaacaaacaaacaagatg

SEQ ID NO: 24519 - DNA, 3003 bp, Unknown
  misc_feature (1)..( 3003): 2750-1469P.txt file - cDNA_ID_2178795; gDNA_ID_1971877; Annot_ID_176763
atggaagcttgagacgacgctcatcgtctatgttgacgtcgatgtcatttggtttagaagcgcgttatttaacggttcatttttttaaaaaacggcacgatgtttggttgataaagacatcaagatgtgcatatgtgtgaacataagagcaagatgtgcataaaaacaacaatgtattttgaattgacaattagataaatgcattatagactgatagtcttaattagctaagttattgtataattatcgggaatccaaaatcagttagtgtattttgaaccatgaaaaaacacagatattccaatcaacgattttttgtatcgaaatttgttatatccgtaagataattaaagacaaaaatttattttctaactttaataacaaacacatatacgtttttgtaaaagagttgatgaagatatatgaaaattagatggaaatttggattgccttcaaaatttaagaattaatttattgttgttgttatgatagattcagttaggattttgttttgagaattaattttgtaaatgtagtttggatttataaacctagcaaaattatatttctaaaaggtatagaaatatatactaatgtgttaatctaatatcagattacatgttcatgaataatatttcacttaaactattgttttttcgtttttaaattaattaaatcactatataacatatttttgtatttgaagatatatatataataagggataatatgttggaagtaatattcatatgcaaatgtaccattacttgcaaatacaaaaatatgataaatagtgttatagttagtttgaaaataacagaaaataaaaatgtttatttttaatgcgtggaaagagacgatagataaggaaggagtacagtacatcttgttaactttttagaattttgaccttttttattacataatttactgcatgcaatttcatagtcctatttaaactcgtcggagggttacttgtcagtccacaaaactcacaattatgaaaaaatgcaaatttctttcgcgtctagttcaaatgtctatttttataatagaataaatttggaaaatagcctctttttgagttttcattgaaaaataccttataacctttttcttttttaaaacctatttttaagtagattaagttacttaaatagacttactaaaaattagtaataattaataataattgatacttaaattaaaaatttattaattaagaagatcccttgcaaaaaactgatgcattaaacggtataacatggtggaaacaagagtggcaagtccaacgtgtgtgggctaacactaatttagcaaagatagtggcaactttaaatgagttcaaatttggatttccattggtccttattctgcaattcaagtcactggtttgttcaaaccattgaaactatcgttggtttgtagcattggagaaccattcacttgacacaaagacaccaaaaacaacatttctctttcgcatctaacaaaaacttttatggctatgtctaacaatgaaaaacataagaaagtaacatctatcgttattcgtaacgtaagatgtatcgcaacgtatcgtaaggaaaagtaaagaaagttcctaaatagaatattaatgtggagaaaaaatttagtattaaaaaatttaaagctcaaaccaaatacaaaagaaagtaaaaaacaaagctcaaacataatctaaaacaagaaaaagactatcttcttagatattatattataaattttaatataaataaataaactatctttattttttaaaaatagtaatttgaaatcgtttttttcttctatatttcgaatttaattttgatttactaaaaacacaggggtttttaaaatctggataaaattgtcattttatatatttgaaattgtagtttttattaaaaatcgaaaaaggtgtatttttcaaacaaaaactcataaatatggtagttttcaaaatcaccctttataatattacagtcattaatactagatgattatcgactttaagcgtcttctttaataaatctcctaagatgattctttgtgttgttttctatatttgaattgttactttgtaattgttttggaaatattgttttaagaaaatattttttggtataatctcaaattcttatgaatgataaacaatagttagctattaaactagagtttgtaacttttgaaatagtataaatgttatagtcaatgatttattacatttgctagagaaccgaaccaaaacattttcgattacttttagtacaaattttaaaaaccaaaatgaatgatctgttgggtttacccgaagattcagagctaaaaattagcatgagccctattcaaaaatacatgaatggccacaaaatatttaagtttgccattttataagtatcatgtatccaaaaaactttatcattaatttttgacaatctatataaccaaccaaaattaaatgttttaacattaattgtaaaataaaaatatccatataatttccacatttaataatataaatattttaaaaaatttagttaagacatatttaaattaatattaataaaaatttaaaatattattaatccaccacttcaatactggttaaatcttcatttaattatattttaataccatcaatacgagacatatcaaaataaactgatttatataatattgtgtaaaataaaatttattttataatatataatagttatttaatgacagttgtacacttaacgaaatataaccattctaaactataaatataaatattttagaaaataatataatttacaacttttaatatataatatataattataaaaatcttaaaatcacaaatgtttaaaaacaaatctattttgttagagtaaaatttaagacccgaattgaaccaacccgactagaatggataatcgaatgtccaagccatccggcctgcactgtgtttaaaccgatcgagccctaaatgtatcggtgactgatgagttaatg

SEQ ID NO: 24520 - DNA, 3000 bp, Unknown
  misc_feature (1)..( 3000): 2750-1469P.txt file - cDNA_ID_2178841; gDNA_ID_1971909; Annot_ID_177026
caagaggcgaaagagaaacaaagaacaagttgaagaagaagaagacaacaacagacgaatcttttcgatgttcggttggtttgattttaaagtgacgattgttttggaatctttccggttatggcaaaaccaattttgctgaccaaatattactaggatatttttccgtattaccatatcagttacctgaaatgacatatcttcattgctgtaaaataatttctgtttgacatatcttcataagaaaagaaaaaatgtacacgaatgagtatgtcatatgtgtgtttgacgtttttttagtggttttgcttgctgggttatgaagttatttattcttgtttagagaaatcgactcttattgcgaaaggaggtgattgatgttatttttgggttggtagtggacattcttggtaaatctcatcacatgtgcaatagaagaagaagtttatttgcttttttggtctatggtttttcttagggtttaaacatgtttgcttttttcttagttaaaggtttcagcctcctttgatcttggtttgataacttttgctttgtatttataccgtctttagtttcccttccatatagtttagattccagaaaaaactcatctttctacgacaaattttatgaaactttcattttgtccgccggttttagtttattttgtttaggtgttgtatttttttctagttccacattaagaattattaatctgggaaggttggcagcgttaccattgtcgatcgacagttgtcttttcatctttctctcgtatttgattggccttagtcttagcttagtggtagattctgagggaacttttgtgtagcgttccacacagacgacgccaaattgtacggattaaatttaacatcttagataaccagaggaataaaaaatgaaacaacacggatgcaaaatatttttcttttttgattccaagaacacaagcacgcaaatacaaagatattattcttccgttaaactcaagttagggtttttccttgtgtttgacaaaaaaaaaaaaaaagttcttccttgtaagtactttcctaaggttcccgagtgttccattgtggatctcgtccttctaggtcgtggaatgtatcctctttccatatctttacttcaagatcttccttttttatctcccggatatattctacaattttttcgtatattcaaagtaatccttctagtaggccgagcttgatctcttcttctcatgatgataggcctttcgcttagaaatagggggtctcccctaattgtacctaggcccgataaaccatttttgaggattcagtttattcctagttcgaggatacacatatagatgttgcataatacaataaaacatacaaaaatagacgatgcatacataattactagatgatgttttcttttatttaactagcaatatagaagtagtttttaatgggctctctaagctcattccaactcttatttagtatgatattgtcttctttgggcttatatgctcaagcccgcaaggatttgttattggcttccttcccaaaaggcctcatactagttggaattggacttagcttatatattaaaaactctttttctaaatttccgatgtgagacctttggtttgtacccaacagtttcttagtctctactcgtacaatacaataatttcttgtataagcaatgaccgctcactctctccttatatacaagtctggcccaaataaggtgggcagatggacggtgacccaagcgaccatctgtttttgttaaacgtttttacgaagaacgagtttatatttttacaaaaaactattaattggcccaaaattttattaaatctattattttacataaaaatgcctttctaattaaaaaaaaacatatcaaaagtaatttacaaaatggtccagattttaaccaataacttgaattgttattttaagtaatacatagtctaatatttttaatcaataatctgaaaagttattttaatcaataatctaaaaagttattttaggtaatacatagtccaatttttttttttttgcccaagggtcgaactatatgttaaggcagggctactgatatcttattatatcaagcttggttttcaaatgttataactcatattattgtgagacgtgtcaagtctatcgatcagattttgacacatataaaaaaatgaaattatgtaaataaatacaaatatttgattatttaatttaatatttataatatttattttaatttcctttccaattggaaatatttaataatttaaattaatcttgaacaatatttacttaagattctttttcaaatatgtgagatcaatatatgatttcttttcctctttgtaatattttttccttagtttttttattttttagtgtgaattataagaaaaaagaaatctgtgatgatttcatttaacatatttattttttgaatttccttttcaactaaaaatatctaatgatttaaattaattttcaatattatttatttgatgtttttcaattaggaatatatgagctcaatatatgtttttatcttagtttttcttataaatacatcatcaatcttaactatgtgaaatatttatagtcaacaatgaaactatgcaaaactgaaagtaacgagacatatagttagattaatctttaaagatcatacttccatggtaaagtagatactatatttgtaaataagatgacggtctgatcagtgatcagtggtactttttttttgtgcaacttatttatgagatacgtaccaaccaatgaaaattgtatttgataatggggattccctacttaatttaaaataaatctactatattggtgagattctctaccaattaaacacttgacttgttatctttgctgacgtagaacttccccccttctataaatccaaccttctcttggctactcatcaaacatttgctaatattaaacacttttgcttttacacaaaaacattcgataaatcatg

SEQ ID NO: 24521 - DNA, 3003 bp, Unknown
  misc_feature (1)..( 3003): 2750-1469P.txt file - cDNA_ID_2178863; gDNA_ID_1971909; Annot_ID_177034
cttttaacaatcaaaatagtattggtcaaacaatatttctgcattaattagttttttcatatttagcaaaaaagaattaattaaaaaattcatccctattcgacttcactttctctctctgcctgaaaattttgatcggtttctggtttctcggcgaaagaagtaaagtggccgacaaatagtgatctcgtgaaggaatcagtgtgtacagtggaagaagatgatacatttggctggatttacatgttgcttaggcggcgtcgctctttatcttcttaccaggagcacaggcaggttaggttttttttcttgtctttactatttacgaattacgataactagggtttactgttattcggtggtaatgttcttctttcgtgggacagagatatcaaatcaatcactagggtttaccaactcaaggatttgggtaatgttcctgcattgttctgcatttcaattttaggtggatgggttttggttatgtgtttgatatcattcgtttttattcagaacaattagtagaagtagagagcaaggtggtacctttgatcatcgcagtatcaggagatgttggctctgagactcctattaagtgtgagcatagttatgttctcggtgtatttctcaagagaacggtatgtatgaattggattagataatctagtttttcgtttctgtgattttggatatgttaaaaagaaacgatttttttcaggcagaacaacaggttttgagacgtaattggagattttcatgggttcgaaatagtacattgatgcagccgatgactaaggaagtcccctggtatctggtatgtctgttggactttgattggagtgtattactttctaaagtcatttacaaaatatgatattggttgcctataggacgacgggacaggtcgtgtgaatgtagatgtatctcaaggtgaattaggcttggcgttgacggttggtagtgatgtatttgaaaaggcagagccggtatcgcttgttcaaggagcgttgggttatcttaaaggctttaaggtcttttcttttcctttcctaccacttttcattgatttgcttttgttttgacaatgcttatacattgtggcaccattgttgtctatagatacttggagtaagacacgttgagcgtgttgtcccaattggtacaccgcttacagttgttggtgaggtatgtcttttatctgttagcggtccaaaatacgttttatatctctctttgttatgttgcttaccatgttaacaggctgttagggatggcatggggaatgtcaggattcaaaaacctgagcaaggacctttctacgtcacttatataccgctagatcagctcatctctaaattgggagatttgtcaaggttgtttcttttctctgtttttgcctattcttttcttcgaaaactatgattgaaaaaaattctaaaagatctctttcttttggcaggaggttcaagtatgcctccatgggtttaactgttcttggtgtgattcttatttcaaagcctgtgattgaatatattctaaagagaattgaagatactctagaaagaaggcggcgacaattcgcactgaaaaggtatgacgcaccctaaccacagccacgtatgaagtattcattgcgagttgcgagttgcgagttaagtgttgggtaacttgttgcagagttgttgatgcagctgctaggagagccaaaccagtaactggaggtagtaatagtatctatccattagagtttgtactttgtagtagtaacatgtgaatcctttttctgcatacacttggaattgctctgcttacaaaaacgtcttaccaggtggtacaagcagagatggtgatacacctgatctctgtgtggtttgccttgaccagaagtataacaccgcttttgttgagtaagtataagaccgcttttcttctaaaagctcttgaaaaccctctcactgatcaaacatggcatcttttgattcctctttttgtttggtttggacttgtaggtgtggtcatatgtgctgctgcacaccatgctccttgcaactaaggacctgtcctctttgccgggaacgaatacaacaagttttgaaaatttaccgccattgaaggacaaaactcagaacgatttttacaagcgaacaattactagtcttgtacatatagtaaagcctttgtatcatgagtttttgactagaaatttttttgcattgatagattgtgattgaacaaatgctaatataaatttcaagcttagatttacatttactaatgaagttatataatcacgtttcgatgttaaaataagaagtgaaaaaacgtgaacggcaggattcgaacctgcgcgggcaaagcccacatgatttctagtcatgcccgataaccactccggcacgtccactttttgttaattcctcactatcttaaatatctaattaccgttaattattacaaatcaggttgggcttaattaagcccaaagttaaagacagattagtgaaggagacagagaaagaaacagctctaaaatggtaatgaacgagaaactagagagtcaacggtcatagcgttgaccaaatctctcactctcaccagccaaatctctccaacttcctctttctctccacccaaatctcgccggcgatcgtcactgacgaatctgattcgtccccaacactcaacgggtaagctctctctgcaaaattcagatcgttctagctcaatctcaacatcggatcaagattcaacttttgttcttttctcttaaacaaagcttttgatcattagtgaaatctaaaatattaacctttgaatctgtaaacttaagcttagagaaccctaagatcaaaactaaaaatttgatctttcattgtcacttgttggaagcaattcaaaattctgtgttgtgtatattttcaaatttgtggattgttccaatttcgataaagttttgatttttattccttttgttgtgtgtttttataaggaggtagaagaatg

SEQ ID NO: 24522 - DNA, 3003 bp, Unknown
  misc_feature (1)..( 3003): 2750-1469P.txt file - cDNA_ID_2178872; gDNA_ID_1971909; Annot_ID_177037
gaaactagttttgcatacaatctagctccgaattcagaagaagcattcaataaaaccatttctgctaatgataaaacctcatatgctatttaagaagcttacgcaacagtgaaaactactaacttaccatctccaaattttctcaaaatatttgtgtaaataaaacctgatagtggtctttgcaacataaagaataccttttccattgagcgaccacaaaaagccttcatggcattcacgaaatcattgtacttctcgaactgaaccacaatcttacaatggagacctgatatgaggtctccactatcctcatctgcgtccttacctagatcatcgtcctcagcaacattaagattcctatagaggattagttaatgcagcggaacatggaatttatgtaaactatcggaattatattaacatcagattcattggtaaacagaataaatgatccgaagaatactgagaacacatggtaagcaagttcaatacaatgattgtaattagtcttcagataagatttccatacaaaatgtcatttcttttgaactacatggacaaatactgtatactatgatcaaatgtagatgcatcaaatctatccaaagcagcacaaaactacttaattttccaataagcaagccatagatcactctcaactcacatagtgtcacattcttgaagcagatttatgaatgttctcttcactccgattgaaaaaaaaacaatcctaatcaagctggacatgaaagatgacaaaatcttacctaattttcccaaagctagagaagattgtatgtgtaaccaacatagaaggcttcgatgaaactcgtggctcagcaaaccatcttgatggcacacctctaagtataatcgtatcagcctctctccttccttcccttgaatgtcctgcaaatcacaatcacatcaattaccacgaaaaaatcgtaaaatcaaaatccaaaattgaagaaccaagattaccaaaagcgtaaaactcctcccaatccttcttcaacttctcgaaatcatctgaaatcggaagtaccacactaagcttatacttaactccttccaaattaagctcaataccattcatcttctccaccaaactcttcctccaatccaaaaacttcttctccaattccttcacatctctctctccatcattctccttcttcttcttcttcccatcgagaaaccctaaatcgcgtataaacaacgatccatgagcaactggctcctcacgcttccgtttcttcaagtccttgtgacgacgaactacgatgtcttcctccggaactgtgacggaggttacgacagagtttttgaggtaatctattaaggatcgcttgagttgccattcgtcgatggatttggatacggatgggactactgggtggattgtgagattgagcttgacgcgtgagacgagagcgagaccgttctcttcgatatctagagtttctatcggagatagctcttctaacgatcgcatttttcgccgtcgatgcaaaattcaaaatcgcgattggctctctctctcagagtgtcgtcggctattgagtacagagaacaggaggatactgaaaacagtggtaaaccagaattccaaatcggttatttccggttctcttggtttccaatattttgggaataaattgcataaacggtccaaaatagagataaattccaatgtaaattttttgaacattgactgaaaccattaataaatgttgaacgtttcatccaatgcctaaatatatatggtaaggattcttatcttagttatgagttttggcatactaggactgaagcattgcatcctactgtgagttttggtggtttgtgctcttctgttgaccttagcaatgcgtccatataaattgagtatggttggattactgttcatacctctagcgaaacattgcaattcgctaggtctctattgtggggttagatggcatgaaccattagttgcacaaatgaactctaatgcatatcatagaggcttgtttttggatatagtttacgaaatattgagatgatatctttcatacaaaaacaaaaaatgcatatgatgatgacactcttacatacacttttggtactatctatccgcgtatgattttaagataatttttttgagcttttactttaattagaatttagtgatatacttgtatgcacaaatttatacaagcaatttatgaatacggtatacacaaatttatatacaaacagttagaccaataccaaaatttggtgatatacttgcaaacctagcatgctaacgaatttgataacttacatgccttatcccatctagcgaaacaaattagagagattaaactgttggagataaatttagaactcggttgatcacaactcaacatttcgcactcaaacattacaaaaatactagtctcctacatcaggattacaaagtggtcttccgcatttgttcatttggaaaaatatacaaccaaacaagcgcattcgatgatacaaattcttgtaccacattgaaattcacttacaatattttaattcgaacaaatttagctgagaatgtctttattgatagcaaaaagttgtgttaatttatattttacgcatccacatttgtgtgttttatgctttcacatttgtaaagaatttctttgaacagttgtgaaaattttcaacatttatgaaagaaaagaaaaaaccacttaataattttcaacatttatgaaatttgaaaaatgtgttaattactacgtgtttatgtaaagttatatgacccgtcttgcccattctctccccgacgaagacacacacagacaaacaaatcctagcttagcaccgtcgcgaccgaattcgaaattccggtaacccaatcgccgggaaaatccaccgctcgtggctaccgatattgattctaatcggatctagcggctccctttcttcgtccagatctcgtacttcattcgacctcgattcgctgtgcaagttacgatg

SEQ ID NO: 24523 - DNA, 3003 bp, Unknown
  misc_feature (1)..( 3003): 2750-1469P.txt file - cDNA_ID_2178944; gDNA_ID_1971906; Annot_ID_176988
tcttttcttttgatattgttttgtttcttattatctctcgttctatcgaatgatctaactcgagcatccaacgatctaactcgagcatctaacgatccacgtggacccaacaacgtcggtcagagtttgactagtagatgaaggactattcttgtggtcgttgtcacgcggtggctgatattttctcttatttttattttattttaactattttttacgttatatttaagtcttgaaccaatagaaacgacgaatcatacattactcagcttgactttgaaataatcctataacaaaagagcattccaagaattttatccaaaaaacaaaataaaaaagagtattcaagcttggtggcgccgtttgtttttggtttattcactaaagttactctgttttagttgtataaatacacactcccatttgtgtatttcttttcatcaatcacaaagatctctctacttcaataaatctccaccttactttaagaacaagaaaaacacagtattaacaaatggcaggaatcaaagttttcggtcacccagcttccacagccactagaagagttctcatcgctcttcacgagaagaatgtcgactttgaattcgttcatgtcgagctcaaagatggtgaacacaagaaagagcctttcatccttcgcaacgtgagtacataaaacatctgtcaagacaaaatattatatttcatctagatactgaatcttggtcttaacaatcttgaatattgtttttgcagccctttggtaaagttccagcctttgaagatggagacttcaagattttcggtaaatacaaatatatatcattatagtcatgtttacaaatttttggttttatgatcattgcaataatagaaagcagaaacactcaaaaatgttttttttttggtgggcagaatcaagagcaattactcaatacatagctcatgaattctcagacaaaggaaacaaccttctctcaactggcaaggacatggcgatcatagccatgggcattgaaattgagtcgcatgagtttgacccagttggttcaaagcttgtttgggagcaagtcttaaagcctttgtatggtatgaccacagacaaaaccgttgttgaagaagaagaggctaagctagccaaagtcctcgatgtttacgaacacaggcttggtgagtccaagtatttggcttctgaccacttcactttggtcgatcttcacactatccctgtgattcaatacttacttggaactccaactaagaaactcttcgacgagcgtccacatgtgagtgcttgggttgctgacatcacttcaaggccttctgctcagaaggttctttaagtgaatctcaaactatttatcgatcagaagatgtaataaaagtggcgatgacctaattgcccaattctcataaactctgtttttctttttgtgtttactctgtttttctgctgccgagtgtttgatttgaatgtaatcttcgataatgagtcttgatataataaaatatttcttatcttaaagtttaactaccaattaatgttgatctcattcttcaaagttgactatcattctcctaagtcttgaacgttgacttccaaattaggtcgctctgctactcatcaatcactaatcttcttcctttccctaatcgattccaaaccttctgtggtgatggcaagcttcaaagtcaacaatgttattcatatttgtttgagcgtaactgtcaccaaaaaaggttcctagatcaaaaaagttgaaagttaattagtttccgaaataaaacagaggaacaaaaggaagcgtgtttaagataaaattagggttttcttaggaaagcatataaataaattgcatagctgtcgcaaaacctctgtttactcgagtgcgaagaaacgacggaaatggttattaccaggagacggagacccttttcaattctcgccggaattaggattctcatttcctaggtagattacttgtattcacggaatgtaagtcttaactagggtttccatttaactggtcttttctgctcgaacgatcgtcttttaatctctaaactctttactgaagtagacctattttgaactatttttgtttactaatttagcgattagtcatcgacgacctagtaaacttgttataacgagggtatattattacgtaacgatcagttgcttatatttgttatatcttattagggtttttagcctcttgaccttactcatgcaactattgatctgataaacatttttgagtttgatttcgggaaaattttgatatgtctagtcttgctcagagtctcgagctatatctgaatacatctcgtctgtccatagatcaaaaggctcataacttgtgaattacgaaagctacaaaacaatgggaacacaaacattgtgaatggatattgaaacttatgagttcgatccactcgcatcaatacttacatgggtataatccattaaatctaaagacggactataaggttgtgaatgcaagcaaggcgaagctagagaaggttctagatagatttattacgaagaacgattcaaaaagaatagcttcttgactaataataacttcacattgcctcatctccttgattcaatgatccaatttgaacatccaacgatccatatgttttcaacaacgtcggtcaactttgactagtatacattaaaagactattcttgttgtcttatccagccatggttgatattttctccgattatattgttttataagttatatgaacagtatatgaaaatcttgaaccaatagaaacgacgaatcatacgttactcagcttgactatgaaataacaaagagtattcaagcttggtggcgccgtttgttttttgtttattcactaagttactctaatttagttgtataaatacactctcccatttgtgtatttcttttcatcaaccacaaagatctctctacttcaataaatctccaccttgctttaagaacaaagtcttaacaaatg

SEQ ID NO: 24524 - DNA, 3003 bp, Unknown
  misc_feature (1)..( 3003): 2750-1469P.txt file - cDNA_ID_2178947; gDNA_ID_1971906; Annot_ID_176989
aagtcttgaacgttgacttccaaattaggtcgctctgctactcatcaatcactaatcttcttcctttccctaatcgattccaaaccttctgtggtgatggcaagcttcaaagtcaacaatgttattcatatttgtttgagcgtaactgtcaccaaaaaaggttcctagatcaaaaaagttgaaagttaattagtttccgaaataaaacagaggaacaaaaggaagcgtgtttaagataaaattagggttttcttaggaaagcatataaataaattgcatagctgtcgcaaaacctctgtttactcgagtgcgaagaaacgacggaaatggttattaccaggagacggagacccttttcaattctcgccggaattaggattctcatttcctaggtagattacttgtattcacggaatgtaagtcttaactagggtttccatttaactggtcttttctgctcgaacgatcgtcttttaatctctaaactctttactgaagtagacctattttgaactatttttgtttactaatttagcgattagtcatcgacgacctagtaaacttgttataacgagggtatattattacgtaacgatcagttgcttatatttgttatatcttattagggtttttagcctcttgaccttactcatgcaactattgatctgataaacatttttgagtttgatttcgggaaaattttgatatgtctagtcttgctcagagtctcgagctatatctgaatacatctcgtctgtccatagatcaaaaggctcataacttgtgaattacgaaagctacaaaacaatgggaacacaaacattgtgaatggatattgaaacttatgagttcgatccactcgcatcaatacttacatgggtataatccattaaatctaaagacggactataaggttgtgaatgcaagcaaggcgaagctagagaaggttctagatagatttattacgaagaacgattcaaaaagaatagcttcttgactaataataacttcacattgcctcatctccttgattcaatgatccaatttgaacatccaacgatccatatgttttcaacaacgtcggtcaactttgactagtatacattaaaagactattcttgttgtcttatccagccatggttgatattttctccgattatattgttttataagttatatgaacagtatatgaaaatcttgaaccaatagaaacgacgaatcatacgttactcagcttgactatgaaataacaaagagtattcaagcttggtggcgccgtttgttttttgtttattcactaagttactctaatttagttgtataaatacactctcccatttgtgtatttcttttcatcaaccacaaagatctctctacttcaataaatctccaccttgctttaagaacaaagtcttaacaaatggcaggaatcaaagttttcggtcacccagcttccacagccactagaagagttctcatcgctcttcacgagaagaatctcgactttgaattcgttcatatcgagctcaaagatggtgaacacaagaaagagcctttcatcttccgcaacgtgagtaatatttgtcaaaacaaaatattgtttcatttagatactgaacctttagtctgaaaaatcttgaatgttgttttgcagccttttggtaaagttccagcctttgaagatggagacttcaagcttttcggtaagcagcaaaacacttaaatttagacctaatctcaaattctgtttttgacaattgcaattaaagaaagcagaaacactcaacttttttaatgttttgttggcagaatcaagagcaatcactcaatacatagctcatttttactcagacaaaggaaaccaacttgtctcccttggctccaaggacattgcgggcatagccatgggcattgaaattgaatcgcatgagtttgacccagttggttcaaagcttgtttgggagcaagtcttaaagcctttgtatggtatgaccacagacaaaaccgttgttgaagaagaagaggctaagctagccaaggtcctcgatgtttacgaacacaggcttggtgagtccaagtatttggcttctgataaattcactttggtcgatcttcacactatccctgtgattcagtacttgcttggtacaccaactaagaaactctttgacgagcgtccacatgtcagtgcttgggttgctgacatcacttctaggccttctgctaagaaggttctttaagtgactcacaaactgttaatcagaagattgaataaagtggcgatgacctcattgccctaattctcataaacaataaaagtggcgatgacctaattgccaaattctcatacactctgtgatttttttgtgtgtgtctcctctgttttttttttttggtttgaatgtaatcttcaataataatgagtcttgatatataataaaaatatatttggtagcctaaagtttagctactaataagtagtgttgatctcttatgaccaaaaaaaagaaaagaaaattagtgttgatctcattcttgaaagttgacttaattattctaatttttgaaagctgacttgagacttcatttttgccattgtaaggaagaaattgactgttgacttttaatgctttgcaatttaattagaatattaaacttcatagttagacagaatcacattcagttattaaaatatcacaacactaactccaagttaggtctgctactcatcaatcactaatcttaacaccaactccagcttagttatgctactcatcaaatcactaatcttcttcgttttcctaatcgattccaaaccttgtgtcattgtgtgacaaagtcaacaatgtttttttctttgggtctaattcgtaccaaatataagtttctagataatattcaaagaagttggaagttaaatattatttccgaaataaaacagaggaaataaaaagcggataaaagttttgttttttttccgtaagcgtagaagaaaattgaatg

SEQ ID NO: 24525 - DNA, 3000 bp, Unknown; identical to SEQ ID NO: 8849
  misc_feature (1)..( 3000): 2750-1469P.txt file - cDNA_ID_2178989; gDNA_ID_2936560; Annot_ID_194393

SEQ ID NO: 24526 - DNA, 3000 bp, Unknown; identical to SEQ ID NO: 8849
  misc_feature (1)..( 3000): 2750-1469P.txt file - cDNA_ID_2178989; gDNA_ID_1971906; Annot_ID_177008

SEQ ID NO: 24527 - DNA, 3003 bp, Unknown
  misc_feature (1)..( 3003): 2750-1469P.txt file - cDNA_ID_2178993; gDNA_ID_2936560; Annot_ID_194394
acattttcaaatatggatgctgttattttgtggatttttaagtgtctaatatattatcgaatatgcagtgttttgtggattttgaagtgtctaatatttattgaatacagtaagttaatatatatatatattatatagacaaattgacatatatttttggccaaagtatctcccttggattttgatcatactctgcgaatgtgattcctttcggttttgatcatactcgccaaagtgcatgaagaaggttttttgaatgtgtttcgtggaataacatttattttcgccaagaacataactttatgctttccgatttttagtttacagtgtgttacatactctgcgaatgggcccctatttactctgtttatgaagtcaatttttgaaatgttggatgctctcgaattggatttgcagttacgaacagagaacacttatacggacaaaattctgaggttcgttatataaagcagtgggaagttaaacaacgttgtagtaactgggttcgttagcgtgttaaaacagcatgctttcaaaaagttgcatcgcccaccgtggggctcgaacccacgaccacaaggttaagagccttgcgctctaccaactgagctagacgggcttgttgactatattgcacactattgttatactcatataaaaaaaacacatcccaattttaactagatgcaggaaagaaatttgcaaggacggtgctctgcgacaaaagattcttgtgaagaaacaaactgaaaactcatcagcttatattataaggctaaagctagtgttatgtctgtaaaaaagatgcatatatataaatagagctgaataaaattacaacaatgacaatcacctgcctttcccattggcgacttcacatctttattttactcagaagagtcacattcatcatcaaacatggctgatgacaacagtccctgtacaaactcacacttctttgccttctccaatttatcactatccgataaaggacacgacgatgtaccctcttttgctgctgacgaatccttaatcggattcttgtcttctacacttgaatcaggcagcacaagcttggtctgatttggtaatgcagaattgttgatgaacgataaaaattgatcggaaacatgtttagagggatgctgatgatgattcatagatggtggcaactcatcaagatgaggttgaagatatttatcagataaatatggatcttccctgtaagacatttccttctgctcactgtaaaattatcggtcaaggaatttcaaataaatcacattcattatagcgacggaaatttgacttgaaaggttttgaaaagaaacaaaaaaggatatcttcaagacatctctatgatgtgatgttatatgatccaccatatgcatcttcacccttttgctacatacaggacatatctacaaaaaccacaaaacaaccaaaacgaattgtaagatgatgctaccacatgacaattcacggaaccagattaataatgttccatcatactacttatatattcatttctttagctcgtaaaaccaatctatgcttcaaaacagagagctcaagtcacctactctctatagcaagtatgtaaagccaaaaaaagtgtcaaaagtattaatatcctaaaaccttaaactgatcaatggagagttatgtaaaacccaaagagtaacttaagataagagtggcatgtttctctattaaaactatttgcaatagcaatcagattctcaaacgcatcaatctaaaacaaatcctaatcaaaattatagattgaagttatgtttcccacaatccgaataactaagctgtgtaaaactgcttcatgtgaagcttgagtgtgaaatgaaaagagcaggagagataggaagtgaattcacaaaccccattgttagcttcatgacgatgttcttcgtcgatatggtgacacaattcaactaaatcataatcacttgcgcaaaacgggcatggatactccactgctatatcgtcgtcaacttcttcaaactcttccaaatcttgataaggccctgaaatattcaccactaattaactcgagagcaaaagagaaaaaaaaagtcttctctcatctaaaaagcaaaacgtaaagctacaatttttaacttaaacgaccaactacaaaaagtcatcaaaacagaactcaactcaatcgaaacccaattaagaccaatcttcaatcataaaccctaaaaatgaagtttgaaagaaaaattgaggggatttggataataaacctgattgatacttagcagcagtttccgatcgatagcttctagaagaaccagatgagctaacgcaccacatatcgtcttccatctgctttgtcggagcctttcttatgtaaaaatctcagataattgatgagagaccttcttcgtcgtgtcagctaaatacccaattgtgtaagagatagcagaaagaaaatgtcaagaaactactccacggaaaggccaaacctttttttaatccgccgagtcttaatggacaagaatacttcgggtggtaagagtgaactactattatacccttacattgcactgagcctttttctcagctaactcaggggtgtttttgtccttttcttgtaaggatgttactgttattgcattgctccccaagttaattatcagtaaaggcctgacttgaaattatataaatgggcttaaagtcaagattttgaaatgatataaatgggcttgaagtcaagattttgaaattatttaaatgggcttgtaggcctaataataaaagcccatgttaaaatctgagaatttttagattctgatagacggaaaatcccaattttcccggaaattttcagacaaaatcgcgttgagattcaacaactttgagtgagtttttttttttgtcatttacctttgtcgcttcgacgtgagacgagccgtggaagaagacgaaagggctcttaagctctctttactcttttcttctcctcctctttttgagatg

SEQ ID NO: 24528 - DNA, 3003 bp, Unknown
  misc_feature (1)..( 3003): 2750-1469P.txt file - cDNA_ID_2178993; gDNA_ID_1971906; Annot_ID_177009
tacattttcaaatatggatgctgttattttgtggatttttaagtgtctaatatattatcgaatatgcagtgttttgtggattttgaagtgtctaatatttattgaatacagtaagttaatatatatatatattatatagacaaattgacatatatttttggccaaagtatctcccttggattttgatcatactctgcgaatgtgattcctttcggttttgatcatactcgccaaagtgcatgaagaaggttttttgaatgtgtttcgtggaataacatttattttcgccaagaacataactttatgctttccgatttttagtttacagtgtgttacatactctgcgaatgggcccctatttactctgtttatgaagtcaatttttgaaatgttggatgctctcgaattggatttgcagttacgaacagagaacacttatacggacaaaattctgaggttcgttatataaagcagtgggaagttaaacaacgttgtagtaactgggttcgttagcgtgttaaaacagcatgctttcaaaaagttgcatcgcccaccgtggggctcgaacccacgaccacaaggttaagagccttgcgctctaccaactgagctagacgggcttgttgactatattcacactattgttatactcatataaaaaaaacacatcccaattttaactagatgcaggaaagaaatttgcaaggacggtgctctgcgacaaaagattcttgtgaagaaacaaactgaaaactcatcagcttatattataaggctaaagctagtgttatgtctgtaaaaaagatgcatatatataaatagagctgaataaaattacaacaatgacaatcacctgcctttcccattggcgacttcacatctttattttactcagaagagtcacattcatcatcaaacatggctgatgacaacagtccctgtacaaactcacacttctttgccttctccaatttatcactatccgataaaggacacgacgatgtaccctcttttgctgctgacgaatccttaatcggattcttgtcttctacacttgaatcaggcagcacaagcttggtctgatttggtaatgcagaattgttgatgaacgataaaaattgatcggaaacatgtttagagggatgctgatgatgattcatagatggtggcaactcatcaagatgaggttgaagatatttatcagataaatatggatcttccctgtaagacatttccttctgctcactgtaaaattatcggtcaaggaatttcaaataaatcacattcattatagcgacggaaatttgacttgaaaggttttgaaaagaaacaaaaaaggatatcttcaagacatctctatgatgtgatgttatatgatccaccatatgcatcttcacccttttgctacatacaggacatatctacaaaaaccacaaaacaaccaaaacgaattgtaagatgatgctaccacatgacaattcacggaaccagattaataatgttccatcatactacttatatattcatttctttagctcgtaaaaccaatctatgcttcaaaacagagagctcaagtcacctactctctatagcaagtatgtaaagccaaaaaaagtgtcaaaagtattaatatcctaaaaccttaaactgatcaatggagagttatgtaaaacccaaagagtaacttaagataagagtggcatgtttctctattaaaactatttgcaatagcaatcagattctcaaacgcatcaatctaaaacaaatcctaatcaaaattatagattgaagttatgtttcccacaatccgaataactaagctgtgtaaaactgcttcatgtgaagcttgagtgtgaaatgaaaagagcaggagagataggaagtgaattcacaaaccccattgttagcttcatgacgatgttcttcgtcgatatggtgacacaattcaactaaatcataatcacttgcgcaaaacgggcatggatactccactgctatatcgtcgtcaacttcttcaaactcttccaaatcttgataaggccctgaaatattcaccactaattaactcgagagcaaaagagaaaaaaaaagtcttctctcatctaaaaagcaaaacgtaaagctacaatttttaacttaaacgaccaactacaaaaagtcatcaaaacagaactcaactcaatcgaaacccaattaagaccaatcttcaatcataaaccctaaaaatgaagtttgaaagaaaaattgaggggatttggataataaacctgattgatacttagcagcagtttccgatcgatagcttctagaagaaccagatgagctaacgcaccacatatcgtcttccatctgctttgtcggagcctttcttatgtaaaaatctcagataattgatgagagaccttcttcgtcgtgtcagctaaatacccaattgtgtaagagatagcagaaagaaaatgtcaagaaactactccacggaaaggccaaacctttttttaatccgccgagtcttaatggacaagaatacttcgggtggtaagagtgaactactattatacccttacattgcactgagcctttttctcagctaactcaggggtgtttttgtccttttcttgtaaggatgttactgttattgcattgctccccaagttaattatcagtaaaggcctgacttgaaattatataaatgggcttaaagtcaagattttgaaatgatataaatgggcttgaagtcaagattttgaaattatttaaatgggcttgtaggcctaataataaaagcccatgttaaaatctgagaatttttagattctgatagacggaaaatcccaattttcccggaaattttcagacaaaatcgcgttgagattcaacaactttgagtgagtttttttttttgtcatttacctttgtcgcttcgacgtgagacgagccgtggaagaagacgaaagggctcttaagctctctttactcttttcttctcctcctctttttgagatg

SEQ ID NO: 24529 - DNA, 3003 bp, Unknown
  misc_feature (1)..( 3003): 2750-1469P.txt file - cDNA_ID_2178997; gDNA_ID_2936560; Annot_ID_194395
gaattcttcatatggtgatttactgatttgtttgccaagtctcagttttttgataatgtaaaaaagtctttgactcttgtatctcttctatacaatgatagttgggacgaatggataaggctggactgtctgttgaaacattcagatgagaatattgagaaacagaaagaacagggtttgaaacagcaagggattaagagtgctatggcttggaaagtgtcaaagatgaaacctagaagccctaatggtcagtcagcttcttcttttgtttgttttgcatattcttgtctcgatggatatcttgctgcttttgtggatattcagagtctctatcagggactctcatttggtcttgcttgctttattctatgtcgactaagtagaagttgttgagattaaagtatacatacacatctttcgttgttagttgagatattgtgtcagttgagatattgtgtcagctgagattttgttcaatattttcttaatttttgcagttgctagaggaagaaagcggaagcaagattctgttgatacggtaatcgctcctttagtggatgtatttgcttaatctttcagcttccaaatatccagggatttttttaatcaggggagtcttactcatgtcttgttgtttgctgaatacaggagaagaatgtgcttccctctgacaaccttttaagtttcaatattccaccagcattaaggaagcaacttcttgacgattttgaatttgttactcagatgcagaaggtatttctatcagcctgttatttcttctctcaattctcaaacggtcttttctgtgtgttttgacgcagttgaccatagtcttttgattcatttagtcagagaaaaaatattcttgtagtcgcatgaatatatttgttgtgaatgtcatatttaggtgcatatgttaaggaatttattttaagtcatttttgggaattgtctgagcagcttgtgcaacttccgcgttctccaaatgtggatggcatcttgaagaagtacattgacagccaaatgaagaaacatggcaggtaagctctttgtggattatagtttctttctgctgtcagtttccaacagttacacttgttaatctcttttgttgctattctcatatacttaaagagagtataaatcatttgtatatgctccatggataatttggttgacagataaagcgtattccaagcttctgatatatctagtactttctttggtgaatctatatagggtaacagattcattagaggaaattctgaaaggcttgcgttgctactttgacaaagctttaccggtgatgttgctttacaacaatgaacggaagcagtacgaggaatccgtatcagggggtgtttctccttcaactgtgtacggagcagagcatttgttgcgactctttggtaaggccagtttttgtaatctgcaaatctgcctttatcatgtggtttagttgtcaagataagactatataaatattgagttttgcagtgaaattaccggagttgctagtacatgtgaatatggcagaagagacattgaaggaattgcaggacaactttgttgatattctcaggtttcttcttcttgttctcctacttaactctttttacaagtatttaaagacaaataacaaaaacaaaatgataaagcaggttcttgaggaagaatcagagtgtgctttttgtatcgacatacaaagcagtggaagaaatggagaagaaagaaggttaggaaattgtgcctaatgacgtgttcttgtaagtatgtgcagcgaatcttctctttgtagtattttgtaacgagacctaagaccatcctgaccatccttattgatggtctcttaacataactcttatgttaagagatatgtcttataattaacaaaagtgacttaaagtctcttatataagaaattttgttagttataaaacatgtctcttagcataagaattgttttaagagatcatcaataatgatgatctaagaactattatactatgttccgtctcgattttgaaagtacttaaacgtcgttatcgtgtttgtctcggcgttttaaattccactgtattagtaagaatttatttttaaaataactttagtcatttttaattatctcttctcccttttcaattattaatgatcatagtaacttctcttgatttgtaaatatgctacatagttgatcttttgaatatacgaatgaaaacatattataatagtatgtgttcaaaatcttttgagttttatgagtacagaactatatgtttaatgggcagattagtatataaaattaccagtgcatcagaaggaataatgatctactcgagtagtatatcaaaataatactattcaaatgtataccaacgacaatgagttcaaaatcatcaaaccccatgggatgatgagcaaataatatttttatcagctactctatacatcatttgatgataatatgcaaaaattgtataccaatgagttcaaaattatcaaaccacatgggatgagaaaaaagcatattactatttttaaacagcttctccaatataaatttatttgaccgttacggaaagggagagagatacacacactctttctcttttattattttccgtttatttgacttttcttctttatagatcgacctggtcccacgtaatcttttcaaacttaccgtttggattcgataatcaccgtccgatctcacatgaagcaacgtgaataaaatgaacggtttagatctatcgaccgtttatagcaatacctttctcctttataatctctatatctctctctctctgaatttcgaaaattataatgctcttctgcttcgtactagctgcttcagcttcttcttcttcttccttagattcaaaatctctcttcttctgagtttctgattttcaagtttgagaactactcttttccttctaaatctttgatttttttctctcgtgatttttgtggttcactgctaattgtgaaccaaagatg

SEQ ID NO: 24530 - DNA, 3003 bp, Unknown; identical to SEQ ID NO: 24529
  misc_feature (1)..( 3003): 2750-1469P.txt file - cDNA_ID_2178997; gDNA_ID_1971906; Annot_ID_177010

SEQ ID NO: 24531 - DNA, 3000 bp, Unknown; identical to SEQ ID NO: 9894
  misc_feature (1)..( 3000): 2750-1469P.txt file - cDNA_ID_2179036; gDNA_ID_2096291; Annot_ID_195358

SEQ ID NO: 24532 - DNA, 3000 bp, Unknown; identical to SEQ ID NO: 9895
  misc_feature (1)..( 3000): 2750-1469P.txt file - cDNA_ID_2179108; gDNA_ID_2096291; Annot_ID_195374

SEQ ID NO: 24533 - DNA, 3003 bp, Unknown
  misc_feature (1)..( 3003): 2750-1469P.txt file - cDNA_ID_2179222; gDNA_ID_2096291; Annot_ID_195400
ctgaaattatttcaatattgaaccttggacatataagagttccgaatcgaatctcttttgaaagaagatcttttgtctcgtggtagcctgctccagtccccttacgaaactttcgttattgggttagccatacacttcacatgtttctagcgattcacatggcatcatcaaatgatacaagtcttggataagaatctacaacgcactagaacgcccttgttgacgatcctttactccgacagcatctagggttcctcgaacaatgtgatatctcacaccgggtaaatccttaacccttccccctcttactaagactacagaatgttcttgtaaattatggccaataccaggtatataagcagtgatttcaaatcccgaggttaatcgtactctggcaactttacgtaaagcagagtttggttttttgggggtgatagtggaaaagttgacagataagtcacccttactgccactctacagaaccgtacatgagattttcacctcatacggctcctcgttcaattctttcgaagtcattgggtccctttcctcgttcgcgaatctcctcccttcttccactccgtcccgaagagtaactaggacaaactcggtcacgttttcatgttccaactgaacactttctatttttgattattctcaaaggataagattattctttttaccaaacatctgcgggtccaatcacacgatcttataataagaacaagagatctttctcaatcaatctctttgcccctcattcttcgagaatcagaaagagactttttcaagtttgaatttgttcatttggaatctgggttcttctacttcattttgatttacttattttttctttattttctctctcttttctttatttgatttcttttttgattttattcccttccatcattcttaagtcccataagtttgatcctatagaatctgacccattttctcattgagcgaaggggtacgaaataaattcaatcagatttatttttgatcaaaaaaaaaaaaaaaaatcactatgtgaaatcttcgtttttttttttctctttctctatcgctttcccataagtacagcacttgttgaatcgatagagaaccttttcttctgtatcgatatgaatccattatgaatcgatattattacattccaattccttaccaatatccctcaaggaaaatcccgaattggatcccaaattgacgggttagtgtgagcttatccatgcggttatgcactcttcgaataggaattcattttctgaaagattctggctttcgtgctttggcgggtctccgagatcctttcgacgacctatgttgtgttgaagggatatctagatgatccgatcaattgcgtaaagcccgcagtagcaacggaaccggggaaagtatacataagtatacagaaaagacagttcttttcttttctattatattaggattttctattctattagattagttagtgatcttggcgcagtgagtcctttcttccgtgattaactgttggcaccagtcctacattttgtctctgcggaccgagaagaaaggaggctccgcgggaagaggattgtaccatagaagcacggaggtaaacctctttccaatatataaattctggcaatgtagttgggctttcatgttgatccgaatgaatcatctttttcgcggagtgaaatctttgcctgctaggcaagatgataggatagcaagttacaaattctgtttcggtaggacatgtatttctattactatgaaattcataaataaaatagttaatcgtggggttaccattctctctttttttttttcgttatctcgcatgtggtcctaagaaaagggaatttgtcgatttttcggggtcttaaaggggcgtggaaacacataagaactcttgaatggaaatggaaaagagatgtaactccagttcctttggaaataggaagatctttggcgcaagaataaaggattaatccgtatcatcttgacttggttcttatttctctatttttttaagtttaagaaaagaataccgtttctcctacccgtatcgaatagaacatgccgagtcaaatcttcttcatgtaaaaccggcttgatttagatcgggagaatcgtacggttttatgaaaccatgtgctatggctcgaatccgtagtcaatcctatttccgataggagtagttgacaattgaatccaactttttccattattttcatttcatacccgtataaagtgcgaaaggaaagcccggctccaatccaagttgttcaagaatagtggccttgagtttctcgaccctttgacttaggattagtcagttctatttcttgatgggggaagggatataactcagcggtagagtgtcaccttgacgtggtggaagtcatcagttcgagcctgattatccctaaacccaatgaatgtgagtttttctattttgacttgctccctcgctgtgatcgaataagaatggataagaggctcgtgggattgacgtgagggggtaggggtagctatatttctgggagcgaactccatgcgaatatgaagcgcatggatacaagttatgacttggaatgaaagacaattccgaatcagctttgtctacgaagaaggaagctataagtaatgcaactatgaatctcatggagagttcgatcctggctcaggatgaacgctggcggcatgcttaacacatgcaagtcggacgggaagtggtgtttccagtggcggacgggtgagtaacgcgtaagaacctgcccttgggaggggaacaacagctggaaacggctgctaataccccgtaggctgaggagcaaaaggaggaatccgcccgaggaggggctcgcgtctgattagctagttggtgaggcaatagcttaccaaggcgatgatcagtagctggtccgagaggatgatcagccacactgggactgagacacggcccagactcctacgggaggcagcagtggggaattttccgcaatg

SEQ ID NO: 24534 - DNA, 3003 bp, Unknown
  misc_feature (1)..( 3003): 2750-1469P.txt file - cDNA_ID_2179226; gDNA_ID_2096291; Annot_ID_195401
agccccgtaacttcgggagaaggggtgcctcctcacaaagggggtcgcagtgaccaggcccgggcgactgtttaccaaaaacacaggtctccgcaaagtcgtaagaccatgtatgggggctgacgcctgcccagtgccggaaggttaaggaagttggtgacctgatgacaggggagccggcgaccgaagccccggtgaacggcggccgtaactataacggtcctaaggtagcgaaattccttgtcgggtaagttccgacccgcacgaaaggcgtaacgatctgggcactgtctcggagagaggctcggtgaaatagacatgtctgtgaagatgcggactacctgcacctggacagaaagaccctatgaagcttcactgttccctgggattggctttgggcttttcctgcgcagcttaggtggaaggcgaagaaggcccccttccgggggggcccgagccatcagtgagataccactctggaagagctagaattctaaccttgtgtcaggacctacgggccaagggacagtctcaggtagacagtttctatggggcgtaggcctcccaaaaggtaacggaggcgtgcaaaggtttcctcgggccggacggagattggccctcgagtgcaaaggcagaagggagcttgactgcaagacccacccgtcgagcagggacgaaagtcggccttagtgatccgacggtgccgagtggaagggccgtcgctcaacggataaaagttactctagggataacaggctgatcttccccaagagctcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattgagaggacctttccctagtacgagaggaccgggaaggacgcacctctggtgtaccagttatcgtgcccacggtaaacgctgggtagccaagtgcggagcggataactgctgaaagcatctaagtagtaagcccaccccaagatgagtgctctcctattccgacttccccagagcctccggtagcacagccgagacagcaacgggttctccgcccctgcggggatggagtgacagaagttttgagaattcaagagaaggtcacggcgagacgagccgtttatcattacgataggtgtcaagtggaagtgcagtgatgtatgcagctgaggcatcctaacagaccggtagacttgaaccttgttcctacatgacctgatcaattcgatcaggcactcgccatctattttcatagttcaactctttgacaacacgaaaaaaccattgttcaactctttgacaacatgaaaaaacctaaaattctgcccttctatccaaaggatgggggggcagaggcctttggtgtccactccagtcaagaattggagcctcacaatcactagccaatatgcttttctcgcatgcctttcttcgttcatggttcgatattctggtgtcctaggcgtagaggaacaacaccaatccatcccgaacttggtggttaaactctactgcggtgacgatactgtaggggaggtcctgcggaaaaatagctcgacgccaggatgatgaaaagcttaacacctctcattcttattactttttcatattgaaaaaaaaaatgaaaaatgaaaaggttgtcttattcaaaaccccaattatgaaatcatcccacttcacaccccggaacgcaccgttcttatagagagaaaggcactttcacatccgaaatggctggggagaggaaaggttcctttttttagggtactcctgggaacagatccagtggagacggggtggggcttgtagctcagaggattagagcacgtggctacgaaccacggtgtcgggggttcgaatccctcctcgcccacaaccggcccaaaagggaaggacctttccctccgggggggtaggaaaatcatgctcgggatagcgatagcggactcaaagctatggaacttggggatgggtcttttgtcgaaatagagtggagtgaccttcttttttatttgaatttagatatatatctattatatctatcgcttttttaattttacatatagtatttttaaacggccgaatcagcatattttttgaagccccgtaactcttcctcagccaggcttgggcagaatagcggagcaagtattagtagcatagcaaaaatgcgttcctcatcattaagtcattaaattcatatgtttgctcgcggtaattgtgaactctcgggagaatcgatgactgcatcaaagatgcacttgttagtacatctgaaaattctgaattggctagttgtaaatagccccaggactatagaataaaggattatcccgaacctacaccgaggtattgacggtgattctcaaatatcacagaacagaatgtgatacgatgagatagaatgcaatagaaacaaagacacagggaacgggttaccgactcttaacggtcaaagcgaacccgttcattcttacattctgaattcttaaattcggaatgaatcaaatctccccaagtaggattcgaacctacgaccaatcagttaacagccgaccgctctaccactgagctactgaggaacaacgggagattagatctcatagagttcaattcccgttctcaacccatgaccaatatgaactcgaagtttccttcgtaacccccggaacttcttcgtagtggctccgttccatgcctaatttaatagggaacctcaaagcggctctatttcattatattccatccatatcccaattccattcatttaatatccctttggtgtcattgacataagagatgtcgtttctagtctatctctttctatttctatatatggaaagttgcaaaatcatcatataataatccagaaattgaaatagaaaagaaaaaagggaggtttgtgatg

SEQ ID NO: 24535 - DNA, 3000 bp, Unknown; identical to SEQ ID NO: 9901
  misc_feature (1)..( 3000): 2750-1469P.txt file - cDNA_ID_2179272; gDNA_ID_2096291; Annot_ID_195412

SEQ ID NO: 24536 - DNA, 3003 bp, Unknown
  misc_feature (1)..( 3003): 2750-1469P.txt file - cDNA_ID_2179276; gDNA_ID_2096291; Annot_ID_195413
gaacctaaacctgcgctcgagagatagctgtccatacactgataagggatgtatggattctcgagaagagaggagccatagtggtcccctccggaccgcccggatcccacgagtgaatagaaagttggatctacattggatctcacctgaatcgccccatctatcctcctgaggagaagtttggtttcaaaccccggttcgaacaggaggagtacgccatgctaatgtgccttggatgatccacatctcagggtcaggcgctgatgagcacattgaactatccatgtggctgagagccctcacagcccaggcacaacgacgcaattatcaggggcgcgctctaccactgagctaatagcccgtcgtgcgggcctcctgctgggggcccgctatgccaagccaaaagcgagagaaaccccatctctctctttcctttttacgcctccctgccgccacacgagagggacatgggggcgtaaaaggggatcctatcaacttgttccgacctaggataataagctcatgggtttggtcttacttcaccgtcgagaaacgaaagaaggcttccacctccaagtttaactcagacgtagctcccttctttttgggtgtgaagctgtgtcaaacctaaatacccaagaagcattagctctccctgaaaaggaggtgatccagccgcaccttccagtacggctaccttgttacgacttcactccagtcactagccctgccttcggcacccccctccttgcggttaaggtaacgacttcgggcatggccagctcccatagtgtgacgggcggtgtgtacaaggcccgggaacgaattcaccgccgtatggctgaccggcgattactagcgattccggcttcatgcaggcgagttgcagcctgcaatccgaactgaggacgggtttttggagttagctcaccctcgcgggatcgcgaccctttgtcccggccattgtagcacgtgtgtcgcccagggcataaggggcatgatgacttgacgtcatcctcaccttcctccggcttatcaccggcagtctgttcagggttccaaactcaacggtggcaactaaacacgagggttgcgctcgttgcgggacttaacccaacaccttacggcacgagctgacgacagccatgcaccacctgtgtccgcgttcccgaaggcacccctctctttcaagaggattcgcggcatgtcaagccctggtaaggttcttcgctttgcatcgaattaaaccacatgctccaccgcttgtgcgggcccccgtcaattcctttgagtttcattcttgcgaacgtactccccaggcgggatacttaacgcgttagctacagcactgcacgggtcgatacgcacagcgcctagtatccatcgtttacggctaggactactggggtatctaatcccattcgctcccctagctttcgtctctcagtgtcagtgtcggcccagcagagtgctttcgccgttggtgttctttccgatctctacgcatttcaccgctccaccggaaattccctctgcccctaccgtactcaagcttggtagtttccaccgcctgtccagggttgagccctgggatttgacggcggacttaaaaagccacctacagacgctttacgcccaatcattccggataacgcttgcatcctctgtattaccgcggctgctggcacagagttagccgatgcttattccccagataccgtcattgcttcttctctgggaaaagaagttcaggacccgtaggccttctacctccacgcggcattgctccgtcaggctttcgcccattgcggaaaattccccactgctgcctcccgtaggagtctgggccgtgtctcagtcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggcaggttcttacgcgttactcacccgtccgccactggaaacaccacttcccgtccgacttgcatgtgttaagcatgccgccagcgttcatcctgagccaggatcgaactctccatgagattcatagttgcattacttatagcttccttcttcgtagacaaagctgattcggaattgtctttcattccaagtcataacttgtatccatgcgcttcatattcgcatggagttcgctcccagaaatatagctacccctaccccctcacgtcaatcccacgagcctcttatccattcttattcgatcacagcgagggagcaagtcaaaatagaaaaactcacattcattgggtttagggataatcaggctcgaactgatgacttccaccacgtcaaggtgacactctaccgctgagttatatcccttcccccatcaagaaatagaactgactaatcctaagtcaaagggtcgagaaactcaaggccactattcttgaacaacttggattggagccgggctttcctttcgcactttatacgggtatgaaatgaaaataatggaaaaagttggattcaattgtcaactactcctatcggaaataggattgactacggattcgagccatagcacatggtttcataaaaccgtacgattctcccgatctaaatcaagccggttttacatgaagaagatttgactcggcatgttctattcgatacgggtaggagaaacggtattcttttcttaaacttaaaaaaatagagaaataagaaccaagtcaagatgatacggattaatcctttattcttgcgccaaagatcttcctatttccaaaggaactggagttacatctcttttccatttccattcaagagttcttatgtgtttccacgcccctttaagaccccgaaaaatcgacaaattcccttttcttaggaccacatgcgagataacgaaaaaaaaaaagagagaatg

SEQ ID NO: 24537 - DNA, 3000 bp, Unknown; identical to SEQ ID NO: 8872
  misc_feature (1)..( 3000): 2750-1469P.txt file - cDNA_ID_2179402; gDNA_ID_1971910; Annot_ID_177068

SEQ ID NO: 24538 - DNA, 3003 bp, Unknown
  misc_feature (1)..( 3003): 2750-1469P.txt file - cDNA_ID_2179474; gDNA_ID_1971910; Annot_ID_177090
acatgaaccagaactacagaggtcctcctccaccaccaaacatgaaccagaactatcagggaccaccagcaccaaacatgaaccagaactatcagggacctccaccatcaaacatgggtcagaactaccagggaccaccaccgccaaacatgaaccagagctatcagggacctccaccgccaaacatgaaccagagctatcagggacctccaccgtcgaacatgggccagaactacaggggaccttcactgccgccaccaaacatgagtcagaattacgagggaccaccaccaccgaacatgaatggaggatggtctggaaactaccagcagaacggtggataccaacaacaaggtcagggtggtggaatgcagcaacagccttacccacccaataggaaccagagttaaaccgtcttgtgttttcatgtataggagcggataccattttgtggtcagtgttcttcagtttgtcactctgctttgtgagagagagactgagagttttagtctaataagttctgcatgagttattgtagccagcactcgtcaatctatttatttattatatcctcaagtcaaccttgtttatttatttagtggcacaagaaaaaaagagaaagctataaactaggagtagaaaagagttaatcaaaatccatcgatttcatggcaaaaagaccaaatctcgataaaacatcacttcctcgttggttcttagcagcttggatctgatcagcaagtgagatatctcctcttgttcgctctttccttatcaaatccaaatccagtttctccagtttagctgcaactgaaacaaccctatccgttccaattgcgatcttaccaagacttgttttcttcttgtgaatctgacaagacatttaatcaaaccaaagaatcatcaagtgggtttctaatattcttcagagtcatcaacggagtagtttttttatacctttgttagtctcttctttagtttagaacgtgaagcaatggttggattctccctttcctgctttggctttcgaatctttccttctcgtcggtctttctcctcacgttctttctttttttctgcagctctcctcatcttctcggtcctggcttttgcagcttcttttgctatcatcttggtttgttccttagctcttgctttctcttcagctaactgaagctgctcagatgaaaaatcttgttttattttttcatagctgtcccagtcaagttctgcctcgccacttcctcctttccttgcagcttctgcaatgttttctgaccacgatgacatgaacttctcctttaatcgcttcgatcttgaccgttctgcccaaacttgtttcactgaagctcttatcttctccttggtttcattactgcaagagacaaacttagcttagatatggctctagcttcattgttctctattctacactcaatactttacaaatctacctgtgtggttgttgatgatcggacatcttcttccgaacctgcaagatattgaagagaagaaaaagttctttgccaaataagttttcttccttcacttctcactgtaaacaatagaagatgggacaacaacaaaatgtccctgaatttgcattgaatcttacttgacttcaccttgggatttgtcaaagcttcgattgttctctgcttgattcgtcttcgagtgtctgttaaagagtatcaacaatctcactacacaaagcctcaaagaagaaacaatgtagaaaatcgaagaaaagatccttctaccttcactgtgtttccttcctttgttccatggcacctttcctttattagctaatccaatcttccttctcctttcctcttctttaatcttcctatcactatcactatcagcttcagtatctttgttcatagctttcacttccaaaagacttgaattgacttctttcctatgaatctcaaacacattgtacaatgaacctacagatttcaactccaagtgtctgatagacctcaaagaagcaagtgaattaggtattctcaaaacgattggttctttgagagtccaatagattgaatttgggaaccaccaagcgcattggaatggagcacgagttgattgaaatgtgcatttcatctccattgataaacctctgcaaaaacagtatttgaccaaatcgaaatcaaaataggtcaaataaaatcaaacaaccagtacctgaacgataaatcaatgaatttctacataattttcatcaaattagaaatagatttttataaatccttgatttcagagatgatttcaaatcacaagagataagagtttgagaatgcagaagcactcacaaatttagtgacatacacggcacggagacgaacaggagacaagagaaaactctgaaaagtttccttttatggtttctcaaacgcgaaagccattgaagaagaagaagaagagtgcgcagacacgaagagagagagagagagagagagagagagagagagcgggagaaacagataaggaagatgaagaacactaatgggccgtgaatgggcctaatctttattaataccttaaattacaatttaccctatttcaaagtaaagtacacctttgttttagaggttctctctctttactactataaactcgaaagtgtacccaaatgagtattatcttcatgtacatattaatttatttagtacggttttgatttatcattgaaatatgagagctgaagagacccaaaaaaatcggaataaatttgaacaccacaatgtgtaaagattttttccctaaaatcaaaaacaaattagacgaaaaatcttaaaaattaaattacgaaaaagacctgaaaggattaaagtaaagagggtggtggtatatctcatcgagtgtctcgcccagcttcttcagtcttcaccacataatattaataaaaagcattttcttctttcgattgcttcagattcgtcagctcactctttcctctccagaagaaaccctagacatctcatcgccaaaatg

SEQ ID NO: 24539 - DNA, 3003 bp, Unknown
  misc_feature (1)..( 3003): 2750-1469P.txt file - cDNA_ID_2179485; gDNA_ID_1971910; Annot_ID_177093
ttacctgatatacacagtaagagatcaacataagaactgaaaggattagagcaatcaacacggacaattgtcttccagaggttgagcccaacatctgcggaagctggacaatgacgaacggaataactgatatagccattattcttgcagcatagctggtccaaatatcaacagttacaccagaatctacaaaaacagagtaaacaacaataaggaacccgcatatagtaaagcacaaatactaaattctactgtattcatcagtcccttataaaaacccatacaaacgaagaatcctgaaggtgtaaccgtataagacacttccttgttaccttttaggtgaaagcctttggtgtcttggttgtttacagcaattgaatcacgaagatcacacttgccaaccacagtacaagttccccagataacagtgagaagcataacagtggaaccagcaagcaaacccattcccacagagacttggctttgagcagttgctgcatctccagatagtccagacactgaaagccaaaagacattgtttataaccaaagaaacaccaaacacataataaataacccatcaagataacaactccacagaaaaaaaagataagattttgactaaaaagcacaaagtgacaagttatgagttcatcggttaacatcagtgtatcatcatcatcttttcacaatttggtatcacaaaacccaacaaaaattcactttttgttaatccctgtatcatcatttgattcacagaaccaatcaaatattcactttttttgctctctcaaaattcaaagaatcttcatcaaagcaaaacaaaattcgtctatttcactcaaaatgaatttcaatttcgcatttgctacataactcgcacacaagcatgacactttatagatcgaattgaatcatacgaaacctcaggatctaaatttgaaactttgaaaaaaattaataaacattttgacatacccatgataagcatagcgtcaggaagagcaccaagcatcggaagaaacaaaccaccgacaattccaggtccaaggatctcaagaagaagctcacttccagcagagagatacgtcgcagccgtaaacatgagaaatccataaaccaaaatcagaaacacgtttccaagagcggtcttagtacacggcataaacccgtatgtctgctcacaagcttcctccttttcctcagccggagccgaaacaaccgacttgataaccgatccggaaccggcgagatttgaaccaccgtcgattccatcggagattagactcgttgaagatgggtttagggagacgaatcgagcgtaagcagatgaagtgaagaagagaaggaagaggagagagatgagagatctgaatctcatgattgatttcgaaagaagaagacaacaaaaaaaggtgaaatcaaaggaggacgttgttcatggagaaatcaatcagtcgagtttttgtggatgagtatgtatatatatacacacacacatatacgtgtacagataataaagttgtgtgtgtgtaattcgtgtggggcagttttttttgtttggagaagatgataaagctaataaggaagacgaagaaggcagtgactaattaccattttagccctgttaatttggcactacaccattatttatgtagtaagtaccaaatcgtttgattttttccaagattttcttctgtttatgtttaattagtcaatttaggaatataccaataatacaaaatttgggtgtataagaaaagggggaatataaatttgttagtgtaagttattaataatacaaaatttggttacatctagaagaaagatgccaaaattagttgttacttattagggtgtgttattaataaattaacaatataaaatttgcccactacaaaaagtaaaagtaaacgtattgggtactacaagtacttcttccctacattaatgggattcctcaaattcaacaatggatttgttcagcatttatttattttcttttttagcattttgatatttaaatactatataaatttaaatactccactagtataaaagttcaaaaacagataaggtagtcatcaattcatccggatttatgatgatttttttttgtggggtagatatgtctacttttttcaaaatttcggttatttatgagaggctgatttttttctatatatacagcataaattaattttcttgcaatatttatttatagttaaaaaattatttgaccttagtctcaacttaaaaaactttcggggtcaatcgcaacaatataataggcagaagctgaaaaaatgaaataaaagtaggtaagggcgattcgggaaccgtacgttttatttgcttagaaacgttcgttagtcattattaccagatttgattacgcggccacacttgtaataataaagcttaagagagggcaaaaatcaaatatttgtcaattttgccgacattatagttagattagataccatacaaaaatcataactatttaaaatatgatttgtctgaattctgtatttatagaaaaatatcaaacgaaagtgttgaccaaaagagcggtgaagacgctgacgctgagctgcgtttgagtaatgtcaaagaatcaaaacgtcacgtagttttgtctttaaaaaaaacaacacgcatgtttgggtattttcgaatgagatcaataattgggcctagtttagtattggcctaaagcccataaagaaaggagcgaaatctgaaaagtcagaagacatctccttgcacctttcttctctcttgctgtttctatggtggtggtattagggttttggaaaacccctaatctcacctgagaaaagcttcatccttttgtgacttttaaacttctcttacaagtcttcttcgtcatcctcctcctgggttcagcaattctcgccgaaatcgtaacctccgagctcacagttctgcaacttgtgggtgtatattgattcacaccaagatttagggattaagggtaatg

SEQ ID NO: 24540 - DNA, 3000 bp, Unknown; identical to SEQ ID NO: 8876
  misc_feature (1)..( 3000): 2750-1469P.txt file - cDNA_ID_2179498; gDNA_ID_1971910; Annot_ID_177100

SEQ ID NO: 24541 - DNA, 3003 bp, Unknown
  misc_feature (1)..( 3003): 2750-1469P.txt file - cDNA_ID_2179524; gDNA_ID_1971923; Annot_ID_177193
gttgcctgttgctgcttaattaggaatgatcggccaattctttccacgaatataaggaattgaaggcaataaaagtgacggagttttacctttaggtaacgaagacactttatctcccaactcacttgccttaagaataataattacataattgtatcaactaaatatatacattatatatttataagtaaaaaagttctttgaaatatatttctaatattcttttacttaaatttgtatttatttttatttgaaatttagttctaatattttactgtatcaaaaaattttggtgttgtttctgtacatgatactatcttttacttgtaactgattctagaaagatattttctataataaataaattgtatatttttttaaaaaagttattaaaataggaaattctctctataaattaatatttattaatttatcgataagttaaaacctctgtaagttaataatattttgtagtcccaacattattaatttatagaggttttagtgtaataagtttctaatttaccttcttctatcatgtgatctggctaaacactgattatattctttaatcaaattcgaatagaaaacattcattgtttaatcattgagacaaaattttcaattaatgtatgttatgttagaaaacaatgtggatattttgctataatttatgtgtcacaaatttagcaatggtttggtctacctacgttaagaaaacttgttgtgatttggactggggacaggttgaagggttttaaatgtgcttttactaatggactcaatttgagcccatttcagtttctagcacatgcttagcacatggtccttctcaccaaaaagtaattcacatgatttatatattcaaaagtaaattttatttttaaatacataaattttatcttttcttatagatatttgatatttttacataggatccagcgatttagcggacaagaaaattaatgtcatgcagactaccagttttttttaagtgtcaggctatttaaccatataagaataaaaatatatattttaaacaaaaagaaaaaatatatattaattcgcaatacgtaagtataggttacatcaagtattcaatattgtgacccaaaaaaaagtcaattattatcacccctgagtccaaagtccatattcacattttgggatttgttcccacttttgtatacactgtattttagatcaaagaccttggtcaaagaatcagattttcatttactagtagtattattttttgataaaaagctactttaccaatcgattaattacatttctttcatagttatactatgatcattgtattatatgaaatgtctatctacaaatgtcctaattatttgtcagtttatatcgcactattaacttgacatgactttcacttttttactaaacccattagtcaaaaagtggtggagtcaaaagtcgttgatcgttgacttgggatacatgggggagaaagtgttaagtgcccaaacaaaaagacagcgactcattagagaattacgtgttataaattaaacttttttggtattacaattcttaagtcttgcagtatttgataatttgggtaattaatcgagtctccaagcaaaatacatatataaccataaacttgaatatacttgcagcactacatatgagtgggatacaagcaatatattttttcattattcaacacattcgtcaaagtcgagttaatacgggccatgtgagtatctccacaatactcaagttactgttaagtgcataatcatcactaagtatagtttacaaacatacaattaacacattgaagtaatctgtatatatatatatatatagtgtttacaaacatacaattagtcatattattaacgaacttgcaactagtcagttattaataaacgtataattattaaattacgcgaggatacaaatagatttattcgtatttactaagcacatgagcaaaaacaatgaaagcgcgttgagaaagaacagaaaagaaagcaaaaaaaaagtgtcgtttttggtcctccatgtgagtgatctgtgatctcaactttctcacttttgcattaaattcttatcctttttctttatttcctttttcatgtttgtatttatttaatttacgagtagtttgcattatcatacattcatactatagattcgctaaacacgtaaaaatagagacaaattattagtattaaacagaagtgacaaataccattttagatgattagatcattcgattgaatagactcccattttaacgaggtcgttatcggatcaatgtacttattcaatatggtagctgcacatacaaaactagatacaatattaatctagaaatcaaactaaatatatagttgtaatattttaagtggaaagatagccttttgtctctcgacaatgggatcaccattaaaccaaatcagatagaagttgtgggagtagttatgcttaaattccttttgttttttcacataataatagcgtatgaaaatttagttacacatacacaaaaatgtctcttctatatttatttataagaaaacgacttttctaattttagatctcgcaaatgattgctattgtttttttactactactcacgtacaatgaaactttccaacaattcattttttttttacttatcacctaccaaatacaaacaatcacataaatacaaaaaaatgcagaatcatataaaaaattagacaagtagcagagaatctgcaacatgacggtgcggttaaacagtagtaagtacattgatattatcaaagggactgaattagtaaattctctggtctccatcttctctcttatcgttcacacacacacaaacactcatatataaacacatatgcacactgtcactaatgcttctctctctctctctttctcttttcctatatattgacaagcttgcgatctctgttcgctagatctgtctgaaacagtgaggggattcctaggtttcagagcaaagtaatg

SEQ ID NO: 24542 - DNA, 3000 bp, Unknown
  misc_feature (1)..( 3000): 2750-1469P.txt file - cDNA_ID_2179548; gDNA_ID_1971923; Annot_ID_177202
aaatcacataatttagttaggctggtaagacaaacttaaatacaacgaaatccactttattaattcacattatacaacacagtcgatatcattggagcaaaaactctttataaactaactaaatgatgattagaacaaatatagatatattccctttggcttttgacttcaacacaattcaagaacaaatgatagtgtgacgaagcgagacgacatcgtttccaggtctcaagcttctgaccgaatcagggagaacaatcctttagccatatatagaatcgacaaattgggttgatttttccgactttgacttagccctcaagataacctttgttttgcaggtaagagatgatgttctcagccatctgacgtggcgaacacgactcgtcgtctcctgtgtgtttcagcactacctggaggatattacatcaatactttattagtacaaatttacgttccaaaatctatctgatcattcacgtgacgaacctcgcaattcactggtgcctcgtaagggtcgtcgattccagtgaagcctggataattaattcaagaaaactcaacaattagctaggtcaataagttacactcaacaattaggtcaataagtcaaactctacgaatcgaacaaaataaaaagtcaaagtcaacttttatacaagtacgttttcttttttttgggatacctttgattttgcctgcacgtgcaagcttgtacaacccctttggatctctcgactcgcacacatgaagaggaacgtccatgaagacctaaatcaaagtaagttttcgtaatgtaatcaatgtatactaatatatcttctataacaagcaaattcatatatagtaaaacgttatagcgtacgtacctcgacgaaatcgccgtcaggtaacaaggaccggcacgcgtctctgtctctccggtacggagaaatcaaacttgctatacaaatgactccgacgtcagcaaacaacttagccacctcacctgatattaaatttaaagatcaatcacaaatcactttacaaaaaccattaagcatataccataaaacgcgttaaagaaattggtttcatgagttagtaaacacatgattataatttttggaagaaaggaaaaattgtgtaccaattcttctaatgttttcggtgcggtgctctgctttgaaagtgaggtcacggttaaggccgtgacggacattgtcgccgtcgagtgtgtaagtaagtttgcctctttcaaacaatgctttacttagtgcacaagcaacagtgcttttccctgaaccactgagaccagtgatccaaacgacacaacccttttgttgaagaagttgttgtctgtcgcatctgcatatcgaactctcgtgccacacgatgttctctgctttctcttttccgttatttcttccctctttcagtatagtttctgcgcaaacacaaagttaaagagattgtaaaaatggtcagaaaaaaacaacaacacgatttgtggagatgcttaaacctaaattgctttttctgaaatgtgaacgatctgctatatgacgaaacagagagagatgggagaacctgaaagggcgggaaaatcagcggtgagggaagcttgagcagagacgttaacggctgagattggatgaaaggaagtagaattcgctactaattttcggctgtccgccggaatagacgacgcaggcagcttgaggaaaccgtcacttggaggttttcggtgggaatcgccgccgagacctggaatagaacagaaaaccgacggtcgagatgctctgatagctaatccttccattgaatccgacggccaataactgtgtgggggtttacagttttatgtgatcgtacaaaataagtttatgtataagaaagacggattatattgaaaatatatagagaagactttaagaggaagaaaacaggtgagaaggagagtaatggtactactactaccaactatataattcctccacaaaaaacacatgaccatattccaacatcatttcaatagtcttaatgtcttattaacaaaaaaaataatcaaaataaaatcatacattcttttttacacaaaacagaacaaattattagtattttaccggttattttttttgacgaaacaggtatgggaatattttaccggttaataaaaaaggtttatttatttatttgtgtaatttgaataataataaaaaaaaaactatatagtggttttggtatgtgtgcatgaatcactgaatcactgatgatggaggccaatcttttgggaaaatgattgtatgactgattttgttccatctaccaacctaccaatacccattcagagacccatgtgatttaataagctatatgtctttatacttattttatgatcttactttatctctatgcttattagtatgactttattttcttgttcaaataaatatgcttgactgtatatatttatgaagggaataatggagtcaaataatatttccaaaatcagattcaacactttcttattgcagtacttgtttgattttcttggtttctcaatttaccgggaagaaaaaagaatccagcaagttgttctcaacagtcaaagcaggcggttccctctttgttaaagggcttacatttatattgggccttgtagcccaactgtactaggttttttgtggcagactcaacttagaccatgtacatagctcatatttttagagtatcagtagcccatttacaattttttaatggaccaaccacaaaaaactgggctgagccgtatcagtctattgagacttctgatactcagtctcatattacgtggcaggctctgattggtcgtccatttatttttgtcgaaaaaaaattccttctgtttctctcaaaaaaattctctctcgtggggaattttccgattccttctaattttgccgatcaattttcttctgtttcgattccttctgaatctcttcccttttctcgaaaatccttctcagatcatcatccatg

SEQ ID NO: 24543 - DNA, 3000 bp, Unknown; identical to SEQ ID NO: 24542
  misc_feature (1)..( 3000): 2750-1469P.txt file - cDNA_ID_2179548; gDNA_ID_2926219; Annot_ID_203212

SEQ ID NO: 24544 - DNA, 3000 bp, Unknown; identical to SEQ ID NO: 8917
  misc_feature (1)..( 3000): 2750-1469P.txt file - cDNA_ID_2179563; gDNA_ID_1971923; Annot_ID_177208

SEQ ID NO: 24545 - DNA, 3000 bp, Unknown; identical to SEQ ID NO: 8917
  misc_feature (1)..( 3000): 2750-1469P.txt file - cDNA_ID_2179563; gDNA_ID_2926219; Annot_ID_203218

SEQ ID NO: 24546 - DNA, 3000 bp, Unknown; identical to SEQ ID NO: 8972
  misc_feature (1)..( 3000): 2750-1469P.txt file - cDNA_ID_2179667; gDNA_ID_1971952; Annot_ID_177348

SEQ ID NO: 24547 - DNA, 3003 bp, Unknown
  misc_feature (1)..( 3003): 2750-1469P.txt file - cDNA_ID_2179705; gDNA_ID_1971952; Annot_ID_58637
acaagaacgagcgtatcaatgggaagaaggtgtgaggcacacgtgcaaagagagtgtttaataaagtaataagtttataattagtatttcgctatatatatatatatatatatatatatatatatatttattatcttaggtcttattaaatgtaaatatattagttatggttagaactagtataacaaacttatggaaatgcgtacattgcgtctgaaaccattaattagcgatatatacatttgagatttataatcataaaaatctagagtccttttgcttatacaagacgaacacttataaacgtttccaaaggggggaactttcgaaagttgttgaaatgagagatatacaattgcgaagtatagagaaataaacttcaggacattgacaataatatgaaatgaagtacacgatttagttgataagaaaagaaaagaaaaaaagtatacacgattaatttccttttagaaaaaccaatcatacatcgatttgatgtttaagtctagaatatgtgatgcaatttaaattatctgtttttgttttccctgagtacccaagaatattgggcggagcagattgatgccaatatcaatatgtaatcagtacatgcatgcatgtggtatatatagagagaaaattgtatgtttttgcttacataacttaaatcaaccagacaaccagtgatgcatgcatgtggtatataacgaaattcacatgaatgttctttatcttaaggaaaaaaggaagataaatcagacgaaagttaattgtctcaaaaggtaaaacaaatgtacgatacaatgattaataacaaattgtatagtatagctagctaccacaatctaagtatcgtattcgtacgtaatttcgtatggatagagaagtaagtatatatgtgagagtgtctgagagaggagaggcacgagaatcgtgttgaccgtttcgtgtggagttctttagtaagctaaccaaccttcatgtctgtcgtgctccttttcttcacaacattaatcctcccttttctttttccgtactttgccattttcaaaattagttttatttcacgaaattcttagtatttcatgacttcattttggtgggttcattttcgtgaattacttctaaatttcccccattccttctccaaatcagtagagccgctattaataagaaagtgtaacttccgaatgacaatgacggtgcttggttgtgtttgctacaaacatagaactcgaatttttcaaataataagagtgttggacattagtatagcgagacaagatgatgatgaattcaggtattctcacaaggcaacgttcccaaacagcaggaactaccacaagagcagtttagcttgtcgtctctgttctctccggccacacttacgtctccataactgaaacttaactcctcctctgcgattatgtcctttgctgcaaagaaacagagccgaggaagcaacgctcctgagcttctcaacagaacagtggagagatttccaccgtcacaagaatggttgatgaatctagcaacgttcccaattcttgtggcgtcgatgtttatccttaaacaagcttgtcctgaagggaggtgttcgcgtacgaccaaaagagctgaagcgaaggattgtgttgatctgagtttgtcgtaaatgttttgacgtctacgtgcttcatctgttgtcaatagctcacctataagaagagacgacaaaatcaagtttatgacttttgcataaaccaagtcattaaggcagatcacaaagaaaaaacacattcaagaaagaagaaagatttgtcattatctctaatctccaaatccagcattgtgatactacctctaaacgattgaaacaagaacatttcgaaagctcagatctttcactgatggagatcactcttaataccatgctagaatctcatctcaacgcatcgagctaaatcatatgcagtccaagtgtaaaaggctaataactaatgctaatattcctcaaatcatgtaatcttaagcttgattttcaagttccaattatcaatcttccaaaattagtgacctactgcaataaaacgaatcactatactattaggaaaccaaaagttggttaacgttacctaatgctaatattcctctaatcatgtaatatgaaatcgaaatgtaattgtaacctgcatattcacagatgaattggccttgcttgataagctggtcagcgtacaagcaccaacctttcttctcatctctcacaatcttcaaactaaccgaaacccccttctgcgtaacccggttcgaacaatcggacccgcatccacaacccgacccacattcgttagctatctcttccatccccgcgaaagctaaacacttgcagtatccttcctcacacctctcgcattcgcatcctgactcgtccactaaactcaccccaaaacgtccgctttcactcactgagtcaaaacaaggtctagactccgatccacattcattagcagcagctccccaccattgtcgcggcggaggaggagatgaagcggggatctgaaaaggtgtgtagatgaagtacgcgtatcgttgagaatcgatggagttgtgaaacgggattgagatgttttccaaggatcgtgcagcgtcgagagatcggtgaatggttagagatttcgagattagggataaggttttgcaggtttgagcaacaacggcgagttctcgagggtttagccatgggagaatcaaattcgcacatcggagaaatcgatcggcggccggaataatgtcggaagcttctccaagacaacgcgtcttcggtggtggtgactctcgcagtcgctgcatattttttctcagccagcgatatacaaacgacgtcgttgcgtttaattctatttatatccttaaattctattttaatttcacttcagtaagaattttttaaagaaaaatggcgagtttttttgtgttaatcataactatagatttactaccgtcgctttggtctgtgtaatg

SEQ ID NO: 24548 - DNA, 3003 bp, Unknown
  misc_feature (1)..( 3003): 2750-1469P.txt file - cDNA_ID_2179705; gDNA_ID_1971952; Annot_ID_177362
ttcgctatatatatatatatatatatatatatatatatatttattatcttaggtcttattaaatgtaaatatattagttatggttagaactagtataacaaacttatggaaatgcgtacattgcgtctgaaaccattaattagcgatatatacatttgagatttataatcataaaaatctagagtccttttgcttatacaagacgaacacttataaacgtttccaaaggggggaactttcgaaagttgttgaaatgagagatatacaattgcgaagtatagagaaataaacttcaggacattgacaataatatgaaatgaagtacacgatttagttgataagaaaagaaaagaaaaaaagtatacacgattaatttccttttagaaaaaccaatcatacatcgatttgatgtttaagtctagaatatgtgatgcaatttaaattatctgtttttgttttccctgagtacccaagaatattgggcggagcagattgatgccaatatcaatatgtaatcagtacatgcatgcatgtggtatatatagagagaaaattgtatgtttttgcttacataacttaaatcaaccagacaaccagtgatgcatgcatgtggtatataacgaaattcacatgaatgttctttatcttaaggaaaaaaggaagataaatcagacgaaagttaattgtctcaaaaggtaaaacaaatgtacgatacaatgattaataacaaattgtatagtatagctagctaccacaatctaagtatcgtattcgtacgtaatttcgtatggatagagaagtaagtatatatgtgagagtgtctgagagaggagaggcacgagaatcgtgttgaccgtttcgtgtggagttctttagtaagctaaccaaccttcatgtctgtcgtgctccttttcttcacaacattaatcctcccttttctttttccgtactttgccattttcaaaattagttttatttcacgaaattcttagtatttcatgacttcattttggtgggttcattttcgtgaattacttctaaatttcccccattccttctccaaatcagtagagccgctattaataagaaagtgtaacttccgaatgacaatgacggtgcttggttgtgtttgctacaaacatagaactcgaatttttcaaataataagagtgttggacattagtatagcgagacaagatgatgatgaattcaggtattctcacaaggcaacgttcccaaacagcaggaactaccacaagagcagtttagcttgtcgtctctgttctctccggccacacttacgtctccataactgaaacttaactcctcctctgcgattatgtcctttgctgcaaagaaacagagccgaggaagcaacgctcctgagcttctcaacagaacagtggagagatttccaccgtcacaagaatggttgatgaatctagcaacgttcccaattcttgtggcgtcgatgtttatccttaaacaagcttgtcctgaagggaggtgttcgcgtacgaccaaaagagctgaagcgaaggattgtgttgatctgagtttgtcgtaaatgttttgacgtctacgtgcttcatctgttgtcaatagctcacctataagaagagacgacaaaatcaagtttatgacttttgcataaaccaagtcattaaggcagatcacaaagaaaaaacacattcaagaaagaagaaagatttgtcattatctctaatctccaaatccagcattgtgatactacctctaaacgattgaaacaagaacatttcgaaagctcagatctttcactgatggagatcactcttaataccatgctagaatctcatctcaacgcatcgagctaaatcatatgcagtccaagtgtaaaaggctaataactaatgctaatattcctcaaatcatgtaatcttaagcttgattttcaagttccaattatcaatcttccaaaattagtgacctactgcaataaaacgaatcactatactattaggaaaccaaaagttggttaacgttacctaatgctaatattcctctaatcatgtaatatgaaatcgaaatgtaattgtaacctgcatattcacagatgaattggccttgcttgataagctggtcagcgtacaagcaccaacctttcttctcatctctcacaatcttcaaactaaccgaaacccccttctgcgtaacccggttcgaacaatcggacccgcatccacaacccgacccacattcgttagctatctcttccatccccgcgaaagctaaacacttgcagtatccttcctcacacctctcgcattcgcatcctgactcgtccactaaactcaccccaaaacgtccgctttcactcactgagtcaaaacaaggtctagactccgatccacattcattagcagcagctccccaccattgtcgcggcggaggaggagatgaagcggggatctgaaaaggtgtgtagatgaagtacgcgtatcgttgagaatcgatggagttgtgaaacgggattgagatgttttccaaggatcgtgcagcgtcgagagatcggtgaatggttagagatttcgagattagggataaggttttgcaggtttgagcaacaacggcgagttctcgagggtttagccatgggagaatcaaattcgcacatcggagaaatcgatcggcggccggaataatgtcggaagcttctccaagacaacgcgtcttcggtggtggtgactctcgcagtcgctgcatattttttctcagccagcgatatacaaacgacgtcgttgcgtttaattctatttatatccttaaattctattttaatttcacttcagtaagaattttttaaagaaaaatggcgagtttttttgtgttaatcataactatagatttactaccgtcgctttggtctgtgtaatgaaatctgtcattttcacagaggaaaaaaacttacaaagacaaaatccattgcaaaagagcgagcaacaacgacgaaatttcgaaatg

SEQ ID NO: 24549 - DNA, 3003 bp, Unknown
  misc_feature (1)..( 3003): 2750-1469P.txt file - cDNA_ID_2179761; gDNA_ID_1971954; Annot_ID_177435
tctttaatctctcactatgcaactttaaaagcggataatttggaacgaaaaattcgtactaaaccgcatcatatcacttatgtaaataacattcttagaaatggctctttagagctttaattaatagtggttggaaagaaaaagtttcctttagtttgtcaataattcatgaaccgtttcatgaatgctcttaaggtttgaataggttcatgagacaaagacccaaatctcaatataatgtttcgttttcaaggaatctagagcaatgcttcaaaaatcagcgaataactgagtgaatttatcaatcaaaatttcttctaatttcgagaactaatggcgtgagagctcatagcttggaatttaaaacgttttgagaatcaagtagttagagtttatgggtttctacttaataactttggcctctacttagttttcaaggaatgtagaatttatggtatttctttgttttggccaaaagtagattacaatctaaaagtatcagcgggtagcactagacttcgatattatttcactcattataaaacaacaaaataattttacaaaaattcgaaactttaaaactagcttttatgtttgtgccaccataaaagatgacggattactctgaagagaaatatcagaaaatgtgtatacgatattactatcaccggtaaaaatggtaactcaacaatcatctttgaagattagccggtaaataaaatattctctatatcggagaatatatttgggagagatgaagttttcactctcttaaatagataaactgaaattaaattaattagaattaaaattaaacaattaaaatttaattattttacattggtaaacgttattttccgccatttttatggctgcacaaacaaaaaaatagttttaatgtttaagtaatagtataataatatcaagtttaaagtgctacccaatttaactttgaaagttaaaaatatgtttttttttaatttttactttccacataaatcaactaagtagtgatctcttaatccagcccaccatttacattatccagcatgaaataccaaaacacttatagcatgaaatacccaaacacttttaccctattaaattaccccagtaaatatagaagatgattggcaagtgacttttaaggttttaaaagtagtcttaagtgaagtttttttttgccaattagatttttttgcctttttatttttccttcttcctttctcttcttttttaagtccgataaacgagactttcaaacaaataattctcaaaagctttgttttttatcttctccccaacttaattattaactctccacaaattacatttttttcacaaaacatttttgataaattatttattatcaattttatatctttcttttaagatctatttcactaataatttcatttcactaataatattttattttttggttcatcattaataaatttgttgatttttttgataagtaaaacttatacaattactcaataaaaaaacattcaaaacagttttagaaaacaatttgccataataatcgttcaagaatcattcaagataagtattttaattatttcaatcttttaatttatttttctaatgtttatttgatttgttagcaaatattttaatctttcagaaatttaagtggttggacgagacgacatccatatttcaatctggttatggagaaacaaaatcaaagtagtatagttggaagtttaggtgctatttagaaagaaaacattctttagatatttaacgatcaactcgaagctaatttggagtggaaacatctaaaaaccatttcgattatttgaagatggagtacaagatatattattatgatctttaagctccaggccttcgtctaaattttattaagtttatccccttcttgctaatatgtttggatattaagtctcggcatgaaacaataaatatcaataaatgtatcttttagaagattcatttcttattttatttctaaacatttgtcatttcttaaaataaatattttattaattaacaatttgatttttagtaaatccaaattcataatgcaatgtttggtttttaaaaattgaatgaataataagtatattttaaaatcattaataaaatttattgttacataaatttaattctaaatttattttataataataataataaataacagtcacagtttctaaagtattgttctaccaatcaaattttaatagccaaagtttctacagccaaagtttttacagccaaattctctatagctcaaaatttttaaatcaaaacttctaaagccaaaagcagtgtttaagaaaacgttaggcactaatcgaataataactcaatgtctagggtctagaacgcttaatcggggcttaaacgattatagacgtgaaagcttaacgtcgactgcctaaaccgttttttttttaaaccgtttttttttaaaccgttttttttttaaacctggccaaaagtaagagtggctaccaataggcccaataatctataacaactacaataaaaccgtcactgtttttaatgatttatggcgcgaggccgcgaggccgcgagtactagtagtgttgttagtggccagctctacgaaaatcaatttataaataaacaatactcgaccacgaacaaaaaataaaataaagaccactcgaaaagctccaaatctcacgcgccactctctctctctttctctctcgccatcactgctttcttcacgtgattacgttaatttactcgaaaagactcaaaaactttccttctctttctctttcattttctcgggaaaattctccaacgaagcttttttttgcttcttctctaaattaaattttggactgaagcaaaaaagaaaattaaattcgttcatactctacaacgaagcttaccacacaatgcttcttctactaccttctctttccaaatccatctccgtcttgttctagggtttatcccaatcgatttcagatcatg

SEQ ID NO: 24550 - DNA, 3003 bp, Unknown
  misc_feature (1)..( 3003): 2750-1469P.txt file - cDNA_ID_2179777; gDNA_ID_1971954; Annot_ID_177439
catccgtaaatataacacccacaaaaaaaaaacttataacacattagtcaaacaacataaaaataatacgatatttatttgtatagatttgtctgatccgataagtttaccttacttaatataaattaatatatatatttagaaattacaattaatatgatatatcttcacttaatctttaaaaaataatattacatttaaaaaacattacattttaaagaaaaatatagtctcacgatgtaccgcaggttaaattttagttgattatacaaaataccatgccaaaaatatattaattctttagagatattaattctttagcatgtctccacacggcatcagcaaagggacaattaaatagaatatgattcaccgtttcgtatgctagagatatgggtgtcaaaatgggtcaaaatttatgggtcaactcaactcaacccatgaaccctaatgagttgaaaattttgacttaaatgagttgatgggtcaaatgagttattgggtcaattggtttgatgagtaaaatgagttgggttgtaatggttaatggtttcaatggtttacccaattaacccatcaagttttgtaaaattgaattaaaccaaccaaaatctctaaaccaatgctaatttaagtttaaccaacacatctaaaccaatttaataaaatcaatatttttccaaatttcttaaatatacaagcgatgaaattgagaaaaagtaaacccgtgattttcccgccaaaaacgtaaatccgtgattttcaaaccaaaaacgaaaactcgtgattttcccaacaaaaaacataaactcgtgattttcccgccaaaaatgaaaacccgtgattttcccgccaaaaacgtataatggtaattttcccgccaaaaacgtaaacccgtgattttcccgccaaaaaacgtaaacccatgattttcccgccaaaaacgtaaatccgtgattttcccgtcaaaaacgtaaacccgtgattttcccgccacaaacgtaaacttgtaattttcccgctaaaaacgtaaatccatattttcccgccaaaaacgtaaacccgtaattttctcgccgaaaacgtaaacccgtaaaaagtggaatccgtaaatatcctaagtttgatgataatgaattaataattattaataatgataattatttattattattttataataataattaattaaattattacttaaattattacttaacccatttaacaactcaacccatcaaattaaatgagttatgggttgactcaacccatcaaattaaatgagttatgggttgacccaacccatttaacaaaatgagttgggtcaacccataactcatttaacaaaatgagttgggtcaacccataactcatttaaccctaaactcatttgattataagttgagttgagttggtttacctattttgacacccctaactagacaacctttttgacaatttatgtgaaaattattccaaacttttttatgcagcagattattgttaaaggttataaaaagcacattaattaaataaataaaaaatggcaaacaatcaagacattacttttctaatgctattttatcatcttcgatgtattttaatgaatttttattttaagactatgcgatacggtccaagttaatcattaaagttagactaagaaaatttttctataaataattttggatttttaaccgttatgaaatactaaattcaacaaaatcaccaatataaaaaaagggatttacaaaaatggcattaaaaagttttttttttcaagaatagcatctcttttgaaaaattccacaaatagcactcaaaactttaattagatattaaatataaataaatagtttaattaaataaataaatcaaagtaaatattttccgccaatattttttgtcaaaatttttccgccaaaaaatttccgtaccaattttttccgccaaaaaaaattccataaaaattttctcgccaaaactttttctgccaaatttttcccgtcaaaaaaatttccgtaaaatattcccgcaaaaaaaattcaagaaggtaactaccaaattccagaaggatgtcatataattcaggaaggctttcataaataaaaatttcattcaaaccttcctgaattttgtataatccttcttacatttcagaaaatgattatttaaattttgaaggattccacaaaattcaggaatgattctacaaaattcaggaatgatttcatgaaatttaggaagggtttcacaaaatattttttctaaatttcgtgaaactcttcctgaattgcttagaatccttcttaaattttgtaacatccgtcttgaatttattttatttttggcgggaaaacttgggcgtaattatttttggcggaaaaatatgacgatttttttggcggaatttttttttggtgagaaaatattgttgagaattttttggcgggaaaaaattatcggaatttttttggcggaaaaatattgtcagaaatttttggcaataatttttttatgtatttttattttttttaattattaattttattaattaaatataaaataattatttgagtgctatttatatcttaaaaaattttttatgctatttttgcctaaaacttaaatatgtgctatttaaagaatttctctataaaaaaccattcgttgatttaatatatccaataaataaatattattagctatctaatgttcaatgaaatttagagatttaattttgaaatgttcccataaatatatatttgcctatttaatatagagaattttctccaccttttttttttaactttcaattttcttccaaaatttgcccgccattctctgtgtctcttcgtctaagggtttcttccaaagaacgacgacaaaaccactgaacctaaaatccgaaatccaaaagattcatgcgaaaaaatcgttaaagagtaccaatttcagaaagttacattcttacagagaacaagtaattccccagaaatg

SEQ ID NO: 24551 - DNA, 3003 bp, Unknown
  misc_feature (1)..( 3003): 2750-1469P.txt file - cDNA_ID_2179789; gDNA_ID_1971954; Annot_ID_177442
taagatcttggagttggtgcaatgagtttttcttaaactacatcacaaacaaataacgataaactttgataagttttgtacgttttaagggagacgagattcacaggccacatcaatgtggagagttaattaacactatctcaaaacatatgcatgtgatcgttgtacggaagacggataataaggccttacaacatttaattttacacgtggtcagttgccgtaaaccggtacgtagtttcactgatgaatgcagggtttaggtttaagggtttagggtatagatataaaatgatgccattgagtgaatgctgcacgttctatattggctgcaaaatttgatcctcagtttctctctttggagattaagttcaccctctacccaagaagaatgaagatttcgaaaaaataagggatttgcattaattaatttatctaaaaataattattctattcaaaatcttaaacaaagaaaaagtcgtaattctattcaaaatataattttgcaacctattttatttaaaatattataacactcatgcaaatcttaaacataaattattatatataatattttgggaaacaaacacatacaaagtcaaggctttgaccaatatgaacgcattttccaccagcaaaatttgattcaatgcatgtcttattgcatttttctgttggaaactctatgcaagtacctatcaagaggggcttccttccatcaatatctttcgcttttgtagattctgaaatttataccggtgtaaaaatgttagtttatcactgaaaaacataaagaatccttagacaaatgtattgtaacagtaaaacgcatattcatctgtaagtattaatgtttgcctacttggattcaagagaacaaccatacataagaacacaaggaaaacacatttccttgatgaaaccattttaatccttttctttacgtattttgtgtcttttcttcttcttcccttttaacttatgaaatgaaatatatagttcaaaatatttcacaaatatagaatgttcggaggatatacagtaagatatgcttttgactttgactatgacctttgaattagatcatctccataaacgactaccaaatatttatggaaattgtttaaagtagtctccataaaaatcaggctattgatttcaaaattgtatgtatgtaaacttatttaatttgataataaaaaggttgactctggtatactacttaaactataccgattctttggtatacattatacattatacattgttcgtcttgcggtgaaactagtcataatgctgctaggtgtaatctatatcccaaggaaaagaaaaaaagacaaagaactactgaggtatatgatccacttttttcttctattacttttttcgttcctttagtaattgtatgtgtctgtgattattttttaggttgggccatcatcgtctcaagtaccaaatacaatctctctcacgcaaccatcacaaacaatccccgacatggtggttatgagtgaagtttaataattctatgaatgtgttccatttagtttaattttgcaaacatgaatggtagtttggagtttttcttatcttggtgttagtttttattttttgaaccaatgagaaatcgttggctataaatctaaacataaacctaagttcttaatggccctacttgttcttttatcaattccagtttcggtttcattcttatgtaatcgatgaaagaataaacattgcttttgttttattcacttaagtttgactgtttcaagttgaataagtcctcctgttttgtagaagttgaaacacgattagatttaaagtctgttttggatttagttgagttgagtttccttcgatcattctgttgtaaggtataaaaataccaaattcgtttcagtcttagtaagagaattattcagaacgttctctatctttcaatactctgtttcttataacaatcagtctaatagaaaacaaaaacaaaatcaaaaaacaaaaaaaaacgtgtattgaagaaattctaaacaaaaattaatggttttattgtttttgcttatttaaggtaatcatggttttctaaacgcaattatcgatttactaaatctaaccacaatttagaatcactatgttgcaattaaaagagaatctataattcgggatgtttaatagaggcaaaaagttgtttatggtgtataaataagaggcaaagagtttatggtgtataccaaagaatcggtatagtttatgcagtataccagactcaacccaataaaattaagtaaggcaaacttatcggatcagacaaatctatacaaataaagattgtattttttgttgttgtctgtctaatgtattataagttctttctttttttgtgggtattatatttacggatgtcaagttggttaaaccaaatcaaaccaatctatatccatataaatgtagtgtctaatggataatgagtcaatctaattcatttagcaaatggtttggataaaaccataactcatttaaattattgagttaatgaattaaataagtttattcagttaataatttttctatagatgataaaaaaatatctataatctaaataattatcattaataataattaataactattataatcatcatcatcatactaccatcatcattcgtgatcatcatcactattcatgatcatcataaatattcatgatcatcatcatcatcatcatcattcatgatcatgtttttggtcaaaatatcacgaaatcacgttttgaccaaaaaaatacgaaatcatatttttggcgaaaatatacggaaacactttctttctttttttgcggaaaatatgttttagacgtggaaatcatgaaatcatatttccgcggaaaatgcggaatcatgtttttgacggacaaacaaaatacggaaacacatttttgacagagaaacaaaatacggaaaataaaagcaatcattataaaacatagagcaaaatgcttggatg

SEQ ID NO: 24552 - DNA, 3000 bp, Unknown
  misc_feature (1)..( 3000): 2750-1469P.txt file - cDNA_ID_2179804; gDNA_ID_1971954; Annot_ID_177446
taattgatggatttggagattattagagaggtgagttgcttctctgagtggtgtcttggagcttagataacggatctatcagatcctttgctactgtggttgttgatggacactctcgacggtatggttcttcccctcccagatcggatttgaacttttgtggcttagtctcgttgtctcattgttcttcttctatattacatgtttgtttgggagacttgtatcgatggtggtgactctgtttgtggattatatctttagatctttgctctacctctctattgtgtcctcttacttgttcggagttgcattttggactggtttcgttcttggtgttggccactttgatggtatttcgttgctgagctacctactagcctatcttgtttggagttaggttctaggcaaagcaatggattcgttctctagttcttctctgggggacgtcatcagctttttgtctgtaggtgtgcggaagctgcattcgacgagggcccgcgtgtaagaactagtgatcttaattggcttatctcttgtcgatctccaaggcttttgtcttgtccctagtgcatttgctatctcggtttggttggtgaggtgtgatggtgtttgtatttgtgtctctcgttctggtggcttcttgctttcctccctgtcggattgctactggtttgacttcggtgtgaaatctttccgatcttattggtgcttccgacgttcaccgtttctttggggaagctttgtgagagcttttggttcctttgcgcaattttagtgcttaaatcttcgttttttcttaacggttgattttttttagatatttgtttctttgttttcattgctggtctaaatagtttctccgtttctttggggcttagctaccctcttttaagcttaatttctcgagacattttgttggtctgccggcttttatatttgaaatggtatcctactttggtttcttaataaaattctggcgacaaaatttttttttttcgaaagatcttgtcataaatatttcctactgccttttgcaatacgttacaatgttgacaattagtaaaattcctcattttttccttaagaaaatatataataccaaatgatgatgattccacgtatagatgtctatctcattgcgatactatattaatataaatcaatttcttccaatttctgaccatcatattagtattatattgacttttatatttggtctgcattaattatatgttccccataaatagttagcaaatccggttcggatatgtaggtccaaagccttttgtatttttatccacgcaaatttttcttgaatcgtacgtaaatattgaattccacgtttccatatacaaaaccaaatcaaatataattacttttacaacaaccccatttacgatttgagaaacaaaaacgtaaataacttacgaattttcatgttcttgaatcttttcagcaggaaaatagtaaaataactcaatgtttttatggaataattaaaaaagaaatagagaaaactgtttaattttcaaattattccaaattttgttagaaaagaagttgaccttgaatatctagtttgattctctatttgagatagctatttatcccttttagtttttaggttcataaaaatgtacagttttgtactttgcacattatcaaaaatgtagaagaaaagtaaattattgatttgattggtgacttaaaattatataaatttgttttacagataaaaaaactataaacaataccaaaataattaaaaataatactaataaaaattagaaaataacgactttacatgatatttttggatatcagctttgaatggtaattcattatcaaaacactacagtttgtatatgtttgacaattatcattcacaaaatttttatcaaaaacattacaaaaatttttagtagaaaactttattatacaactttctctgcttatttttttacagttttacactatttttaaagctcttataattgtagttaacatcaaaaaaatttgtacaaatttgtattaccaatcggactcattatttttgcgattagtaataactaaagaggtattagtccgattcggatctaatattggacttaagacattggaacttgggacgacctcgaataaaccctaacaacttggagagataaatacatttagaggctgtcaattttctaaaaaattaatacaaaaatcatagtaaatatattattattaaatacctagtaaatgtactgtccacctaacacttcaaaaaaagtttggtgtatcggtcaaaaaaaaaaactgggcaaccgataaaacaagtttccaagaagaaaaacacaaacgccaaatcagcccaagtcacaaatccgtcgtcgtttagtccacgtagacttcacaaagtctacctttttcaccggttataaccggtaaactaaaattctcctctcttttaccagtcccgttgaaactccgttaaacttttccgtttctccgtcattataaatatcaatcttcttcactctatcgttttttttttttccttcttcttccctctcctataaatctctccgtcttctctcttctctcatttcacgtcggagatcattttctcctcctccgcctccgcctccaccgccaccgccaccgccgccgccgacgacttttctcacttactcaacaccagaggtctctctctcactgtttcttcttctcctttctttcgatttcgtttggtagatttttagatctgatttttttctggtctctgtagctttacttgaagttgactctgtttctcgttatagatcttgatctgtttatgatttcgaataagaacagcttcaagcataattttatattcgaataaaaattagatgcaatgtgtttatttcgcgtgttccaactacacgagttttttttttttttttggattaggagttataacaatctcattgatcttattgttttgattttagatcttggtttagtgttataatg

SEQ ID NO: 24553 - DNA, 3003 bp, Unknown
  misc_feature (1)..( 3003): 2750-1469P.txt file - cDNA_ID_2179811; gDNA_ID_1971954; Annot_ID_177449
aatgatttctggcctagtggctttaacaactgacatcgttaatcaagtcacattacctaaactaactagctagtaagcatgaattttaaccccaaaaatatatatatatatatatatagtaagcatgaagggctttaaatcctattgttcttgggttaaaaaaaatttctatgtggaccaaaaaaaagaaagacttgcactacttcttataatttaaatttgaaagattgaatttcattttctataccatcagtcatagctataacaacattctataaaaacattcaaacatatttcacatttatacctgtttatacaaaagtaagttcagaatatgaggcatattgcgaaaatatctttcaatatttatatatatttatacctgtttatacaaaagtaaattcagaatatgaggcatattacgaaaatatatttcaatattcacatatataagctataggtcgaaaaaggtaaaacaattaagtatattgaagattcacccaacaaatattttattactgttatccaactaggacttcacaaattatatgctatgaattaaaattatactaggagtataaaacaggactctggaaaactatcaaaataacattaaagaaaatgatatgattggctaaatagctatcctgtaagggaaattgatgtaaattataaggtggttagaatataaggataacataataacatatcgtggaatagatgctttgattatataaaattaaaatagctagctatatcttgtagaggaaaatatttaacaaaaaaaaatcttgtagagaaaaatgatataaattataaggtggttaggatttaggaataacatatcgtagaagaaaagctaccaagaaaatgcaatacacgtcgatgaataaacaaatagtgtttaagctgttaaccatatgttcctcgtgttccttctttcagatcgacaaaaatatcaattcatagaataatcaaggcatgactcggcacaaatagaagactaccaaaccatttttttattaaactgtaaactttcaacctaaaactaatcggcgataggtatacaaattcatatcttatatataccacttaaaatcctactcaacttttaatgtaaaatatttttaatacgatctctcaagatgatgatttttctagccattaatcttgatttattcgagcatggatcgatggggcaagtattgggccgaactgatatggattagattgagtatgtgtagatcgggctctgataccatattagaaaagtatggatcgaactctcatatcatttgaatagtattaatataactttataacatacaacgatatatcatcgggaataattaatattctctctaaaataaaagtcagaaaaaaatatttagatatcctcacagaacgaaattccagaaaaataaaacatacaaacaaccaaaaatataaaatgataaagtaaaacttagaaaacaaactaataaatctctaatatgtgaattaactaggaactaccaaaaccgaaaaaaaaagtctgaactaaaacctaaaagatcgatgcacattatttatcttgtggagagaattaaccgaatcgaaactcattgtatagctcttatctctacaaagaaagtgatagagcattaggattatcttagatgctccaaaccaatccgagaagttgataacctcaaatctcactataaaagtgtactgaactaaagtccttacaaaaatgtaattatctgtatcaaatgaaaaagtaattatgttcaatatatatataaacattaacaattaagtttaaaactatgtaaactcataaattagatcaatgaacattgccgagtctctcttgtccagtggctctaccattcggtggtattttggcatttgcaagacaaaaaaaaagaaagaaagcaactttacgttacaatcatgtagtctttccataactaacacaaacgtttgagataaaacatgtacaatcgttttcattgaatttaacgttactgaaaaatgtatctttttatataatgatagaattcacgaaataagatatagaataatatataaatgatattagccaataattcttattcgattttgatttaaaaacttatagaatttaatatggtataattacagtttggttttgttaacccaaataaaatgtttcaagtgtcgtttattgctagttctagagtgtgattaagttcaatgttagagttatcatcttgaaacggtttgttataaatctcacttcaaaattgtggtggataataaagtataaataacataagctaatccacttattacctattgattttgagtttgaaaacaatcataaaacttaatgaagatggtaccaagtattattattaccgattttgaatttgaaaacaatcataaaactatagagttgaaatccatgtacataaaagaaattgttaatccatgtattattatcactacaagaaaacagataaacaacgactacagaaagcgacaacaaatgtagtcgtcgtttttgacgactacgtcacgaccgttttacgacgcatatacgacaacatgaacattagtagtcaattagtcgttattttacgactaaatatgttagtcggcaaatactcgtatagtaacaactatttaacgattatattatattagaaaaacgtttgttgttacatagtcgcaaatggacgactacagtttccgactgcggaagttagtcgcccaatcggcgactaaaatacgacacatatctgtaatcgtaaactagtcgcaactgaatcgcagaatagtcgcattaagttgttggaaaacgttttccgcattgccaagtaggtacacctaatttgtttgttgtagtcgtaaattagtcataaaaattcgtctatataatcaaaattcacgacactcttctttcacaaacaaatcaaaacaacaatcaaaagaaaaaaacaagaaaacaatagaaattttgtttattctataatg

SEQ ID NO: 24554 - DNA, 3003 bp, Unknown
  misc_feature (1)..( 3003): 2750-1469P.txt file - cDNA_ID_2179838; gDNA_ID_1971954; Annot_ID_177457
aatttattttctgtattacatatatatttgataggaaaaaggttgaattgcgtttttggcaggaaaatgttaaattgcgttttttgggggaaaaatgttaaattgcgtttttggcggaaaaatgttaaatatcatttttggcgggaaaatgttaaattgcgtttttgaccggaaaatgtgaaatctatttggcgggaaaatgttgaatgtcgattttggtgggaaaatgttaaattgcatttttggctggaaaatgtgaaatcatttttggcggaaaatgttgaatcccgtttttggcgggaaaatgttgaattgcgttttggcggaaaaatgttgaaggtcgtttttggcgcgaaaatgttgaattgtgttttggcgggaaaatgttgattgtcgtttttggcgggaaaatgttgaattgcgttttggcgggaaaatgttgattatcgtttttggcgggaaaatgttgaatgtcttttttggcgggaaaatgttgaatgtcttttttggcggtaaactgttaaatcgcggtttaggggaaaaaatgtgaaatcttttttgacaagaaaatgttgattcatttgaaaagggacttaaaaaaactcgtgagtacccataacccaatgaggtaaacccatataggtaaacccatatgggttttttttatttgggtacccagcccattttaaacctgtgttttttttccagaaaaaatagatctatggactcaaaattttatgtgggttttgggtacccagtgggttttaacccatcattaacatctctagtatcatctgtggaatataaccatgatcatcgaactaaatttttcgtatagctaattatatatatttgtgtagtctagtggtgaatgtactgtgaacatgtttcagttacagtcttttcgttctatcgaaccaatttttattgtaggcagtttgttagtattgtactgtttaatataattcaagaatatattttcagaattcaactctttttttcttcttctacagatgtaaatttcataattgacaaacaaagcaaaacggtatatatatcttgaaaaaccgatccacaaataataatctactactaaatgagcgtccatccactccataatgtgtgtgataatgcgtttatcaactgtgtttgtggatgttatataggttagtagctttaaaataatatattcaccaatctcgtattttagattaccatacctagatattttctaactatcaaacttaaaattaactagacatgcacggccctaatattctctcccaggcacggaattcaatgagccgcttcccttgaagatatgagcttcttcctccgacgtagctcctccggtagcttccttgtctatcggtgctagctgctaaggcgagatctctcaggcggatctctttttccggtgagacacctgagctgactttctttcatatgttttcaagccactctcgtcgttttccgatgtcttcggttgctttccttgatctgaggcctcctcctgctccaccaccggagtcttcttctccgccgactccaccagaaccacctgacccccctgaccctcagatctgcctctcctttaatgtatctcttgctcagtcgcccttgacgacgagtgtccctctccttcttgcaaagtcactcaatagctttggagtgctgcttctcgacgagtccctctttacaaactggtttggagagatgttcccccatgtttgcttgtcctcctcgtcctctacttcttgtaacatgggaaggaattttatgttcgttgaatgtgtggttcttgttttgtagaactcggggttaactcaatcgatttcgatgggtttagatattcttgtgtctacatttttgctctcttctagcatccttatcgccttgttgcgatcgcttactaaagtatgcagattctgtctcgatttagctcggtttaaatttgtctcatggcagtttagacatatttatttatttcagtttatctggccagctgcccaaaacttattggttttgaattccgacctatgtagagagttttattggttcaatttgatctcgtagaagtttgcttgaatattcaaaatgatactaagttaatcactattaatttactaaatcatacgagtaaaaatttggatttacgttaagctttgaaaacatattgagaggaatcatgaaatcatcttatgataataatgctatgttaggtgaaagctctctagtacttgaaaagattataaaagcagacgtagatgttattatagtatggagcaataacgggcagaataaacagcgagagaatcgaaaaagtatttgatggaacaatgttatgggtcgagatacatgaatgctcctaatggtttctctaataatgcacctaattattggacgaatcaacctcagccataaaatcaattgctcctccaccatcagtggtggagccataaatatatgttacggggtcatatatttgaccgtcacgaaacaaaatgttcccataatattttatgcttattttttcctaaaacacgaagtactattagaattcttttcaaaacgaagaataatgtcattatttctataaactccataaattggagccctatttgaatataaatttatatgtttaaattaatctgatatatgggtgagaagcaaaattgtatgaaatatatttatcatattttttcaagatatttgtttatcgaaattaaatgtataaccaatgtctaaagataaatcaaaagaagtgtaaaaattcatttgtatttaaagagaaagagaagaaaaaaaatgtagaaaaagaaacatgaaaatatatgaaaaaatgagtaagtgttaaatattacgtattaaaaacttaaaacaataaacaattactcaaaacaaagttgaagaactaaacatgggggtcctattagatatttcaagcaaactaattcaattactactaacataagcttgtaaaaaaaaattattaaatttatg

SEQ ID NO: 24555 - DNA, 3003 bp, Unknown
  misc_feature (1)..( 3003): 2750-1469P.txt file - cDNA_ID_2179873; gDNA_ID_1971954; Annot_ID_177468
gacttgatcaataaatccaaaaccactgttctccttcgacttcactaccctgccattatccaaaacaacaagggaggatcccttcttcccacctaatccctcacccacatctcttgacctaggaccactgtgacgcttattcttcctgccatggctttctctcaacaagctgctcaatctagcctctaaatagctatagccttcaacatacgcgactccatacgcttgtctttcatgtcaatataatttttaatcgaatctagtatgtgaacctgccctttagttttacggggtttagaagagccaggcaaggaagcatcaggttgtatggtatcctcatcaacacaatcataagtgctacatacatcactgttgtcattcctttcatcgggtagcgaatcagggacaacaccacctgaaaacatggacccttgaatgtgtgctcctcttttattagttgcaacatgtagtcaacagatagatcttcttcgtcctcgacccaacctgacttgaaagcgtcaccagtcggtgttccactcaaaacaggaacgactttaatctgaaaaacaaagagttagactttagccacatgatattatgttttattacatgtattaaaagtatttatactgttactaacagtgaaatatagattatgtacccatctgctccttaaaaacaacatcttatttcatcatataaccagatgttgtaatgcataccgccatacgtgacttcaagttacggattgtcagataaagaactgtgatcatatgtaaaaccatgcaatttttgcataaatcatgatataaataataaatagtaaatcaacacatattaaaaaaaactaaaccatattctacacatttacacatcacgatatgaatctatagcaatggctcttactgaggtaacaggttatgattattttaaagaaactgtgatcatatttaaaaccatgcaatttatacagaaatcatgatataaataataaatagtaaattaacacatattaaaaaaactaagccacatgctatacatttacacagaatgatatgaatctataattgtatgtttttgataggaaaagaagaggttttcatgataaaaacgagcatatgaaaattaatttacgagagcagagatgcattgctcacctgagactgccggtcgactttccaaacaagatccaacttcaaacttcataagcgctcaatttccgtatctgtttcctctatttctgagtcactatcttcaacggcttcagggaattgaaattctctgattcgaggaacactttaaaagttggagtgcgtgtgggaaaccttgaaccgtgacagatttccgcaaaagtttatcagctccccttgcagtaacactcttcaacgtcattaagaatgacatagttccccaaggaaaatttagaaacatgtctaaattttctgccatgtccacatggaccggagagattttacttctacccgaggttgggcataaaacgccatcaatcaaggccagcacagcgtaacgtaaacgaattccttgatcttgaaccactcgcttcttcagcctgccaacaacccactcaacagatacatcactgcggtcaaataggttgtaccaatacttgccaggcgccaattttcgtttctctttcctctctttcatacgaggcggtttgtcgcagttcaaaccggtaacattttgaaactcagaaatggaaaaccgaacaggggatccagagaaaattacccaaatttcttgtttcttcctaacaacaagctgcctcgttagcaaaaagtaaataagcttcgcagaatacgcggcgctttcggagaaatcaaataatttaccaaactgagattcccggagaattttcatgtcctccgcatctaacgcgttagcgatgtcatctatcaaagacagttcactgtaggactgcactctctcactgttgggctcggatccagacctagacaaccgacggggtaaagagttgttcgtcatctacaagtcgaacccttttctgcacaaaatagaagtttataatcagaaacagtatgagattgcagatttcagttaatcggaatacaaattggagaaataaagaagttgataccgatcgagaacgttgaatagcttaaaccgcatatattttcaaaattacctgtagccggatggaattgatcgcctaactgcgagattgaatctaaagaaacgatatgtatgcgaaacaatatagatttgaaatagatattcggagagtttgcagaatctatgggtagagaacggaagacgttttctctcggaaaaccagcaaatgaagcggcgctagttttttttttgcagctgctgatatttccaaaaaattgataataaatcattttctcgaaattaaaatctatatcgtttgcgtccacatacaacattgctcttaccaaggttttcaaaattctaatttctgcaatcatacgcctatacacctatatgtcccctaaccaagaacacagttatacggggttgcgggtaatttcaaatacgtctccgacatacactatagacttatagttagtttctatattattattgattttatggtcatttagtgcatatacccgtattattattggttatgaatctatgagctgtattatttgaaatgttctgattgggtggtgattttgtggaggtgtgaagcatagaaaaacttgaaatgctgatgtatcagtagaggagagacttttagagtttttgtggtatgaattatcttttcgattttgttaaagccaaaacaaaatgggctttgtagaccactaatataaaaattaaagtaagtaatgggcctattttgggcctttttctaaacactaaacaagttctcgaatgttcgccggagacaatttcggattcctccgtcttcctccaaaacctttgaattctcacgactcagagcactacttcctcttcaattcagatcattttcagaactgatacactacaatg

SEQ ID NO: 24556 - DNA, 3003 bp, Unknown
  misc_feature (1)..( 3003): 2750-1469P.txt file - cDNA_ID_2179882; gDNA_ID_1971954; Annot_ID_177473
ataaactcaacattgattattattagagacttatttcattaatttgttccgttaagatacttaaaacatccttaaattttattggaaagttggtgctttttctcaactaaatttgaaaaatggtgattgttttgacattttttccccaaaacaaagaatactaataaaatttctatttattaaatattatctcgtttaaactatagttttttttaatacttatttttagtaatatgtactcctctaaataaccacccttcatttttttcttatgtatttaactatttattacttgaaattctccatctcattcattttatctttaacaaccattactctatttatttaaatctcatttttctaattcatcatattaaacacatttttcaaaaccatttccagttagagcatatgtctatagtaccaaaatataataaataaaacccctaatagcaaagattattgcaatttaattttttatttctaacatgtttagtcgaaagagtatgaaatatgttatttgttatcaaatataacaaaattttcctcatgctcgtatgagttatgttctaattaactactccatatattaagcttttgtgtcaatagctaatttttgtttaaattaatgtaaatttgaatggttgatcagtataaaatagaccaaaatcaaacaagctaactatagtatataataaataaaatattaagttccatactaaagtaataaaaaataaaaatcgatgatatggaatacatggagaatttgattttgcatgatgaaaaatagtcaaaaccaacatatataatcgaaagagactacttcctaggccctagcaataattttattcttttgaagaagtcaagattcgataccttcttttagttcacgaatagcgttatggcgataacgttaatctctcgatttcaaaacgtgttcctgaatttttctaatgatattgtttctcttatattaaatcaaatagagtatatactttatgcatggtttactttactacagttttctttggttataatttattggaccataaaaaactagatagaaataatacaactggatacagaatcacaagtttccataatgaacgcaaaaattagaatgagacgtgtagataaaatgggtccaagtcatgtaaacgtgttcagcattatccactagtcttctcttcgtactacgaccccaaaccccactagcctacaccaatcaaacctacaccaatcaattataatattttgtcagacgagctttatgccaatctaatggctagttgagtgttttcttttcaaggtttgtttattgattctaaaacttgggccgcctgaagttgaatttgatacaacaagccttggaaaataaaaagtaatgtttaaaaatcacaaaacatatgatggtaagatattacttagcattatacactaaataaccaaattgtgaaattttattttgcaaaataaagtggtgagaaaattacaaaataaataggtgttgatttttcggattgtttaaaacaaatactatgagtttttatcgtgtattaaacaaatactagcttttaatttatctgatgatacattattcttaaatacaacaatccacttatttatattttcaccacaccatattttagcaaaaataaattaaataaaaaattgtatatcctaattaactcatatgttttacaagaacaaaacacaatactatttttatacgttccaaaactttgtattataattattttaatgtttctaaagttatagcaatgtgactaatgtaacataaaaaaaaagagatttatatcctaaattttgcaatgtcactaattaacaaaaataaaaaatatgagaaattaaaaaatgagatttatatctaaagttttgcaatgtcactaatataaaattaacaaaacaaaaaaaaggttgattttggttttttatgtatgtaaagttaaagcaagttaaactaatgtgatattaaaaaaaccaggactcagaatcccgcgatgtcgcggaggaaatattctaaatatgtttatataatgatttaaaaaaaaacaaatcgcatattataaattttagtaattatttaaagaatatatatatatatatatatgtatatatatattaaacagattaataaccgtcaataattttacaaaattttgcaataaaaaaaagatacagacgaagaaaaaaaactcgtcaatattaacaaacaattacgataataaacaagaaaaaaataatcatcaatgttttagcaaaaaattgggatgaaaacacacaagcggaaaaaataaccgtcaatatattaaccaaaagtatcaataaaaagatatgaatgaaaaaaggtaagtttcaatatttcattacaccatattttagcaaaaataaaataaaataaaacaactatatatcctaattaactcatatgttttacaagaacaaaacacaatactatttttatacgttccaaaactttgtattttaatgtttctaaagttatagcaatatgactgatgtaacataaatttaaaaaaaacaaattaaaaaaaattaaaaaatgagatttttttgttttaacatattctttcctatttatattatgaggattatatagtaaattttgcaatgtcactaattaacaaaccaaatatatgtaattaaatttagaaattttaaaatgagatttatatctaaagtattgcaatgtccctaatataaaattaccgatttagaaattaaaaaatgatggtgtttttatttatgtaaagttaaagcaagataactaatctgatattaaaaattaacaaaacaaaacatataaaattaaattagaaaataaacaaaatgtgattaaaatgatataaagagagagtcaaaaaaattggagaagagggaaggagcaacaaagaaaaagtctgtttatcatcttcttcttcttcaaatcgagatcgaagaagaaccaacaaaaaaccaaaaatg

SEQ ID NO: 24557 - DNA, 3000 bp, Unknown; identical to SEQ ID NO: 9088
  misc_feature (1)..( 3000): 2750-1469P.txt file - cDNA_ID_2180041; gDNA_ID_1972049; Annot_ID_178340

SEQ ID NO: 24558 - DNA, 3000 bp, Unknown; identical to SEQ ID NO: 9088
  misc_feature (1)..( 3000): 2750-1469P.txt file - cDNA_ID_2180041; gDNA_ID_1971984; Annot_ID_177675

SEQ ID NO: 24559 - DNA, 3003 bp, Unknown
  misc_feature (1)..( 3003): 2750-1469P.txt file - cDNA_ID_2180069; gDNA_ID_1971984; Annot_ID_58738
ttagagaagaatgaaacagagtttagtttgatgtaaaaggagttacgtgtaggtcacgcgattgaaatgctgtggatttatcttcgcactccgcttcaaccataccatgaccgatggagccggcctgtcgctctttctgaaatcactatgcgagttggcgtgtgggcttcacgcaccctcggttccacccgtatggaaccgacacttgttgactgtgagtgcttcggaggcgcgtgtgacccacacacaccgtgagtacgatgatcaggtgggaatcgatgtggtcgccactggacaccctttggttagccggtctttctttttcagagcagaagagatctccgctataaggaaactccttccgcctgatctacacaatacctcatttgaagctttgtcgtcatttttgtggcgttgtcggactattgcgttgaatcctgaccccaacactgagatgcgtctaacttgcatcatcaactcgcgttccaagcttagaaacccaccgctagagcctggttactacggaaatgtgtttgtcattcccgcggcaatagcgacagcaagagatctaatagagaaaccgcttgagtttgctttgaggttgatacaagaaacgaagtcaagtgtaaccgaggactacgtccgttcagtgaccgccctaatggcgactagaggccggcctatgtttgtggcatcagggaactacataatatcggacttgagacattttgatttaggaaaaattgattttggaccgtggggtaagccagtgtacggtggaaccgctaaggccggtatcgcgcttttcccgggagtgagcttctacgtgccgtttaagaataaaaaaggtgagacaggtacagttgtggcgattagcttgccggtacgggcgatggagacgttcgtagcagagctaaatggagtgctaaatgtgtctaaaggatgagagcttagtcgagactcgagacgttattagtaatgtagtaaatagttccttttcttattcgacatcatagtgtagtaactaatatttatatcattgcatctttcaacgattttttgtttttctgaaaaaatgcatatatcaatgaccaatcaaactctttagctcttttgaatattttttatgttttggtagacggaggtgaattttgtagagctttcacgatcgtagaaaacctacaaaatttcttcactatcacgtggcgacttcagtgacaagtttcattagtttgaatttttcatatttatcaatactaacttgttcgtatatttacgcaaatactttccatacctaaatttttttatagacacacatattttggtcataaaatcaaataaaaatcttatgatataatataattgatttgcgggtaaaaataatctctaaattaagggtgatatttttacgaagcttgtaacaataactttttccataagtgtgtttatttttagttttttatcgatcatgctcaaaattattccagcctataatataatttttgaggataaatgactagaagaggtttattctcacaagtcacaatccactgattgtcaattggttttcaaagacacatagaatttaaaggttaaataattgcataccaccaagacagtcttcttagcggctccaattggttttgatctcatggataggatcgtgacaatcacaagaacttatcatctattaatagtcctcccaatacatttgggaaatttcttggatctgaatacgctcatggaaaaatattagtggctttgtgccacaagatagacgactatctaaaccaaattatggaacattgttatcaacgacgataaaaataaatgaaaacaatgaaaaagcatgccaaaaaaattgaacgaagacacttaagctacaaacttacaaagtaactgaaattgttaagctctggatttattacacgattaaaagaaaacaaaactagaagcagcaacgtacacgatactacttttatattttctgtcacttgtcaatttccttacactcccattcgagtatttttttgtgtggataatatatttatttttgttaacgtgaaactaaaaatttaatactagatttataacaaattacacgatagctagctaatcaaaactcacaactagtaaaaaaaaataaaaataataataataataataataataataataataataataataatgagagttaaattgttcatttttcattttaaaaaagatacgcttatacgaaacagagtgtgcataaggctatatacatcggttgattgaataaatattgtatattttaattgaattcagataaagtattaaattttaatttaaaaaaataaaatcaaccatttctggaaaaacacatggtcagaaacgtctatcagagtttttgaaaatatggacgattctgacttttctctattctttttaattactttgtattattttaataataagtatcttactgatgaaggtgccctaaacacatcgaacagttctgaaaaccattatcggtcggctgccaacaaaaacgttaagtaatttatagattatagacctacgacataatgtttgtttagcttgtttttttaccgtgttcgtatatatgcgtatttctcttcttcttttaaatgtttttttcgatttttgtttgatgatgacaccacaactcgttgcgtggaccaaaataaacaagtgtacagagatatctacatcaaagtcatgcgatattagatcaatggtctagaaaatatcaattaaaaaagtttccaaacatcatagtactacttgacgtttaactatcaaacgaatccaaatctagatagctccgtaaaaaagaaagaaaaaaaacgttctctcgtttctttctattattcaaaatattttcaccaactaaaaaaagatacatcgaaacaaatctctctaatcatatctaagttataacttttctttataaacaataaacaatagctttgatttgaagcaagaggagcaacaatg

SEQ ID NO: 24560 - DNA, 3003 bp, Unknown; identical to SEQ ID NO: 24559
  misc_feature (1)..( 3003): 2750-1469P.txt file - cDNA_ID_2180069; gDNA_ID_1971984; Annot_ID_177683

SEQ ID NO: 24561 - DNA, 3000 bp, Unknown; identical to SEQ ID NO: 9104
  misc_feature (1)..( 3000): 2750-1469P.txt file - cDNA_ID_2180086; gDNA_ID_1971984; Annot_ID_58746

SEQ ID NO: 24562 - DNA, 3000 bp, Unknown; identical to SEQ ID NO: 9098
  misc_feature (1)..( 3000): 2750-1469P.txt file - cDNA_ID_2180086; gDNA_ID_1971984; Annot_ID_177692

SEQ ID NO: 24563 - DNA, 3003 bp, Unknown; identical to SEQ ID NO: 21514
  misc_feature (1)..( 3003): 2750-1469P.txt file - cDNA_ID_2180096; gDNA_ID_1971984; Annot_ID_177700

SEQ ID NO: 24564 - DNA, 3000 bp, Unknown; identical to SEQ ID NO: 9083
  misc_feature (1)..( 3000): 2750-1469P.txt file - cDNA_ID_2180137; gDNA_ID_1971979; Annot_ID_177650

SEQ ID NO: 24565 - DNA, 3000 bp, Unknown; identical to SEQ ID NO: 9085
  misc_feature (1)..( 3000): 2750-1469P.txt file - cDNA_ID_2180145; gDNA_ID_1971979; Annot_ID_177654

SEQ ID NO: 24566 - DNA, 3003 bp, Unknown
  misc_feature (1)..( 3003): 2750-1469P.txt file - cDNA_ID_2180154; gDNA_ID_1971979; Annot_ID_177657
cacatgtttgtaaatatcaaagtgtcaaaattttacagaatctgtcgaagccttactctaagttaaactcgataagttatggttgttgcttcaaggccaagtacgtaactccataatccgtcatgattctatgcgaagtagtttgctagtttgctaatttcacttttatgttttaggaacgtaaatcaaagcaagatgattatcaaagaaagatttgatgcataatataattacttgtgcgagcacaaagtgttccactatggattaataagtttgataacggagtcatgtggagccattccagctctaccttcaagacagtacgacgaagcgaatgtggtggagatgattttagagacattgctagggtttttcttaattcgaaggtcgtcgatgttgctaatgtaaccttagcatgatccaacatgactagtactactcaaagttcaagatttcttaagaaagttttatattattttatttttttttttgttattttaaaagttaaataacataattgttagataaggttttttaaatatttttcaactatgttagatgtggagtttttatgttaattaatttggttgttaaatatatatccggacgtaccccggacttaatccctagtagtaatagaaaagcaataaaagtataacatagattatacgagtaaccgagattcatatcaatcccaagctcttcacgcaggtccggcttagtacatgtgctagagcacatagttctaaggtccaaaatatttttaatttttttttttcatacaaaaatcccaactattttttacaaaataaccactaattcaagaattataccttaaaaatccctaattttattataaaaaaaaacaatatgaaaagatccaaacttttaaaataatatttctataacgaaaaaccacaattatttgaaaacaaattggtatttattttttaaatataacaatataccaaaaaaatttttgtctaaaatgtccttagctattatggatcgggtcttccaccgggtctcgccaatatttgagtcgggtctgtctccactcatgagaccatctagcatttccttgatgtgggcaattgatgcaccaagctcattcatgatatcatgaacaccagttaacaagggtatttgatatatccttgcattaacatactcatacaatttattatttaaataatttattagattgaaaaagaaacaaatttaattaattacttatatcagtaggtgagggtgtcccccgtaaagctcacaatgaatctcgtagagttacatcatatattcgtcagggtccaagtgtgtcacgatcatcttacttgagagtatcgaagttggtctcattacggaccaaccatggcaaaatacaacgacctaaaattttcaaaaaaaaaatatctaatatatcttaagaaatcaagaactactcgcaatttccaaaaactacctttatatactcgaactcattctaaaaatgttgtcactcttttttattaaaataatatatacatatatatatatatatatatatatatacttcatatgagtttttttaatccaaaatgtacataatactacccaaccttatactctaaattagcaagtctaatatattgtataaagcaattatatttaattttaatacatatttttaaatcaaagttacataatatacgtgtatatattcttcttacacgatattttatagaactcagtcactcaaaggaactaaatttaaatgagatgaaaataaaatagaaaccatcaaattaaagctaaccataactcatgatattttggtgaatgatttgattcagtttctagtaagataaacaagagaaatgcaagcacttagaagaagatgagctttctctcatttcattcaaacgttttttgcacatttaatgctccgaaagtaacatattgtcagtcattagtttttatttttgtacaagtttatcatacttcttgttttatttgctccacacaattttccttttatgtttttcgtagacgtcacaatgaattagaaaaaaataatcttaaattattcaaatgaatatatatatatatatagtatatactaaaaaatagttaaagatatagtatacctctttcaaaacaaagcacaaagtaacatatacttattatacatcaatttgataaaatacctagtggacatgactaatcactaataccataaaaaagaacaaaatctggataatggatccaaatgatccatctaaatgtatccattgtatgttgtttgtttttgaatttggcaatccatctagttgaagcatttgaataaagctttgttagtttgagtaaatttgcatatgcatcacgatttatgttgtattaaaatgacttagaaaaaaaaaatatcttcatcttcttcttaatcatagtttaatgatttaaaattacatttacaactaaataaattttaatactttttttgttacacctataaccttttataaaatagtaaaattagcatctcattttcagagcagtctaaaaccacctaaaactaaatcatagaatctgatattattgtactgatgtttctcttctacttaatttcaaaaccatatacagtacctgggctgtttaaccgaaccaaaccgagattttcggatttggttcatgatcggttagtagtctaaaaccgatcggaaataattatgggcttagcccactaacattggtgggattattaatctgtaaccaatcaaaatccaagaatttcgctataaataaaaagcatattcctttttttaattttttttttcctatcgttgtcttcttttgctttcttattttgtcttctcacaatctgttcctatcaatcacacagataataatcctcagcttctctctcgctggatttcaacattcttccactcatcgcttctctttaccaaatcaaactcaacacttcactcaactcttatcggaccttccaaactatatccttcaatg

SEQ ID NO: 24567 - DNA, 3003 bp, Unknown
  misc_feature (1)..( 3003): 2750-1469P.txt file - cDNA_ID_2180275; gDNA_ID_1971986; Annot_ID_177721
gatgatgatgatggtgatgacgctcctaaaacatgggaagaagtcagcaaatctctagaaactaaacttaaacctgccgccgttaaaccgccggaagtagactctgttaaacctccggcgactcctccacggcggcttccgcggaagagcgcatcgttccacacactggacgagcttgaagtgagggccaaaagaagcatcgccgcgcaaatcccgacgacaatggttaagcttaagagaaccgagtcgatgtccaagctaagacccgagtcagatgatcgaaccgagtccactcagtcgtcctactcggggcctcggtcagtgaaggagaacatattcgtcaagagagacagagaacggagggagaaagaagggaacaagaagccggtgatgaactgggacccacttagggagttcccggagaagtgtccgccgggaggaggggaaggtttgattgtctacacgacgtcgttgcaaggagtgcgtcgcacgtacgaggattgtatgcgtgtgagggccatcatggagcagcaaggagttgtggtggacgagagggacgtgtctttagacgccggagtcttgagcgagcttaaggagcttctccaagacgaagcatcagtggcgccgccgcgagtgtttgtgaaagggaggtacttgggaggagcagcggaagtgacagcgatgaatgagaacgggaagttagggagggtgttgcggtgggcacgtgtggagagagtaggggaggaagggaggctcacgtgtgaagggtgcggaggagcgaggtggttgccttgtttcgagtgcggcggaagctgtaaggtggcggcggttggggcggccaaaggtgaaaggtgggagaggtgtgtcaagtgtaatgagaatggattgattcgttgtcccgtgtgttttgttaattaagaacattattagtttacacaagcaaatagaggtgtgtcaaatatactttgtcccgtttgttttgttatatgtatgtgacacgtttgattttgtggaattgaaaatgatttgaaactatgctaggattttcataaaatgttaaagcatgaacgtgaaccattataatgctaagcttgcaaggtctctcactcgtatatgttgatggttttgatcaattacgtaaaggagttcaacaatctcactaatttaagtttggatcgtcagaaggtaaaagctggcaaacaaagtcacttctgcctgaatactttacaaatttgttctttgttgctattttgtttgattgttatgcatccgttgaggattttgtgctatgaaacagagtaatatgaattccatcattatagtaactatggcaagttagtgttagttaaaatcttttaatgaaaatgcatacaagtatgcttctcaaacttagctttaagagtttctcacagttacataagaaagcagagcaatgcacaaaaaaagatacaaaaaagatagatttacttttgttcttacaaagaaacaaaaaaagaatctgacatttttctcacatacacaatgttcatggtcttcagttgtacttcctcttctttatcttgaaggaagatgatcggataatgtcatcgtcggcagtgagaacggtctcgagtggaactattgattcgggtttggtgaagtaagtgaagagaaggtagattccatccaagtaagtgttggtttctccagctttgttcttctttcttatgctgtaagccaacggaatcactcctctgttaaacacttccacatacattccacctcctgccacaagcaactgccacacacaccaaaaagaaatcccagcaacataatgaatctttcagagtctgcaccaactaaaaacttccactactccgaacataaatttcagaattcctcattagattaaacatgtgatatagcgtaaaagaacccacgcgtaaaccacaaatgataactgtgtattagctcgtttcgagcatcaaaggacatttcaagaattgagttaaaatgttatggtaaaacatgactaaaaaactaagaagtgcactaagggctcctatcttgtttcaaatggttgagacttaaagaattcacagcccacagaaggatgagatttgctcttagaaagttaaactctttacttcaattttaacaaggagtcgtcacaaacattcaattgatagctgcaagttacacaactctacattgaaaccattttctcttgctttgtcattaacgtgtaagaacagacacaagatacaacttttagtgatctcttactcaacttctaattgaatcctaaaatctctttctctctcaaataatcaaatttccctctgacatgaaacagaaaacaggtaaagttggagacttttacttacctcttcgtatttctgggtaagaccaagccgttcatcttcagacatgtctggtctcaaaaccgccattgtttcgtactgcctgagcccaggtgggcactgaggttccggtttgtcttcaagggcagttgagactcccgacccggaaggagaagtcgggtcatcatccgacccgaatccaccttcaaagaaagttccagagaagtcaagagcctgagatttcaccacaaattgagagccatctctcttctgtatcgaggcacacataggtttcgacttggaaatgaatggcctgagagagtgggagaatgatagcagcggctgcgaagatacattaggcagagggcaaattgtggaatttgatacacacagcgaagacgccattgttgtgagattgtgaaagcaaagaggagatgagagagtaaaatttggataagagatgatgatggtacacattagtcagaattctattgtacaccatgggcctttttaggttattgggcctgttaaaggcccgttttgtaaagacaattatttctatctgtattatttgtcttcgcgatcaagccagttctcggagcaatcaaatctataagaaaagaatcgtcgccggtgaagagaaaaaaccatagaagcgatg

SEQ ID NO: 24568 - DNA, 3003 bp, Unknown
  misc_feature (1)..( 3003): 2750-1469P.txt file - cDNA_ID_2180306; gDNA_ID_1971986; Annot_ID_177730
acacttgaatttctctgtcccaacctagtaagaaatagagcttatgcagaataatgaattttctcatctgagaacatcaatatgcagaagatagaatattgctccctcatgttggcccagtccaacaagttatgaacattccacaacaatatataaaactgtttcacaagtcttgttaaacacaacttgcttgctttttcgtgctgcccagccagcattattgaatatcatatctcagtgagatgtataatgatgtgcctcatttctatctttttccttcgtgctttgctcgagcctcgacctatcaagcgttgctcaatgatgtaccttcgctaacaggaagagcttcaagagctaggcacaaaggattaacagaagttgaagttttctttatagcagaatattgaattttaatgctgcccagctccagcaacatatcttccaattgtccatcaatttgcagttctccatatgagcagatcattgaatttatccccatcaatatgcagatcattgagttattaagcagataattgaatttctaacacgctgcccagccagcaatatatagatctcttactgttaaacaagtcttacagtgttataatcacacagcttgcccaatcggacatcatagacaagtcttacaaaaggcaatttatccccatcaataataagcagatcattgagtttttatgcagatcactgaattttttcccatcaataagcagatcattgaatttatccccatctatataagcagatcattgaatttatccccatctataaaagcagatcattgagcttttaagcagatcactgaatttatccccatctataagcagaccattgagcttcttttaagcagatcattgaatttatccccatctatataagcagatcactgaatttatccccatctataagcagatcattgagcttttaagcagatcatagagcttcttttaagcagataattgaatttatccccatctataagcagatcattgaatttatcctcatctatataagcagatcattgagcttcttttaagcagatcattgaaattatacccatctatataagcagatcattgaattttccccatctatataagcagatcattgaatttatccccatctataagcagatcattgaatttatccccatctatataagcagatcattgagcttcttttaagcagatcattgaatttatccccatctataagcagatcattgaatttatccccatctatataagcagatcattgagcttcttttaagcagataattgaatttatccccatctataagcagatcattgaatttatccccatctatataagcagatcattgagcttcttttaagcagatcattgaaattatccccatctatataagcagatcattgaatttatccccatctgtataatcagatcattgagcttttaagcagatcattgaagtttatataatgctgcccagccagcaatatatatagaagataatcgcaaagatttgatctttgaacataacaagacttacaatgtttaatcacagcttcttacgattcaattatccaatctttgtgcataatttgtcaagacttacagtgtttaatcacagcttgccagccttacgattcaattatctaatatttgaacataatttgacaagacttacagtttttgatcacagcttgcctgtcttacgattcaattatccgatatttgaacataaatctgacaagacttacagtgtttaatcacagcttgcccctgccttacttaggcaacatcgggacaaattttcccaagttagaaaccggacaaacacaatcatataatgtgtagttccctttcttttgggtttgaacaaaacataaaactttctttgaaacgaaaacagagaatcgatgatggggtttctaatccagaaaaacgaaaaacaaaatctttaaaacacgatccgtattagaaacccaaacaatctttcacaaacgtataataagaaatcgcagattttaaaagagggtttctgatttaaaacagaccaaaaacaaaagaatagaaaccctaattggtaaccacaaatatgtataatttttgaagaggaatacaagattgaaattagaaaccctaagacaaaagacggtttttttcttagattagcgatataaaagaaatcaattgaaactatgattctgaattacaagtttttggaaaatcaagaacctcaaaaatcagatctaaaagagggttttttcgatttgcacaaaaaaaacaaacataaaatcgaaacgcaatttggaaattaaagagagagaacttttggataaaaattcaaaatcgaagtagtgaatctggaaaaagggagtttcaaaatctaagaaaacgcaaacaaaagtctccccaaatcaaaagaaacacacgaaatcaaaagaatataaaagaacaaacgaagaatcagacaaataaaagaagtaagcatggcgacgagcgagtataaataaccgttgtgaaatagaagaaagacggtggtctctgtgttgggcctaaatgaatatgtaagcccaaatacaagttgtgttgttttttccctcatcgtaatataaggcccacatatgtttttttttgtcgtcgaaatattttataaagcccaaacgaaggcccacatatgtttaactgaaagttatggattttccaaagagaaaaagaaatacaaaaattaggatccgacccggctgaacccgagtggtttgttcttgttcccacggagaaaaactttgctctccctttcctttgtcaatcggaatctgtcccatttatcgattcttcacagacacgttttcttcaatctttctccattggtttcgttctcaaggtttgtttgtgtcgatcgaatttagtttcaggacattgatcgtaattggttctgttgcagtttgagaattgcaattgttgtcatgtttagatagtggaaccctaatttgagtcatg

SEQ ID NO: 24569 - DNA, 3000 bp, Unknown; identical to SEQ ID NO: 9110
  misc_feature (1)..( 3000): 2750-1469P.txt file - cDNA_ID_2180329; gDNA_ID_1971986; Annot_ID_177736

SEQ ID NO: 24570 - DNA, 3003 bp, Unknown
  misc_feature (1)..( 3003): 2750-1469P.txt file - cDNA_ID_2180333; gDNA_ID_1971986; Annot_ID_177738
tattttaagttatatctttaggagtacgaaatttgtttacacattttaaaaaggtaatagtattttagattttgaatcatagatatagaaaatgatacaaaattttgttttacctggatcaccatttttaaatggacggccaccatattagacatcaaatgcccatttatctaagagccatattggttgtcttggtcccaaaaacctagatttctaaataataatggattctatagataccaaagcaagtgtccatttacactagcttgtagcttcgcttaatttagttgctatatatgtccacatcattcgcatatgctatctgacacataaaataaatgtaatttagtatatttagttcatatttgattaatttcggttacaattttcatattgtactctattaaaattctaataattgatattttttttgtacaaaggttaaattaataattgatattttgtaggtataagtgaagcttttcttgttaacatgcgtttaagatggttaatagttttttttgacatgtaaacaatcgatcatatggatcgttcttaaaagatttttatgttttttttacttgagatgcttaacacacttaccatgcatgtgagatgtgtcatgcatattaggtatttagagcaaatccagtagtggtttctaagcaaaatttctaacctataataataataataaaataataaataatattatttaattaagatagtttttaaggaaatgtgagagagtttctaattcaagagattttgaatactcttctacctattttaagaaacttttcaaattaaataatattatttcttattttattattactttagtagattagaaactatggttagaaaccaccattggacatgcttaggttaaacttgaatttcaatcattttccggatctgtaaagaatatgatattactactcttaaacaattatcaagggtattaaattggaattttattatcaatcgaattcgtggaatatttgtcacgtttaatcaaaaagtcacttatgtaaagcgtttgcatggtaactgtcgcattttaagcaaattaaaacactattgatgcatatggaggatataaagtcattgattaattatgtgttttttttttttggtatcaagattaattatgtgttatactaatgatatctaacatgtattcaaggaagaattgtggatacagaaaactgaagtatataatttgcgtgggggaatttatattgggcacacttgaacagcatttgtgaaaattcttgacgttaaaggaaaatgaaaaatgtgtgtgttcgtttacataaatacaaaaaataaaggtgctctatatcctaatacaaaacctagggggtagaagctgaggtggatcgcaatagaagaagatggtcggctctcactctcgagatcggacggctgagaagagaagagaagagaagagaaggagaggatgcgtttcttacggggagagagaaataaggccaaacaggtagagcccacaagatgactaatctccaccgtccaactcaaaaacaacatcaacaacaacacatcacaccaaatattattcggtttctctcttcaggtccgactcaatactgtcatacaccacatccactactctactactacagactttttggtgctcttccccctgtggagtccaaatcctttgacacgtgtcgttttctcaagagattcactgtcccactctctgcgtgattcccccccacatctgacggctgcagttcgccgccggtctactcatccgtcaaacgccggttactgctcagactttggtttgatcaaaataaataaaaaaagatcaacggctggaagaggaagtagaggttgaatctggacccttagatttatatatactaaaaaaaggtatttgggtcttcatgtcagtagaggcgtttctcttgcttgtttaacacaacactcccccactcttcacatttcttctattttcttctaatttctacatctcatcacatgtagcacacaaagtcacaaacacttgtactggaaatgattgaaagagaaatatgtcttatatttgcggatatataaatgtgctttcacttcaatatcatttaaaaaaaaaaaaaactctaattttctctgctaattgttacgtttgtaaatatattttttaatagaaaataactatgaaaaatccgagtgcaactatagattgtagataaaagggacaaaagttgaaaggaagtggaagcagcaaaagatgtttcaatggataggggagtcatgacgtgactaatacacttctttttataaaatgtactatacattagtactaaatacagtattgtacaaatattcccgtaaaaacagttttaatttttaatcaaaaacaactatcaaatatggataaattagcgtccatagttaaacaaaaaatgctaccctagctaaaatctccatttcttagaaaagaaaaaaaattctataatatataatacctcaaatgaaaaatgacacattgtacacgttcatcaaatgggaatagtattagtactagtaacctaaagatttggtaagaattaagaacaaacaaaaactagagaagagagagatatgtaagaagaaacacatgaataatgggacaattttattattagaattaagagataaatgaaaaagattcgtgggacggcgggcgcatagttcagagtgtgtcagagtcagaccaaaccctttctcttatctctctctcttacgaagaatccatcaaaaatcccacatacacacaatatacgtgtatctatatattccttcaaataaaagtgacagttttttaagaaatataattaaattgtttaaattctcttttttcgtcttcttcttgctttttcaaaaaccagctttacctttccacacacacttcttcgtttctctctctctctttctccttagcttcctcttcaagttttttttgatcagctgcaaatttccatagccatg

SEQ ID NO: 24571 - DNA, 3003 bp, Unknown
  misc_feature (1)..( 3003): 2750-1469P.txt file - cDNA_ID_2180343; gDNA_ID_1971986; Annot_ID_177742
cgataacaaaaataagaaagattaaaataagttaagccttaaatattagaattaagataaattacgaaaacacggatattacatgaagtcttaaagatgttgacctcgaggggatgcatgttgtgtaaactagaaaattgatttttggagtttttcttcttcttattcgtatcaagttcattattactttcatttgtcaaccaagaaaatagttttaatatcactaaacttataataaaaataaaaaatattcttttttaaattgggtgaaaaatccaaaacatcattctttttaaaacatggaaagtataaattaactctgaaactcatttctattttatgtagactagggtatagggctaacaaaaattggtctcataatagatatcgaacaaaagacacagaacctaaagcaataacaaaggagactaataaccacaaatttttctcatatagaaaaagtttacatattctccatagctattttttcgaacaaattaagagtcaaatgcaaaagattttaaaaattttgtgtgctttcaaagatgaagtttttagcggttaaccatgacatataaattcgtaatattttgtagttgtttttaaaaatatgattggattatataataagttttaccttgttttccacaactcattgaataaagaatttgtcacataaacaatacatatttgcaactgtcatagtaaaaatatattatcaaatctaacaaaaattatgtatattatgaataaaatactctaaatttaaagaaaagtatgaatccaacactatctctatcttagtacatatatatgtggactaatggtagttagttagagttactcttaagttttaagcgataaaggaattttgttttgtttttgacagaaaaatatgttctctagtcacatattttaacgaaaagttttaaaatagcttatctaacaaaaagcaagtgtacaacataaaatccaacttttggatttatttcaccactttcggacacaattgtaataagaacggaaagtttcgaaaagggacaataaatcaactaaagacgaaaaaggattaaggtgaaaatcttgatgccgttgacttttgttctcaacggccatgattgagcgtgtgatgagtataagagaccaaattatggctatttctaataaccccaaaaaataaattgattgatgagtttttcttcatttgatatgtaattataatcacttattccatttcaagatttgtggatatctattgatattctctaccactatcaagaagctaaaagtgtattaagtgcatgtacattagcttaggccgagaagttttttttttttttttttaaaggtgatgtatttgtggcacttaggcttaggcatgtaatgtgtggtgtgagatgttgcgcgacttgcgagtaacaaaaatgggtctcaaatattgaggcatgtatttctaacgtttgctatatatgcctttgatgttctctaaattctattttatatcgtatttccatagtaatattcagtaaaatcatgaaattcgaaggttgatatcagagtttatatagtataaagttttaagatataaataatccattgaaaactcaaaacataggtacaaaatagcaccatgtacaaataaatagctaaaataaagtaataaagtaacaaattaaaacacgtttaatactattcatgaactaatgttcaagtctatttaacattcacatttttccttgcttgtgatcttctatataaacttaaaattaaacatgcatggtttcctgataataataagatgtttagttatattaaagaaaaaagatagtagctctcaagacttaaggcggaagcataaccttattttttttaggttggtaccacaagagaccacaactaaacatttggatgaatataggtataacaaatctcttatgatatgtatatatctggcttatatatgaatgcatactctacgaatgtatgtgactgctgacgacattggtgttagactgttgatataattatatgaggcagtggatcgagatttgagaactacttaagtcaagattatcataccgagaattcaagatttaggtgacacatattttgggaacctcattggcccatacactaaagaggcggtcattctttctttataactctaaaccatattttccaaccaaaaacggtcgatgttaagctttaatatgatgttcaagatataggatacgagggagaagatgatcgctagaaactccacagcaccatttatcttcctctgttgtggggatcacattctcctcatttttatttttccattgcaccagtttccactatagaaattttcatcaaatgttagttaattaatcatatctaaatatattgaatactattaaagtatatcataaattcgtatcgagtatttaatgaatcgatgataaaaagtaaaatcaaaataaaatctccctttatggaaattataccctcgaagatcctctcccgtcctaaatttttcaaaagacaacaaataaatatatagtaatcaaagcaaactttttcactaaaccggcaatagccggtgtaattcacgtcacttccgggacaaaagcgtgactggacaccggcagacaaatcacatcaaataaataatagtaatatatttaattcctcagacaaaaaggctcttccacttcttatcgaattacaaacatttcatgttattgtttggttatatatatagagagacaaagctcttaactcctttttaattgcttgaacaaaaagcaaaactcaaaggaattttctctgtatttttttctatctgcagaaaattaaagaaaaaaagagaaaactcaaaaacccacatttttcctctgtttccagcttttctttatctttggagtttggtttctggagaagacaaaagttgttgtcctttttaagagttcgagatcctgcagaaattaaaagggctcttcccggcttggattcctaaatatg

SEQ ID NO: 24572 - DNA, 3003 bp, Unknown
  misc_feature (1)..( 3003): 2750-1469P.txt file - cDNA_ID_2180366; gDNA_ID_1971986; Annot_ID_177745
gctgtagagatagtacacatacggaccctgcaaccagtccccagctaaatgccgccagggacataaattcattgttggattttaggatctatggacaatcaatcaatcattgggagcattcattcattcattccggtcaaatcacacaccgacactaagctctatagaaatcagaaaatggatcgtgatcagatgtagtgagaactaacccatcatgagagagtagacgaggagatagttgttcttgaaggagttgaaggcggaggaggtgttaatgcggtctttgttcgatttgctcagctccaagccggcgacgatcgcagccaggccaccgaacaccacgaagtagaagatctccattgatacgatcagatctcgcaagggaggaaggagatgatgagatttgtaatttcagatttgtagagtgtgtgtgcaagtattaagtatatatcgttgatttaaatgcggactaaataataataagtttatgtgcctttgcctctctctaattcatttctttttttcatttattaacctcctaaccttccaacaatgtttttttttttttttttttttttcaaaactaaaatttacccaaatgggcttacaaacggactagatttgtgattttaatgatgcagccgaaacacataacgttgtattttgggtcttgtttccatggttcccctttgggctttatgctccgttgttggttttttggtattttctgtttggccctgaggcatgtgttgtattttctgtttgggccttgtaatatgtctttttaatggaaaattatgaattaaaaaaaaaaaactgtagtttcattatcatgttttttttataaatatctcatggaacacctaaaatagaaaataattctcataatcataaggactaaggagagataagcaaacctaacattcttatttcctaagaatacaaccgagcgtttaacgtaccaaaaattgtatagagatgcgtctagattttttagtaagtgaaacagaattcacaaccatagagaaatgttgttacaatcttgtatttgtttgactatatatatgaatgaaagttacgcaaataactgaataaaaaaaggagtaggaaaataagaaaaaaaagaaaaaaaaaaagataagaaagcgtagaaattaggatgaaatgtaatgcttattacttatcttcatgtgaagtttctcaaatatctatatatacatttttgcatctattttgtaaaataaatcttagagttggaacttatttacaatggttgtaactggcttttaattattgattttcttttggcaataaattgattaacaaacaaaaaatattccaaatatattccaatctcatatatcatgcagatttctccaaaatttgaactagatttcggaaattatttaaaacaaaaaatatttgacaaaccaaaatacaattgcaatcccttaaaatgagcaaaacgcacctaaatacatttcttatcagttcactaaatcttatttctccaatatttgaattagatttcgacaactatttaatacgagacggtatagcacgggtgaaatccattagatatgtttagtttcactgaacgggattagatggtaggacgggtttgagtcgatagtaatacgaaacggtataccacgtgtgaagttctagatataacaatcaaaatataattatattatcttaaatactaaacaaaacaattataaaataaaaatataattaaattttaaattatttagttataatctagattttaatttaatgaactgaacgttattgttcttatattttaaacagtaaaagttaaacatagtaattgtatactaaataatatatagatataagagttgtacattcagaaaatacaaaatattaaatcatatatatttttaatcgactaaacaaattatacttttatttttaaaagaacaaaatagtcccgcaggttaaaacctagtattttacaaaaatatagacaaataaaataaaaatgaactatcgtggatttagttagagaaatccatacaaaaataaattgcattgagaaactttagatgacgactaagtaatataagattttgcattgagaaagcttacatgtcaccctaatttctatcaaaagggtttctgatactaattggaaccatgtgagaaactatccatagaaatgatgatcttatctagttatcatgagctgatgactttgaatattccacagtcactaaacgcatgtttatttctcagctttatgaatctgtatgtagacacactttcgtattttcttcacttttgtgtatttgtattgcccattcctcttttaccaaccaataaaaaaagcagtcttttttttgtttggtcaagcattggcactctttgtcaatcaattacccaagggatatataataataaattggaataatgaaagtagttcatcataaggttcgtgattattaacttctacttttgtttatattcaatagattaagatgccgtgtatgataaggagagcaaaagtaatccgatagagatcacagcaatattcattacaaaatagttttcaaataaaaacacatgatcaaaaagtgactcacaaaaacacatgatacgtacgtgggatgctaatcctaaagcaacaaggccacaagggcaaaatatgtagctttcatgctttggcaaagcgaaaactctagttaagcttacctaacagaaaaaataacccccaaaaaagcgttacgttccaaacatttagacagggtacacgtgaatgactcccactttttttaaaaaaataatagtactatcaattcaaatgtgtaaacaacaaaaaaaaaaaatgtgtaagtaacgtctgtaattgatttgataagataaaaaaatcttgattaatttttctataaattgaagcctttcctctttacatttcgttaacacctaggttcttgtttcctaacaaaggctctactttttctttagttaactactatg

SEQ ID NO: 24573 - DNA, 3000 bp, Unknown; identical to SEQ ID NO: 21956
  misc_feature (1)..( 3000): 2750-1469P.txt file - cDNA_ID_2180521; gDNA_ID_1972008; Annot_ID_177803

SEQ ID NO: 24574 - DNA, 3000 bp, Unknown; identical to SEQ ID NO: 9141
  misc_feature (1)..( 3000): 2750-1469P.txt file - cDNA_ID_2180545; gDNA_ID_1972008; Annot_ID_177811

SEQ ID NO: 24575 - DNA, 3003 bp, Unknown
  misc_feature (1)..( 3003): 2750-1469P.txt file - cDNA_ID_2180561; gDNA_ID_1972008; Annot_ID_177815
ctgatgaagatgatgaggcggtgttagcattagagaaagagatgtggaataggttttacggagctggattttggcgaagtccgtcacagagagaatcagtttcgtctccgagagtttccaagtctctttcgtcatcgccgagacaatcgtttactgaagtataccggaatagggatacaacggttagaggaggaggaggaggagctacggtggtggcggcgacaccaagagccgttaggcattttgattagggtaaagaaagagagcttatgaaaaaaatgtctcaaaatgtcttttgttaatagtttcattcgtgtggcgagagttgttgtgtgtgtgagctcaaagtgtgtgtctgcgtttgtcaaatctttggtgtgtgactttatttgcctatggtatgggattttgtgatcatcaaatatgaaaattcgaaatggaattgtgttttgtcgaaatgtgacatgacatgagatctttgactatcaaagtctattgagggtttagtttggatgtttaatcactcataacacaaggtataattacattgttagattcgcaagaagaagaatagatcatgaggtaaataattagtgtgacatggtcatggatcagttaaaaagataaagataagattcaaagggtaaaaggagagtctagggtttaaaaaaacaagtggggagctgtccttttctttcaagggggtttggaacttgtagccttgtaggttgtgatgtaaactatgaggaccacaacaatcaatcagtacttggtcattagtgttaagcattaattcaggtgttgctaacaactactaccaccttcttcttctgcatctctctaatgactcttctttcctttttcatctctgtttttttttttgttaactttgacctgctttgttgtgtttcaattgtctttttactattactcactaattcagctttgatgtgaccctacttcatttatttcattatttggtgaatctcatgcaactgtttttttgtttcttttttcagatgtttgtaagaaaataaacgacttgtaattataatcgaatagtaaaatgtgtatttattttttcgacaaagagtgggcaaccaaatgttcctcaaccattgattgttgaaatataaatttttattattctaaatgaaatcgtgcgtcttgtatcgaaaggaaatgcttgaggattcaacttataacaagataacatttattaattaagaagattttggttgttattttgttcttaatataaaattcacgaggattgttttaaaatgtattatctttcggctctttcggcaacttttagttgattatacttggaccttacagtttcttgttattcaaagataacgaatatttaattcttgaatgagaggcaaaaggtcgtcaccagtatatacttctaactttaacaaaaatggcgtcaccgaaatgaatcttggatagcccatagatttttatatagcagtgcctagcatctctcgacacctcatttagcttccccttctcatgttcatttgatagttggcccatttcggcccaatattttacatgctgttcgtgagatgggtttatgcatgacttgtgtttcctaatttcagatcgttctagatgaccttctgggtatataaagtgtatgcgattttttgtttcttttcgaagaaaaaaacgagttaggcccgtagcaaaacaataagagaaatcgggcttaagataaaagacttcgaaaagatgggtttaaattcagttgggccttaaagcctgtcttcttatcaggcgggaacaatcagaatcgcataattgtgttacaattttccacaagtccacaaccattagccaaagacgctgtcctctggctcttttgatgtagttggacgtaagggcacgtgccaagttggagagcgtgagagtaacaggtaagtggaattgaggtgggacattacacgattcacgaacttagcgtagcaaccaaaaggtgtcccaataaataaataaatgatggttgtattaggtcatacaccgacagcttcaattcaagccacgtgttctcccttcttcttcggctgcttctctttgcttcacatgatgtctttcttttttatgtttggttacatatttcttcttaatttcactttcaatttaagtatcattaactatagaaaactgactaattaactactatcccatttttatcatctagtactcgccgattgccttagtccttcttatgttaagaattaaaagacttgaggaaaagttcaattaccatcactttcactactctaccgtattacaggcaaatatttaattatctagttccgaatattttcttttaactatgattcttatttatgattaattatgtccaaaatgtattcaagattcttttctgattatactatagtattcggaaattgatgtaacagttttgtatttgagtatcaaagaatattatgaccattggaattgttgcgcatgactatttaatatattacctaaatcacggatcaaaaatcaatagttattcactttgcataagtagaattccatctgaagagtttaatataagagcagagcttgtttgttctgaaatagtaatactttcatttattaaaaaaatagtttatcaataaaagacaaaaacaaactgctgtgtttattcaatgattataaataaaaaagattaagccgacgctgagccgagacttaaaaaagaaagccaaaaaagtcagagctaaaataattaaatgttattcagacaccgtgtagtccccaccaccagcctgtccgaaaacccaaacctgttttgatacacaaacaacacagaccacccccaaaactcacatctatctctatctctcttctctgtctctcactctccactttccgatcaccgacgattcaacaaaacatagtaaaaaacaaagcaaattctttttttctccttagttacttcttctacagattatctcaatcttacagagcaccatg

SEQ ID NO: 24576 - DNA, 3000 bp, Unknown; identical to SEQ ID NO: 10927
  misc_feature (1)..( 3000): 2750-1469P.txt file - cDNA_ID_2180565; gDNA_ID_2214466; Annot_ID_133014

SEQ ID NO: 24577 - DNA, 3000 bp, Unknown; identical to SEQ ID NO: 9134
  misc_feature (1)..( 3000): 2750-1469P.txt file - cDNA_ID_2180580; gDNA_ID_1972003; Annot_ID_177764

SEQ ID NO: 24578 - DNA, 3003 bp, Unknown
  misc_feature (1)..( 3003): 2750-1469P.txt file - cDNA_ID_2180594; gDNA_ID_1972003; Annot_ID_177768
gagaagaacagactgctagggctttttcttatagttttcgttttttttttttttttttttccatctcttttagttttcgtttgggacatttaatgtctataattaataacaaacgattgggccttaaatttagctcaggcctggaataagcccatatagtcctcgtttttatgtcactctcaaaacctcgaaagtggtttctatctatcacttgggcttttattacttgttaaaacaaatttgatccaaatctcaaatggaaccgacaaaatagaaaatccggttctctcaaaaggccaaacacgtgacgtttaggaacaaaaaagacgttatcactgcaagaagttttgactttgagaaagtctttgaataatcaaaacagagtttttcaaatttcccaagtctgaaatggtactcgcaccctgcagacattttcgatcaaaattttcagagagtgagagagagagaagggagatcagataatggcttctcgtaagaaacgtgctgcgaagatttcagaggattcagaggaggaacagagtcgccgtcaacggttacaagccattcttctcgctgacagtttcgccacgaaactccttcccttaaccttagaacgccccaatgtcttgttaccgctagtgaatattcccatgattgattacaccttagcttggctcgaatctgctggcatagaagaagttttcgtcttttgctcgatgcaagtcatcgattatctgaacaactctgactggtactcgcacaaagactttacggtaaaaactatagagtcaccgcaaaactccaccagtgctggtgatgctttgcgttatatctacgagcagcagattgagacgtctcagattcaaggtgactttgttcttgttaatggatgtattgttagtaacatgcccctgacgcagctgattcaagaacacagagatagaaaaaagaaagatgagaaagctatcatgactatggttatcagacagtcactcatcaccgatcatcaactcttcatcgctgtaaatcctttaacaaaacagcttctttattacgatgaggacaacatctgcttcgataaatcattgctggatcgtaatccatctgttttgttatgtagtgatatgcaggattgttacattgacatatgttctcttgaggtgcttagtctatttgtggataacttcgattaccaacatatgcgttgtgattttgtggaaggtgttcttgctgatgacattatcggttacaagattttcactcatgagattagctcgtgttatgcttctaggattgaaaatttcaggagctatgacatggtgagcaaggatataatccagaggcggacattcccgtatgtaccggatatgaagttcagcggaaatcgcactcttaagctcgagagacaagggatctacaaggcttctgatgctactcagttaccatctgctcatgttggagcttcctatgtcattggacatgccacaaatattgggagtgggactaagatcttgaactctgttattgggaatggatgttctattggatcaaatgtggtgatccaaggctcatacatatggaacaatgttacggttgaagatggatgtgagataaggaatgctattgtatgtgatgaggtgaaagtgtgtgcaggagctattgtgaaacctggtgttgtgttgtcttttaaggttgtagtcgggagggactttgttgtacctgcatattcacaggtttcactactccgacaaccaatggaagaagacagtgatgaagaaaatcttttgtcaggtgtagatttgcaaatggagtctaagcttggtcttgatggagcaggttacatatggcgccaagcgtgtgaagacgagtggaagcattctgttccaccaatccccaaagataaacttgctgagatcattaaggccattgacgatgatgacacggatgatgaaagtgttgtcacaacttccggcgatgctaatactagtattaacaatgatctctttgactttgagagagaggttgatggcaccttcttaagggctgtcgaagagaatattgtagccgaccttgcggttttggagataaactcactccggttgtcatataacatggaatctgcacattgtgctggtgcaatattctactctatgatgaaactagcagttagtactccacatagctctattaatgacttgtatagaaacgcatcgagtatcattactcgatggaagggacttcttgggttctatgtaaagaaaagtgatgaacagatagaagtaatatcgagattggaagagatgtgtgaagaatctgctcatgagttgggaactttgtttgctcatattttacgttatatgtatgaggaagagaatgaccttttgcaagaagttgcaatcttgagatggtcggatgagaaagccggagctgatgaatctgacaaagtttatctgaaacaatgcgagccattcataacgtggctcaaggaaacatctgacgatgaagatggctaatgaattggtggtaaacatgtgttcgttggctcccaaaaggaacattctgattgattatttgcatcgaagagattactttgtctttttttccatgtgttattctaatgatgtgctattttatatctcatccattacatgtatgaggtatataaatacaacttttatgtttttgtaaatgtattataggaagcttattacagtatttcccaaaaaaaaacaattatagttatctaacgaattagagaaatttaactaagtgaaaaataataaaggaatgatctaaatattaatttttgggctgattttgaaagaaaagaataaggaaatgaaaacgaagaagaaggaacatcgtcttctccacagagtcctctttcaccgcctttgattctttacttataaacccttaccttcctcttccttttgtatatacctatttctctagaaacctttttcctcatcgaactcttcttctttcgcctcgccagaaatg

SEQ ID NO: 24579 - DNA, 3003 bp, Unknown
  misc_feature (1)..( 3003): 2750-1469P.txt file - cDNA_ID_2180614; gDNA_ID_1972003; Annot_ID_177777
tgagcgtttttaacaaacaaaaaaagtcgttcgtgagaattaaaagatggggggatacaaaaaccgaacaataattgaatactttttgaccggagtgtaacatcaataaaggtgttaattagagaatgtaattaggctttttactaacgggaataataaattaaaaactgtcctcgatctactttactatgtatggaaggaacattcgcatgtggcattgtgggaagctgaatctcaaaacttattttaagttttgacattccttacacttatgaatatactatacgattttttttttatcatcaatatacggattagtacattgatgataaaagaaaccacggatgataactattaataattattttattatatgatgaaaatgattatgcatttcacgaaatttcactaaaaaacaattattatgaacaaattcattttgtttatctaataacaataaaaatcattggactttgattttatacgtcgtgggaaggtcgtcgaagcacgttgcgtttgatcattgcatgcatcgtgaaaattccactaaacatcgtcttttaaaaaaagaaacctttaaaacattacaaatggaacgtgaacctataaaatatgataggtagatctcacactttatttacagtattaaacaatatggaacattgacgttaaattattattttctacttataacaatttacacctcccaaaatttggaaaggataaacccaacaaggcaacaagtatcacaaatgtagctgaaatagatgggcttttaaagtttatggattgggccgtcatgaacacatattccataacataacctaattgggtgctccgacttcttttcgcgccgctcgcttgtacatgtcctcttcttcgacttccagataaaatcgcttcctctgtttttttccgatctaaattcacagctcatcgaaaatgggctcacggcaaggaccaccgaagcatcagaacaaattcgcctgggttcccaaagccggcgtcaagatcaacgaaacggtaagctatttgctcggctatgagattaacgaaattgagtgagtactgtagctagacccttgattttttcggaaatttatgaattgttaggaagtcggcgggagatttagaccattatccgagattaccggagtttgctaccgatgtcgagagcagatcgcctggaaacgcaaatacggcaaatacaaaaccctaactgaagccaccaaatggtatcgtttgatttgaatttagagtcttctttgtcattctctgttggattttgaaattgatttgttttgttgtgtgggtttttttttcttaaaagagcaacctttttgtttgtgggtgcagtcagaagtgtacaaagcgaaatgttcgtcaagcataccataagttatgccctggttagtgttttctttctttgcttttgttctcgtactttcttggctaattagagtgtatagatcagtatcttgttttataagttgatgtgttatggtattgaaatgggtatgaaactgataacaggttgtgccaaggagcaaaaggtgtgtgcaaagtgttgtcaaagtgttgatcaaatccttggaaggtacttgtaccttgaagacagtctttcttctacttatgctagatgctggtttccttaagagtgggtttagtagacaagatattaaactaatcttgaggtaattattcgtttctcgcagagatatttacgaagtagaggctgaacagaagctgcttgatgaggtttgtcttttaattattccgcttttggcttctaatgttcaatttcatgcttgtttttgggaggttgttgctgatttcttattgatgtgatgcagactatcaagaatgctagggaaagagatcgaaggaccctattacgtgctgtaagcttctctagttactttgaagagtttttgagatttgtaaatgtgtatgtttgtgtgatttggtcctgaagttgcgtatttgcttgacatagatgaacaaagataacaaaccaaataaatcagatgaagaagcgtcaaggagtgatagcagcaaggttggtgatgtgtttccctcaacttcccttgaagaatatgcaaacaagtccggaagagttagcgggattattggtcatggtagtgtgcctgatcatgcccatgatgatgctagtggacctgaatcagatgaggatgacaatgttggtgatgatgagcatgatttgcgcgaagacagtgatgaaaatgagcaatctcaactgcagaaataaactcatgtttggttgtactactgtcaatttggtaggattgtgagattttgcaagactgtttattcctgttgttttgataaaacttttacttggtcacctgcaatgcaagactagcaaagaatactataaattttgttctgttttcttgtatgggacgggcttaaacgggcctaacagtcgttctttatcggcccactttaacaacacctaattgtctagtctagtagtagtattctctagagactttcaaaaagtctttggattactaaatagtaaatgcgaatataagtaaactataaatgtgaataagaatgtttgaaattgaaaaaaagaattgctagctaagtgcattaatgcttgtgcattaagtcaaattataacacttggcacgaaaaaacccatctcatcccccactaaagcagccttcttttggctttcattaatctctctgcacacaaaaacccaaaaagctggatgtctccattttcaatgaacaattatgagttctttttttaaaaactcattatactttgaagattaatcacaaagatttcgaagctaattcgtcatttcttgttactataatcttttcattgttattaatcactttggcttaagtttctgtatattacgtcgagcttcttcagtcttcatccttgtcttgtcacttgtcagagacagaagattaaagaagaagaggcgtttctctctctttttttgcttcagaaaaaatg

SEQ ID NO: 24580 - DNA, 3003 bp, Unknown
  misc_feature (1)..( 3003): 2750-1469P.txt file - cDNA_ID_2180622; gDNA_ID_2684224; Annot_ID_191875
taatctcatcttaacgggtgaagtatgtttggtgcatttcatctacacatatctttatctaagaaaaaaggtcatataactggtcaaccagtttattctgaaggttacatgctatttatagtctttcgaagtgtatatctctttaatctatcattcatttcacagtttaacattttaaccacgctgtttattactttgatgcaatcatgaaaccatctatatacacaatatcatccaagaatcgttataagatttattcgcagaaatgagtgtcaattagtaataatcatatatgtgtttatcaacttgacactcaaaagtttttccccaaaaatggtggctcatctctaactatgtacccacacatactctcgtttctaaaacagtgattagttaatctttggtaatgataacaaaattgtttaaacacaagcaaccaagagattgcatgaagtttacataatacatttgcagtaagcttaaataaggttatgctagctataatctgttgttactcacaaattgttattagtgcataaaattgaaaaacgacccaagaattcaaaccatcaaatcatacataaaggtaacgcgcttgaaattgattatggtacaatatttgaaagcaaaacctaatacccatgtgtaatagtatattcctcggtacttccaaggtcaaatcaattaattttgtttttttatatgaatagcaaacaatatacttgttatgaaaaaataaatagataagaagtcacaaaccccacctggttcacagcacattgtggaacaaagcacgtgatatgcccacaagctttttgtgattagtacatctaaggacataaaccctcaaatcaaccaagacaaaatactaaaagacgacgacgactttattccatatatataataattttcttcctcattttatatgccagattccttaatgttgaatgattcacatgcaaaaagttattacatcatcttaagcactttatttaatacattaagcaaccgactaattgtttttaataatcagaaagtaatgaactttttgatctaatcgtttcttcagtttgataaccaacttgtggttttgtccacaacacttaaaacatcatccactaaataaatcactctactattcgattagggatctaagagcgctgaaatatcacaatctttaactggttaaagtaattatgcatgcctggctataaattcattattgttatattgatttgacgcatactcttaacaacaggaaagagatgtatgagtaaaaagaaccttgcacaataatgtcttagtagccatctaattatagaaataggttcctttcatgatatttattggtgtttaatcgaaagaatcaaacaaatgaagttggcttattttttaatatgagatcggatacagtttccaataccaaattcatgtatgtatatataaagtagaagatgtagtctatataagctgtgtcgacatctagaatcgattcttacttaatataatgttgaataacctataattcatcttcacctagtggacatagttacaaacacacattaatacacgacacattatccaaaactttgaatgtggttttttaatagccactctttaataaactataatttatgacaaaccatatttagtgtttgtggatattcacaaaaatgtggtccttcgtatatgcagaaacttgaatccatattttgctttaactgtttaacttgcatttgcatatgcatgcattattatgcatcagtctctcgctaaactattgaagtctatgaatcaaagtacccaaaattaattattttcaataactaaataatattgacaaatttaaaataataatatcctagtttgaaagacccaccaatctcagaccatgcaagctttcttccagttcaccaatccactttcccccctaataatttattttgattttatgttgccattagaatacaaattttatttattatctcttattatcctttaagataaatatatgtattatcaaatgctgtgtgttcctgacaaactccacatgcacatgtaaaagaggcaccaagacttataaagacccaccaacattattttgttcacatggatgtgtaaggctaacttagctaattatcaaaactcatagataaatatttttttttttgctaaaatagataaaacttctaagagaaaaaaagagagagtcatatttggagagaaaaaaaatatgtattataaaatgtatcaatttctcattcattgacaatttgagataaatcaatgaatagataaacatgcctaacatttcttataatagatccaaaatataaccaattttttccgaatttcaaaaagcatttaattttgttttctctaaataagttgccttgtgctgtcatgtgcgtaactatcatcttaggagatgaaacagattcctcattatttggcgagcagaatttttcagagctctgacataattaaagaatatataagattactagtgtatataatactaaaatacataaaatctcatacatgtataaactttatatgttaacacatgtacatgcattacattatatatgcttcaaacttcaaagcctcctttgacagttgtatctttgcctttaaagatagaaacctctctctctcaaagaccaaaaacaaaaaaaaaactttttttttttcccccttctcttctttcttcttcaaggtagcctccaagccaaacacggaggaacctaatctgttgtctgctcgtaacttcacaagaagctataatttgtcgttaatgttggcttcttcttgtccatttcttcttttcttcttcctctgaaacacaagaaaaacatctttaacccctgagcagagtaaaaagacgaagaaactggtaactccaaaaaacagagtatatatatgaagagaaacttgagtttgtgaaagtttttttagttatcttgtttttgagataagagttaagtagaggaagaagatatg

SEQ ID NO: 24581 - DNA, 3003 bp, Unknown; identical to SEQ ID NO: 24580
  misc_feature (1)..( 3003): 2750-1469P.txt file - cDNA_ID_2180622; gDNA_ID_1972003; Annot_ID_177781

SEQ ID NO: 24582 - DNA, 3003 bp, Unknown; identical to SEQ ID NO: 24580
  misc_feature (1)..( 3003): 2750-1469P.txt file - cDNA_ID_2180622; gDNA_ID_2684224; Annot_ID_137511

SEQ ID NO: 24583 - DNA, 3003 bp, Unknown
  misc_feature (1)..( 3003): 2750-1469P.txt file - cDNA_ID_2180635; gDNA_ID_1972003; Annot_ID_177784
ttattaattttattaaattgtacattgtcttttaaataaagtgatataagaatattagaagtggacgaaagcaatatatccttatgaatcgaaacaaaggagtaagagaaaaagaaagtgtgatgatgatcattttatcttaagacatcacatgggaacaaaggagaaatcggacaaacttagaatccattaagtcatgtctacttcaccgactccagaattttgttgtctcatgaacaaagattggggttttaatagcttttctatagtattttcacatccataataataattaatgatgtgaaggatatatatatcaacgacaataatatcctaaaaatcatgttaaaagttaaacacatttctccatatttgataaatagcaatcaatatcagcgtatataaatgagatgaagctaaagttagcaagacaaacaaaaacgtatgaattacgtgagcttacgtgaatattgcaaatagaacaccaaatcattaatttcggttgacgtggatattcaaataatgatctacacatatacagtaccgtgggtacgcatgccatttcgagacgtatacaattcagtttcttccacttgagtttcagatctttatcaaaattacaaacacgtttatatatatatacacatatagatagattgatagccacatttctgagattcgatagtcatatatacgactatatattaaatattccagaagatatattgacactttttctgaaagactaattaagaagaacgcgcaagtatgactatgcgttactaagaatatttaatttccattagaaaatgtgtaagtttatctgatatactagttaattagccaaatgattttaaaatttacgttaagaaaatttcgtaggttcaactttttagtgtgtaagttattaattgtgaattatacagctaggaacgtccgttatatgtaaacaaagtaactatatataaaatttaagacttagagtaagtatttattatgtgattgttatatatactcgctaaagagtactagatgaagagtgaagaggttgggcatctcgagagagaaactgaagaaaacagaagagaaagagagttattcactcgatggtccccctaattttcctatcactttttctctctcaatttaaccgtctcttgtattatccccaatagttacatttttaattactcttatcatttcaatacccaacaaagcagaaacagcccagcaaaattttcacttccagaaattataacatggttgaatacacaacactaattaactgcaatatgaatcataaataaatttattaagatttctatataaaaactgttgggcagcaaatgcatgcgtacgatatctatagaattggagtttagtgcaattgttggtatttctttctttggggaaagtgacacgttaaaatatgaaaaatgtaaaaatttgaacaagacttacaataactagaaaaatcagagatacaaaatttactactctatcagtctatctgttgtcttatacactacacctttattatgcactgttcctatcccaaacaccaatccctatgctcagtccatatggtagatactactagagatggtaacccaacacatatgtgttagatggccccataggcagtaagcaaaacattactttttacaaccatatctttgtttataaattttaaaagctatgtgaatttaatttagtattactatcctggatcacaatcttgggccaacaaaagaaatgtgtatgggccaactgtgatgaaagaaaagcccaatggatcaaagttcagatgctttctgtagctcttttgtagagaagtttttgtaagtttagttatagaagcaaaaataggtaaaccacaaaactgaagcccggttgactaaatccttaaatgtgatcatgtcacacagcaacttggctacatgttgtcgtgaagcaatgaataaagtggtacgtggtgtattctagaagcgaaacgtgtcactaatcttatcacctttttagggtaaaatagatttgaaacaaaacatttcttcaaacatacaaaaaaagaaagaaatagtacaagttggccactatgcgtgtcccacttctcgatctcctctttgattgtttgcgtctctttaggagatcctcccattcattcattctttcctctccaccttattattactattattctgctgcatgaatttcaaaaaattatgtaacaacaatttaccgaaatgaaattaccacaaaggattagaaactagcacattcttaataaccaatattgaactcttattagtattgttgttagaacttgaagttaattaggccacaagaaaaggcgcgtagaaatgtttagataaaaaaaatgtctaacgtatttctttggtttgccgtgtcgggggcccagtcaggctggatacacgtggcaataaagggactgtcgtagttgagcacgttgattattagacacgtgtcgagttgtatatgaacaaagtagcctacgtctacgccacttgatgcccttttccacgtggcgtggtgggtggtcgtctatcttttcctataaaaaatcataaatcaatattaaaatgttttcaagaagataatccgaataattccctatattttgtgtctgtcaacgagaaatcactatctattttcattgattatactaatgcaaattggtatattaactggaaattatgtctattttaagccaacttgtgtgaaaatatactaaagtaaagttttaaaatccgtactacatcgtcaactatgcttgtaatataattcaaaaacatgattttctttttttttccctgaaaaatataaaatatgcaaattgaagtactatagtttataatagtaagcatttggtgcttgttttaagacaaaattgtttcgtctctctcaagattgaaaatagaaagttaagccaaaaacgtttctcccttctctttcgaatttctctgactttgatatttggttatg

SEQ ID NO: 24584 - DNA, 3000 bp, Unknown; identical to SEQ ID NO: 9154
  misc_feature (1)..( 3000): 2750-1469P.txt file - cDNA_ID_2180666; gDNA_ID_1972015; Annot_ID_177877

SEQ ID NO: 24585 - DNA, 3003 bp, Unknown
  misc_feature (1)..( 3003): 2750-1469P.txt file - cDNA_ID_2180724; gDNA_ID_1972015; Annot_ID_177896
gcgtttggtacttagtgatcaattttgtcatttttaaccatgtgaagagtttttgttttttttcaacaatcaattgtatatatattttttgccatctttatcacttttaataatagtaaatgaaatatcggtattcattttctgtgacctttatagtctatcattgaaaatagtgttggtgagaagtttagtctttagggatatggtgttattggaggaatcccaaggcctgaagcaatctttgtgtgaagcaaagcaaatgtaagaagaatatatcatctaaatttgtttaagaacacatcactttatatttaattagtctcatataatagcaaaatttcggatctaaaatacatgctacgcgagcctaatatttcatatgcgattgagatatcttttaccttgtagactgtacttgtaatttttttcaaagaagttacatttactttactatcttactataaattactaacttttgctgtataaatatgaccactgaacgtctgtgaagttcacgaccaaaccagtcttactctctcttaatattaaatcattggaatatttattaattgaatttaaatcattggaatatttattaatttatatttaaaaatattaaattactttttcttattgatactagaaatgtataagttacaagttttattttcaaaaaattagtttttaaaaaacagttgccaatagaaccgattccaaaacaaacaacaaagtgtctttgtagctggttgtggtcgctagcaaatacgaaacaattacatggccatatatatatatatatatatatatatgcgtttggtacttagtgatcaattttgtcatttttaaccatgtgaagagtttttgttttttttcaacaatcaattgtatatatattttttgccatctttatcacttttaataatagtaaatgaaatatcggtattcattttctgtgacctttatagtctatcattgaaaatagtgttggtgagaagtttagtctttagggatatggtgttattggaggaatcccaaggtctgaagcaatctttgtgtgaagcaaagcaaatgtaagaagaatatatcatctaaatttgtttaagaacacatcactttatatttaattagtctcatataatagcaaaatttcggatctaaaatacatgctacgcgagcctaatatttcatatgcgattgagatatcttttaccttgtagactgtacttgtaatttttttcaaagaagttacatttactttactatcttactataaattactaacttttgctgtataaatatgaccactgaacgtctgtgaagttcacgaccaaaccagtcttactctctcttaatattaaatcattggaatatttattaattgaatttaaatcattggaatatttattaatttatatttaaaaatattaaattactttttcttattgatactagaaatgtataagttacaagttttattttcaaaaaattagtttttaaaaaacagttgccaatagaaccgattccaaaacaaacaacaaagtgtctttgtagctggttgtggtcgctagcaaatacgaaacaattacatggccatatatatatatatatatatatatatatatatatatatatatatatatgcgtttggtacttagtgatcaattttgtcatttttaaccatgtgaagagtttttgttttttttcaacaatcaattgtatatatattttttgccatctttatcacttttaataatagtaaatgaaatatcggtattcattttctgtgacctttatagtctatcattgaaaatagtgttggtgagaagtttagtctttagggatatggtgttattggaggaatcccaaggcctgaagcaatctttgtgtgaagcaaagcaaatgtaagaagaatatatcatctaaatttgtttaagaacacatcactttatatttaattagtctcatataatagcaaaatttcggatctaaaatacatgctacgcgagcctaatatttcatatgcgattgagatatcttttaccttgtagactgtacttgtaatttttttcaaagaagttacatttactttactatcttactataaattactaacttttgctgtataaatatgaccactgaacgtctgtgaagttcacgaccaaaccagtcttactctctcttaatattaaatcattggaatatttattaattgaatttaaatcattggaatatttattaatttatatttaaaaatattaaattactttttcttattgatactagaaatgtataagttacaagttttattttcaaaaaattagtttttaaaaaacagttgccaatagaaccgattccaaaacaaacaacaaagtgtctttgtagctggttgtggtcgctagcaaatacgaaacaattacatggccatatatatatatatatatatgcgtttggtacttagtgatcaattttgtcatttttaaccatgtgaagagtttttgttttttttcaacaatcaattgtatatatattttttgccatctttatcacttttaataatagtaaatgaaatatcggtattcattttctgtgacctttatagtctatcattgaaaatagtgttggtgagaagtttagtctttagggatatggtgttattggaggaatcccaaggcctgaagcaatctttgtgtgaagcaaagcaaatgtaagaagaatatatcatctaaatttgtttaagaacacatcactttatatttaattagtctcatataatagcaaaatttcggatctaaaatacatgctacgcgagcctaatatttcatatgcgattgagatatcttttaccttgtagactgtacttgtaatttttttcaaagaagttacatttactttactatcttactataaattactaacttttgctgtataaatatgaccactgaacgtctgtgaagttcacgaccaaaccagtcttactctctcttaactaataatattgagatg

SEQ ID NO: 24586 - DNA, 3000 bp, Unknown; identical to SEQ ID NO: 9179
  misc_feature (1)..( 3000): 2750-1469P.txt file - cDNA_ID_2180801; gDNA_ID_1972017; Annot_ID_177962

SEQ ID NO: 24587 - DNA, 3000 bp, Unknown; identical to SEQ ID NO: 9181
  misc_feature (1)..( 3000): 2750-1469P.txt file - cDNA_ID_2180805; gDNA_ID_1972017; Annot_ID_177963

SEQ ID NO: 24588 - DNA, 3003 bp, Unknown
  misc_feature (1)..( 3003): 2750-1469P.txt file - cDNA_ID_2180809; gDNA_ID_1972017; Annot_ID_177964
agaacccatacaacataaatgacgttacaataaaatgtgatattataagtagtatggaataaatttaaaccgagagggtaaataatatacatagaagaaaaaaaaacagagattgaataacgatataacgtatatatatggtcacagtctcatagaccacgaaagccacctaacttacaaaaatgaaacctatcattgattggaatgatgtatttgtcaacacctattaagctatatatgatgtaataatgctctatacatataacatttttatgttgttgtaagaaaatataatttgattcaatgtaccaattacttggttttaaatgctgatatctattcttagcttagaatgattgaaagtcttaacgtttctaaagcaaagattatgtatagatttggtcgtaccaacacatcaaaagtccaatggctagaactcatcatattcaaaaacccgcttgtgggcagaagctgttctttgaactctagttataaagccatttaatatttcttttctttttcgatatgagatattttagcgatgagttagtgatcatttagtcactttccttccaaatgtgtgagatctgaaaaatcttaaaaaccattgcaggaaaagttttatgacaatcacttcttctaggttaaaatgcaaccaacaacgtaaagaatcaccaaacacatggcaagcaaataaacgtggaagtaaattacatagttgggccgccggtgggcatttttacttattctccgggttctcttcttcggaaatgtgatatatgctttacttgggcctaaatgggcttcttttattgacatgcagatttctatctttaatctcggaagaaacaattcgttttagattacacggattggaaaacagcttacagattagagtgaccagacttgcccaaaagaacaaaagtgtgcaacatgatttgttttcttctttttttctggcattcatgatgtgacacctactcatacacctaggatactaaaacttattgccccatttttaattttaaaatgttagatactagtccttgatagtcatcattgttttatccatttccggaaaagttttaatacagtttttaaaatcttatttagtcaaattaaaaaaccacataaaaaataacgaaaatttgtttattttttggcaaattgataattctcgttttccatgaagagcatttactttttgtttcattattgtctgatgcatggttctgccaaaaaataatacgaactctggtcaaattgactatgaccattgagaacctcacgtgtccccgtaaagcaatcttcgcagttgacataactgctgctacagtttttgacggttgagatcagacgagagtattcaagattcggtgcactcgtcgtagtggaatttgccaactgatgaaaaatttatgtcacgcgcgggttttagtgagtcagggcaaagtaagcgctcgtatcgaggcacggtttcagttttttttgcggtaaaaacggaaaaaagttaaagaggttaaaatttgtttggttttgttttccaaacaagaatactaatttatagtaatttcttctagttacatggttgttacaccgaatatatcacagtcaattctatgttctttaaaattcaaaacacaagatttttgcttagttttatatagtggtcgtgatcaataataatatctttggcaatctctttcatgtacttttttcacaccttctcaaccaaatatgcatcttggacttggacacatgggaataaacaaaattgaggagtatttcttttgtataccatgcatggattggattatagctatgaaatacattaaatctaagacctttgaatgacatatctttttattaaactaattttttaaaacaaaagtagaagtttgattgaactttataaagtagtgatctcataacacaaaatttaatcaattttaatcgattcataataaataacttgtaatccctaaattagtaattttaaattatgttatagacgacaaaagtacgattgctagggtaattttctcgttgtcatatttcgacaataaaagggagacacgtgaaatcaacgtagaatcaacttttgactactccgaaaactaatgcgcattcggcatctatacataggttacacatataaaaccaaatccgaataactcgcaagcgcataaatatcaaatattcttggaaagttgtgtttcagaatttatttttgttttaatacttttagatcgctagctaattaatattttaaattacaaaattaattaaatctaagttatttgtagaagatatcttcttattaaactaaattgttcaaataacacatagattgaattttaattaaactttatatatcagtaattttgtaacgtgtatatttaattaaattaagaaagatttatatatatataaaaaaaagtcaataacacataatttttagtaaaaataattaaggtatatgaatgaataataacatacttcccatagaatcaaatccaactagttgactaagaaattaagagttaaagttttctaaaccaaaaatgttgcatccaatgggatgtgtatataaacaccctaggttggtcaagggagaagaaaaatatactattgttaaacaaaatcttaaagactaatttatctttttagcaaaaaaaattcgatttttaactataatcccgctcctagtcttggacaaacttcaaaaaaaaaaccctaaacccaatatcacaacaacagaacccgaaaaaaaagaccacattacgaaagtagttttttttttgctttaataaaatggttcattagaagacaaaatcatagtctcaaatctcctaaaaaaaaacatcacatttaacgctacaaaaaaacccaagttagtacccactactctctcacaaaacaaaagagcctcttcttcttcttctcaatctctctgatagagaaaccaaagcaaaaaaagaaaagaaatttactgtgaccatg

SEQ ID NO: 24589 - DNA, 3000 bp, Unknown; identical to SEQ ID NO: 9164
  misc_feature (1)..( 3000): 2750-1469P.txt file - cDNA_ID_2180847; gDNA_ID_1972016; Annot_ID_177911

SEQ ID NO: 24590 - DNA, 3003 bp, Unknown
  misc_feature (1)..( 3003): 2750-1469P.txt file - cDNA_ID_2180851; gDNA_ID_1972016; Annot_ID_177912
gactggaccagggggtagctgcgaagaagcgggacctttgcctccctcatagcggagaagaccagtggtggttataaccgacttcaagaacctagaggatgcaaccatgtagtaatctttagcttcctgattagcggtaaggatggttccgtaacactgaccaacgtgaacgtcgagagagtcataatcgttctggagaacgtgcgatccttccatctcaacaagcttcaacttgtgattctgaatcctaaagttaagagatgtcttgagacccacgttacagatcctaaccctgtaggtctttccaggtttcaaggtaaagagaggtgcatcggatccatcgcctttcccggactttccgttgatgagaataccatctggacggccaagagtacgaccgctgtcaaggaatttcttcaactgggtgtggctcttggtgtaccagtcaccgatcaagacggtgtagtcatcttctgggtcagcataagggaccgggatgaggagacggctgttcacacggagaccaccgaatccaccagcggaacggtgcatcgcggtgctggggtagtagaaatagcttccgatctgatccttaggctggaaatggtaagtgtagttggtgccgggcatgatcggacacatagttcctggagtcccatcttgccaacagttcttcctgtgttggatcccattcctaaaacgcaaaaacaaaacatatattataagcatgcatattgaaaatgatatattttggtgaaccgtgaaacaaatgttataattaccatgtgaggaggaaaggttcgtcgaggttgttgaagacattaatgatgacgttgttgttggaggttgagttgacgttgggaccagggaattgtccgttgatgagaatgacttgttgtggaacaccgagaggagacacggttccgtaggtcacgttccatacgtgatggaagtaaggatcttcggctcggactaccaccgttgcggcagcggccaggtagaggcacgcggccaagagtttaacccctcgcataacaataaacaatttttggttgagataacagttatagattttttatgtgttttggtactaattgtttattgttatatataattatgctttggggtttgaatttcgagttgtggaaatgtttcgaggcatttttatagggttatttttgacgaatgtttttccaggtttttctcgtcttctttggggtctcctaccatttcgctattcctttcgccatatttgggaatattgaagtttaacctctccctatttttggtgtttctctttaattcctcttagtttattttcttttttccctatgtcttttttggttttggttttcatgtcttcgagaattttgctatttgggattaaaaaataatctaaaggatataattttatatatatatgtgacaaaggtataggtcgaccaataaacattttacattattatagaaaatattttgaaaatcgcttattttaatcataacactttgttttgtacattatgcttttggaatttggatgattatgtctttttatataatatataccagaaaataattcgatatgtcgtattttttctatctatatatcttttgacttctaattgtaaccataggaaaaattagatgacattgaaaatcaggtaatgatgcatagcatttgttcacaacaatattgttaaagttaggaataggagtagtatcttttcccttttcttcaatcatacgagctagtcaaccgttgacgataaattcacggagagcaccggaacctttaagtatgagaaactacttcaataatcttagaaattacttacctaaaaaatcttgcactgtgtagaatttggtaagagacatatggtctccaaatacgttctcagctagcgttatgtcattgatgccaaaacgttctttcatctttctaattagaaaacaaagatgaacaaaagtttgtgatacactccctttggtcagacgaaaagagtttgtgacacactccttttgaccaagagtttgtgatacaaagatgaacaagagttcatgatgccgtaaatacaaatattttgaatgtgtaactttttgttaaagttataagtgataaactgtttttttttgtagtgtatatataagaaactctaagcatttggagaagaaaataaacatgtcgcataagacccacgatgtcaattaccatttattaggcctttatcaacatcccacctcacaatatatctatactaatatataaaattattttattttatttttatatatagaacaccatatacacacatgtacatctcaattaccatttattgtgcagactattatcttttttttttatttttatttttttatttttttgggcagactattatcttatttcaataatctgcataactttttttttaaaggatcaaaagaagattgaataacatgcaagttcatttttgaaattttattatcaaaaacatggaagttcttaaaattaaaattacaaagcatattaagttggtaattaattctgtagttacttactaagttgtaccataatattattttttgtccgtgtaataatcaaccgtagctgaaatatgttaagacaaacaaaattacttgatgatgacacttgtgggtagttaatttggcttctttagagacatgtccaataatagaataagatccgagttgtgtgctcgttagagaaatcgggagtcctaaggaccagcgagcgagagagattcaaaaatagaaatttcacgtaaagagaattagaggtgcagcgtgaaaagaggcaacaattccgtgcataccaaggtccttcacctgcataaataggtattcacaacatcaccaaaagattcgtcaagagcaagagaacatagtttcttcttgcttttgagaaaaaataattatatatttttatataggaaagggttaatttattaataaaaaaaaataaaaagaagcagaaaagagataatg

SEQ ID NO: 24591 - DNA, 3000 bp, Unknown; identical to SEQ ID NO: 9174
  misc_feature (1)..( 3000): 2750-1469P.txt file - cDNA_ID_2180860; gDNA_ID_1972016; Annot_ID_177914

SEQ ID NO: 24592 - DNA, 3003 bp, Unknown
  misc_feature (1)..( 3003): 2750-1469P.txt file - cDNA_ID_2180874; gDNA_ID_1972016; Annot_ID_177922
gcatcatttgttgtaaatatgtaataaacaactccaccgcatcaagtttttctctttatatgaccacccattaagtctttgcatagtcctaaagcttaaaaagatgaattggaagttggttttgctaattggttggattctcctctcgtctattgcatcaaacccagctttggctaaagttacttatccaactcgcacaacaagtaagtatccattacctatctcttttattttatagttgttatttgatagatattcagatcaaattcgtggatctattatctatacatatgccacgtaaaactctttgatgtatggaaaaagttgatcttgtagaattaataattgctttcgatcaataaatgataactacaaactagcaacacttttgttgtttaatttgtatagaaatatacaattgttaatttacatatacataaattcttgaaaaaaataggaaatttattttatggttaatcgaattttaaataggaaaatggcttggaaatatacacatcagcaaaggaatgaagattggctttacaggcagtttttctagacctgctcctcacggaggcggtccaccgaagatcatttctaagttatgacatgtaacgatcttaattagcgatccaatctatatataatctattaacttgtgatttctgattatttgtaaagttgtttcattgtgtgtgatactcttcgaataaattaaatgaaacttcgatatgtaaattattatttagttcactatacgatttaaaatcgagtattgagtgacaacaaggtctttttcattttctcaccaaaatgatgatatgattaacattggacttttcaacaaatgcaaaaataaggaaaaaaagacaagacttagaaagtcaatatgttttcattgcatgcattgacgtatacatatcagtatcacaccaactgtaatgagaacgaccctgatatatataatctctgcctaacagtctaacactagctaatttatagtttataagatgttatatacatatatacccgggaagaaagaggaagaaagaaaaatgagtctcaagttcattcttatagctttgcttctacttttatgcatcacattttccaattcgaccgtcgttcctttttccaaaaaccggaaaattagtaagtcttcataactgcataagtgcaaatattgttattatatggtgttaaaatgaggtttgtaatatagttttaacgtgtaacaagccaatgaagaagaagaagaagaaggtagagagattgacattcacaaaggaaagaagatcaccgtaaaagtcagccgttcgcctcctgcaaaaggctggatttgttgcaatgattaactaaaaggagctatgtgaacattttcataagatcccatccttcaatttctatgaagataatatcgaccaagatcaaacttcaaagcttgaaattagaaacgtgtatttgctatatctcaaccactaatttaaggggctttcggcccattacacgcatgggaagattcaattatgttgattttgtaagttttggggctaaagtgtaaattattgaaacttgtaggcttgatttcattattccaagtttccactttttctcctccgccgtagccggtgcttcttcttcgtgaaaatctttcgtctgagattttttctttactagttgaataaaattgaagatttcgaagactacccaaaaccgcgttttacaaaaagccagattctttttttttttttttttttttataatttcattaaaactacccaatgggcttgggccgaaacttacaaacaattcggtccagttacaaaattagggttttctgacacatcgccaggaaaaagaaaaaagctcgccgcctgttgaccgtcgctagcagagcgaccaaaacctagatccggcggactcaagtcccacagctttgtggccgcctccgagaatcgtccaccaccgacgaaagattccggttttcgtctgtagagactcaactccaacgcaccaacccaccacaagactcccggaaagctagccgctccgacgtagcggttccacggaaccggatcccgacctagcaacccgaaacactcagcgataacacttctctcccatcaccggaaaatagcaaagacccagagccaaacacacgtcgatccggaccggtggagaccaaaaacggcagacctaaagactggtggctcagtcagactctctagatccaaaacccgctgcagccatctaagatccaaacagatctactgttaaccaccgcatcagacaacgaacccccccttacccctctccaacttccgccgtggacgcagcgactagaatcacgggtgagcctgagaacctcgcagcaaccctcagcgtccataaccaagagacccccgccgcaaccttctcgaccgacaaaaccagagccaaatccacatcagagagagagctccacaccacacgttgacggagacaagcatcggctcactcctggacttccttgaagaggcttcaaaccgacgatgaagagcagatcggaacaaaaagaaaaaggaaactaaatctacttaccggaaattgtcttcaagagagagagaagggcacgactttcaaggctacgattgagcctccatctcataaagccagattctttatcttccataatcgtattaaagctacgaaaacctcgatttcgtgttcaaaacttggatttgctcgctatcgaaaggtctgacctttaatccttttcatgggtttaatcgttcagatatgatttctcgtatcggtattatagcttagaggaaaagtgtcgtagttttggcagatgaaattaaaattggctctgtattcccaaatagttgaaacccatttgatgaagctatcttatcagacttttacgcataagttttcttgtggtcttggatcgtgtctagtggcaattatcttctctgagttcttttgcttagtttgattgtctgttgttttagacgaatg

SEQ ID NO: 24593 - DNA, 3000 bp, Unknown; identical to SEQ ID NO: 9171
  misc_feature (1)..( 3000): 2750-1469P.txt file - cDNA_ID_2180882; gDNA_ID_1972016; Annot_ID_177925

SEQ ID NO: 24594 - DNA, 3000 bp, Unknown; identical to SEQ ID NO: 9167
  misc_feature (1)..( 3000): 2750-1469P.txt file - cDNA_ID_2180910; gDNA_ID_1972016; Annot_ID_177932

SEQ ID NO: 24595 - DNA, 2073 bp, Unknown; identical to SEQ ID NO: 9168
  misc_feature (1)..( 2073): 2750-1469P.txt file - cDNA_ID_2180918; gDNA_ID_1972016; Annot_ID_177935

SEQ ID NO: 24596 - DNA, 3003 bp, Unknown
  misc_feature (1)..( 3003): 2750-1469P.txt file - cDNA_ID_2180980; gDNA_ID_1972019; Annot_ID_178000
tcacaatgaagacttattgattctggatgaggaacttgaaaaatgagaagcaactccttgagccataagagttcttgataagtataagccatagctctgtattcagcttcagcggaagagagtgatacccgttcttgcttctttgttttccaacatataggggatttgccgagtaagacaacataaccagacagtgaacgacgcgtttttggacatgtttgaaaatctgaatcacaataggcatctagatgaagatcatcatcgttgcttagtaataagccttgtccgcaagtccctttaagatatcgtactaggcgaactgctacatcccaatgacgtgtacgtggttgtctgagaaattgcgctagaagatgaactagatagcaaaggtctggtcgggtgatagaaagataaatcaaccggccaactaacctgcggtatttggttggttcatgatagaattcaccgtcttctttggctagagtatgattctgttcaataggagtgtcaacgggtttagctccaagaagtctgcattcagagatgatatccaaagtatatttgcgttgcgaaatataaatcccctgctttcctctagagacttcgatcccaagaaagaattttagaggacctaaatctttcatgtgaaagcattcactcatatatgccttaaactctgcagttagcttgatgtaagggggagtgattccccagaagaatctagtgtcactgaaaacccggtttctcttccaccaccggatgtgtcacatgaaaaggatataccggtttcaacggttgaggctacacaaacgcagaatccgaccgtgttgttggaaaattctcatgatccagaagaagaaagtgatgaattgggtaaaggaaaacgtcaaaaatttacctccgttcgtctaaaaggttatgagacttataatgctcgctgcactgaagaaccccatcacgtctcacccgtctttgatccagtttcctcttatgcggtccaaggtaccacttcttatcctcttacaagttacatctctgatgatatgttttccccacagcataaagctttcttagcagctcttattgatggtgctgaaccaccatcatataaacaagctatgcttgatcctcgatggacaaatgctatgggaacaaaagttggtgctcttgaagagaatggtacatggagtattgttgatttacctcctggaaaagaagcgattaacaataagtgggtgtacaaaatcaagcttaatgccgatggctctcttgaacggtataaagctcaattagtcgcatgtggcaatcgtcaagttgaaggtgaggactataatgaaacgtttgctcatgtggttatgatgaagacggtccgtagtttgttacgtattgtggcagccgagaaatgggaagttcaccaaatggatgttcacaatgcctttctccatggtgatttagaagaagaagtatacatgaaattaccggttggttttcgtcattcagatccgaagaaggtttgtcgtctccataagtctctatatgggcttaaacaagccccgcggtgttggttctctaagctctcttcggcgttgctaaagtttggatttgttcaatcttattcagactactctttatttattctctcacgggctggtgtggagcttcgggttcttatttatgttgatgacttgttgatttgtggtaatcatccacgtatgcttcagagttttaaagagtacttggaaaaatgttttcacatgaaagacttgggtaaagcaaagtactttcttgtcattgagattgcccgaaattcagaaggtatatatctttctcaaagaaaatattctcttaatcttgttactgaagctggacttcttggttgtaagcccgctgcaactccgatggaacaaaatcacaagttggagatgaatgagagtgagtttcttcctcgacctgaagaatataggaggttggttggtcgtctcatctatcttcttaccactcggccggagctgtgttattctgtccatatcttgtcaacgtttatgcaaaaaccacgtgttgatcattgggaggcggcgctccgtgtagtgcgttatttgaaagggtctccgggtcgtggtgtgctactaagttcgaattcagatcttacttttactgcatattgcgattcagatttttcgacatgttccacgacacgtcgttctttgagtggatatgtcatgtttttgggtggttctccaatttcttggaagacaaagaagcaagatgttgtatctcattcttcggctgaagcggaatatcgttcaatgcgtaatgcgttgaatgaagttcgttgtttaaaacagttattagaagacttgggatatccacaacatcaaccgatcaagttatattgtgatagtcaagctgcgatacacatctcctctaattcggttttccatgagcgaactaagcacattgaaagagattgtcatgccgttcgcgatgctattcaagctgggatacttacgatggttcacgtcaatacacatgatcaaatagctgacttgcttactaaagctttgggtcgtattccgtttgaaggtttgtcatccaagttgggcatttgtgatcttcatgctccaacttgagggggagtattgggagatctccatatatcttagctataaaataggaaaatatctttgtggagattaggaaattatatagcttcctctccacgtgtagttaacctaaatattctcttgtatatatatcaaggtgtaatcgtatgaaatcaataagagaaaacgttcatctaacctagccgcttctagtttctacagtcaatttcagagctctagagataatcttcatcttcattgaactttaacctcaaaaattttcctaaataaattgaaagcagttttcaacctcaggcttcattagaaaacaagccaaaagtcggagatagaggcacgccaaaaacagagctaggcaaagctactgaagaagctggcaatg

SEQ ID NO: 24597 - DNA, 3000 bp, Unknown; identical to SEQ ID NO: 9216
  misc_feature (1)..( 3000): 2750-1469P.txt file - cDNA_ID_2181198; gDNA_ID_1972022; Annot_ID_178099

SEQ ID NO: 24598 - DNA, 3000 bp, Unknown; identical to SEQ ID NO: 9208
  misc_feature (1)..( 3000): 2750-1469P.txt file - cDNA_ID_2181227; gDNA_ID_1972022; Annot_ID_178106

SEQ ID NO: 24599 - DNA, 2658 bp, Unknown; identical to SEQ ID NO: 9210
  misc_feature (1)..( 2658): 2750-1469P.txt file - cDNA_ID_2181242; gDNA_ID_1972022; Annot_ID_178112

SEQ ID NO: 24600 - DNA, 3003 bp, Unknown
  misc_feature (1)..( 3003): 2750-1469P.txt file - cDNA_ID_2181266; gDNA_ID_1972023; Annot_ID_178126
attctatgggtcttaaagacaaaaggctacaaaatgttacccagtttttttacaatacgtcattgttcagcagttgttggtactcgtctactcacaaaaaggtctgatgcctactccagtactccaatacctataagcaaagaatggaaaattgatggagcaattatacgtaagattaagaacaacgagagatataattatgattttaatgccgaaaagaaagtaagaagatcatcagctattaaaacaccaaccctcctaagctcaactaacccattataaagttagactaccatgatgggtgagcattgatttgtttacccatcaatttatcacatcagtggtcaaatatatagaaatcataaaatccattattcctgcatattcaatttctcccttctacagaatatgactcgttgacatagtaaaaaaccaacattgatagtattttatatgctgtattaagaagcattatacatacgctcatagttctacaggtagagtttaccttcaaagctaacttgtgtaagcaactattggcttcttagaacttggctcactatttgtgagggttcatatcattacccctcttctactctacacactttagtttcggggaactgagatgctaatgcagcagtactttattgttattctcttctaaaggtcaccagggtgacgattgtaccttatagactatgactatgtttaactcacctactcaatgacggcgctcttcacgtctcatctcaactcgaaatttatctttaatatcaccctgtgagagaatgtgtctattattagaaacaagataaaattaactccgagaaatgaataaagaacagaaagataagtgaagctgtgtacattagttctgcgcactagaactggattctcatctttgatccgtttccagtttgcaccatacctgaatcacaaaagaatgcatcaaatcaatagaaatgcatgaaagatattcatctaacatctaggagaatcttcaggtttcagtacttttcatagcctttgagtacggccagcgtttctgcagtactccaaggaagttttggccttctagcaccttctgaacatcggtttcttttcaaaggagacacgacaattcttttacgttttgatttattaatcctttcaatgtcatcgcccatttctccatctgaatcatcaatggagtcattccactaatcaaacaaacaaaaataatgtgaaaaacaaactcatctgaacaaacaagtcctatgttatacagttgcatgaaaagcacattatattaactcagctataactccgaaaccgaacatgcaaagaaatcaattcagcgagtcctacacaatactaattcccaccgagtgcagcgggctggtcagacaatatgaaataataggaaaagatcaaagaatgaatcgggatagtgctgagaaaacttagttaatctgtgtgtattgggtgggtattccatcgacctagctatttaaacacaggaagtctgaagaaaaaaacataaatgatatgatgaaacaattagaaaaagaagcaaatttacttcataagtgtgtgctgtgctacgtggctccatcaagctaggccttggtgcagcgtttgttgcagaaggattagcaacatcgttttcttgttctgtaatcgtctcattgtttaaatttgaaggtcttcctttttctaaagctttcattagctcgattttactagctctcagctttctgagcgctctgtcaacaactgcagatggaatgggattgaattgactgggtacatatacagcttttgaccctccagaagtaggtctttccagttcagtatctaagaggctctctacaacaaaaggaatgcatcagaccctttcagtatccacaaaagcacaatcacatcgtaacaaagtaaatagagatgaaagaaacaaagttgagaaagtgtagaccttggtcgtcttcttccatagcttcagacgcctgactgttctgattacccacgccctctcttgcttcaaccattgattctgtctcttcagattcttcactagattcaatctcatccgattcatccatgttgagattctctaaaacaagattgggattcaaatctaaaacaaccttcctcaaacaaaccaaagctttgtctcttgtatcttcatccatcagtgtcttacaagccttgtcgtcagtgtgggccttccataatcttcgacagcatttcaagaggtcaagagtaaccaaacaactaaccttatcgcataaaggcataatcctaccgagccatatcgttttgattgcttcggtgtaagccttttttgcatctttctcataagcgagacacttcactgtgcactccacagctactttacaatacgcttccgtgactgatttgggtactttagaaccttctttgtgtaaaatctccacaagattctctaatcgctcgagattcttctcttccacaataccatcctcaatctccatgaaaatcccttcgagtatagcttccttccactgcgagagtgccattgttgctaaatcaaccaagcaatgtttgggctttttagagaaatcagtactttctcactcgccgattccgtctctcgaattgggttacacaggaaaggtcaattaggtttgtaacacttcaaatttccaatttttcacttttcgattttcttccgattacagaggcgaaaacgaagcgatggaagaaagaaccataactttttgccgtttccatctttaaaaatagaaacgcgtgtcgttttatttactataaacggctcacattcaatatccctagggagaaaacggcaagatactcactgcttctaactttttacattttttaataaacgaaaaatcatcagaaggcatttgcggcggaatcggattcattgggtacagagaagcaagacctaagaagaggaagctgcagcagcagcagaacttgttcaccagtcgctatcttcttctcaaaacgagaacaatg

SEQ ID NO: 24601 - DNA, 3003 bp, Unknown
  misc_feature (1)..( 3003): 2750-1469P.txt file - cDNA_ID_2181290; gDNA_ID_1972023; Annot_ID_178133
gaatattttacaaatcttgttttgtaagtgtacttaaaacttgtattttgctgtgctttagggaagctgttaaaaggagaaaagcttcctaaagaagaagaaaatttccagaaagtgtacgtcaaggctccatcatttctttcaattcacatgggtgttaaagcagaggttctccctccagatacagattgccatcattttgtgctcgaggtttgatagtttcctactaagatctattcacttgccaggtttatagttattgaatagcgactttcgttttgctgcatccgtaggacgattggaagaatctggaggagccttatggcagtattttcctcagcattccaaccattcttgattcatctttggctccagatggtcgacatatacttcacatatttacaacttcgtccattgaggattgggaggtaaggctactaatattattgctattttccttagctgtagaattatcctattgagtttttattgatttgctcatctttgtttatcaattcgtctatattttggtactagggactccctccaaaagagtatgaggcgaaaaaggaagatgtggcagctagaataatccagagactagagaaaaaattgtttccagggctcagttcatctattacgttcaaggaggttaggcttgttctttattcccctactattttacatgcacattgtagaaatggtgatagtaggtctgcatgatatgagaaatctgtatctgaaacccatgagaataagcctatgccttatttgggtatttagcctgtatatctaaacgttttttgaggcaggtgggaacaccaagaacacacagacgatttcttgcgagggataagggaacttatgggccaatgcctagaggaaccccgaaaggtttattaggcatgccattcaatacaacggtaagctaaagaaagagatagatagatagataacatcaggtttagttagttctggtggtgaatggttttgctaatgaaagaatggttggactaataataggctatagatggtctatactgcgtgggggatagttgttttcctggccagggagttatagctgtggctttttcaggagtgatgtgtgctcatcgggtagctgctgatattggtgagaaaatgccatatttttgcaatatgttaaatagaatgggttgattattatgagcataagaagcaatcacttttgtgttttgatttttagggcttgagaagaaatcacgagtacttgatgttggccttcttggtttacttggttggctaaggacactcgcatagatccaatacattatttccttttcttctttattatgttaatttctattgttttactatttcttcatagaattttacttttctttattttcttatttcctcgtttacttttttctagttctatataaagaagaccttcttgtaagaaatacatctcataataattttcttaagaagcatagagtttttctctcttctactggattatagagtttctggtggattccagaattttatttttcaaattcatagcttgtagacttgtaaaccgatataggtttggcgcttgcattttttagggtttttcgaccgcgtcagatttgtgcatgggaaaggttgattcataaaaactgtaagcccattaaagtaaagcccattgttaactctaaattatcttcattcagagttatatcttcattcattcaggaatttcgaaaccctagtcaattatcgagatcgatccaaccaatttttttttaaggttaaaagtttttgattcgtgaatgatgatggagcctccgcctacgaaggagattgctttggcccctgtatatgtgtattgggacatgaagaggtgtccggtccagatgactatgatgctcgtcgggttggtccgtgtatgaaacggattttaaggaaattaggctacaatggtcctgtcaccatcactgctgttggctcactagcaaaggtccctcgtgacatccttgaagcggtttcttccactggaatctctctttatcacgagttctacagtaagcatttctcatccttattccctttttattccctttattagataaagagagtctctctaagtatatagtttctgaaacaggtcgtaaaagcatggtttcgtgtttccttggccatggtatattgaatccacgtccatctactatgatggtcatatcccgtccaccagtgtacattcctccacgcttctattctaatattagccgccgacgtgaaaatagatacaactccattttcccgtttccacttgagtctcctcgagaagcctcctccaccctctggaaaaagtttcttttagctgatccagggccacttgatgaggaggatagctgcagtgaaacgcctggacttgcctcctggctttgctctgtgtgccgtcgtattggttgtggtccaggtattgctggtcaaggcgttgataattttatcacgcatatctctactcgagaacatgaactcaatgtaagctaagcatccttgccactagtttaactatattccctttctcagttgttcttttctttgcctacatttgaccctgtgttgtctttttcctcgcagcgtcgaggctgtattaccccaaaaggtgatcgcaataactccagattgaaagagagagatatgtgtaaagaagaacataagaaaatgatataatgagaacaattctttttaatccgtaatgtgtgtgactgccaaatattctcaaatgatccaccattttcatgattttttggctgttagaaataaaacgtttagaatttgtaccaaaatacggggatggatttaaacaatcaattgtacgttaagttcaacacatttgaaaatgatttatacgcatgcatcatgagcattattgtattattgtttattttatataggtccctttatatattataaaagagtgcaataaatttggttacgactttgaaactcatcgagctttcaacaatg

SEQ ID NO: 24602 - DNA, 3000 bp, Unknown; identical to SEQ ID NO: 9220
  misc_feature (1)..( 3000): 2750-1469P.txt file - cDNA_ID_2181294; gDNA_ID_1972023; Annot_ID_178134

SEQ ID NO: 24603 - DNA, 3003 bp, Unknown
  misc_feature (1)..( 3003): 2750-1469P.txt file - cDNA_ID_2181315; gDNA_ID_1972023; Annot_ID_178140
aagatcaccttctctttcatatctcccaaagaaaaaaatattgccaaccaatcatttacctgaaatttcttcatccactaataagattcagctgaaacaaaaaatctccatcattacccgatgttatcttctggtttacaagtctctatgcaaatccttgagagccatcaaaggtctccaaaatcacgccgccaaagaaaatatgtgtgtcaggcgagtttgtttcaaagattcaagatgaagccttcacacaacacctcccaagttcaagttctgcaagcaattcagaaaccactttttccattgagattgtttctatcagctgcttgttgctcctcccatcctttatcatcccttttgaaagaagattgattctagatgactctgaattttcagccaggagttgttcgaaaaacttctcttcatcattgagtttcgaggccttcatcagatccaccacctgatgcctttttgcaacatttctacctgctccacagcccattgcagttgctgctccaaccgcatttgcaattgttaaggtattaacaagcggcatgttgcgtatataacctaatgcaattgcagccacaaaactgtctccacatccaacagtgtcaaccacttccacctgatgatgatcatgttttcgtaaagaaaattagatcactacacaaacttacttactctatgatacatacataataattcaattttcaacaccttgatgtgaatgccgaaaatgaacgatatttatgatctgtaagcaggtaccttaaacgcaggtgccactgagacactagatttcgtcactagaattgaaccctttgggcccatctttacaatcacccatttcgttccctttccgttcctcagaatttcttgtcctgctttaacagggttcctgatgccagttagagcctccacctaagtaattcattaaagaggtcaacaataatttgacacagtagagaaattttcagcattagcgagagatgcacaatgtacctcctcagatgttagaagaagaacatcactcattcttaagaaatgagcaagtgctctacgctcatcaggagttcccttggacagactctttccccgtggtccaggatcgaagaagatagctgtcccaactttggcagcgtaatctatcgttgacataataaaactagggctgaaatcgtcaaagtcataaccattgcagaaaagaacttttgactgtctgattgccatctttacttcatcagataggtcagtgatccaactgaaagcaggttcctccttgaaatcagctcgactaaaaaaagagaaacaactagagagaataagttcctatagtagtaaacaagaatattacccatcagaaatttgtttcacaaatagacaaaagaattaggaataaaatgggacagaaattccctgagtcaacaaattcaaagaactaggcattggaggcaagtatgacaatatcacccactagcgtttgtctcaatattagaaacaagatctctaaacaagaaagccatatctttctagacatatagcattaagaacactatcagcaagaaaaatattccgatagaaaatctggtatctacacttttttgtttccaaaaaagttctatcaaatgaaaagttatatttctaggtccccatcaccatccccatcacagttcatgaatgagatgatgcattcactatatacccttagcaaccgtttccccacataaaccagctctaccatccatagatattatcaagttttggcgtggcaaaaagcagtacctgcaaaacccatgcctctgcaaaggatccacaagaacccagcaaatgagagtttcacagaatgagctggtatctttttcatttgttcctccattcaatgcaaccgtacctattccttcctcatgaagcacatcaagaagaaactcaccatagatttcatccccaacgtgaccaatagcaacacaatgaagccccaatctagcagctgctatagccatgttacagttgccacctgcttcccagtatttctataagcaaaacagggaacatatacttcactattaacatcaacagactcaacaatactttaaccttaattcaactgaaacgagaaaacaaagattcaattttctcatcaaagagattgagctaagaagttctttcgatcaatccgaactaaggcagaacaaattatacatacaatgttcgaaattatcaccattgaaacactaagaagcagttaaagtcaagatttagaacccaaaccttatctgggggagacatagagagttcgtccatgagggccttgcgttctccacgagaaggagggggcaattcgtgaacactgagaacaatgtcgacgcagagattacccaaggttgagacatctataggtttctcgaccaccgcgacatctccagtttccccgaaagaacagatggaggaggagccatcggcgtatataaccggagatacatcagcggcgctgctccggcagcggaggcaaacagagctggtcacatgagggactctagcgaatggcgggaggagaggattagggctttgggtggagaaattggagagggataacgcatagtgaggagagaaggagtgaaattttagggaaaaagcgtggtgatacattcagaaaaacccaggaaaaaagaatgaagaagaaagagagttgattttgaatctgcttcgtcgttctctctcagcttctccttcgtcttcaatcttcttgaaatgagatactttattgttcttcaccatttgaggaagaagaaggaaggctttcttgttctgtggtaaactaaaccggagtgaaattggaatatgaaattataccgaaccgggtttgatgtggttatttaaaccgccttgaaattaaaacgggaggttttataagaaagggtttttcatctttacctgatttatacttgtcgacggcggacaccaacagctttcttcatcgtttagagctcacttcaagccatg

SEQ ID NO: 24604 - DNA, 3000 bp, Unknown; identical to SEQ ID NO: 5864
  misc_feature (1)..( 3000): 2750-1469P.txt file - cDNA_ID_2181319; gDNA_ID_1972023; Annot_ID_178142

SEQ ID NO: 24605 - DNA, 3000 bp, Unknown; identical to SEQ ID NO: 5864
  misc_feature (1)..( 3000): 2750-1469P.txt file - cDNA_ID_2181319; gDNA_ID_1620822; Annot_ID_169517

SEQ ID NO: 24606 - DNA, 3003 bp, Unknown
  misc_feature (1)..( 3003): 2750-1469P.txt file - cDNA_ID_2181347; gDNA_ID_1972024; Annot_ID_178162
tatataatttatttatttgtttgtttagcaattgagcaaaaactattcttgtaacgctttttcatgtttgacatgttgatttttgttttttgtgacacgatttgtaatataatgatataattattagctttttaatattttttaaaatgatgaaatttactttgtcacacctaaaattgataaaattttgtatttttttagaaatctaatgttaaattatattaaaaaaaaatgcaaacgtttatacatcgaaatgcaaacttttcttaaaaccgaatcaaaatatggttcaatctatctatccttgactttgttgtgacgcaaaccacacttaaagtcctccaatgtatttttcttcccctttcattgttatggtgctcaagcggtttctcatatttctatcaatcagcttgacaaatttctcttttcttgatggtttttctccgtgtcttctatcattcctttcacgccaaatagagtgtatcgtgttttggaacacataccttagtataaaccttttcgttgtgtctcggtttttgttcgcaagctccctcatgatatcccgccatttttcagtgaacttgtttgctaggatcccccgtgccagctcctcccacacctttctcgaatacggacattggaagaacaagtgctctcttgtctccaaaggatcttggcataagacacagctttgatctgcattttggtttcattgaaacatcctttcccctgttgctaacctgtttttcatcattaaccaagtgacaaacccatactttggtgtagcgtacttgcaaaatttcgtacttgcaaaagaagtttctacgaacttaatgatgacggaaaaaaatacatatgaaacactctacataaactagtattaaaattctttatctgcatggttgttccttaagatagttagagatcatttttgggaagtaaataaatttccactaaaacttaagacattatttgaaacaccggtacaccggtatagtgccttctaaagaacattcaatgttcaagacttccaagtcataatattttttgtttgactttaaaagagaggaatccatgtaaatataatttattcgatgtttgtttgtatcttttcgtgagcttaaagatattacatatctcgatcctttcaatattgttaggtcatgatgccatttatcgatcttccgcatgtcacgccgttcagtctaggcgtgagtaccaatcctaactcctaaggatacgacatcatagcaacttagcaaccatgtatgataaaatggttcacacaaattatttaggcccgtatttcggccccttttgatttcgaaatattttgggcctataaaaaagagagaatgtttgagactcgagagtagtaagaaaggagagaacgcaggtttttttttttaaatgaatgatttcagagaacgcaagttatacacgtactacacgtataacacgttcctcagcaagacaacaatattatcttatcctcaagtggatgcaaataatataaagattttaatattcatttactacatcaacccccaagaacaaaaaatgtcttcaacaaacaaatctacaatcaacgaaacaaacgtaatcaccaaatatgaatcaatcagcagtatgctgaaaattgttgccaacataatttaagcatgcgactttcaaaaactcgaaaaattgtcaacaatttgagtaatccgaatttttctgtttctattacacatgaaaagacaaagtaacattcaaaatccatctcatctgcttggcgcgataacatatctgataagacttttttttgtgtgtccaaagctgataaggtttccaactttatcagaatcaatctatatttgactattcaaaactgaaatacaggagattatttctgctatgaacaaatattattttgactatttgactgatctatcacaaacatcttagccaaaaaataaaatttagtgaccacagcttgagaaaaaaggaaacattcgtgtagaatgtattttgctgatttgtggagagtatagtcttgtgctgtgaacaaatacattcatattaccctgcaacttgcaagtaaaaagaagttatgaagtgacagctaatcaggagataagaataactcgatcataaatacggaacaccgcaacaagcggaccaaagagcatgcaagtagccactagccaagtaggagaaagaaaaatatacaactacataataaatattccaaattaaaaacttattgatttagtctcagcatttatacaaatgtaaaatgtttatacaaatgttgtctattttttttattgttaacgaattttctaattttgaaataatagtgatcaattatgttgcttttgtgactaaaaagtaagtgaatttacaaataaaatgatacgtcaaaattatggttagctaagcctaagtctaagagcttgaatgatatatggatttttggtcgatccaacccaaaaacatctaaatattctatcaacatttatactcaaataacaattgtacatcactaagttacatgttttttataacttaattttaagaataagtcgtgatcaatcaaattacccttgatgttgacttttgattgaaaaaaatgacaaaaagaatttgctgatacaaaacaaaacatggcaaatatctagctcgtacgtgtatcacttgtccaaaggaagtatgcgtattattgcgtaataatacaataatatcggaaagttatataaaataaaaatacaaataagataatgtaattgcatacttattttttaacgcgtatagtacactcatctcaaatgccaataaatatacagatacacataaaagaaagactagaaagtttagttacccaaaatatcataaattaatgtaatcgtgttcactagttgcgcaagacaaagagatcttttagcttaaaaatctcatttaggcatttaccctttaaaaagttttcacagagattctcaacctctattggtgagagaaatg

SEQ ID NO: 24607 - DNA, 3000 bp, Unknown; identical to SEQ ID NO: 9244
  misc_feature (1)..( 3000): 2750-1469P.txt file - cDNA_ID_2181351; gDNA_ID_1972024; Annot_ID_178163

SEQ ID NO: 24608 - DNA, 3003 bp, Unknown
  misc_feature (1)..( 3003): 2750-1469P.txt file - cDNA_ID_2181355; gDNA_ID_1972024; Annot_ID_178164
ccttgatttcctctgaagaaactggacgaataagcctctcattcatctgatcaatgacttttgcttcgaacccaacaaaccagtgagagaaaccagaaggattagaagatttgaacaggttggagaagtaagcagtcgctacctcaccccttagcaccatcagagaaatgctcacttccattgatatccagaagtttgtcaatccgattcttccccctattattcttcacagaattgtgaaagaacagagtattacgatcaccacaatgcatccaagtttctctactcttttgactccaaaaaacctcttcctcccagtacgccttagcaagctccttcttaaggtagaaaatttgatagaaccttggagaaagagccgattgttcctcctctagagctttttcaatcttgtgaatgttttcttgggagttcagattattatctctcttccacccactgagagcctctacacttcttaagtctgtcactaacacaaaggtcattaacaacattcagggggtcccacgactgcaagatggtttcctcaactctaggcttatgcagaagccttttgtcaaaccgaaactgccctttataagaatcttgagaagccatcagtttaagcaaaacaggacgatgatcagaaccacgcatctccaaaaattgttgattagaagcagggaaattcttcagccattccttattaccaaaagctctatccaatctgctctggatccacaagtcataccttctccctgcccaagtaaatctattaccagtactcgccaactccaccatcccgcaagcttcatgcatttccttgaaaggtttaaagtaagactcacatctcttcgggccaccaatcttttcctcattatgcagaatttcattgaaatcacccaccatacaccatctttctctccttccaactccaattatgcttagtctttcccaaacaatctttctttttttaaagtcggggtcaccatacacacaagacagaaaaaagttcaccgcaccaaactgcacttgaagatcaatcaaattcttatcagcaaacttgatatcgatcttaacactttccttccaaaagatagctaaaccaccacaccttccaacaggctctatagaatacactctatcataacctaaaaatgtatgcaaatcaacaagaacatctctactattcatagtctccatcagaaacaacatctcagggaaatactttttacgcaattccttaagacgagggaaagccaagtcttgagaccgtcccaagccttgacaattccagctgataatgctcattgcgcggtgggcaatcccccctttgggatcacctctaagggattgagttttgtggattttgcagtgctagttccctcatcaactgcctttcgtttctctttagcaccatgactgagacctttcttcaactcttgtgatgcagcaagacctgaagccggtaaaggattagctttcctctgattcttagttggcctttttcttgcctttgctttcttaggcttaattccggataagctaggttcaaagaacccagctttaaaaaccgccgaattatcctgaaaaggctgagacaaagcaagaaaattggcatccacatcaaaggcattagggccagcctgatttaaattccacgaatgtgaagaacttgaagtcccaccctcttcacgcagattgggctgagctaatacttttccaacattcctcaagttaatcccttcatcagcatagctaaagaaaactcctttgtctttagacaagtccagatgaaccacaggggctggttcatgactcagcattgactttctcagaactggatccttctctacttctccaacagactttttcaccttgttaatcctcagcagcttctcagtttcatcagagaccaaaagatattgtctcatcccttctaaaacatctgcagcgattctcggtctgcccgtcaacttgtcaatcccaacttgatcctctcttaaaaccccaaacaaagggtctgattctttcaaaacagggggtttcttaggtctctccactggtttaccagagcgtcttgccaaagcagcatcttgtcttgcttttatgaggacagggcaaacatctctctcatgagtcaaacgttgacactcatagcatctcttttgaacccgctcatactgaaaacgcacttctagtttatacttaaacaataatacgtcaaaataaaattttcaatttttagtttcccttaagtttattcataaaagtgtttatacttattatacatgtaatgtgacgtttttaactgaataacagttaaagggtcttacgacggttagttaaattataaacaattttaagttatacactatttaattactttctcgactcatagtactttctttattatacaggaattgtggtatataatgcaactaattttaacaaaaataaaataaaatcatgatagcacaaaatagtaatctaaaatcattatctgaattaacacgatttaaaaaggattattacactaagaattaataacaaacaattactaaaaaaaaaacttttagcttatttaaaagatgaaaattagcttgtatggatcgtgtcatttaaatttagtagctaataaaccctaatagttgacttttgatttctgtaagataaaataacgaaaacagtgatatatagacatgaaaccgcatgtttattggttgttagttgtaactttagattatgtaatcatattagaggattaaaatatagctcgtgaatcacgtccatttaaaattatgatagcagctgtacaaatcataaaaataatacagctcctcataatcaatcactcatctgactagactatataaaaagaatatatacatatcacaatctatttatcgtgttcattattcacgcagcaaatatagctttaatatcaaaactaaatataaataaatacatatagcttaaaatccagtttcctccgacaagaaaatg

SEQ ID NO: 24609 - DNA, 3000 bp, Unknown; identical to SEQ ID NO: 9241
  misc_feature (1)..( 3000): 2750-1469P.txt file - cDNA_ID_2181359; gDNA_ID_1972024; Annot_ID_178165

SEQ ID NO: 24610 - DNA, 3003 bp, Unknown
  misc_feature (1)..( 3003): 2750-1469P.txt file - cDNA_ID_2181363; gDNA_ID_1972024; Annot_ID_178166
ttgtgaaaaaactagaagtaatatctatgaacaatttgaataaaaggaaataggttgatttatttttaggaaaatttattagagtaacccatattttatacataatgacccaaaaggaatgctaaaaatatgagttatttgagtaataattatacctaaattatccttgttttcctttgcagagaaaaacaatattacagaaatgccattactatttaattccagcaaggcaataaaaccacatttatttacgaaaatgccatcgtcgtttttggtaaatctgtggctcttgttgcgacggatttgttatcgatcacagatttgttggtcaaccacagattttttacaacagacttgttttgtaccacagactttactgtgttatgttacgccagatttttttttttccggagattttttaaccgtgactgatttgtttcatatagtctccacagattttatttaaatttcaaaagtaagaatgttgaaaccaaatctgtcactgatttgttttccggaccacagatttttctttatggtggcaacagattttctatttgcacccaaaaatctgttgtgttataacagatttgttaacctcgaaaaatgttatataggcatgacagagttgttttgtgtaatcacagatttaattaacttgttaacaaatctggtgttttacaacagatttttgttaaaaaataaaattactacacagtcacataatgataacagatttgtttttagtgatgacagttttgtttttcagtgtcaaagcataacagatttactcatgtcaatgttatggccgatttgtttatgactagaataacctttttagtaataacagactttttttggcagatttatttttaaaatttcgaaattttttgttatatgagatttattagttagccctcaattaaattatttccggtttgattgtatgttaaatccggtttgactggatttttttttttttttttgaaaacgttacgacagacttttattagccgacagatttttctgaaatattaccatatttgagtcaaggaatattctcgtaacgcctagggttttcaatgaaaaaaactgccattgtcgttttcttttttcttctgtaacgcctaccaaatctaatttcaatacaatccattattcttctacctattcgagatcttagttgcttcatctttgatacaaattcgattcccttgtttattcgattctctctttggtatggatcaagtaattctcgtgtgtggtaaatgggtatatgagaaaacgagatggctttttgtggttgatagtacaaaaggttgccgtgtacttgaaggtaatagtcaaaccagttatgatgatttcatccaaatggtgtatgaggattacaatatcgagaatatcaaattgtatcaccacagaaaacagcccaccaaaacctactaatcctcataattcaatagtgataacatacaatctgccattcttaaacaatctacgacaatattactttaattgataaaaaataaaatgtggaaaatgatttacgagctacaacggattgataagaaatagacttttcggtgttactcgaaaacatgatcttaacttttcggtgtacaagaactggaaaacacgagcgaaaggctttttaattttacatactaaagttcttaacttttggtttgcccatttgcttagtacgttcctttacaagctatgacaacaattaatttaattgataagaaatagaaatgtggtttccataaccggatttctgagttttgttatttttacatttgtttatttatttttattagtaatttttttttttttaatcaaaatatagttttaatactgactgaggttaaatagtgttttaacttaaaatatgagtcataatagttagtcatcgattataggagtcacaatagttatttctattaagattagagtcagtctaagcaattttcacttatttttacgttggtgaacatgtttgtttacatgaacgagtaaaacttcatagtatcttaggaggtacgggacaacgacattttgtttttattaatattctcttaatcattaaaaaggataaacatgtttaacatagtacatgtcagtaaatgaaaacatagttaagtaagaaaattctacagatatttacaaatgtttattgaaaaaaaaagagagaagacaactctattcttggaacgattcaagttttgttttgtttaatctaaacgtacacttaggtgatgatacgataacatggtgtcatgatttgataagaaaaccactttagataatttattgaaagcctgattagctttataaacacacatatattcccccatcaaaatattctacttttccctcaaacaaacaaatattgatcgtactttgttcctttaatctcgaagttgtctttacgtaatatgaaaacataacataactctcttgatattaaatctaggtctagaactcatgcgaaccaagttttggaagagaataaaatgaacctaagaatatatcaaaagatcaaaaatatccaaagaatatgcaagagttagaagtgaatcggagatcaaaaagctgtgactgtgagtaaattagacaatatatcctttccttagagaagaaaattagtgtaacgaatctaaaatataaaaggaatatgaataagtaaaatattcaaaaaagttgctaaattagttaatgtttaaaattggtgaatccaaaattgagagaagcaaaagacggccgtttggagaaagagaaaatttgggaccctctactaagaaaagtatcttccaaattagctgtccaacagctccgaccagtctgttctcttttgctcttctcacacacacacaaacataacatctcctccattttctctcttctctctttttataagaactcttcttcttcttcttctctctcaattccatctctctctctctttctagttcttgttccctttcgaatcaagtgatcatg

SEQ ID NO: 24611 - DNA, 3000 bp, Unknown; identical to SEQ ID NO: 9239
  misc_feature (1)..( 3000): 2750-1469P.txt file - cDNA_ID_2181388; gDNA_ID_1972024; Annot_ID_178175

SEQ ID NO: 24612 - DNA, 3003 bp, Unknown
  misc_feature (1)..( 3003): 2750-1469P.txt file - cDNA_ID_2181407; gDNA_ID_1972024; Annot_ID_178179
ggtgcccattttcctttacccacattaactccaacgggcttcgtcaacgttgccggagtcgtcgtcgccgccgacgccgatgaagcagctggtgtttttgggtcggtttgcacggcggagatccggaaagaagtgggtctggagacggcggaggagaagtttggttgacggtggttgatcatcgatgatttgaccgatgatagattcatgcttccattcataagcgccattttgataaaataaaataaaaagttttgatttttctgatttgggattggtgttaagatttcgacaaatgtgtgtgtgaaatgttacacgaaacctgagaagtgttgagatgagaatttgagggttttataaacgaaatcggagatggtggtggtgtttggtgaagaagaaggctaatgtgttgttgtagttgtggtaggtaatttacttgtaagggtattattggtaattccatgtttgcgattgttagaagggtagatttgtcaattttcattcaaacgataaccggctaacgtgtccgtaatcaaaaacgtatccggtttagcttcgtgttgaatgggcatgtctttgccgctaacgttcggtgaaattcttataatcatgtatactttattttattgatttggagactcaattgtattataaaacaagtttttcttattaaaacgaagatttttcaaattttattttacatgtgtcgaaattgaagatattaggtcgaattgtaatgttttttttttgacatctttgtattgttaagttattaatgtttaattctgaaaaactaaattttttatacgataagaatataaagaaaaaagatgtaattcaattaaaaaaagtaactaaaactaaaagaaagttatattgaatattgaagcaaaattagtatgggatattttatagagttatatcaaacattatttattaaaagtttttttaaaaaaataatctttaaccgcgtatagtctttataaatataaacacggcgttggtcgtggtcttatatatacaaatttaagatggtcatggtcaagattttgtatatttagttatttataaaagttggtcgaatgttgtgttatattaaaaaaaaacatgggtgtattaatttgtacatatttgaaatagtaataaattaattacacttataagtagattgattgataagaataagttaataaccgatcgagattaaatgagactgagtaaagctagcttatctcacctaacacccgtcgtaaatgacggaaccccacctttctaatttcgccaactcccacatttgttataatcttatttattgttcatttgtaattgtttatggtttcaaagtctattcgatttctacatattatttattaccaaactttttttgttggtttgttatattagtattgatttgtaagagttgtttaaatctcatccaatccgtggtataatgcattcgtgtgtgttattaacgattattagttctatatttgtagactgaagactgaaaaactttccgttcatatgatcatgccttctcgtatacgatcaaggaccacattcaatggacatattcttggtatttgttatagccttgtaggtattattagtaaacgtgttatgcagacttggaaaatagaatgaaaatgaagagcatattctttcgtgttattctcctatagatcacaaaatggaccgtcgatgtgataatgatctggtgaggtagaccctacggagtcttgttcttcaatatgttggtggaaaggagagagagagagacacacacaaaatgttaggtgtgttgactttggggttatgtgcttattacaaatatatatactagtcattagcaacgtcagtaattatacttcttgtaatttcatgaaattttgtgttctttgcgactttttttttttttctgtttgtttgacagaagtcagaaataatgtgtcagtgttcttgttttctttcaaggaatccactagattaaaagtcacttggtatattagaaaatatattagggcaagagttaattacgaatattaattaatgtggtgttgttaagacttaagatatataagacagttcaagcatagttacataccaaatcgctagatatgtttccatctctaattttctactgatttcaaggccatctgttcatgtaatgttaagtaaaaaaaaataagttctagcaacgttacatgttttacatatcttccacgcgagagataaaactgactttcaacatttaaggatcataacaattactccatgttgatattgatgtacgacgaaatgtagcctcaactacaaaataaacggcagaattaacgtatttgataaacaacggcttattggattaaataaagaacgagcttacactggaccctagggatattgataatctgatactaagatttgatgggctaagaaactccattgggcctagtagtcatgctccctaaaacaggtgacaatttttattctgaatttctgacgcttcatctcatgtttgcggcacattagagcaggtccattgggaagaccttatgagtttcttagaagaaaactaaagaaaaaaagtcaaaaattaattcagaattgtggtattaagcaaggttcgcaccttgcattaggtgttttttggtttttaaggttcgtatacgtgtcattctcttattggaagactatacaaacaattttttttttccttcgttgccttctctcctccttgtttgctccgaagctctacgcttctcatcttcgtctcccttctgcaaatgatgaactctcttctcatcatcgtttctcatatcatcatcgtctctcgatccgtcacgatccccatcaagttttatcacgtcttcatcaccggtagatcaagcggaatcggtgaaattagatacgtttcatgagcttgcggcgaatgagatgatgcgttgtgcagagcacggtggagaacggtgcggaggcagtgagcaagccggaaaataaaaaatg

SEQ ID NO: 24613 - DNA, 3003 bp, Unknown
  misc_feature (1)..( 3003): 2750-1469P.txt file - cDNA_ID_2181414; gDNA_ID_1972024; Annot_ID_178181
tccgaagctctacgcttctcatcttcgtctcccttctgcaaatgatgaactctcttctcatcatcgtttctcatatcatcatcgtctctcgatccgtcacgatccccatcaagttttatcacgtcttcatcaccggtagatcaagcggaatcggtgaaattagatacgtttcatgagcttgcggcgaatgagatgatgcgttgtgcagagcacggtggagaacggtgcggaggcagtgagcaagccggaaaataaaaaatgggggcagaaggttggatacgtgcgagatacttcggagaacttgcgacaacaaatggtaatgtgtctctatacttctatttgagacagaatataagggaaacaagcaagattgatgtgtgatatctttagaagtggactcaaatggttagagctgtaggcttggtatcatgatggttgtcgtatttttggctggtttagataataggaatgaagctagattgcctttggttggggtgtttgtggctacaagtttttggtttttgttgagcgcacacaaggtgtttgataaaatgtcaaagagaaaaacagattggatagatgcaaaattgttgttggctaaagaatgagtaacagatagcaagtaggatttaagtttaactttgccttctatgtgagagctttgtgttgtgtaattgtcatgtttgtgtgtctaggtgtgatggatgtatgggttctttcctctccttagctgcgtatgatggctgcagcaataccagcaacaacccctgagaaagatttcaattccttacaaagttatgtatgcatgtcacaattcaggccaaacacaaaaaattctgtacaaggacaagcaacgcaagagaatccaaaatccgatgaaggagatattaaaacaattggaaatttgtgattcgaggttcctgtgcgtgtcaaattagctatgttcttgtaattgtcattttttgtttttttttaagaaacccacttaagattctaccattgggaaataagattgaataaaaactctaaacttccatttattcaaaatataataatataaaattttaaggaatccttaattaaggtgtttcaatgggggtgctcttaagagcatcctcaatgggaggatttaagaggtttcttaggttaataaagggatttaaattaaatgtttaatgatgattttagcttagaggccctcttaccttagaggctctcttagaataggtgtggaggtgacgtggcattattctcgtgtttcttcttcctcctcctctctctctattccgcgatcgaagtgaaatcggaacaaataattctcttgtccggagtttctataatcctttcaattcctctacttataattcaattttctctcgttaatgtatctgatgcttttgtatacacaggttccattcgataaaatagtttttttttccaggtaagtttcatgatgattatgtgttctctcttttatatttcaattgtaggatatatgtaattgttttgtgtcatgggattgatttgtgttaatgcgtttaggaacattcatgggattgatttgtgtcatgtagagagattgagtttgcctaaattagctcatgacttttttggtgcatgtactctttacattacatagttctctaacttctgtctgtgatgaaacgaatgaatccgatcattcttctgtctttagtttaacgaaagagatacaaaatatagtgatgtaaccactatgttaatagctattttgtcttatatttttatctaagctcatgcagcttaatcttatatggtgatgacaaatttaacaattggagacaaagttgtactttatttccagccatgtggataacctcccattgaggatggtctaacatcctcgtgtttcatactaatcttttttttgttatatttagcttatccaattcgcttgttctttatcatccgttcaaccatttataccgtatacgactagtactccaccaatttatttcataattgcaaatgaaaactcgagtcaaacccaagtccaaaagggcaattcgaacttggttattgtatccaaattttgaagtcaaagccatgcatcaacttggttacagactgtatccaaattttgtttgtcacggaacgtatctttcttctttgtcacggtgtatttaggcgtgggttttgcactttttgtggttttctttctttggtgaagttcctttaatttgacatatggaatagtggaaaaaaaataaaaggacaaaaacacttaaatttcccgaacaaggacaaaaccttaatagttccaaaattattaaatttcacagaaagttagaaacaaccaaaggtatccgtagaggttaactttaaaggaaaataaagcaagtggtccactcccacgtcgatagtcaacttattgctcttttcgacataatttacctccttattaaatctccttggactagtataactttctaagtatgcttatatctttcatttaaaggcgaaaatttgaaatctgttaattaagcagacactaaattccagattaattattcggcacaagacaagcaaaatagataggcacatgtgccttggaagatgaagatatacttggaacgtgatcatgatctggtgccacggaaacctatatattttgttgcacgtatccctaaatgattaggtccattcggcatatctggcattgtagattttctgcagtacgctcaacttgtagatgaacattatcttatattaggtttttatgaattttacacataaatggaaatcccgggctcatggcaggttttggatactattcacacgtgacgtaatttgtggacaaccaccaaggccaagaagttattagtttggtctcttttttcttctcttctttcttctcttctttctctataaaatggcttatttcaaaggcaaaccaaaactcacatttgttcattacaaaaagaggaaactgacaactgatttcgcgcaagagaaagaaaaatg

SEQ ID NO: 24614 - DNA, 3000 bp, Unknown
  misc_feature (1)..( 3000): 2750-1469P.txt file - cDNA_ID_2181434; gDNA_ID_1972029; Annot_ID_178199
atagagacagagatatagagagaaagagagaggaaggggtgagaaaccttcagcggaatagtgctcagctaatgaattcaacttgttctttgccatataaccaccagctgtggagaagtctgttccattaatatttccattcctaatattgacatcagataagcccacgcttcctaatctagaatggtctgaagttgagtagagactcgctgaagaggaggttcgtttagggatgttgacctgtccatgggaacccactgtagaagcaccaagacttgctccatacccactcattccaccataatttgcagaaaacaagtgatctttagtttctgccgtattttgttgccgcaaagccttcttatgaccattgggtatgtaacgcatgacatcagattgattctccagttccacttgaagctgtgactgcatatggttttcttttacttgactcatctctgacatgttcaacctggacaatgtgtcggcaacatcggcagcagtgtaagattcacagttttggatggctgtgccaaaagtattcttcttctcgacaggaccaaccctggtaccaatagggggaaggccagaggccgtagatcgtcctactagatgtgagtcaggagttctatttcttggcaccggagaactcatggtggatccaagcatagtatttggactgtttttggcagtagaatgtaatgaatcatggaatgctaatgggctgtcaaatccaccggcactgaaatttgataaaacagcagcatctttcatatcccgaaaagtgttgcagcttgcaggccgagagagttggctgcctaaggctgcatcccgttcaagtccttcctgcaaaagttccactcaatgaagtaagaaaccaaggactattcagacacctcacaaccagtatatactcaacagcataagcatcaatgtatatacattacctgaagtatatcagcaaaactcttccttctcggtccaagcccagaatatccagataatccaatcaagtcttctctgccttgatctagccgctgcaccttctgagagcggccctgagctacagcattcctcagttccatcaaatcattctctgcctgctcaactggaacccctggctgaaccgagaagagcgatgaggagttgtcgacttcaaccgttttcttcctccattccccaacaggatcaaacacagactcactgttgtgaaacctctgagcaaccctccaatcctctctagacaacaacggaggaggcaacctcggattcgaatgctcattcgaatagtaataagagagatactcagggtgccaacgtaactcatcatcagataaaagctcaacgccattgctagtggttatactgctaatattcccaacatctctatgatcagagttgttattgttcaagtactgattatccatagctctcaacaatccttccacggtaggaggcgcgcttccgcttctgtgaacatcaatgtctcgttctcgttctcggccaaatgattgctgattacgatgttgttggagcaaagattcgagctccctctggaatcgatcttcgagatccacattggatcctcgattcacacttgtcaaatttgatcgcgtatccatgtagctattagtaaccatctcttcccttcatccgaatcaatattaaacctaatcaaatcaacacctgcaaaaaccagaaaaagccaaaaacaaattcgtgtcggtgttacgaaatcggagaagaatctatcgatttttgaaaaagagtaatgatcagaatccgatcgcgaatcaaagtaatgaatcacctctctatcgatttcaatgtctacgaagacggaacgataaggttctctgtttcgtgaaaacgcagaggagagaacattgaaggagaaagtgagagagggagtgagataagaaatgtaagtgaggaagattgagagaaagggaaaggggattcaaagaatgagagacgaataaggtaaagaagacaaaagaggcaaatcatggatgtctgagatcgccttcatcctctggtaattctcccaaactgtcacacttaaccttttttaattacataaactaatcttaaaaaaggtgattagaagaagatgcggctattacgacatcgtatatccatctctttgtctgatggacaaattacataaagttaaaaggatgattaattaatgattaaatttgtcacctaaattcaagaatctcttattaaatcgagacaataaataatcacaatttctaacgtttgtttttttaatcagagagaagtttgtatttttcgtttatttcgttacggtcattcatttttctgataattaatttgtaatctttatacagaagtttaattaatatagtttatttacaatagagaaataccctctacggtaatagcattaaaacaaatatttagtatggcttaactcttttaatactaataatgatcaaatatttagttatgtcttactgactatattcctaaacatttccaatcttaagagagcaagattcgcacattttaagaactagcaaaaactcacttgcaaatcctccatattttgaaataattattttcaattttataatttgttagtctagtttattaaattaactcgcacaaattacttctatttttcttaaaaaatcaaaaacactattgtttgtacaaaacagtttttaatcaaaaacttacaaagcctataagaaaaatctcttgcagcccactcaaaccattccttagaactcggaactctctattcatatgaaatgaccaaaccatccccacttcacttaccttctatgtatggaaagttgtgagggtgaaacagtaatttaaaacgatatagtttccattacagagatttctatttccattttttgatatcattcgcaatcattttcttcttcttctttcccatgatcgtctctcgcttcccaacgcaatcttcttcacccaatctctaaatctctcctaaattccatg

SEQ ID NO: 24615 - DNA, 3000 bp, Unknown; identical to SEQ ID NO: 9255
  misc_feature (1)..( 3000): 2750-1469P.txt file - cDNA_ID_2181458; gDNA_ID_1972029; Annot_ID_178206

SEQ ID NO: 24616 - DNA, 3000 bp, Unknown; identical to SEQ ID NO: 9250
  misc_feature (1)..( 3000): 2750-1469P.txt file - cDNA_ID_2181472; gDNA_ID_1972029; Annot_ID_178209

SEQ ID NO: 24617 - DNA, 2750 bp, Unknown; identical to SEQ ID NO: 9247
  misc_feature (1)..( 2750): 2750-1469P.txt file - cDNA_ID_2181517; gDNA_ID_1972029; Annot_ID_178222

SEQ ID NO: 24618 - DNA, 3000 bp, Unknown; identical to SEQ ID NO: 9273
  misc_feature (1)..( 3000): 2750-1469P.txt file - cDNA_ID_2181575; gDNA_ID_1972048; Annot_ID_178304

SEQ ID NO: 24619 - DNA, 3003 bp, Unknown
  misc_feature (1)..( 3003): 2750-1469P.txt file - cDNA_ID_2181579; gDNA_ID_1972048; Annot_ID_178306
accatcaaaagctaaaatgaagccacccttaaaggacatagatatcttactctttccgacgccaaatgctgagcctgccatcgacatgaccacaataaagcaactccttgtttggatcaggcaagatatcaagaaacttggcgcaaccacgaggtaatggcgtagtcgagaggggcgtctcatattgcagatcaaacaccaatagctccctaggaaacgtcacaaagagtatattcttccaatgtggcgagaaggcaaatctagcaaagtataacggaaatgcggctgaagcaggcgaagacgatgatgaattgccattactagctgcctctctttccaacctcggtagctcactgaaatctgtctttatctgcatctcctgaatcacaacatcgttctcactatctccaagtaccttaaccgacaataggaatcctttaaggccaagcacacagaaatggcgagaatcatagggatcgcggcggagacaggagagaatctccgtgccggcatcgtacttccagaaaagtccaccggaggtcgtgtagagcgagagaaacgaagatccagaaatcgcagcgaggacatgagaatcgtggcgagcttgaacccaacaaaggtcttgaattccgagcttgggatcggaggaaggattaagccagacgacgacggagcgaagatggaagtcaacgagagcgacacggccgtggcgatctgcaacggcgaggagaaggtgagaggcggagggttcggtggagagtagatcgcgggggagagggagaggaatccaacggacggaagtgacgaagggagagagagcaccgggaggaggagggagagggatagtggaaacgagctggagagaacgagaatcgacgacagagacggaggagccagaggcaaaggcgaagagaccggagggactgagatcggcggatccgaagttgttacggctgggaggaccggggagagtagaatcccaggtatcggttggtgatggcttcgatgctgccattgttgcagctttctaccaacttaatttctctcgatttcaatttcaattgtctcatttgtaaacttccaaaggtgagttgaaatctatacatgaaccagcatgtacagaggaccattctatttttaattttttttcacaaagtgttctttttgtttagaaacagagagattccaaacattataaaagtgggtacaaccacctacaacctttaaagcctgctaactattacaagttttggattatcaaacagagtactgacaatccctacttcaacagaaccaaaagtatcctaagttacttgaagctcgaccataacatcttgaacattcaaggattaatgagctcgcaatgagaataaccaaggatcattagaagactctacaacataggctagtcttcatcttttacctgaaagttaacacacacaaattcctaaaaactggattaaagaaaaaaaacgaaacaaccttttcctgctttgtcgaaactacgtgataccaaaaagtggatgacagtatttgtagagtgatattatctcttctttggaggtatctcaactccccaaactgatgttcttgaaactttcattatttttttcttcagttcattatctgtcacaattgatagatatttagatgactccccaacctcaatctttgtgtcatctcatctatcagtcctcactctttacaaagttctttgctgcccaacaatgctttctttggcaaattgatccgacaatcattgaggatgactgctagcaacataagattgaagtcttaatcttgttatcactacaacaaatatccacattaatagcacaagaggatacattgatagcacaagaggataactcattttccgttactgctatgaaagattaatttttattttgattattttgtaatagcgtttgataaacactatgatagaaaatcactaagcggaaagctaaaatcatctattccgccaatatatatgcgaaaaaatcacttaagcgccttatgtctcagatctaaaaatattaagcgacaaaacgctaaacacatcttaagaaaaaaaaaaatcccccaaattgattccttcaaaccctaaatttcttctttgaaaatctctaattccacttcttacatcccaaattctacattgttcttcacctttctctcctcctttctctcttctttcactcatcctctcacgtttcagatggaaaaggtttgttgattttgtctctcttttccctttgaatctatagcttctaatccttgtttgttggttgtatcgctcctctgttggttttgtctctcctctttttttgaatttgcagctcaaaagggtaacgtttttgaagtgtttttgtgcacacaaggtgttcgacgaattgactgtgagacaaaaaccaagaaaagactcaacatctctttctctgggttcgtttctctcttctccaaggttgtggtatatctcaaatcactatgattcataaacctaattacaaatactttatctataacatcttaagtgttcttcctcatgttgaattatgttgtgtatatggttcgacattgcattcagccgtggatattgtagtatcttaggtcattaagcaaggtctctttgttagcatatgtagcataaaaaagattttgttttgttctttatgttgtttcgtgctaatatatttcacaaattctcattgctttctctcatgattctctaaattgttgttactctctttggatttctttaatctgtttccatggatgattacgtttagctactttaattgtatttctacatcgagtttataatgatttggttatatgattaatagttttccttctaataatgacttataattttctctatttcagtttactattgacaatatacttagcttcaattaagctactaggagaccgagttttggtaagaccaaagagacagagaaaaagacttgacttttgaatatagagaattgagagatg

SEQ ID NO: 24620 - DNA, 3003 bp, Unknown
  misc_feature (1)..( 3003): 2750-1469P.txt file - cDNA_ID_2181660; gDNA_ID_2214712; Annot_ID_189912
cacataaaaaaatacgtatcaatttgtgttaaaacgttaaagaataaagtattttccaaaaaagaaaaagaaaaaagataaaataaattttgctgccagtaaccgaataaaagaaaattaaagcatccataggaaatgacgtgtatttatcgacgtggaaaagaacgtgagacacgtggcagtatatatcagagcgagagagaaggttgatgcacggaagctgttcccttttaaaaaatttggtgcaagtctacgttgtggcactcactcacttaataaactccacttttctccaaagttgattttatcatcctttttccttttttaaaccattattggattcttataatttataatccgcatgaacatttaattaccataaattaatctctactgtatatcgtctttagtagttaattgtaatttcatcttaggtattttaagtctttctgtaaatcgccaaatattccggaaactatatggttctgagaccatcttatcttttactctcttaattatttcctacttttctatttatagagttaatactttgatagtcagaaagtaataaatctttatctctcttaatttttcaaatctctgctcagtttataatttctaccttctcattttctccgtactctctgcagatttggcctaatatattaagttttttttaaaaaatatatatatatatatatatattttttcgtgactggaaaaatgcagatctaatccaacaatgataagcctctttgataataaatttcaaacaatcgaggtatgagaggaaaaagaaaatgagtcctggtttggtaactccttggatattgaggaacatcggtttaaggccaacctaaagcttcgatggatatatttgcatcaaagattcgaataatggctcactgaagagcaagtctcggtaatacttttgctctaaacaattcgatcttatctcattcctctcttaaatccaccctataatggcaccaccacccacgttgcataagtttgtatataggtgtttctttcacaattgttttttataaaaaagaaaaatgtttttttcaaagaagaattttagataaatttaaaaacctttcgacaaaaaaagaaagattaaatttaaatattcaaaagaaaaagaccttaatccccaaagtcggtcaatgaggcaaaaaaaggttgttcaaaaaatgatagcacacttttaatggatttttgttttttgtgtcacgaacactttgaatttaaggaactaaatcgtaagaattgaatactataacgttccactacagtcagttttacaactatagaacagtttaaaaaaaaaaaatttatctataattccttaattacagaaccacctacaagtgttaatatgcatccgtttttatatgcgacgcctggcacgtatagagaaaacgtgttttgttcacgtattcgctattcgcaaaacgtatgccacgtgagatctacatgacgacatacttacttgtattgtatgtaacctcttcgtacatgatacctactaaattgaaatttaagtttgcttgaattttctttaaaaaacaattctaatgaaatttatcgaaatagaactatcattttttgtaatcatattaactttcatgagcttttcaattcgatactaattgctactaaatgagttgatctatcattaatatattactttagactttttgtattttttgatgtggaattctaacaaaccaaaaataaattaagttaaaatatagactaaacacttatcacgaaatgagctcacatcaatattttgataatcaaatgattttttctttttttaccaagaacaaaacgtttaggaaaaatagagaaattagaaacaaagaaacaaaagaacaaccttgtataaggaaaaagaatcgcaaaaaagggaatgcgaaaattatgtatataaaagagtatcaaatacgccaaatgtaaatgaaaggaacatataactttaattatagttatttctttttcatattgtacaagggtgaaggatgaattcaatgtagctaacagatagaaagctaagagctagatggtccattttagtgatatatactgcatgattttgcattttatcgacatatttataaaaaatttcctctttttctttcttttgtaaaatacgttaaacctcaatttaattaaaagggtgttgacctataaaaaaactaaagggtaagagatatataatagacttaatagtgtttaattataatagaacaaatctgcaaaaaaaaatggtttgcgcaacggttattaaagatataattcaaactagggtgcatacaaacctattgaatttcctaatctacttaaaccaggtttcatttaaaccattttcatgaaactttccaattcacatatttctttaagaattcaattagttagtttattttggttgacatctacaatgagtgtttttttcccctacataaaactccatcatttggtaaaaaaaacttttactagcttgtacctttcttcgttaaatgtttaattttcactttttaactcatccgtattttacaaacgaagagaataaaaatcaatttgaagtgtatatttggctatatacagttttagtttaattcgtataaaattggaaaacacatcttttgaagaaacagaagaagcatggtaagaaaagaaggaaaaactatttaataaatacataaatccacccacataggtgtggagacaaagatatagaattccaaatatggaaattaatctctgccattagtggaagttaattctcataacaccgaaaagctaacgattttcaactttttttttttgttactcagaagattttaaacctttataaatacgaaaaaaccaatctcacaaatcatcaacaatcaccttgatctccactctcttacatataaataaccaaataatttctctcccctcttctctctacacacatagacaataaacacataaagacagtttctaatg

SEQ ID NO: 24621 - DNA, 3000 bp, Unknown; identical to SEQ ID NO: 9284
  misc_feature (1)..( 3000): 2750-1469P.txt file - cDNA_ID_2181660; gDNA_ID_1972053; Annot_ID_178355

SEQ ID NO: 24622 - DNA, 3003 bp, Unknown
  misc_feature (1)..( 3003): 2750-1469P.txt file - cDNA_ID_2181693; gDNA_ID_2214712; Annot_ID_189901
cactccgcagatgaatccaacttttcgggtagagtttgaagtaccttgtgaatatgaaacacacacggcttgtttagcaagaaacatttccacgtttaaaaaaattctgtttatgcgtttttgtttgcgctatagtcataagaatgggttttctcgttgttaaacatttgaaatatctcttgggcaagatttactttgtcaaagtgtttataaatgttatcaatggatttggatgccttgtttttcaagaaatttattgaaaaagaatcctaattttgatttgagatggtttcttgtaacccaatctcccctagataaacctaccttttcgccggtggctccaaggaggaaatgaatattagtggcggtaaggtatttgccgtaacagctttgaagacggatcacattggatccaggtacgatctcaaccgtccatctagtgttttttgttgtgccgcgacgatcttgatgaacggattcttgatcttcatcggcacttaggtatttgtcgttgtggctacggagacgtacaatcgttgcctttctaaatatctccatccgagaacaataatgatctctttctaaaaaattaagaattaggagacaaaaggggatggatctataagttattcttcattatcgtgatgcaacgtaggctaatatggtttgttgacctgagtcttgttttttaattcgcttgatttgagtcttttatcgttaatggtttgttatatgtttgatccatgtcaaaagtttgttgaaccgtgggattaggattgttcagattataagaccagatttctaaatagtatgacaactccgaagaccagattctgaacctcttccattaattgaactatttggttaaataaatcaaactgttctatttgtttctatgattccatctctgtaaacggtcaatgtatatgtgtgagtcttttataattcgaatcttctgctcagatatatgaatttattctcatagattacaagaatctctgaagtctgacatgtgaatttctcataaaatcatcaccgcagaagaagaaattatccaaaacgaaatttgaaggaaaatactaaaaaatcgaaagaaaagaagagagatcagagtttggttaagaattttttcggtcacggttaatctgaaacacggaccaatttgttgatcatcatatctctcgtttcaaacaaaacaatcaaaacagaagaaaatcaaatcgaaaaagatctagttgaaaacgattaagatcatcagagacttaaatactaataatcacaaagattactccatcatattgttgcagtattacctcatcacctgatctcaattttgcattatctatacggaccaatacatcataactcgaaaaccaaagatctaaagaaaactaaactgaagataaaatacgaacttgaacagagaaccctaaactgacttgataagagcttgatgtctgtcaaagtcatgtgtggtttgtatataaaggtccccaatggcggcgattcttaggtttctcgaggaaaaccctaacgcttatgggtcgtatatgagcttcataaggcccattataataaacctcttttgacccataaaaaccccaaaccaatactcaattagcttatatggatgggcttgactgaaaatttacaacttctcatttttggtttgattcaagaaaaaacaaaatattaattttaaaaaaaaatatgtacttggaacaaaataatttgtaagaaaatctacatctatttaaggcttgaagtcattggatcctattttaatggaagacaagatcaaaatttatatcctttttttggggagtagatataaacttttaagcttaatttagcatgttttgtagtaaatccaaaactggataaaatctaatttcaaactcaactaattctgttcattttatctttaaacaagttcaaacacttgaaacaatagcttcatacatacgcaaaagaaacaaacacacaacaaaattgatagaataaaataagtttggtattaaagaagatataatcgtaacaagattcaaaacttaagtaatgacatcgctacaaagatcagctgtttcgttccgacgtcaaggttcttcgggtcgtatttggagtgatcaattcatcttagatcaaaaaaatggagcaattcttcaaaatcatctagaacaaaccggaagaaatagtaatgatcttgaagataaaaatccatcacagaaatcaagttcttcgtcatcttcttcatcaccacctccatacttttctgaaatacgtagaggaccagacatctcatcttctacacgaaacaaactcgcttgtggtttatcatcacttttccgacaatgtatcggttcttcggctcgtgcttaattttgttcaatgcttgacgcaaatctgtacatatattttcttgttatatgaaaaattcatcacaattttttccgaccaaacagagttcttgataaatgggcctattattttaaaaagcccaatagatatttgagtgtccggcccaaattgaagtagaataaaagataagttaccaatttaccagtagttagcagcaaacacacagagaaagtgaaacatcgaagagaccccagaatgcaaaatctctctccgcctttttctccttccttattcgaaaattctcagcgtctttgttgcaaactcctctgaaattctccgtcttcttcattcgttttcgactctgcgttctactacttctcgtctcctatcagtatcatcgcaattcatattcagtctagtgtgttaaaccggagaatttggagtctcgccggaattttcctctgtctatgtatgattgccggtgatcaaagcgcttcttaacgattctgttctcctttgagagatctgagtatctgatttcatctactacatatgttttctcgagagtgatagaaagtaggtctcatacatatttttcctctggagggaattttgatcctctgcttcgttaattaacttgtgatg

SEQ ID NO: 24623 - DNA, 3000 bp, Unknown; identical to SEQ ID NO: 9288
  misc_feature (1)..( 3000): 2750-1469P.txt file - cDNA_ID_2181693; gDNA_ID_1972053; Annot_ID_178366

SEQ ID NO: 24624 - DNA, 3003 bp, Unknown
  misc_feature (1)..( 3003): 2750-1469P.txt file - cDNA_ID_2181722; gDNA_ID_1972049; Annot_ID_178323
aaggtgtttcctgattcttgattcaaaagagagaaataccttgaaggcgattggagaagaagaaggaggaagaggagacattattcttggttcttgaatctgcacgcgagaggcatgaccgttgcttgttggtgtaggcatagatgcgttgtatttgccaggagtgttccttgaatcccaagttccacttaaccatcttcatcaatcatcattcttctgttgtatatatatatgtatatatacatacatctttgtcaataagttctatcattttgttgatgttttattaaatgcatttcgaatatttattatacatactttattccattactttgacttactccatctttaaactaaacctacacttcattgttgttttgactttttacatcaaagtttcctcatttcctgatcccccaagaaactaatcaataaaaatgataaatctttcatttggtcttcagactccacaaattatggaaaatacgttttacatacttattaaattgttaggtttatattttggtagtatttgatacatgtaggttcatcttggctacctactcatcgccgtagcaaaggtatttcaaattatattattagatcaaagagtttagagtaatcaatgagttgatctgaagataatgttatttaattataacaaaatattgttaagcaaatatagagttataaacttgatgtctagatatcatttggtttattcatttccgtatatgatgatagatgagatggagacatgaataacattaaaacgctcagtttaatctttgaagaaacaaaaacataacaaatcgtatccttctttttgattatgcatatcttgtcaaactataaaaatgataccatttgaagcaaataaacaatattataaatgtaatttcaaggaaaatgaaaggggaaacgagtagacaaacgaaatacgttctttcctttatgctttttgttgttacttttttgtatttggcgtgagcggataagtatcgatatctatctaatgaattcatccacgggcttgctgtgtgtgagtatttctgtcttctttttattttttcaatatttatgacttatatgaaatttcggaacaaaacacaaatatttttcatgcagccgttgtgaaaagtcaatcaaaactaaagatatataggttatgtaatggtcttaggactggaattaattgacaattttagttataaactatgtgactatgtgttattgtgttgttgatttgctgacaaccttttttgtttcttaaatgaagaaaaaaagaaaaactaaaaatatagattttattgatagagaaaatagaaattttgatggtgaggttggtttgggatcgattgcttactcctgtacccgaaagcatacaaatcaaatacctaaaccaaaaagacaaattaggtaaagtggacttcgtagtagttaccaactcaaacattccacatttgacaacaattatgagtgaacatttttttttattatatctatgatagatgatggtagaatgatcgattccaaaatatagcactgtagaatgtattgctattgtgtaccacaatggttacatacgatcatcgagacgtcaatgtcatttttctgatccctagctttttggaaatacaataaattatgaataagcttttgttcttatgctgttttactgtctttttaagagactgagattgttatgccctggtctactttacatttatcaattatcaccttgcaatcttttgggtgatgcagagctaagaagaaaatggaaacgctggtacaatataactttggacggtcaacaagcaatggcatttggatgaagatggactgatattgtataatgtatagtatatgaatggctctcaaaatagttgcttaggttttagtatctttgacaaggcccagtttaactttacataggccttcttgggacttggggtttcttgggcctctatcggactctagaaacaagttaaaacatgatttgtatcatcgaacgtacattttgacatcatccaccaattcggccaaccacttccataaatcagctccttgtaatttacaaatgtatcctgctaaattccaagatcttacccactaggtaagggtaataaagtaaaattggcttcacacgtgagtaagtaagttccagttggaagatctaaaaacatgtggaagaatgtgagagataggacagatggaggactttgcttgaaagcaaggaacccacaatcttacagttacagccttttcacattttcttactgtcagttacatttgtctgtactttataatcgttctatttctttctatatttatctctttccaaaacaatttttacattgttttcttaacgcagcttttagcttattttgggtaatggattaataaaatgcagtttcatttgttgtcacacacacaaaagaagtcaaacgcagtttttttttttggcagcttgtcaaacgcagtttctacaattagaattctcttatgtgtcttttaaacgtcaaaatcaaaactaattaaaaacaaaaattgatatcgttcggttaaaatttatgtttggtgaatattactaaattaacacaaacacaaaattctgatttttccttagtttgttttcttttgttaaagttttccttaaattgtttgtttaatctttatgtcaagtttggtaacaatcatctttcaaatattggtactgtaccatataagctggtaccaatgttataacaacaaccgttgtttatgaatacttttgagtatgaaatttaatttcactatagatttacagcagattaacacgtttatttgattacggagtttgtatgtacttcagactattgtggggtaataacataaaaaaaacaaaataagggggcatatttgtgattctacaaactacctatcactaaaccacattaaactctctctctccctctctcttctctaaagagattcgaagaaatttacagagagacaaaaatg

SEQ ID NO: 24625 - DNA, 3003 bp, Unknown
  misc_feature (1)..( 3003): 2750-1469P.txt file - cDNA_ID_2181748; gDNA_ID_1972049; Annot_ID_178329
gtaatatgatgtgaaattatttaggtggaagtgcacagttgtaaatccgattagttaaagactaggatactcggatgatacaattccaaactaaaagcgatactgatcgagatgcttggagttgtatgtgcgacatcgagtaaaatgataaaattctccaaattggccatcataagaacgtgtttgaaacggcgcgcatcataatgaaatgaaaatctaggattcttaagaataatggtcctttttaaaaaagcatcatatatattcactcacatagacaattaactgaagtttgctcaaaaaataataataattgaattcgatgtatattctatgaatctcatttgaaataataataatgagtcatttctactctaaattttcaaagaagagaattcaaccaataaacttcattatattttgaaaaatataattttagcaaatcaaaagataatatatcctgctattattataaggcatgttagaaataaccaaaaaaaaagttaagtggctcaaatgcatattaaacatacacaaaacgatagtacttaatgaatgtgagccatgtaaattagtaaaaaggttagcttgttaataaattaattagtaaaacgcttagtgatctgattttaaaccaaattcaatattagcatatcagtaccgatatggtgatatataattcggattttattagttttaatgaatatatatatatatatatatatatatatatctacgaaaaataagaaaacaataaaaaggaagagcataagacagctgggttcatcagatttctattcttgtcgattcctgctctccgaaacacaaaccttaattaacagctcgaagcaatatcttaatcggatagtgaagacaaatttttatttttttatagagccaacttctgcccattagatttagatctaaccttgtaaacatcaagtacaaggttataagtattgaactaatgttcacttaataaaatctgaaggacaaaatctataaattttagaaattacgcatagacaaatccaagataatttctttataaacttttttgatccctctccgtaattatatagggtggcacgagcacatataatattatgttgggtgaacacaaattgtcacatcatatatagtagttgtatattgaaactaaatttgtgtagacgagatcgatataaataactcaataagcagagcttagataaactgaatagaatatgtgttgccattttatacagaaaatattcaatattcaataattaatgttatactagcgatagaagaagattatttagatacaaaaattcgtattaagaaataaaataaagcaagtaggcgacaacaccgaccactataaccagtgactaggagacgcatgtttggttaattcttgatttcccaactcaaagaagaaagcatatattgtgagacttaccatattgatcttttcaaactctctccacacattttcctattggctcccatgtgggtaattaattaacttttgtactttggagatactcaacctttttagcgtttgtactttttagcttcccacattctatgtgtatttttttggtttctgattttgtttgttgactaatcttgttaaagataataaaattcggcagtgattaaatgtatgtaaccagcccataaaaaaaaaaacatacggctaatgaaagttacaatgacttgatcaaatatggccacatgctcttttctgttggcccagcccaaaatatcgtaaatccacaaccaaattggcctagcgtaaatattttcttagtaacattagttttggaatcaagatccatttgaattagttgacaagcaacataattaaaattcaaaagagctgtcaggtttcatcccacgtaaacgttgacagaccaaccgacgatgtgatttgcacatttcatttacagaattatatgtactttttcatccagaaaattgttttttttttggttaattaaattaaatatctacagacgttacgttatcaatgaataattaaggagtcacttaagatctttaaaatactatcaaatgctataaaacaattagaagataattatgcatcattatttgtagttcttaaatagaatcacctaaaaatgcattcttttgagcagcttcatcagtactagacgcagccgatgatgtggagttgtggacatttgggttcaaagcacgaatccgttggggaatcacggtgaaccacaagagcttgtgcaccagtaggaaagtacttttgtaacctaataaaatatgaacagtaaactctgtcagatctaataaattctctttaatcaatcataacgttttgaccatttactaaaattctgactaccattaatctacgcaaactttttactatttcaaatatatttatttccttcaaaatcagtggtctcagaaatactaaacaaacatttttactaaatcaaaactataggagtaagtaatattgatacatattttaccctttttcttgatattgtttttacgctaaatcaaaactatatgaataagtaatattgattaccttttccttaattttttttatgctaataaaaatcagactttttttggttaatgatagaaataaatcctttggttaaacaacaaattctaatatcgttttgattgccccgcgtctcaagatcaacgacgacgactcagtttcttccttcacaagcgagatagatagagcaaagagcgtgttgtgttgtttcttctctcttcggcgttttcatcgtttctcatctacctcgaaattttctcgtcactctaatcaaaaatctcacttcgttattttctcgggaaaaatttcccgatcactaaacctagtttttagatattttctctcctggattctggatctacacaatctttcttcctcttcttctatgaatctgttcatcgtaatttcagattcttgatatatgattccttttctccaatctcttctcttagctctcagagatg

SEQ ID NO: 24626 - DNA, 3003 bp, Unknown
  misc_feature (1)..( 3003): 2750-1469P.txt file - cDNA_ID_2181828; gDNA_ID_1972110; Annot_ID_178744
tttcatctgcccaaccttctagggttttccttctcttaaagcttatcccttttttttgccttctctcgatatggctggagccgcttcttctgatcgtctcgtcactagcttccctcttctgggtacgttgcttttagctcaaagattaaaacttttttggcatcggaagttatcattttgtgctcatcttataacttgcgattgatttctacccttgggtttagggtttagcgactagtgttatcagtatctgtcgtaggttttctgtttctgataggattgattggtgtctagagttctctacaaacctctttatgggatgctagatgaaattttgtgtttttctgcaagttagtgtttttttatctgcttatgggttgaatttcaccagtaatttgccttgtttagactgtgcaattggagtttgaggctttgtcattttaaaatattaactgggctcttgtatataatcgctgcagatacagcagatttgtttcaggacttgtctttaggttcagatgcaaatgaagttcctatgaactttactaaggtacttaattactacttctttttgaaaatttaaagtttttggaacttaaattgtgttgtgtcgaaggatctttaactacaaactgttctgtggagaggtcttgctgctcatttaatgtgaatttgatatactgtgagttttttttttgttaactgactgttttctgagaagggttcttttcagcatccgtatggtcatgcaccttatggtgcatcttctcatggaagtgaaagaaggccaaacatgaatgctggcaatctgctaaatggtggagactcgattggttcatacccgtggggttacatcccagcaaactatccttctggtggctaccctgatccgaggtttggttatgaccgcaacagcaatcacagttccttttcacatctcatggtatgttggttacttcacatgacctctctgcctcttttctgtcttcatatagtcaagagaatgtgtgttttgttctcttcgtcatctctgctgggacttgggattttttttttgtctaattactggctacaactgttttatttaacagaatccacacagctcacaagaagtaccaagttttgaccaattgggatataatgatcatttgtattccaaccatggattgtatggactttacgggaatgtaattgactctggtcatgcatatggaacttttggttatgattcctggaaacttgggcgaggatggtatcccgttgatggttatagaaagaccagaagcttcaatcatgggcgtggttacagtgatgagaaagcagataggcttaatgagctatgtcgaggaccaaggagtagtgatttcaagaatccacaagttcttaactcttcaatgctagatgcaatgaagcaagacgtttcagcagtagatctccagcgctacaatggggagaatttccctgaatcatttgtgaaagcaaaattctttgtgatcaagtcatacagcgaagatgatgttcataactgtattaagtatggtgcatggtcgagcacaccaactggcaacaagaagttgaatgctgcatattatgaagccaaagaaaactcccaagaatgccctgtgtatcttctgttctcggtcagtatgaggttacttcacgtcttgtgcaatatcctttcagatttacattaagtaactcactgtaatcggttttatctacaggtgaatgcaagtgggcaatttgttggtcttgcggagatggtaggccctgttgatttcaacaagacaatggagtattggcagcaagataaatggattggttgtttccctgtgaagtggcatatcatcaaagacataccaaacagtctcttaagacacattaccctggcgaataacgagaacaagcctgtcactaatagcagagacactcaagaggtccgttgaacttcccctaaaccctttcttggacatgtttgaagcctaattgaattctaataaataatgattatggctgttagtcaggcttttaaactgtacggtgatggttttggtacaggtgaatctggagcatgggaccaagatcataaagatcttcaaggagtatatgagcaagacatgtatacttgatgattacaagttctatgagacaaggcagaagatcatcagagacaagaagatcaagcaaaagaaacaggtacaattccttaaaccctgctgcatctaaagcacattaaccacccctcttgatacagtctctgggattgtttcattttgattgttttgttatattaggcccttgatggagcttcgggggaaacaattaacttgagttgaaagatggaatcaatgcaaggaaagaagaagatgacttaattaaaagaacttagttttgaattatgttttttcttcagggttgggatttctaaaaacctaatacacatctttaatctgtgtgttttctctgcttatctaaacaaaacttacattgtcttttgttcctcttaaggggacgcacatctgataaaacaaaaactcaggctttccttcaaagttcatatcatgttattttcaagttatttctcttttagtccctaaactttcatataataagactctcatccgtaaatgtcaaaaatctcacattttggcccacatcaccataaaagttaaaacgacaccgtttagcacaaaaaccagaaggaatggtgttctctattcgtccctaaactttcatataatacaactttcacccctaaagatttaagatctcaatttttggcccccatccccttaaaatttaaaacgacaccgttgtgaactcccattttaaaacctcgaaagttttctagggcaatctcggccacttttactcacagaaaaccttctctctaaacttcttcgaaaatctcacagagcttcttcttcttcgcttttagggtttttgctctattgtttcgagtgacccaacttcgaagcttatagatcgttaccttagaaaatg

SEQ ID NO: 24627 - DNA, 3000 bp, Unknown; identical to SEQ ID NO: 9386
  misc_feature (1)..( 3000): 2750-1469P.txt file - cDNA_ID_2181832; gDNA_ID_1972110; Annot_ID_178745

SEQ ID NO: 24628 - DNA, 3000 bp, Unknown; identical to SEQ ID NO: 9381
  misc_feature (1)..( 3000): 2750-1469P.txt file - cDNA_ID_2181846; gDNA_ID_1972110; Annot_ID_178749

SEQ ID NO: 24629 - DNA, 3003 bp, Unknown
  misc_feature (1)..( 3003): 2750-1469P.txt file - cDNA_ID_2181850; gDNA_ID_1972110; Annot_ID_178750
cacttccatgttaccgtgattcaacgcgtttaaagaagctaaaagcgtgtcgaaactagcgtcgaagacgttcgtgtagataacgccgttatcgttaacggtgttttggccgtcaaagaaagcgtattcgaaaggaaagtcgctgcttaagtagagactgaggaaaggataaatgttgactgtgaaaggagctttgttctgtgcgaggaagttaacgatttgtgtcatttcttggataatgtcggaacggaatcttccggcggatgggacttgattgtccggaggagaattgtaaacgtcggcgtttaaaggaacggtggctttggtaaaatcaccaactccagcctcgtttaaagcggtttggatgttgaagagtgctgggtacgttaggtttatgaatgatccgttgtacgctgtcaagaacggttcgttccccactgcaacgtatctgcaaaattaaaataaaaaattaaatcatactttagttcctagttttaaaatttccaaataaatttattcttatgatttaatttcgataaataacggttatgatgcatcatacatgtatttttacgtttgtacctatgtaggaaatttcacatagtatggtatgcatctttgcaataaagaggaattgaaaaagaaagattccgacttttttttttgtttcagaatacgtttagatcattagcaataaatacttgacacacacatgacggtccatatttgagtaaagatgaaatatgggatataacatatgacggtccatacatgcgatatgcataaaccaaattcaaataattcactttcagaagtatgtatgtattatattatttaacaaaaatatcaaaacaaaaaaactaatgcatatagagataaatgaaatatgtggtgctcaacaaataacatgtcaagaactgatataataaaagaaaaataaatgattcaactataatagtcgtccaataatagcagttaaagaaaaatattgagttgtcaaacaattcaaaactcaaaaccaaacgtgtaaaggattggagcttacctcagtttgtctaatctagtgggctcaggactattatagacctcctaatccaactattattattgttttcaacattttattttctatcattttgtcatcatttttaatttttttgttcatacaaaataaaataataatacaaattcaaaaataatcaactgaaaataatgttctgtgaaattccaatattccaaaagggtctaatatctgatttccccttttcagatcactacccaatatctaaaaacttaagtagtcctaagaaacttcttaccttatgttaaataacaaaacaatgagtttcaaacttacttgatcttaacgccgttgttaaagttgaatctagagacgtttctttggacccaatctttagctctttgatagtttcccatcgctaggagcagatcattagggatagccaccatcacttcgacgccggagccggcgagagctcccatggtgtttgtgtcggcatcgaacaacttcactttctgtatattgttgtctttaagcatctccaccaccgtcttcggcggtaactgatgactcgccattgttccccagtttactcccaaaccagagacaccgccggagagaaaacatacggcggagatgatgataaagacaacggcagagttagttatagcactctgttttcgtcgataattcatttttcctttgttttcctctgttttttccgggaaaattttgtgcttggtattagaaaaaaagaaatcttggaaaagttttaaagtttgaaagaagaatctgatgggagaagaattggaagaagtgtaagagatatataaatattttttggtgtgttttgtgttctgtttgtttgttgtagctcgatgattcgaataaagaatagaaatgatttgtttaagctgacaaaaatctgagtgaaggaaagaaagaaggaagaggagatcaaataggtaagagagactatagaaggaagaagaaggagaaacagagtcaaaaccggcctttgaaacagaaaccgaccattaaaatatctatagtttttaattaaaaatatataatttggttaacatatacatagactagtattattaacactatgatctataccatgcatttatagtttatttagacctaaccaacatagttggcgaagtgttagctaacataattctattttaagtatatatgaaatttaatcttttgcacaacacttcaagtttttgattctatattgtgtaagtttacacgtacgaatagagaaaccttataattgcaggttaatatcgctttcatagctttagtatgtctaagtagaaaacgttgattatctttttcaagatcgagtacgtacaaagtacaaacgtattttggagaagtaaccctgatggtgcatgtacgtaaattaaattgcaattaaatatcagaaacatccaaatacaatacatgacgatagatattcttgatttgatagcacactaataaaacaccaattaattcatttaaaaaagacatataattagtcccggttggtcgatcgtttcgatataataaaaagctgattatatcaaccagaaaaatcatagaacaaaaatttgaaatttactagttattataaaataaacttttaataaaatatcaatggaattagggagtcgacatgaaaaaaaaaaaaaaaaaaaaaatcccgtacgcggttagatgacattcagtggatatttattatcacaatatgatcatgttgaattttctttaggtcaacatgtcatcaatattactaagctgtgattttcattaatgggccttatctactgagccatcattgggtatttttaacagcactaatgggcccttgtagctgtttcctaaacataccgttaacttccttcgctcgccgaacattgtctctgtcattgagtagcgatcaaagaggcatttcgtcgaacacttggcgagcatagagcgcgatg

SEQ ID NO: 24630 - DNA, 3003 bp, Unknown
  misc_feature (1)..( 3003): 2750-1469P.txt file - cDNA_ID_2182007; gDNA_ID_1972104; Annot_ID_178655
cttctgattttttttttttacataatgagtcttctaattgttacttgttatctcatattttttttcttgctttcatatatatttgatacctaagtttcatacccatatgaaacaaaaccaaacgacccaaaacaagaccaaaaacaaacaagcaagaataagataaagtgaacaagcattgatgaattctcttgtcttattaagacaatgttctgaccggagcttgaagtcggaaacctccgtgtctgaggtcaccttacacatggttaatatataaccggaggtggtcttttccctccttttcctccacctcctccaccaccacctcctcctctcttgttatcaaacccaaattctatgtcccctccgtttcgaccagtgggtttgctcataggaccaggccgcttcatatcgaaaccaaactccacatcacctctttctcttggttcacgctccacaggtctaatctcacggctcttctttgacgatggtttctcatgcttcgaagctttgttgttgtttttgtctttgtgttgctttccaccgcggttgcatagtcttccaaacacacaagccagtgctgccagaacaagaattgcggctagaactatgaatgctgtaccaaacgagccacttgaaccggaggatgaaggcgagaaagaagatgaagtagaagaagaagtagatggatacacttgtggttgctgaaactcttgtggttggtctcccattttattttattttggtatttgatatagatttatgtgaggtatatgctttaggagctctatgatgttgaagactacctcaatttatgccatttccataggaaatgaggccaatgtattaatagtactagcactcactcctttccttgatcattctctgtaataaagtttaagtgagacattgtttttttttttttttttttgaaataaagttacctatagcttacttttgtggaaattatcagtttgttttttgttttctttttctttaataaagaaatatagttgttttttcttttcttttgttatcaacaatgtggctatgtttaagagatgcactttagaggattttctgattgctttgtatgaagagaaagtgggattttggttaagaattttgagatgagacacaatttcattgtttccaagaaagatgaattaaagatttgatgagtgggaagatgctttaccaatcattgactctactctttagattcccatttcccattaatttatacacttttttctctactcttcaatctctaattttcaattccgtagtgcttgaatgtatcttatgtattctatatagtatattgtaataaagttgagctaaatatcaggagaacaaaatgatgagtttgcattttcaaataaaagtaggattatggatccactagtttttgcgaatagtactcattcaccatcaaatcttctttaatggtaagtgttaagtgttaacccttcttgtgagtttcttctaaccgaatctatttactttagttctgtaggtagtcttttagagtggggttccacaagagagaatgtaatcggaatgtatttaacatagggattagtgtaaaacacattttatgttcattctttcacgcaaatattagtttcctcttttctttttcatatttctttcaaactttttgtctccttgaatgtctttttcttcctcagaaaatgttgaagtgttcacatgtcttcttttcaatgccttgcctaatgggatcgacctttagattttgaattttgattctataatatcttggtgagacttcttaaccaattagttttctttagctcgtgcttgagacttatcacttatgtaacgtttttcatatctcttggtttatgttttgtttggttttgatgtttttatgtttcttgtatttctggattttagtttgtttaaaggaaaaaatacttatgcgagattttaaatagtaatttaaaaaaagagaaaaaaaatctcgattagtgcccgcaaacgttagaccgacactgggtctaatgcaaaagaattaaaacatagaagcataatttataacacaaattctagttcatctactcaatcaaaacatccaaactaatggcgttagtgaagtaattacaattttgcgattcttcgcgaattagttgaagaagacgaaagacgagtgcaacttgtagaagcctacaaagtttaaaacccataatttgatggggtcaaaaagtagaacatatcaatgaaattttttcacgccagtgatactcgtgaactttgtatactcattccatttctaccacatttgcactcaatacaatcttttagaatcataataacttcttgagaaaagaacttggtccaagctagtgaaatcaaaaaggtacgttaaaaaaacaaatatcttacaaacgggacgcagttttcacagtaagctaaaaacggcacgcaggtttctaaagagtggcgaggatttcaacgttagcttaatttttccgcgctaagaccagctaaaaaacgacacgtggcaatcgtgttcctcaatggtctctttcgtccaagaccagaaaagagaagaaatgtggccactctagaatccgtcgcatctcgattcaaagctattgataatttcgtcttcttcttccatggaataacgtgtttaggcgtgtatcacatggttctttctttgtgtgacacaaaaccaacataaagcttccatacgatttagacattgtcgatcgctattgtaagatctggtctgggtcctcgattttggtgaggattgtcgggtggaacaaaactctttcttaaaggctctgcagaaattaattctctgctctggctggatctgatagtgattttacagattgttcaggtgctttattgggctgtgtttcttcgttagtaaagctttttgctttcctttagtttagtgaaatcttaaaaatgtttaactttgcggctttacttcaattgccttatacactgtgcaggtcagaaatg

SEQ ID NO: 24631 - DNA, 3000 bp, Unknown; identical to SEQ ID NO: 9357
  misc_feature (1)..( 3000): 2750-1469P.txt file - cDNA_ID_2182011; gDNA_ID_1972104; Annot_ID_178657

SEQ ID NO: 24632 - DNA, 3000 bp, Unknown; identical to SEQ ID NO: 9362
  misc_feature (1)..( 3000): 2750-1469P.txt file - cDNA_ID_2182034; gDNA_ID_1972104; Annot_ID_178665

SEQ ID NO: 24633 - DNA, 3000 bp, Unknown; identical to SEQ ID NO: 9356
  misc_feature (1)..( 3000): 2750-1469P.txt file - cDNA_ID_2182102; gDNA_ID_1972097; Annot_ID_178623

SEQ ID NO: 24634 - DNA, 3000 bp, Unknown; identical to SEQ ID NO: 9350
  misc_feature (1)..( 3000): 2750-1469P.txt file - cDNA_ID_2182114; gDNA_ID_1972097; Annot_ID_178625

SEQ ID NO: 24635 - DNA, 3000 bp, Unknown; identical to SEQ ID NO: 9353
  misc_feature (1)..( 3000): 2750-1469P.txt file - cDNA_ID_2182153; gDNA_ID_1972097; Annot_ID_178636

SEQ ID NO: 24636 - DNA, 3003 bp, Unknown
  misc_feature (1)..( 3003): 2750-1469P.txt file - cDNA_ID_2182177; gDNA_ID_1972097; Annot_ID_178643
aatcccggtacgacaaaatttctggctttaccaatcgtcgaagcagatgaaacaacgaggatcataactcatttaggatacgatgaacagaaggatgtattcaaggtgttatgtacaaggacaaagcccgaaactccacatcttgttttgacggtgggatcgggtaaagaaccttggcgagagatagtatgcaaatttccgcacacagtaattggtgctggagtattttacagaggaactttatactatcttgctgcttttcactcgaaaagtatcataatgaccttcgacgtcaggtctgaaacttttatgcccattacatcacctgatggagtcgatttgaatcaaggttcctggagacttgtcaattacagtcaacaggggggatttgcgttagtgaatgaatcaagaggtttcatttaccaatcgaatggcggcgatgcttatcttgaaacgtgggtttggaatgtcgatacaagaaaatggtcgatgaactccatcctgattcgtaaatggaaagattatgctcaagacaatgaagattatgactaccgtttccgaggaacccaaggaacatacgaacttgtttttgcaccaatcagggttaaagaagacggatcactcactgtcatcttatacaatactgatacacaagcattcagaagatctaaggttcaaatgatgggtgaaggtcatgagtttcgatttgtggacaccttcttggatcatgttgatagtactctgcttatatgaagatcaagagttggtctgtattcattaaactggttggttgctcaagctaaatattctctttaagtactagtactatgcttatttagtgggattgttctttcgtattcgcttctattgtccttgttaatctttatttatgatgttgctaaataataataatgttgcctctcaagtactggtcttattgggattgctagttttcatttctatataatttagttaaactttatttatgctatataataatgttttcattctggtattagttggattggtggtaaatgattgttcagctctttgtagtttgtgcgaaatgatcgttcgtctttcactcagatggaactttcattagagagccttttgatgaaacaaaagttttattaagttttataggtcagcctcagtactcaacccaaaaagttgtaaaatctattaagataacagaggaggaactaagtcaaatcttttggcacaaaagagtactatttacacacttgtatagacatattactcttctgttttacaactagcagtaattcgaccaaaagactgaacaaatgtttcaattccaataaaggactcatctacgactaataccatgcaacatacatatttccttaatcacatccatcataatagtgtcttgctcatgtttctcttcatgttatccttccaaaggttcagaatccacctcttgatgagtgttacttaccggtgaaatatgacctgaaacttttagtgtaaaaaaccataacatgttttgtagctttggtttcagatgtatgagtaagtcctcctcctcagccattccttgtggcttttcttttacgaattcttgattcactgtcttcatttattcggaagagcctcttgactttagtgccgactgcttcttctagctccaactgagtgtactcatccataagtttttctggtgttagattcagacaatgaccaacactcgcacaaccgactttagttatctccattctttcttctgcactgttgttctaagtgttgtgttcaaaaaagtttccatgtaaagttgctgcttgtacttccttctctaaggaacctttcacatcatcatctttgtttgagtgaatctccttccaacattcaactgagttttccaagattgctgtgattaaaatcagaaagaaacacggattagaacaaaattagtttagccataaaactgaaaaagtaactcaaatcaaatgaatacaagtatataccttctatagagctacactctcagatctaggagtgcaaataagagtttctctcttagttttggtagttttctcagcaatagatattgaaacgatattcttaacaaggtaacggccagtagacacgactagctcagcttcagtgctgctcactggtacttgcactgaagcaggtgataagcgcttgacaaaaagtacagagtgtgatgatacttcctctttgtcctccttaactgcagatattaaaactgtgtctcgctcaattttctcttcacgttgtccttccataagttcagaattcaactctttagtgcttattatttgagaaactatcaactggtttttccagtgtagaatccagaacattctcataatcataacagatcctgcacctttggtttctgaggaaataaggtgaatcatcaatcattccttatggcttatccttaatgcactcttgattcattttcttcaactactattggagcctcaaatgaattatgtctcgaagagttccttgtcaatctaacatttagcttcttgaatcttgacattttcaacagaggctccatttcgttcacagtcaatactggaacaacttttctgtgaattactcattgcttccagtattcaaaatgtatatctcagagaaggacaaatcacgtcgcaacgtaataattttttgcaaataatctaaattaatctaagagtcatttttgaggataaaatcgagttactgacatcttgtgtgtctgtccttcataccaaattatccggtcaaaaagccaccacaccggaaaatattattttcttatcatcgccatgttttgatttttccacgtttacaccttttaatctaaaaatcaatatttctggaagaaaaaaaaaaacaaattaaaattgtcacacaaatcacaaactgaaatctcaaaatcgaaactaaagcttctcagatctctaactatagctcaaggcggaggagactgagatcgatcatctgaatcgccgaaacatg

SEQ ID NO: 24637 - DNA, 3000 bp, Unknown; identical to SEQ ID NO: 9392
  misc_feature (1)..( 3000): 2750-1469P.txt file - cDNA_ID_2182186; gDNA_ID_1972112; Annot_ID_178793

SEQ ID NO: 24638 - DNA, 481 bp, Unknown; identical to SEQ ID NO: 9394
  misc_feature (1)..( 481): 2750-1469P.txt file - cDNA_ID_2182260; gDNA_ID_1972113; Annot_ID_178802

SEQ ID NO: 24639 - DNA, 3000 bp, Unknown; identical to SEQ ID NO: 9407
  misc_feature (1)..( 3000): 2750-1469P.txt file - cDNA_ID_2182263; gDNA_ID_1972113; Annot_ID_178803

SEQ ID NO: 24640 - DNA, 3003 bp, Unknown
  misc_feature (1)..( 3003): 2750-1469P.txt file - cDNA_ID_2182279; gDNA_ID_1972113; Annot_ID_178806
ggcaattgataataaatctttgagaggtgtatggtggcaggcagattcttttcgtgtttgacccattagattagattttgtgttcggcgttaccctaaaattctagtatcttactttactttttctgccacaaacactattaaacgacctttgggtcctaaccaaacccacatatttgtttttactgttgtccaaaactaatttctttgaatcttttgttagatataaaacaaactttattagtgtataaatatataatgatagaacatttacgaaaaaataatgtgatgtaattgcagcgattatactagagataaatcatagaagattttttgttcaaaaaaaagtatgtagaacatttaagaaacaatatattagtaattaattgcagggatattgcaaacctttattattattaaatatttgggaaatttgagatttgattatttcattccacaattacgtggattaaaaatcataactttattttagtataagagactagaatttattctataatataatataccgtagatatataaaatttcacacaactctaactaaatcaaccaattcgacataaataataaatttggtaactgtaacaaagaggcatgagggtcgtgtgatgagatgggcaatgggagaagagtttgttttcatatcggtccatttgtcatctttgttggtgtcttaggattcaagactcatatgccttatatgtggaacttatacaaacacggtgtccccgcctcgacattgaatagcaagaattttatgcttcacaaagaatcaactaatatagtggaagcgacacacacagaagccaaaaaagacgacaaatgcaattaagatcaccattgaagacattaacaacaagcttgatcaattttgcagctgagaaaaatgaaaaaaaattgcaaccgacaagaatgagaagacttcatagaagactagtttcaaatcctaatatatgttttagacaagttgttttgatttgattgacttattttttatttgttaattttattagaattttggacctaaatattattggagcatcaatttgatttttagattaaaaaattaataataaataataaaaatgtattcataatatttacaaagtttaaaatatatcgataataataataacagtttttagaagttaggttttaactttcacccaaggaaacatttataaaaatataagtaacattataaaacactaatgaaaactacatttacgaatttgggaataaagcgagtgatgggtcaggtacaaaaaatagaattaatactgatatttgacacttacttgcagataagaaaattataatactttttatcttcattcgatactaaggtttcaaatatttttttgagacgtgtacgagtcggataacagatcaaatttggataacaaatatgcctaatcttaacttataattatatgtaataatttatctaaagatattgttttataaactgtaattcaaaagtgttaatattgattagaaaaccctttcacaaaaccaaaaaaagtgttaatattgattatcacttcgaatttgagaaagattgaatatttagtaaggaacgagatacagtttgttggctaataatgggcttggagccgtgggctattcacaagctcgggcctggctttttagatgtccagattaattaatatacaaaataatcccaagacaaacactactatggtcgtactcggtgaattcgtcatgtattatgttagacgaaagaaatatgatcatagaaatgatttcgattagcatcataatggaagtccaaaatcgtatatgatgaaaagagaaagatgatcgttgtaataaagcatgcaaaaggataatttaacataaagatcatggaaggagttaaattttgtcaacaattggaacattttcatttatgttctttcactaaaaccaaacgtaggtcatcctcactcatcacgttaaaaactgtggtagacaaatcaattcataaacatgtgagataagtaattgagcaccgttttgttatatggttccatatggtgtctataaaacatagccactaagtaatcaaccagatacaaacaaacgaatttatttcaaataattcacaattattaacaatttcaattaaaaatttgtaaatgataacatggtattcgattcgatcataagcattatttgagttaaacaatcatatgctcttaaatgttaaacttttttcaagtaaacttaagatatcccccgccggtgattcaaataagaaaatcaccgtacattcaaaaagagtgtatagctgttgtaatgactaatttagtgattaaaaagataatatggttatttaggaacagacaaacggcacgcgtggcgatgcttcaacggtggtctgaataaaacacatgggttagtgggtccccactccacagcctgtgttcaccttttgcttaaactatcttctaaatcaagtttgtgtttgtagttttgacacaaacaagttattcatgttttgttaataacattaactagatctagttaattaagactactattttgatttgaaagcaatcatactagtagttaattaagactagatctagttaatttagccatccaatcccgcaaaatttgtccaaatagtctcatttacattcatttttgtatgattgcattaaatgacttagtaaaatggcacacaattaactgtttatttggaaacaaaatataggcaattaacacttttctctgactaattgacattgacccttaattttatactccaaatattatctctcactaactccttcctatttagacaacaccttacacgcaaacaaaaaaattaacacaaacttataaatagcgtttcccatctcacttctattcaaagatcgcatcaccaatcgcagtcaaaagaaacgcaaacgcgatctctctctcttaaaaactctgattcattctctcccgcagcagcttttcctaatcgatg

SEQ ID NO: 24641 - DNA, 3000 bp, Unknown; identical to SEQ ID NO: 9406
  misc_feature (1)..( 3000): 2750-1469P.txt file - cDNA_ID_2182283; gDNA_ID_1972113; Annot_ID_178807

SEQ ID NO: 24642 - DNA, 3003 bp, Unknown
  misc_feature (1)..( 3003): 2750-1469P.txt file - cDNA_ID_2182291; gDNA_ID_1972113; Annot_ID_178809
ttgaagttattgttcatgaagcttatggttcgcagattcttcattggaaccaatgggtcgaggtttagtttcccggtcaaacccattccctcaagttgtaatccccaaacgtaattgctacaaagaacaccaaaccaatttgctgtatttccttgacatggtgatgataatggatcccaactacgaaattctgaaccatttgctaatgtatctttgaatcgcaagagacaatctgcatctgaatccggcacaaccacctgagacattgccaccggacataacacgctgataaagatgatgatgaaaatgcaagaaggtagattcttcttcaaggccgtgttacacgcaagcgtaaacgggtcctcccaattgcgcattgcggttacacgcgcaatggaatcgatttgattgatgtgaaatctcttgttttcttctttttcttttttgtctttcgtgatcgccaagaaattgtgtgaacggaagagagaaaaacaaaacctaccaagaatagacaaagcaaagtatttaaatttgcaaaattgtgattatttttttttggatttgtggcatcttaagattattattaggtgagagagttctttggataaccattcaattatcttgttttaactttttaagttatatatacatgtaatcgttgttgtactgatttgtcatttgctttagttccaaccaaatttatttttctctctatatgagaattattttggtataactgattttaagaatcaggcataactggtggattgttctatatgatgatgataatatctgaaccaattaaacaagtaatgtgatataactcggtagagttttagagatttctgttttatcaccagttacccgttaaaaacaaacaaacaacatgttttataaattaatcgacaaatatggtcagtcaaactaggagtaaaacttagtagtctcttaattttcttttcaaaattctagtaatgaaattataaaggatgactttgttattcctaaattatgtgactgcgcacgattaagagttgttattttcggacagtgttactcgaggaaagacataaaaaagacaaaagacataaacaatgataaaattaaactttatggggagaaaatcaaatgtaaaaaaatgaagaaaaagaaaatggaaggtcaaaaagttgaatgctgaaattgttcttctgaaagaacgcggaattgggttaaagagctttaaagtgttggtgggccgacacgattggtcggcatgaaatcttaaggtgtgaacctttcaagtacacatttctgctgcttatgcagtgtccatactccaatttcggttcgtactggaaaacatactaaagtggatgtatatttgataacagtttttgtttttgtttttgaatactagtattatataaaagagatttttcctagtctactaatgtttcaatccaatccattgtagttatcaaactagttatttatgggtattcaaagctgataatatggtactgcggggtagtagtataatactaaataattacttacgaaattaataatgaaatgagtaattatagaatgaatgcatataattaagtgtttttttttcacaaaagaaagacgcctgaatttaataataaagtgtattaaatattaattcacatttgtcgtaaatacgtggattgtaaaagtgtatcaatcgtatgtatgtaccactggttaaacaaatgtatgatgcatcaatagtcaaactaaaaaactcgctgatctttgaacacgaagttgaaaaaaaagtcgaaaaaatctcactgatgtatgtaaaaagaaaatatgttggtaaataaaagaaaaaatgggaggataaaaaggcagggaataatcacaaacttttaggcctaaaaatgataagtgttggaccaacccatggcttgcacgtttggtctcatctcgttacttttgttttcgatctcatcgatgtctgcgtctgtgcggaccattttacccttgccttttattacttcactaaaagatgaacacacgaattatttagacatgcggcacacaattttattacggttaagtttacagttttaaggcgaaaatatatcgttatgctttatgctacattaattatgtatagtagtactccctacccaaaacaaagttacgtatagtactttgattggccatcgaggactcaaggtttactaaatagaaagtaaaacaaagagatgtttattgcattcgtcgtccacacatagaataatcaatcatcatcatgatttgttttacattcttaagttctcgtaattattcgtttcgtacgtttttttaattttattccaaagaatttaacattaatattttgaagaaccatgtgctactagcctactattatactcaattgacaacaacccattttattttgcttttgctcgtgtttcattcatttcgaacgattggatttacataaaatagtctatacacaaagacaaaacaaaatcgctttttttttttttttttttttcattttgtatactattattgtggaaaacgcaacatttatatatcatactattgatcttgcatggttccatgaattttctaggtaaaaaaagtgtgttaatagaacaaacaaaactgttaaaacatgttgaattacttaatgcaatttgactctggtaaaacatggtcagccacgacatttcaactactctcattaactcccaaatgtttcatcatttaatatatgaaaatcattatataatactcgtatgattcaattactcagataatagtgatgtaatgcatgacacttgtttttggaattttattttatttccagttatatattacagttgtttactcgtcagactaatattgactgttattagaaataaaggtacttaattcttattctttacgcgctacaaaataagcaacaatggcaaaaccgtaaaaatgagtagtcaaaggggtatttggttttagaaagagatgaggataaaaatg

SEQ ID NO: 24643 - DNA, 3000 bp, Unknown; identical to SEQ ID NO: 9401
  misc_feature (1)..( 3000): 2750-1469P.txt file - cDNA_ID_2182327; gDNA_ID_1972113; Annot_ID_178821

SEQ ID NO: 24644 - DNA, 3003 bp, Unknown
  misc_feature (1)..( 3003): 2750-1469P.txt file - cDNA_ID_2182335; gDNA_ID_1972113; Annot_ID_178825
tttattttaaaattaataataagaaaacagaagagatttttttttcattttttctgatcaaaatacacaaaataatttgtttggttgttaatttttttgttgtcataatgttaggcctgggatttcggcattaaccgtttaaaccgaaccggacaaaccgaggatttcggttttcggttccgaaccgatttactgttataacccgatcggtggaattttaaattgatttcggttttcggatttttcggttcggttcatcaaaaccgatcggtttattcggttaaaaggggataccttataaaaaatagaaaccctagatctaccacttcatattttttgtttcctcctcacgaacctttctttgtcctcttctctaaccttttttatagtttttatcttcttcaatcttcttcttcttcattcttcttccttcttctccttgtgttccttcttcttctccaccattttctttcgtaggataccttctatcaagccgccacgacattaattctctccggcatcgactttagcggcagcaatttatttcatggatttctacatttcttctcgacaccgcgtcgcacagatccatcttctctgttacgttgttgttcttctttacacatcttctctgttacgttgttgttcttcttcacacatcaccgttgttttccttcacttcacagatccatcttcactttactccatccgtattaccgtcaccttaaaaaagtgaacaccgaaaacctagatctgggtggtggacttgagttgatctcaggggaaaaaaacatttgggcttttaaaatctaaaaacatatttaggatttgaataacttaagcccattatgcacaaaagttaagcccagaatgcataaattgacccacaacgatttggttaaccgattaaaaccgagaaaaaaaatattcggtgcaatttcggtgaataataaatcttattaaccgaaccgaaaaacccgagtaccgaaccgaaccgaaccgaacttttattctgttcaattcggcagaattttgtgtagccgaacaaaccggaaaaccgattaaaccgaaccgtttaacccgatttaaccgatctcccaggcctacataatgtagttaacttacgcttctttatcaacctaattatcttgaacatggccaataatagaaacaaaatgattaaacatatgacaaaaataaaattcataaaagagagaatttaaagttttgtcaataattggttccactctaaatattaacgatgtttttttttgtatggttaccaaacaatattgttttgcatttctaccctctatttgtataatattaccgtcgtgaccggtcgtctatatcttttactttaatcgcactttatttcaaggtcagttacaaataggagatcaccaaacgtaactaaatttaaattccaatcatttttaagaataaaataaagtagaaaagagtaatacaactagtttgacctttgaccgttcgatttattaagactctgctttgaattaaatttcaacggcgtgctctttttgccgttgggaatctctctctcatcacccaaacattaaataattagaagaattcttttaaccatcggaataatttaattagcaataataaaaccagtccatgatctaattattgataatgactcgtggctaaatctagtccaataaaccctactgtataggggttcaattgtaatattcacctttgttttgctcctttttgtaccatgccctacatttttagccaacttggcaatattatgtgcatttttttcacattggcattattattttctgccagccattattgcaatttttattatgtaacttaaattaatttatttcacataaaaacatcttaagtttaaccgttttatgaacagtatataaagaataaatgcaaacggtaaaaatctgaagtatataaattataaaccgttggaacatatatacttagacaaaaaaaatatacaagattactataaacgaaaaaaatttctataaattttttatttttagaaaatttaaatggaagattctatagttgttaaaaagtttgtaaatatatgagattattaaatactaaatagtattcgaatgtcctttggtgtatgaatgtggcgaacagcagcataaaagctggcaattttaattttacattatagttttttttttttaatatcaattttgtttgtttttaaaggaaaagaaatgtttaaattgttgggaaattaaaatatctacaaatggtgagggacaaatagcgtcagagcccatgaaaacgcacgttgcaatttaagaagaagaagcaataaccaaaaaaaaaaagttgaagaagaaaaaaaaatgaaaatgaaaaaattcgttcttccccagtttgacagctcgctgccactcaacagtaggacccataggtttcataatatttacaagtttgaccctagtaggggtctacttcgtcctccacctctataaccctagaggttctccgcgttttggtctctctctcagattgtggtcacgtgacttgacacgtcacctgcttacccttcgctgacgcaacgcctctctctttgcctttccagtttccaccattacaacgttttttctttttctcatcttatttaatttcgcatttaagtttatgattgattgcatttaattttaatcaaatttttatccacggtgttgaatagttacagatttgagctacatttatatttaaacacccgacttgtattgtctgatgtatataaaactcaagataagaataacaaacaatttacaaatgaatgaaaaacttgacgggccttatattatatttcctcttttggaaccacgatttataaggcccagatatttatttattaggcccagatataaagcccaactaagttatcccgttcaaattcttacacgtcatcatcgtctacgataaaactgcaaaaggagatgaggtgagtgaggggagggagagagaatg

SEQ ID NO: 24645 - DNA, 1534 bp, Unknown; identical to SEQ ID NO: 9397
  misc_feature (1)..( 1534): 2750-1469P.txt file - cDNA_ID_2182351; gDNA_ID_1972113; Annot_ID_178829

SEQ ID NO: 24646 - DNA, 3000 bp, Unknown
  misc_feature (1)..( 3000): 2750-1469P.txt file - cDNA_ID_2182382; gDNA_ID_1972118; Annot_ID_178854
acaaaactaatgtcgcggcatgtagccaccgtttcgcccttaccaacttcgtatgtaataaattgctttaggtacgttcagttcactgatcagtataaacttattaaccaatcagattcataatcaaattttaaccaagatggtcttcgtattttcttaaaaacaaaggcagaacataatgcacacgtcacatgtgtattgtatgtataatttatgatttatgtttatatgtgtatatatactaaactttttttttttttatatactaaactttggctagctttaggggcaaagtgactaaaattaaaacgtgtgttatgtattgtagtctttatattgaaggtcaataacatcaccttgacattttctaataacattaggcttcgtgatttgttcgtatggggtaaaaaggtccactttgtacgtatcacgtaacctccagttgattttagtattacggcttggttagatttttagaatgttatgtatgcaactttctcattttggtcggttttgttggaattcttgcatatgtatttttgttgaatatgtagcatcgaaatggaacacagttggaaataaggtatgaatggtacatttttcttattgatggtgtgaaataaatgagacataccaactttagtacggttaccgcaaaaatgtacctattttgtttacttcaaaaatgatgttccgctccaaatagttgtactactattttgtgaattttcaataatgtgatttttttgataaaacaataatgtgattttgataaacggtattaacatttccgaagggtaattaatatgagtgaaatagttattgtattatttcaaccgcaaagactaatcatttttgaaaccatataatatttgcttgcatatatttttctacaaaagcatagatgcatgaaatgtaaccaagacaaacgaaacatgggttatggtcaagaagatgactatgcgtactacttacatacacatttgtccatttcgtcatcgacgacatttacgtcccaccctcctgctttaagcaacttcctacgtttttttcttccttttttttgtaatttttttttgtacttcatattcttttattttgaatttaatttatatataatattgtgggatccaaactatatttaggagataggaaacatttgggtataagtgatctcgacacatttcacaaatggctaagaccatacgcttaatagcttattgtcttcgtatgttgtccacaaagtttgtatagcaatgtagcgttaaaaatattatcgttttgtggaagcattttaactttaatagttagccagatgaccagatcactagaagatattacctagatctaaggttaaactcaaacaatgaagattacctgagttcaatatttctggaatgttttttttttttgccggtatttctggaaggttacatcatggtataatgtattatggattggattatccatatgtggatgaaatgcttcttttgtgatatgtatatatatatggttatatttttcaaattgtaattcgaattttgaagagatttatatttttaaaagtatcaagaatcccgagccagtaattttaatgggctaccacatagggaaatgattttgatttgttttcaatacgcagcaagaaatcagaaagatatcaaaaagtaagaggacaaactggaaagaagcagaagcataggggcatgtgtaatgcattatcattacaaaaaattcttttcagaaattgcgtgtaagtattagagaagaacaaaaagaaaaggaatgaattggaaatggacgaaaatgcaaaaaggaaattaggggaatgaagtcaaaaggttggttcaaatacgtacgaaggaccattaatatgactttctaataatcagaaagtaaataattacataacacgaaatcccagaaacaagattttttttaaaacaaggaaactaaaaaaagaatggaatgatgatcctaaggtcaaagcttagcagttgggctatttttcatttttcttatttttatttattttaatttggtctaaataacctatgatgaaaaaagtgtgacgcctagaggaaacttcttcatttgggtaaatcccaaatcccaataaggtaattcttgtaagcaattaggattggacaaaacaaaccaaaagcaaatatgagattcttctacaaagtagtccatatcttaatacaaatttggtgctggatgatattttagtggctgtcgagattaagtaaagatgatagataatcataaagtttcacatatttatatgtaatttttaaagcatacaactttcatctgatttttgtaaagataaacggtgattaattaatgaaataatgcttcaatattttaacctctttattgtttctctttctctggttaatgacgtttcttcgacgggagtggtccatgtattatggataccaaccaaaactcgaaaagattcttgtagagctattttctactaatgcatggaaagtcaaatggatgataaatttgtgttgaatatattttattctgttaggtcaaaaacacatgtcacctcaaactatataaaagtataacaacattccagctggttactaattataaaataattaaaatattatcatctttcttctttctcgtccaagaattacttatgttatcacatcacacaattaatttcttgagttaagatttttctttagcttctctaatatatacacacactgacatacatatacacacacatataagcacgagttcttccaaaaagagacaaaggagaataaatagtaggggaaaagaaacatttatcctctataaaaacagaaaccttttgtccttttatatctttaaccttcactcacaaaatcacaatcctcccttagtgttcttcttcttcaacatctttcttcctctacagaaggcaaaaaaaaaaaacgttttctttttctttcaagaaatcaagatcaaaagaattagggttttcgaatg

SEQ ID NO: 24647 - DNA, 3000 bp, Unknown; identical to SEQ ID NO: 9414
  misc_feature (1)..( 3000): 2750-1469P.txt file - cDNA_ID_2182394; gDNA_ID_1972118; Annot_ID_178857

SEQ ID NO: 24648 - DNA, 3003 bp, Unknown
  misc_feature (1)..( 3003): 2750-1469P.txt file - cDNA_ID_2182405; gDNA_ID_1972118; Annot_ID_178861
gcaggtgagacctacttctttattattatcacccatatttttttgaggcatatttattatttaatactattaacatataaatgatcaatacattagtgctgttttaatataaatagtaagttaattgaataatctttgtgaataattttcttatatttaaacagacgaatctccaaattcttccatcaatatatgttctgaagaaaaatcctcaatttcgtcgagaaactctttcgaaccatcctcgtccacgtcaagtaagcatattgtattttcttccgaagtagtgaattatatgggactttttcgtttttgtttatgcgtaattgtccacagtagctataattaaacaaatcaatcatgaaatttcacttttattcatttgcgttttgcgtttataaaatatttaatattaataaaattatgtgtttctaatcacatgcaaagcattttaaacacaaagtccgatcccgaataaacactgacgtaacacttgtgcattacagaaaagaatgactatgacgagaagaagagggtggtgtatccatttggagtggtaaaaccaggtggtcgagaagaagatataactctaaatgacattaataagaggattttaatgccatcggctaggccggttcgacatccggttggagactttgcatgtcgtccgtgtgtctctgcagatggaccgggtctatcaggcaaagccgtggttgcattcacgaagatacaaacattagggaggggcacaattactattataagaactaagggatgatatatcatatatgtaattaatattggctattagaggggggtcgttataatatgtactggagatgtttcaaaaagactaatcattggttgacatgttcaaacctattgttgtatataatgagaaatggtgtatattagtatacatgcttttccattttcttagaaatcttccttctaattatttagaaacctcttaaaaaagaatcaagataatagatatcttagaaacttactaaacaaattttcttaagaaatcaagattttgtatgtattgacaaaaaaaaaaagttctcttctttttttcgtttgatatattatgttttttgcatgttcgtgctttttgttctttaccctttttcccctagccaacccttttgttctttagtaaaagaaaaattcagtagacaccaaataaataaacgaagcgtgaagaagaataaataacaaagaaattaaagcaaaagagaagaatatgctgaaaagcaagaacaaacaaaagagaaagagagagtatttataagtaccttatcaggaaattctcaaagatggttatatgattttaggcaacaagctttcttatctatatgttcgaaatacttaaatgattattaattattaccatatagtcaatattcttaatgtatcatatcgaaaaatctaaagtggattttacttttaaaatttgaattgaaagaataaacaagtctataattagtaattttaaaattaccaagcttctactacaatttttgaattataacaagtacaatgaatcattttgtttcagcaaatttaaatttcgaattagaacaagtattgtctccaaattttattttatactaaaccaccaatgtataattagtttaaattaaatgaaactaaaatataatataatacctattttgtaagatcaatgtcattatgggcccgatggtaagcccaggtcgatttgcacacagtcaaatacatgacgtcatataacatatatgacgtttgtcagcattttctggtccgggacaaaagatcagcaatcactcgtactgtagtcagtactagtaatgtaatgctcaagtgtttagcatgtgggaaaaataaaacacattttcaggtggttagtgacgtggattggttaataattaacaatcgctagtgctctcttttttaaagatttcttgaaattaaatggaacaccttttttgtcaatcaaatggaacacctaactactaatttaccggtcctttccattatttttcatctccaaacgaccaagatcaacgtagcttttgaccttagtgggttgggtccatgttggtagaccatggttaaaaacttaaaattaagtaattaacaaagctgaataaacaacaatattttgaatttttttctttcctcattttttaaaatattgtttttgggggtgagaatagagtgtttttttctttaattaaatagatgaaatacaaaatcaaacatgtaaaactccataatattatgtaactttgacttgtaaataacatccaaatttgataaaacctaatttaaaatcaagtatttatcaaatttcagttcaagataaaatattgaattaacaccagatttaagccaacaattcaaaattttaacctaaaaacttacataatctttttttttccaaataaatttagattaaatatagtatgaatttaggatttttaaaaaaatattatgctattataataaaatatatctttctaatttatattcatgcatttgattccttatctgtatcaaccatatacaatcaaatataagtctctgttgttaacagaaaaaagaaaaagaaatgatttttttataaattaatataatgatgcagatcgttgacgaatcgaaaatagtcggtttaggcgtctagcaacttatatggaacaactttttaagcccaagtgaaaaagcccaataacaaacttgaatacagagtatatatatattctagggtgcggtttcttccctcgaagatcgatttccattgaatccgtcttgtacgcttttagatcacgatttgctccgtccctctcttcttctccacgtcacggcgattctcgcggcggtgctattccttatcggttgagatacggtatgtttcttaggtcaattatgctcaattttgattttcccaatgtcatcagaatctgatgctaatgtgttttttttttttgctcgctgcagaaaatgttcaattcgatg

SEQ ID NO: 24649 - DNA, 3000 bp, Unknown; identical to SEQ ID NO: 9419
  misc_feature (1)..( 3000): 2750-1469P.txt file - cDNA_ID_2182439; gDNA_ID_1972119; Annot_ID_178875

SEQ ID NO: 24650 - DNA, 3000 bp, Unknown; identical to SEQ ID NO: 9428
  misc_feature (1)..( 3000): 2750-1469P.txt file - cDNA_ID_2182451; gDNA_ID_1972119; Annot_ID_178879

SEQ ID NO: 24651 - DNA, 3000 bp, Unknown; identical to SEQ ID NO: 9421
  misc_feature (1)..( 3000): 2750-1469P.txt file - cDNA_ID_2182459; gDNA_ID_1972119; Annot_ID_178882

SEQ ID NO: 24652 - DNA, 3003 bp, Unknown
  misc_feature (1)..( 3003): 2750-1469P.txt file - cDNA_ID_2182483; gDNA_ID_1972119; Annot_ID_178889
tatatgaaaaatggaggaagccatgccatgaaagaacgtcgatgcattcaaaatgagatttgaaattcctaattaaagttaagaccagttgtattagtgttatgcagagtagtatattattctacttggattaattcacagtaaagaagagatatacataattcaaaggcttattgttatttcaaagcaaaacatgaagaggtcacccagttaagaagagatacataataaattcagaggcttataacatgaaaaggtattcgacaatagatgaaatgaaaagagaagacaaagagtacataagaaagcgcgcacacacagacacagacacagaccaaattaatagttaatcattcacttgggagggcgagtagcgtgaactatcccgttttcctttaacagcttagtctccaacttcacgagagacacgaaagcaggccaattctcggtacgattgtgcatttggtcgcagtttgggtctactttcttcaagtaggagtgagcagcagctatgccgatagtgttaccaatgatatccacaaagagtgcaacctcagaggtagagaaactcatctcctttctatgcatccacataaagatctaacaacaaccaaaaaaacaaactttcataaatcctaacacaatgatctctaactagaaaagaaatagagcgatgaatacaaaagttagatagatgagaaagatacctggagagcatctacatgtttgccttccatgtaagctgctttgccgagctgacgagatccgcctgggtgacgggaacacccttcttctcttcctccgcgatgatgaattctaaggtctctcgggtaagagacctcagcttcttgaaaataccactctttgcattctcagcatcacaagaggaagcagaagaagaagctccgttgatctgcctgttccctttgttctcagcagaagaagaaaacggagccgttctcgcgatcttaatctcagcagaagaagaagaaaacggagccattgttctcgtaagcgtagagatcttcatctctcttttccatagatgaagagaacctgatgataccattcggcgcaaggccaacattttccaaaccctaattttgataaccctaattctctaatatataaaacaatcaagttgccttgttaaaatcaggatatgatctctcttatattagtaggttacttacacaattacctacatctttgtcgatttgtcagtttgacttatgaatcagtctactagattgtaaaaataaataaaacgatgaaatgtctataatacccctaactctacacacgtgtgaactttttgaatagtactggacccgggtcaaccacacacagtagacacgagccttcttcttcttctctaagcgagtgaagtaagcttaccagtggcagtgagtgagctcttaccagtgtttagggtcttctgcaattttccttgttttgatcgggagcttgatcaagactactgatgctgagatttacgaaaattgccaacggtctctatgttcccggtgacagtgaagctctttacgcttccaagtttcaagactccactgctactttgacttcgcctatctcgctggtacaaggtctgtggaggttacagtatgggtgataaccttttccttctgcgaggaaagcattgtctcggcttttacttttgttcataacttgtggatattggatagtaaagcctaccactaatggcataacattcaggatgcttcttggtgtgctatgatttgttataagcgaatcactctcgttggctaaacactttgagaaaatgactcttaaaatgctctcttgggctatactggaaacttgctgtgttcagtggatcttcaggtccttgttgacaaccattaacaagcttaaggtaagaataaagaaaccaacaatactttcagtcctttgatgatttataattccataacagactaagggcagtgcatatagatatctttcgtactcatctgctttttctggtctccatcacaaaagccaactaggtaatcatatcaatctctctttaccgtttactcgaccttttccaatcaggtgcttctggtgtgtctactactatcagttttaggtctttgtatacctgatcttatctgctactgaggcttgtaaaagtgattaaaactgtgacatttactctaagagaagtaacctgtttgatgcatttccctaatataccggtgtggaaaagtgtaggtatctgtactcagctgaaatggtggacgattttgaagaagatgaactctcattgactgaaagcgggttgaagagtgaagatggcgttattatcgagatgaatgtctcctggatgcttttattatcatgtttgggaatttaccaagggagaggtatcagaatctatcttagaaggttacatttagctcaagcttgcatcaacatctttacttagagctctacgggttttagtgtgtttgaagtttcttaactcctagtataattagaatcttctgcagcagactttagagttttgggatgtagagctaaccagagtcggtttgtttaaactagaatctttttatgtagcagacttgttcagtacctgaataccagttttaaattaccgtcagatgttgatcttgttggtaataatggagaaacggaagaataattagacgaaacaaactctttaagaacgtatctttcagttttccatcacaaattttcttacaagctacaaaaatcgaactatatataactgaaccgaatttaaaccggagggagggtttgactttggtcaatcacatttccaatgataccgtcgtttggtttggggaagcctcgtcgtacaaatacgacgtcgtttaaggaaagccctccttaaccccagttataagctcaaagttgtacttgacctttttaaagaagcacgaaacgaaaaaccctaaaattcccaagcagagaaagagagacagagcaagtacagatttcaactagctcaagatg

SEQ ID NO: 24653 - DNA, 3000 bp, Unknown; identical to SEQ ID NO: 9425
  misc_feature (1)..( 3000): 2750-1469P.txt file - cDNA_ID_2182487; gDNA_ID_1972119; Annot_ID_178890

SEQ ID NO: 24654 - DNA, 969 bp, Unknown; identical to SEQ ID NO: 458
  misc_feature (1)..( 969): 2750-1469P.txt file - cDNA_ID_2182487; gDNA_ID_1591154; Annot_ID_150595

SEQ ID NO: 24655 - DNA, 3003 bp, Unknown
  misc_feature (1)..( 3003): 2750-1469P.txt file - cDNA_ID_2182510; gDNA_ID_1972119; Annot_ID_178901
atgataaaagtagtgttttaatcattgaaaattcaactaaattgagaaaagtgcatctagaatttttattttctttcttactttagtggacatatccctttggaaattgaatactataaaagaatgaccctagtggcccggacaataacaaagttagaaaacaagaaaattataattaatttacacttgtagatcgtatactataatttacactagcagacagtcacaaacgtcgaggacaataaactatcactaaaaactaaaaagtaaataaaattaaggagaaaacaaaaataaaataaaatattctgcatatttttatcaataatagcaaatcacacagtacgagtcaaatggatcagacaagtgatctcaaactcgggaagaaaatttagcaaaaaaaaaaactcgggaagaaaaattgataggagacaaatataactaaaataaaataaagacaaatcaaaattttaaagtattttctttaacatttacaaaaataatcgaagtttaaggattttatagtttctatcatatgtagacgcacaagtgaaagaaaaaaaaaaaaaaaaaaaacgcacaagtggtatcatccattgttcttcgcaatcgaatctccaatattttatttttattgtttcttaattcttaaaaatgggtcgggttccgggccgactccatctactccaaaaccacatgttaaaaccgtgccaccactcagagctattgtagatctcttttaactttttcataacacttgtagaaaaataggaaacgaatctggtttaaaatgttttttttttttggataaatcttctttatatgttatttaaggttaattacaaaataagaataaaacttttcgttgtatttagaaaaactgagtagacatggctatataactagttatcgtcatctgaccattttttttttttggctaattattatgtaacaaataacaatataggaagttcttacttaacgatcaatatggctaaaagataattgaataagctaaagtcgttggttgatctgatgaaatggttatttcctataaattctattgttacgaaaacgttttagaaagaagaaccgtttaaaagttatcaatcaataaagcaattaatcgaaacagttaaagaagacgattagagaaagtgactgaaagcactgcaagatggcaaatctagacaacgttctttatcatattttttttttttggattaaatatgttgaattggtgaaaaaatgcacatgtttttatcagtcatcgttttccgcgcatctctaacattttcttcattggtttttttaacagaaaataaaataaataaagccaattccgtgtactacatataagaccacatcttttaccaagccaccactccaacccattgcatgtctctttaacctttagttaacattcttactatagaaaatttcgaactgattaagtcacagaaagtttcaaaatgattatacttaatcagttttaatttcattttaagttaataatatatatattacgataaggataaggtttaaaaaaaaaaaacagagtaggtatagataaatcagataatgactgataccacttgttatttttcattgtagctatagtcaaacgatatatttttgtgttacttttttgttgtcagttatctttactggctaattattacgatgtaagtaaaaataggtatagccgagttcatacttataagtcaatatttctaaaagatagtttgaaaagatcgatgagctaaattctttagtttaactgtttaataaaaagtcattggttggttgcgttcaatgtaatggttatttctttcgaaatcaatttttggtttattcagaaagcatatgtaacgtatatattttataaaagacattacgtgaatatttttataaaacaaaaagccattattaagatgatattacgttacttatttaattcaaacgtgaaaagtacaaacttttttaccgcgtgtttattgtcaatttttgccacataatttagctatctagcaaatttatatatatatttttttttatcaccatcaccaaatattaatggtggtattttttaataataattgatatacatctttggtggttgtcagagatgaaaaacgccagtgatagaaatctatagttgtcgtcgttagtgtgtcgagcgtcaatggatcggatcagatgtaatgaatttcaaacaactgaataagatagctagcactttatattttagaaaacaaaatagtttaggtgtagactcttttttttatattaaaaattgttttgccactgacttaatagaacaccaatttgtcgtttttcttttttcttatatagacggaatcccgtgaattcgtgaaaacacgtatatttgttctttttaataaatgtggataacttttaacagattgatggggaacatggtctttgttaattcagtatctcgtaaatttggtcatgtagttatcaaaaaaaaaatttggtcatgtgtacgttttattatatgaatagtattgcgatttcaatctgttaacgttatctatcaaatattatatttcaagaatgtaaagtttcacacatacgtcatttggtttacatgattttaatcaaataatttttttaaatttttttttagtaattaaaatttacgataaaaaagaattgtcgtcataatataaataaaaattggatatgctaatttggttatatgagtgcttctctatatttttaattcgagtgctgggcaaaacaagagtcaacatgttcatttaatttgcttttaaaaaaaagacaagcacattgttttacattaatttatagagtatttggtgcaatgataatgaaaaagcatgtgcaaagaaaaggaaatcatagcacttcctcatgtactccactcactagcgttttctataaaatgtcatgatttgcggtagtgaaaggccaacacaaagaatcattttacctctaaagccaaagaccaacatg

SEQ ID NO: 24656 - DNA, 3000 bp, Unknown; identical to SEQ ID NO: 9444
  misc_feature (1)..( 3000): 2750-1469P.txt file - cDNA_ID_2182561; gDNA_ID_1972120; Annot_ID_178924

SEQ ID NO: 24657 - DNA, 3003 bp, Unknown
  misc_feature (1)..( 3003): 2750-1469P.txt file - cDNA_ID_2182578; gDNA_ID_1972120; Annot_ID_178931
tcttgcaataatttctcgtaggaccgacaaaaaaaaatgaatttaagttttaaatttggttggttcaaaacttaatatcaatttttatggtttagaagaagaattatagctgccaaaagtattttgtccggtaattactaattactctttgtaatctcatttaacttgcccgtttaaataaacagacaaaattaaagaaccctaattaaagtttggcagaacctatgtcccagaaagtaagaaaaaaacaaagtaaactgagaagtcatagtcaaaagacaagttagttccaaccaaaataaaataaaatgtgatatcaagttgaaaaagtgacggatagagaatctatcctttggatcctctcctctatttttagcccttcacttggatctctcttggataactcattaaatgacactatccaatataaccacatgtgtatctgcgtatgtatatgcatgtgtatttatatttagaagcttcctagttttgtctaagaaaatatcttcttgttttgttcctttcagcgctataactcataattctcttccaaagttcttggatttgttccccaaatcaactggagatctaagaagaagaagaagaagagcgaagatcaaaggataaggaagaagagaggaaaatgtgtactcatgctgatgaatcacaacacaacaatctcccttgtctccattgccaaccacattcttacattcgcatggtacataactacatatatacacatactgtatatagtttatacgttttgtatttgatgtaacaatcctcacaactagtggttgattttgttaggttcaacatatgatagagagatgcattctactccgtatgacgcgggacgaatgcgtcaaggcgttagaccaccacgcaagcattctaccactcgttacactcactggttagtctttacaacgttacacatataacctctatatgattcctcaaaactgttcgaaagcttcgttaactaaaaggaattaataatgatatttagacatatgtttcgattttgcttcgtacgtcaaattatataattatatggaacaattgaagaaattgattattgttttcttggatcatgtatgttcatcattatatattcgacataacttatattgttgagttcacaacagtttttcaacgtaactagttaatttatgcagttttcagctatatattaggctttgcaagtgtgctacaaaaaaaattacatgatatttttcccccccccgcagtttggagaggacttcaaagagaaaacaaggacttctttgaaacgtatgggcatttcgtctctcctaggcccttcttaagtaagagattgtgggatcaaatgtcctcttctaattgttaacaaatttcaattaattcctcagtcaacatataaaccacacatcaagtatgttgttatatagttcattttgatgagagttatgttttctttatcaggcggatatgttcgaagatcgccgaggtttgcgaaaaggatataatgaagacttggtttaggctcgtagctagatatataggagaaaaagcttgaactttatatatacctaggcatatgtattacatattcctatgatgaaatactcatgcttattatctgtggtccttttgatgtcataaggttcccctataagattaagcagataagattgattttcgtgtgtaaactagttttaaggttgcttatttagataattagatgcagtctgtttattgaaaaccctcgattataagaggctttacgatttatatatagcaaatgtgtaaaatatattttttaactaaaccatgacgagcgcttactaatttgagtaaatagactgcatctaaataagcaaccttaaaaatatgacactaagactaaaaccaatcccgccggcatagaaaacgaccaatctggttcgaattctgaatactaatttgaatctaaactaaaacactttatttccttttacgaaagaataagtgcaactgacgatcattcagttagttgtttataatgtatatttttaagttccaaacgaggctggctaggtgtataaatgtaaaaaaaaaaaaaaaaaaatggtgacaaaagataggcaaagatttgcatatgaaaagatgttggaaatttggttatttcctttgacaaattttttttttggatattttatttcaaagatctacacgatttcatgagtaggaaataagagttggatatttgagcatattcctcctaaaaacataatgcagcaacaaatgttttaacaaagtgacattaaagtccggttatctccggtttaagaaaagtgaaagacggaattgatttgcgctcacacctgttcggttcttttttttttgtcacaccaacagaaatacagaggtacacacatatcctaaaccgaacaaaaccggggttgtaaaaattaattgcgatttgtggcgattccgtttagatcggataaaaaatctgcacgacaaaattttccatcttcctcctcttcctctgccaacttataatcccgtcaaagatctttccttttttcttcttctggtttctttgtggtttcctggaggctctcagcatcttcgagtcgttgcgaggatgcgttagaagagagtctcctctcaatcttcgaatctccaagtaatctttctgtattttaggattcacctctctttttgttctgtttgctcgatacaatgaaattttgaaaaacttcgttaatttatgaaaattgaaatggattctatatcgcaagttcttgttccaattatatttgtccgttagtgcaaaaaggtcttacctttttcgccatcttacagtcttgtgaataattcaaattctaaaactttttgagattcttacagagacattttgtcactctttgcaacagaacagtgtgagaatgggtgaccaatatgtttcttagtggtgatgttctcttttgctttgttggtggaatcttaggactgtattgactggccatg

SEQ ID NO: 24658 - DNA, 1204 bp, Unknown; identical to SEQ ID NO: 9461
  misc_feature (1)..( 1204): 2750-1469P.txt file - cDNA_ID_2182627; gDNA_ID_1972122; Annot_ID_179023

SEQ ID NO: 24659 - DNA, 3003 bp, Unknown
  misc_feature (1)..( 3003): 2750-1469P.txt file - cDNA_ID_2182635; gDNA_ID_1972122; Annot_ID_179026
gatttctcaccaggctggatcagatagcttgttaacgttgcgtactttcatcaagatgaaagagttcttcttcactggttccttgctcaagtattctggttttttgtttggattagataatcctcggttgctcactggatccaaaaattaaaattgaaaaaaaaaataaaaaaaatgaaaaaatttaaaactgttttttggtgtctttttggttaggctgcttttaggctatgtggaattacaaaataggtgttaagagcgtatatgatgcacaagaatttagtcactaaaaaggttattccatgatcttattaggtgaagaagaattgtagaaatgaaatcatgtatttaacatttggtttagtgagtttgattgttatggtgaaatgattctgcagttttcttattatcgatgataccatttcgtggaattgcgttttatatttcgcaaaactattgacaataacaaacaaatttcagttgtttacaccctttgtttgtcaaccacaacttttccaatgattccactaatccacgttgctgccaatgtctaatatcgtatcaattatcaaaattgtgggagagaagggaaccaccgaaataataatgtccttacacaacgtcgtctagcccaattaataggcccatttaagcccaaataatacagaattgtggccctggtccgctacgatccgttaaaatctgaaattagggttttagtttaactctccatataaattgttccaaatttcattcgtatcctttccgctgctgccgtcttcgtctctgaggtcagtgtttcagctccttgaacgatatatacgatcttatcgatttcgcattattctatcttaggctatgtatatgactgtcgaacttagttttaccgccgccgatttggcttcgttatattttccctagtagaattaattgtttaggtgtttgctaagctcatttgcatgacttatattggcagataataaggacttgtgtatttttccatcgttaaaaggcatttcaaagagacaatatgtcagggtaagcttctccttcgttgttaactgcatttgtgaatcttgcgttatcagtaatacatgtagctaatttctctgattatccatccctttttcatatactccacgataattctctcttctattttgaggtggccttatctatttaattaaatagcatctgttgttacattgttgatttctgttttgtgggacttagtcaagcttcggaataatcagaaagttgctgtacgagtatcattttgtttgtttagcttgtctgattcttctaatcgcgtctagttggttcttgacaagtttcaaatcagaattgttccatgctttagatgtttcgatgtttattgtggacaatccaagtatatgatatcatgtgttgtgtcctgacttttcagtgatgaggctgcccctgttgttgttcctccccccgttgctgagccagcggccatcccagaggacatggacttaatgactgcattggagttgactcttaggaaagctcgtgcttatggtggtgttgttcgtggtctccatgagtgtgctaagcttattgagaagcgtgtggctcaactcgttgtcttggctgaagactgcaaccagcctgattatgtcaagcttgtgaaggctctctgtgctgatcacgaagtcaggttgctaacagttccaagtgccaagacccttggcgaatgggctggtgtaagtctatgttttcctctttaatactgactcttcatatataccttattgtcgctcagtttatcctcctaaatgaatgtttggttatcaatggcaaattgaatctttgatgttgttgcagctctgcaagattgattctgagggtaatgccaggaaggttgttggatgctcatgtcttgttgtcaaggtatataaagtcatggatgaatcatctaatttttaggattcattgatgatggtccatagttcttttacttaacacgtttctgtgatttcttgtcaggacttcggcgaggagacaactgccctcagtatcgtcaataagcatattgcttctcaataaaatgccatgaagcatatctaaactcggatttcatatgttttccacccccaatgctgttttctcttggttttgatatattatctaatatttagcggacagctcttgagatttgtttggaacatgatcaagttttgttgttatctagactttactcttccaaggccaaatttgcttgagatttatttggctcattactcttcatcataattttttttttcctattaacctatatggtttctacttaactaatatagttgagagagtgaaagcatttaaaatctgtttaccgtatcaaataacaggatatttaactcagcctcgaaaacacttatatttcatattattcatcttgttccgtctgtatacatttttttttttgttaaaggctttggtccgtctgtatacatatgaattgtgttctatcgtcgtcaattttttaaaaaaaaacttttttcgttttacacgaatacaaaaatcattgaaaatttcattcatttcttttgaagtgaaaagctcggggagaaggcgggaagtggaaaagccaaggctctggtattgcaacaattgattataatttgtagagatacttaattatgatttgaaaaaacaggggattacttaataatcgaatgacaaagcacacacatgattgattttagttttgtgttttttgtcaagacttgcataatcgagtttaaagagtagcgtttttttgtttgtttatgagttaatttcgcatgtacgggttacatagagcagttcttgcatgttctacaccgcctttaaaaggcgcaaagttgtcatttttatttccttttcatttgcttccaaccatttagatttgaggactctctgtcttttcttatttcggagaatgttctttttctagggttttgaaattctaagagattttctgaagaagaaaacaaaatg

SEQ ID NO: 24660 - DNA, 3000 bp, Unknown; identical to SEQ ID NO: 9473
  misc_feature (1)..( 3000): 2750-1469P.txt file - cDNA_ID_2182643; gDNA_ID_1972122; Annot_ID_179029

SEQ ID NO: 24661 - DNA, 3000 bp, Unknown; identical to SEQ ID NO: 9472
  misc_feature (1)..( 3000): 2750-1469P.txt file - cDNA_ID_2182651; gDNA_ID_1972122; Annot_ID_179033

SEQ ID NO: 24662 - DNA, 1032 bp, Unknown; identical to SEQ ID NO: 289
  misc_feature (1)..( 1032): 2750-1469P.txt file - cDNA_ID_2182651; gDNA_ID_1563395; Annot_ID_147600
  misc_feature (9)..(9): n is a, c, g, or t
  misc_feature (385)..(385): n is a, c, g, or t
  misc_feature (395)..(395): n is a, c, g, or t
  misc_feature (760)..(760): n is a, c, g, or t
  misc_feature (785)..(785): n is a, c, g, or t
  misc_feature (843)..(844): n is a, c, g, or t
  misc_feature (981)..(981): n is a, c, g, or t
  misc_feature (996)..(996): n is a, c, g, or t

SEQ ID NO: 24663 - DNA, 3003 bp, Unknown
  misc_feature (1)..( 3003): 2750-1469P.txt file - cDNA_ID_2182712; gDNA_ID_1972123; Annot_ID_179064
ttgtgtacatatgacattcttggcagtaggaatggctaacaatatatttgattgtttcaaaatgttctgtaatgatcccttttttctggtgtgtagaatagagtgataaacaatgcaagagcttctagtatcacttaatctgttcatatgtacaagactccattaaactatctgcaaaatataaaaaggttgtgttactatcatagtcttagtgataaataaaatcttaacgaaatatagacaagaatccgttgtagtctagctggtcaggatactcggctctcacccgagagacccgggttcgagtcccggcaacggagtttttttctcatcgtactgagtaattttccacgtggcaggatttagttttactccattattttaccttttggcccctaaaattaaaaagcttgacgtaaaaagcgtgacgcttgcgaaagccgaggcgtgtggtgagtttgtttcccatgtggccttgagggttcgctcacgcctttgtctaaaaggcaagcaaattaagcgacatctattcatggttttgttcggacttgtaaatttatattctttctttctttttttcacctttttgtttgtaaaagcagaatgtgaggtaaacttatcatgtaatttacttttacatacacactagagagtgaacacgtaatgattagctcaaggtttatgagcatgggaaaaaatacaatattagacaccctcaaaatgagatctcgatttcactcttctgtctaagataatttaaacttccataaaaaactacttgtctttagtagatacatataaaaagtagtggtatacggtttctgtttttttttttttacaaagaatttgaaaaaaatggaattgacttgtggatgtgggggtgagtgtagatcgacaaaggcagaacataaacgcatgtaaaaggaaaggtgctttttgtgtgtggacaaggagcataaaaaatgtttaaaagaaagagcattccaatttcaagatttcaagaatcctaaagacataaggataagacactcagtcactcacacttagcttcgccgtttaggtccttatcattgttcaccattgcatgcgtatttttgtttatttttcttttaattgtttttgttcatagacatgtatatagattattatcgacgtaatataagtgcatagttagaaaccgcattaaaacttcaaaatgaaaacagtttagtttaaatcgctagagtacaaattaaaggttgaaataatccttaattatatgtttattgaagtcgttggttcagtttttttttgtgggaagttgagaagtacaaaaaagttaaccaaagagaagtcaaaagttcacgtgggctagctggttactacgtacgtcagccgaactaaaagacacttcgtcggacaacgaagcttcaaccacatgcttagataagtatagtactacggacaaaatcacattccatcaccaaataataatagaggaatattttgctataaaatgtctttcgtgacttcgccaagtgcgttcgcatattgtatcggtttggatattcagagatatatctttctctctgtatacatatataatcttttgttcttttgtaaacgatatagtatgtatgtagagcgtcatgattaaatagtggttaaaaagtggcagaatgaaactccatagataatacaatttgattcctaattttgattagcaagaggactcctcaactatacataccgttatcacttaagacatgaatgcgccaaactatttaaagccacccatgattttacacctactatatacgcactccttcgtgactatgacaagtcggcgaggttattcatgaaatattgaagtgatccacgttctgaaagttatgtgtaacaaacgtacgtagatgactagatgatatagtttgtatacgagttgaacactatgtgttaatgatttactacataggtgtttacaacagaacatatatccatacgaaattttttgagatcgaaggtcacgaaaattatcataaacacatagtgttcaactctaagtataaatgaatcaaaatctaagaataaactagtaaataaaatattttatttaattatcagaattcaaaattttgagatagggagtgaaacacttaagtatatataaccgcaatcgcacgccaaaagttagtgggaaagattggattctttgagtaaagattaggacaaaattaaaccccacatttaagaaatgaaattggaaaacaaaagtgtatttgctaatatcaagaatcaacacaatgagtatgtttgaagatacaaatgaccccacatgcgtgcatgtgttcatcttaaacaaaagaaaagactcattaatctcttaatctcgagattttcaaatctccatcatctctttcctttttctatatcactatcgattaaatgagtttctaaagtaaccaatactgaaattatccaattaataattcactttctaatttcttacaagaccacaattttgcctttatttagtttataatatttaatgtttgggggtatatggtccccttcttccatgtatattctctcgtataaagaagctggtaacttctgcttagctgttcttgtctagctgtgctcttggggttggtttcttttcttcttttcattattttttgtttgaatttggtgttggagataagattatttgagattctgggtttctagtggttttgctcaagggatctgttgttgggtttaggttaatttctggtgttagttctgttactgaatgtggagaaaggaagcagctttaagtgtttgttagaatgtctgagtgaaattgatctgtttttattattatctcgatctgggttttgagggatgaatccaaagtttctttctatctgagaaactctgtacattagggttttgattttagttggagggagtttttttttagggttttggaggctcaaatttccctagtttctttgttgaattctggtgagagaaagaatg

SEQ ID NO: 24664 - DNA, 3003 bp, Unknown
  misc_feature (1)..( 3003): 2750-1469P.txt file - cDNA_ID_2182724; gDNA_ID_1972123; Annot_ID_179068
tatagatgatgatacgaatgatcttgacttcataagttatagaatgttcacaacggtctttacattcaaaattctattgtgatttttttatttattgcttatggcaattcttcggattcattaccgataaaattttagattataaagtcaattggtaaatatggtactaatctggtacgggacgaagttggaatcttaccataaatattagacatgctccacgctggactacaattcttcttcttcatcgactaatcataccaaaatttcattgatatcggattctagtcaatcgtcggatcatcgattttttgaggaaaacttccaaatttctctatgattttttaggctatgaattaaggatttcatttgatttgtgaaaacttgaaagttgtagattacgaattaactccatcagtataaatttaggatgaagttccatggtggttatgatattgtgtgatcaaacatttgacgagagatttacagctttcttcgacgaagaaaccatggactttttttctcatgaattgatctacctaaatggcgaagaagggtttcaaggatgtcggttctcgagttgggaaaagttatttttctatttctatttttcttatttttggtgaaaatttaatttaagtcgttatatagagttttgggcctttaattttgccaataaacgttaaccttttttttttcttagactaatacatgtcttttattgatataatgaaatcaacatttgaatatgtactatatcaacatttaaactccttttgcttccatcctatatatactccttgaggattttcaagctttagaatctctttgtgaccaacaatctcattgcctctgatcacctttttcgtagacttgtacatccacttcgcaagaggctgaagacgaatctctctattaaaaaggttgttccgtagacggagtcttggaacataatactagtaatgatttttaggaaagaacttatgagttggaagcacttgattctctgataatcaagataaaactcaaaatgaattaccagattgcgcttgaagttgttgtttgtgatatatggcctcaaaaaatccacaactagctcaatttctgaagaagaaaacttgacacccctatgcggcactggactttataatattttaggttttggatatttaagtttaagatttaattttattagcatacaaagtaattaaatttaataataattaatactgtaaaagtaaatttcatgaattaaactattttttgaggatcaaagctattgcgttccatccaacctacaagatttagattttgtgttcgtagagaggaaggtaacattttttgtgagatcatcttcaataacaaacaaacataataattagaaacgaagctttacaaaattttaaaaactgaaataaaaatatataaattgagataacttacttgtttcaagaggtgaaataaacataggcaaagatgtaggatcttttgatgttgctttccaaacaacaactacacgaacaggaaatgaaaaattagacgatgatgaataacacgaagcacaaagattagtatacaaatataattacgtgaacattattgaagaaaaaataattgtcttatttttgagttatggagggcacataaattacatgttggtaactatttgttatatgttgattagcacaatagctaggaaaaccaaaacatgtagtcgattaaactaaccttgcgtaaacaactcatcatcaattggcaaagatctatgagattttattttccatggaccataacagaaaaaggagaaaagaaaaccgatgacgatgcatcatagaaaggtccaagattgaagtaaaaaaagaactataaaccataattattacatatcatgcataaaaatcaagccgtgatgtttgagtttcaagggagaaatcctatatttatagaaattttcaacataaggttttagggttttagatatgacggcataaattatacggacataatttttttaatagaaaaatataagtccaataggcgaataagagaattaggattgatagacgaattaggggtgattagagttgattagggttaataggcgaattaagattgatacgcaaattagagttgttatttgtaaaacagaaaagattacattacattttttacacattttttttacatattaaaatatggaaatctcattaatgtaaaatataatcttattaattaataattaataattaaagggggcaaaaacgttcgttaatattctgagagcaaacgtgagcactttgatatataagataaagtttatttatttcccaaatgttacgaaaaattaattccgtcatctttttgttaacaaaagtttatcgatatgcttaaaatgatccaatcatcgaaatttaagtatttttttataaagtcaaattaaattttaaaattttaataatatttcaaaattatatactttttcatcttaaatttaaaaatttgtgatttgtttgacattttttcccaataaaatatagtttcaatttttctattttgctaagatagcaatgtctgtttataatacaaatttggatgtataataaatattttgtctcacaactaacacgttgaaaatcgaccactacttggtacgaaaatagcaaaataaattaatttggggcttttcttaaagaaaattattttatatttttctttaattttgtgtttgtgtcgtccttctatctctaagaagcactacccctcccgcaattgaaggttctcttcgtcgctcacatccaatctctatcgatctcagattccaatttctgcgaatattttcttcccagagagattacagattctagggtttcgaatagttctttccaatctagtcttcttccttttgtttctcgggcgaaatttcccttagggtttcgaagatccgaatctgtggacggagacaattcgacgtcttcttgagctgcaaagatgttctggcgaatg

SEQ ID NO: 24665 - DNA, 3003 bp, Unknown
  misc_feature (1)..( 3003): 2750-1469P.txt file - cDNA_ID_2182736; gDNA_ID_1972123; Annot_ID_179071
gtatatttttgcagacgtgcatactaaaagtcgatctaaagtgttgcattggttgccaaaaaaaagcaagcatgaaattgcagagtatctctggtaaaaaatacttcaaagcttttaattgcgtggctcatatgtctttaaacatgatgatttaaatactttgtttccaatggaaataggtgtagaggaagtggagtataacatcgaaaaagggctcatgacagtcagaggtgacgtagaacccatggctctggttcgtaaacttaataaacatgacagaaaaacagagcttttctcagtcaagtaccagcttgatgatgatgatctaaacagtgattcagaagactactcttcttctgactctactaattcatcttatgatcctaaacccatggaacgtcaattccaagagaagatgatgcagcagaagaagaagaagtctgggatactaaaaatgctttctcttttatggtgtttcagcagtaaatcaaaagttgttcagcctttaccgatgcgaaaccgaaactggcatgtcccatcaaagtttgagaatgttcctcctggctttggcttcaattctactacatcgtcgcagttgcggcctccgcatccaatgatgccctatccaccaatgatgcaaccaccaatgatgcagcaacaacgaccactaatgatgcagcaacaagcacaagttccaatgccacctaatgttaacatgttccagtcagcaccccaaccgtttaagatgcaccctaagttgcattacggggagcagaaacaggttgtcacctaagctacttgttctgttgattatgtctctgatacatatactaagcaaaagaattgtttttaagtttcgtatcttttgccaattgccgatagtgaacatttctcaagtctggcaaacttttaaaacaaaagaacaagggtacattttgaattcatttatgtgtgattctctgcatctcccaaacctggttccataaacatttggataagatgagctttgtttgtgtcacggaacaagaatctcattcataacccaacagagaaaacataaataacaactcaaatctgtgcctattgctagtactagaatctattgtttttgatacagagatttctcttggagaatacttgtcttgagatttgtctgttgtgcttgtgcatcatgttttcctccgatttaatggttgttttcatgttcgccctccaaatctttcaagtatcccatgaacaaaagaaacccgaaaaggaagaatccacctgaagagctccctccaccgcctccgccaccaccaccaccaccatcatcccgaggtgggaacccgtttccaccgtcatcaagctttggggatttaacttttcctgatatttaagttaaggctaaaaaaataaattctgaagatacaaacaagaatagaccagtccgtttctgttaaagcacattctcaagaataagaaccatagcaagccacaatttgagttcaaaataactgtttcatattagctagaatcgtatggttttttaagcccctcttgtttgttagaaacgcaaaatagttgttcaacatagagaaggggatgaaacaatttaccatgagtaggagcttgtgtgattgttggtgattgccgtgtaacggtctgtgtttgtccttgactgcattttgaattctgcagaaaacaaatcagaataagtaaacagctagcgtttcagagacacttaggaagagaataccggaaaataaactattatcggccataagagcaaaaggatcttgttcataaaacaagcaaaatggcttatgatgtgtaattaagttatgtgagcaaaatggtgtgtgatgaagttatcccaacagctaaagatttaaaacacttaaacttaaaggctgcaaagtcatgaatggaacctaccagcgcagagttacatgcaaagactggtcttttattcttagagacgacaactggttgcactgcatcctggagagaagggaatttactttggctccaaggctggcgttgcatagaaacgcttgtaggataacgcctttgagagtttcctattacagacagcaagtagaagaagagctttagaattccattgttcattcaataaaagcaagctcgaacgatgggactaaagcaagaatcaatgctacaacaacactcactaaagctctgagatatcaataacaacaacaagtctagtttcttcaatttgtcaagagcaatccaaactcaatttcaaagaattttccaaagaagcaattgtaaacttaagagccaacaagtgttgagatttagaagagacataccattactcgtaaaagatttctcacgaggagcgaggtacaccgatgtttgtgtaccaatacacaatgatggattcattaccggcataactacaaacagcaacaaaacaataatctttaacctatttcacaagggagaaaaataaaaaaaaaaatcaatttctcataaatcgaatagagaaaaaaattatggattcatcaattttgaaattcgattaatgataaaaacccatagagatttggatcaaagcaggtagattttttgtcgaggaaaaatttgggattttggttgctcctcgaagcttctcgatcatagaggacgaaacgcaaataaatagtttataagaagaacaaaaaagatgaggaacgtgaatcgcacctgaagactaaaacgcaaaaagacggaaaaaacaaagatctttcttagggtttatgtaaaattctcgcacaaatcaattttaaagcgttggcttctattgcaagaatctaaatagcccagaaaataaaataaaaggacaaaatatttctcctttgtttgtcggttttttattttccaacaaaatgatatttgttttatttattattactaaggctgatcggaaaaaattaaaaaccctaatttgagcagatctttccaattgaaagcgaaccgtgaattttgagtctctttaccggcggcgaaaaaatg

SEQ ID NO: 24666 - DNA, 3000 bp, Unknown; identical to SEQ ID NO: 9478
  misc_feature (1)..( 3000): 2750-1469P.txt file - cDNA_ID_2182765; gDNA_ID_1972123; Annot_ID_179082

SEQ ID NO: 24667 - DNA, 3003 bp, Unknown
  misc_feature (1)..( 3003): 2750-1469P.txt file - cDNA_ID_2182795; gDNA_ID_2926134; Annot_ID_197109
atcttccaaatcgagtttcctgccatgtcgatttcacaaaacacgatcagttttgagattagcaatcacacagacaagaggacaaagatagaaaaaaagaagagggaagagaacataagagatgatcacatacctgtccaacaccggcaatcagaaatttacccgattttgcaaaagccaaagagttgacaaatccagtctgtaagatcaaacaaggcattgcaaggattattacttggtgaagtgaaatgcattaatcacagtcacaaacaacagattcatcagacaacactaaggaatataactagtgaacgaaaatttaccagtggaagctcgtacaaaggtcgaattgcattagtttcaacagcccacaaacgcacaaaaccattaccagctccagatgcagcaagatcactgcctctactagtagcaactgcattgacccaagaatttgctgaacagttattgttgactggttcatgatcaccgttttctgttaagcaaataaataagaattagatatttcagagcatcagtagctgcaacgaaacaaaagtgttttataactatatactgcaatgtcaagatccaactgcaacagagatgaaatggggaggatctaaattaggtttcacctaagattccattggtggtaatcccatcaggtatatcttgatgtgcattcttgaaaacgaacaccggtttcttttttaacatgccccaaagagcaacagttccattatccgaaccagacaggtactcattatcactgatgaaacagcagctctcaagagacgatgcaggagctcgatagatcatacgggtgctctcaggcacctataatcatataacaagacttacaaatacagaataataatagaaaccttatgatgatatcttccaacagtgtttacatggaggatagaactattaccttatgatacagcatggttctatctcttccaaccgtaagtgcacgctccttcctcagtgcatcaatggctagaatttcaccctggtgtccatgattttcagttataaatgctttatcttctacgttccacaccttcacagttctatcaaatgaaccagaatagagttctgaagttccgtatctgaaacatagacaagaaactgtgttccggtgacctggaaaggcctgtagacacataattgtaatacctgagcgcaagacttgatgaagaacaaataaaaaaaacactaaacaaaaaccaaatttattatcattacctggacatgctctcgggtacgaacatcccaaatatgaacatgacggtcaactcctccagtggccaaataacgaccatcagagctaacagctaaagcaagagattctctactgtgatttttgttacgaggctccctcaatttcatcccatgcgacttgagaatttcatcacttggccatatgtatttgtcagttttaccagaagatacatcccaatgcataatagtaccatcttttgaagctgaaaatcctctagaatcgtcatccgataaagctaccgacacaacagatcgtcggtgcttgacaataacactaaacccatcagtacttagtggctcctgaaccctgaatcattgaaaaactttaatcaatactactatcaaccaatcttcaaagatatcaaattgacctaagaaatgtacaaaatcactaagtttcttcacaattaaaccagctccctaaaacactaactacccacaaaccctaaattaccaacaatctcaaacctaaactatctaatttgaatacattgaggtactaaatttcttccttacctcgatgcaataagtcttcgaatcctaccactatcctcctgctgcttctgcatcaaactcttcttaatagtctcatcgtcatcttcatcatcatcatcatcattatccgcttcctcacgctctctcctcatcgcttccctccttctattcagcatctcctccgccaatctcttccgcttctctcccgccgtctcatcagcaaactcatcttcatcctccacttccccatcaactcttctcccatcttcatctccgccagtaaatccgttctcttccgcatcagagtccacagactcgatatcgtcgtcatcgtaactgacttttctccgtttcttcggctcttcctcaaaaaatggatccctttcattcgaaccctttttacctcctctcttaaagcttcctcctttcttcttctcgttgttgtacttcattcttctctctctcactccctcttagggtttaacgattttacactttgactcgtctaggtttagcctcagggtttagtggcgacggaagaagctggaaaacgattttgtttatttggtcggaaagtttacaactttaaaccttccactaggttttcttcaggaatcgggtctaccgggttgacccggactaaccaagcccatgacttacctggtctatggtttgagcccattaactatttcgttcttttaaagcagaaacttgggcctttaatttgtagagccgaagactaaccggaccgtcaatttaagtttggttcaatccgatttctgaatttttggttctgatttctgaagagtagtacgtaaaccgaattgggagattctcttatttcagtaacagtttaatacagtttttgtttagtgttttcaatttcggtattttttacaaactcgaatcggatgattccggtttaataaaatcaaatgagttcggtttagctgaatttaaaactgtttttaatcttatagtataccgaaccggaccatccatctaatttcaattgtctaccaaaaccgaccgaccagtctttgtcgaaagttgtctttcttcttccttgttcgattttcgcctcctttggcttttcattctctctctaacttctctatgttaaaattccgaaagctcgattcagaaatctagaagcttcctcgagggccctcgcgtagaaagtcgaactcaaattccctggagacaaagaagaggaagatg

SEQ ID NO: 24668 - DNA, 3003 bp, Unknown; identical to SEQ ID NO: 24667
  misc_feature (1)..( 3003): 2750-1469P.txt file - cDNA_ID_2182795; gDNA_ID_2926134; Annot_ID_138856

SEQ ID NO: 24669 - DNA, 3000 bp, Unknown; identical to SEQ ID NO: 9459
  misc_feature (1)..( 3000): 2750-1469P.txt file - cDNA_ID_2182795; gDNA_ID_1972121; Annot_ID_178971

SEQ ID NO: 24670 - DNA, 3000 bp, Unknown; identical to SEQ ID NO: 15444
  misc_feature (1)..( 3000): 2750-1469P.txt file - cDNA_ID_2182799; gDNA_ID_2926134; Annot_ID_197108

SEQ ID NO: 24671 - DNA, 3000 bp, Unknown; identical to SEQ ID NO: 15444
  misc_feature (1)..( 3000): 2750-1469P.txt file - cDNA_ID_2182799; gDNA_ID_2926134; Annot_ID_138855

SEQ ID NO: 24672 - DNA, 3003 bp, Unknown
  misc_feature (1)..( 3003): 2750-1469P.txt file - cDNA_ID_2182799; gDNA_ID_1972121; Annot_ID_178972
actccacaagagttctttctaatgtgaactctggaaagacttatgcatgcccagataacaaagttaaatgcatgtacaaaattcttcgtagcacaggcatgttaagatatttgcaatacctgatatagtactgcaatagtgggctttgcacatccaaacagaaacttgatatccagaacctgcaattcctcaagcctgaaatttagacaccacactcagtacatcatcattcagttttaaatatccccagaaaaatcatatcgtagtgattctagaggaatgagtatattgaggattaaacagtttatttacgaaagaatctgatgcctggaaacaaatgcacactagaattaaagagtacctgatattaaaagcttccttgagctgtcccttattatcaaatggaataacctaaaagaaaaaccaaggaaatagaacgcatcatcatacatgtataaacagatagattagtggaagttcagtaacatgatatatttaagtaaacaagcacatctgtcaaagtttttatagaaggtaacattataccttgaacaagccgtcatacagatggagtccaattaatctacaatctggatcaattataccaatctacaaagcaattgtcaaatcagaggtaagctacatgcccaccaaacccttaatgacaacgcatattttttgatgaaggaaagtaaatatataagcactctgaaatgcacagtcaagacgacgatattcaatacctgaccattgtctgttggccggcctatacgatcagaaacatcccccattgctctgaaaaaagtcaaaacatcatacagaatcagctgtaaagtagaaaatggtcatctgatatattgcttccaataataaccagtaagatgcaacaattacgccagcaccatacatgattttttccatgctttggatatacagcaatgtatcaattttgtgaaaggtgagaacctataatcaaactctcataaaaaatgcttaatcagaaataggttatagatcagattttgtaaagcaggaatatgctgtaaacagctatctaaaacaggcaagttggtaccatgcactaatctgtacataggtgacgagtgtaatacatttatttctaacaaaaaaatgataagataacggcgaacatgatcatgaactaaaagaaaaatagcacaactggttggttaacatcaactggatgcatggaaaaaaatttatcttttggaagctataccttgtaataagctcagaggactcaggatcccattgaagaacacagaatttgtatctctcagttgcaatgaacaaaaagtcttgcgcttcgccctacaaaagacggtggacaatactatcaacattttaactcattattaagaccatgacaaaagaacacaataagagatatatactcacatggggtcggaacaactccagagtagcgattcttccatatataggaacgtccaacataggctgcaatataggaacatccagcagattcttatattactaacaaaacaaagcatgacaacaaagtttttgaactttatactctaatgtacatggaacttaatccatataagcttgacagaatagagatgtatgtacctgaagtccttgtggggtaagcaaatggatctcgattcgagtacatttcctgagaacagatcaacactgctgtcaaactaatctactaatggatctgatagatgttacaatttaaggggacaatgctaaatcggataaatgagataactttcaaacaaatttacagtactgatagctaacgataattgaaaatcctccatatcaaaaaaggcacgatcttcaaatgtaatttagttcaggaagtaaaagccataccaaaaaaaacacaattctttgtcacagtttcaaaaaatccacctcatcaaagaacccagaggcattaaaatccttatagtcatctcccaaactgaaattgaactacaattttgtttgcaaagtgggtaaatttatgaaaattaactcgtgatgggaaattcattgaaaaccctaaacccaaatcaacagctgcaattcaaaaggggactaattgacaaacaaaaattgataacaaatagaggtagggggagagtttcgtacgcgacaatgagattgagctcttgaggacttgtgaagttgccaacgcacgagtgagtgacactggtcggtttgtgagccgtaacaacgtagttccatgagctcatcttcctcttctttgtctccagggaatttgagttcgactttctacgcgagggccctcgaggaagcttctagatttctgaatcgagctttcggaattttaacatagagaagttagagagagaatgaaaagccaaaggaggcgaaaatcgaacaaggaagaagaaagacaactttcgacaaagactggtcggtcggttttggtagacaattgaaattagatggatggtccggttcggtatactataagattaaaaacagttttaaattcagctaaaccgaactcatttgattttattaaaccggaatcatccgattcgagtttgtaaaaaataccgaaattgaaaacactaaacaaaaactgtattaaactgttactgaaataagagaatctcccaattcggtttacgtactactcttcagaaatcagaaccaaaaattcagaaatcggattgaaccaaacttaaattgacggtccggttagtcttcggctctacaaattaaaggcccaagtttctgctttaaaagaacgaaatagttaatgggctcaaaccatagaccaggtaagtcatgggcttggttagtccgggtcaacccggtagacccgattcctgaagaaaacctagtggaaggtttaaagttgtaaactttccgaccaaataaacaaaatcgttttccagcttcttccgtcgccactaaaccctgaggctaaacctagacgagtcaaagtgtaaaatcgttaaaccctaagagggagtgagagagagaagaatg

SEQ ID NO: 24673 - DNA, 2906 bp, Unknown; identical to SEQ ID NO: 15453
  misc_feature (1)..( 2906): 2750-1469P.txt file - cDNA_ID_2182840; gDNA_ID_2926134; Annot_ID_197080

SEQ ID NO: 24674 - DNA, 3000 bp, Unknown; identical to SEQ ID NO: 9317
  misc_feature (1)..( 3000): 2750-1469P.txt file - cDNA_ID_2182840; gDNA_ID_1972121; Annot_ID_179003

SEQ ID NO: 24675 - DNA, 3000 bp, Unknown; identical to SEQ ID NO: 9924
  misc_feature (1)..( 3000): 2750-1469P.txt file - cDNA_ID_2182888; gDNA_ID_2096292; Annot_ID_195423

SEQ ID NO: 24676 - DNA, 3000 bp, Unknown; identical to SEQ ID NO: 9928
  misc_feature (1)..( 3000): 2750-1469P.txt file - cDNA_ID_2182911; gDNA_ID_2096292; Annot_ID_195431

SEQ ID NO: 24677 - DNA, 3000 bp, Unknown; identical to SEQ ID NO: 9921
  misc_feature (1)..( 3000): 2750-1469P.txt file - cDNA_ID_2182941; gDNA_ID_2096292; Annot_ID_195441

SEQ ID NO: 24678 - DNA, 3003 bp, Unknown
  misc_feature (1)..( 3003): 2750-1469P.txt file - cDNA_ID_2182978; gDNA_ID_1972133; Annot_ID_179125
ttatagcatgatcatgaataagcaaagtcaactaagctatcgtctacattggctattgaagttgctgcctaaacgtaaacgaaaagcatccacagattacggaaaagcacaaaatgagaagatgcaacacttgggttatccatgtgattgatgcccatttgtaaaaattcaaagacaggttcataaaggtagattcaatgataaacgacaacaaagtccaaccacatcttcaagataaactaatttataaatgacttctcctcataacacaaacaccaacatgaaccctcgtggttaagttggcaagcttagccttttcaatcctcgtgcaaagttcccaaaacatcctcgtcccggaagagatggtacctgcgtccatcacacaaacacaaaagttactcactttgagtcaaattcttcttcatttgtaatttcttattcgtttctaaaatcaacccaccaatcaatatgtaaatctggtgttcaaattggcattattaaacattgatcaaaatgtttttaaatcctctgttacaaaattttcaatatcttcacagtcttacaagtaattcccttagttccatccattaatctaattaatggataatgattcctgaacatgattagctaaacataaaggttcaattagatcagatcagaattttatcagaatattagggcaataataagaaagaagcgggtttaacttactcgttctcgccgagcttgacctgtgtaccaccgtactctggaagaagaacagtgtcgccttccttcacagagaccggaatcaatttcccgtccttatcccttgatccaggtccaacagctatcaccttgcctgagttcagctgcaatcacccaaaaatatgtttatttttcagatctaagaggcgaaaatcagaagaatcaaatcgtgaaatcaaagctcttttaccttggaggatttctcaggtaggagaatgccgctttcggttttagcgggctggatgactctctgcaccaagatgcggttgaacgttgggatcagacgcttcatcatttctcaattcttcttctctctcagttgatgaatcggaattttctagggtttctgagtttttaatttggggcagagacacataagacggaaggttctagatcgtagggtttagcgcgacagaaaaaggccaagggttttgggattgtttgggcctataatatcatactatttctttaatgggcctcactcattaaaaaaaaccagtcgcatttgtgtttgtctaaataaattcttggaagtgttgtatgaccttgcagctcaaatggttagttccttccatgattctctttgccaagtttttcaaactccatgtacaatcccatttcatataccacatccagaatgagatgtttattttcggcagatttttcgtggaatgaaatcttgacctttcttttatcaaacgtctctgctgatgatggaaagcttcttgctctgtcagttttccccatttctttcaaggtggtaaccaaagtttttccccggattgttgctttgctatgctatatgtttattacattgtgcctctgcgggaattacatgctcttaattttcagagtacaaatctgaataatccatgtaagccaatggtacggttccggacttatacaaacaccatacaaatgttccaagataccaggattcgaatttgctataacaagattaggcacaaagctgaaacaaagagagctggcgccactagccacttccatcgagttggccttgagatagaaggtgagccatgtattgctgcattcacaataaaatgagctcaattcttggttctaaccccacatgattcgacaaacatttctatcaatggcaccacaaagtcagtaccatcaagattctagacttatggaaactgacctttacaacactaaaatatccgcaccacagagattatcataaagagattgaagaaacttacggagtggtaaacgtatggagattttccctggcgatcaaaatgcttagccattatgcagaattcaacaggaccccaatcttcagattcatagcaattcccaagcgccgctttgtacagctttactccaataaaccccaatcatcagttccacacagaactaatcaactatataaactgtaaacgacaactcaaaattgtcatcaaggacaaaccttagctgtgtcggtcaaaagttcggtgccagcagggtaagatgcataaaactgatctcccctggaatatcctgctcttgttctacacaacattcgaatcagtaacattaaatcaaattaaacctgaagcagaaaccaagagaagaacccagaaattgaaatcatctgcgaattccgatattgaaaagaaagaacaaccaaaagaagcaaactgagatcggacgaaagacattacgtgttgtttgtatagaagaatgtgagggcagcagtgaagcagtagaatccggcgtaagagacagcccgtcgtagcttctggatctttataacctctgagcaaacatccaagatcatcatcttcacaccttcggaaactctttcaggtattatatcgaacaccttgtgatcactttaccaaacagagatgacgagtagaagaagcatctcacgaaatttgcaattgacaaattgtaaacgctttgtattgtccaactttttatgggcctatctgacctttttctcttttcggcccaataaaacttttagattttatttcttttggcaacaataaatttaaaataatatacattatggaaaatcatctacaaacaaaaacctttaaattaaaaaactcacatgttaatgcaattaggttagtaagcaagcacgtcttgacaaaaatgttattgttacacatttaaaaattcacatgttatacaagacaaaacataaacgtaatgttttgcagtcaaataatgaaataaatgaaataatacaaagggatctttatgtaaaggcgtcaccaattagtggaaataatg

SEQ ID NO: 24679 - DNA, 3003 bp, Unknown
  misc_feature (1)..( 3003): 2750-1469P.txt file - cDNA_ID_2183028; gDNA_ID_1972132; Annot_ID_179104
gggattacaagagacggaaacaagagcagtgagaaaccaaatcagcgtgaatcttccgcagatggggaaagatacgattgataaagtcatcttctttcttcttcccacgtgcctgatgtttacagcgtcagtcgtctcggcggagaagttgaaagaaaccaccggaccggcggcgacgacgacgacgacgaggaagttcagaaattacagagtttgtttggtcacttcttccaccaattcccgtattttattattttttatttccagcgtggacttttctttttctttcgacccattaattcgatatttttatggtttcattcaggtaaatttattacatgtaaacttaggtgttactgacgctgttacaactcatattttactgttcagttatattatcctttttgtcgtttcaactttcaattgtaacaaaattataaatcataggaatttgtttccttaatttaagtattaggttatgagtttaagactaaaaaccatgtgaacaaatttataacaaacgaatagaaacaaatatcattcgcaaaccacatttatgtttccttgctctttctctattttacacacattcttccaatacaataattaaatatggttttacatacagaaaaatataaaatgtaatgttgtttgcattataagttctagagggacaaaaacacacttcttctttttttaccacaagcaatttcacttattacgtaacattaagcaagagagacttgagagcaacggcgatatatcataagacttacgaagaggaagaggaaggtacagttgaagggttgaaaggtttctgttctgcgcagctgagctcatcgtttggtcccgcgtcttctcttccaatacccatgaggtcaaggaagtataagtagtgtgagattatgttgttcattggatcaatggaaccttgaccacatgtgtactctccgtagaggacgttcatggtgctgccaaaagtcgggccacgcttggacaaagtgtcgttctttgtaggtttccagtttccgacaaagatgtcgtgagctgagggctgagctctcttgattggagtcatccatctccagattgcagcttggaatgcaagtgtcgcgttttgctcaatgtactcagggtggttcaagagatcagctttcagggcttccccagctgctccgtagttgaagttccttcaaataacacacaggtaaaaataccttcagtatggacgaatgcaaattgtttgacacagtttttatctagagcttcaaagtagaagagaaatgtgtaccagtaaatgggtaaggcaccgcgtccgtagtattcagctccagggctgcaggggtacttgaatttccaggactcgtcacagtaggattgcattgggctcatttccctgttgtagcacagaccccaagctaaaggccctcctgttgcaactccatagccacctataagacatcacagtaacactcatatgcagcttcttacaacatagaaaccaccaactgcaacttagggcatatccattttcatgattctgaatgtcgagtttgatcagattaatataatggtatagctatggaggtaagcttaaagcatccttttttctattcatagttagatggtcaactatgtagaaagaggactaaaatgaaggaaaacttacaggacgttttgctggctacatgaccgagaaaggcagccatttctttctgtcccatgagctttcctccagtggtaccaaaaccaagaggctcaaagagggcagcagcagtaatgaaagactggtagtcccagaaaccaacagcatgagcaatgggagtgttccttttggaaaagagttgctcaaactgataaacctgaaagtaatctgatatcgtctggttacagcagtatttagaccaccagctgcattcccatccttgcgtgcacaccttatttcccctcactttcttcactttaatcgttttgtcctctccattggcaaccaaggccagaaatgatacagccagcagaaccaaaatcacgattgaaccactcctgattgtcaccatagcttacaactatggaacaaataccagctacaagctgcaaacatcaacaaaaaaacaaatttagaaacatccattaatcccaagtaagcatctgaacattactataaagaaaacagaacacaaattactaacaatacagatctaccttatacaataggcacttaatgccaaaaagctgattagaaacaacaaaggaagaattaaaccaaaaacatggaactctctaagttcttaagtgaaaaaactaagaaaaattgttagattgaccaatattataccaacttggagagattgatgtataagatatgcgaagacttcaaatgtgagatcacgaattcaataaccaagcaacgaaacaaaattctctagtcaagatttagctaaatcgttaccaaaattaggcataagtacttgtggaaaaaatgcttacccgcaatgcagatcagctatagatccagagagagatcgagaaaactagcttgtgaattcaaccgacaaaaattaccctttttgcttcgttgccgagaaaataaggaagagattcttgggaaagagaggaggaagaagaaacactaaactaaagcgggtgacggatcagcagtctctatcaaccgttggattagagaacaatcaacggtgaagattgcgtttggtgtaatgtatgtgtcggttagacaagacagcctggttcgtgttgtgggccctactttactgaagtggagccttccaccgacagccgcacaccagcagaacctgatttaaaccaatcggtctacttcgatttttttcatgggttttcggttcatgttatggcccattgggcttttaagtaaggcctttctataaatgtcaattttgccagagtttcctgtctcgtccttgtctttcctctagccactcttcgccactctctttctctctcccttgttttccaacagtaacaatg

SEQ ID NO: 24680 - DNA, 3003 bp, Unknown
  misc_feature (1)..( 3003): 2750-1469P.txt file - cDNA_ID_2183040; gDNA_ID_1972132; Annot_ID_179108
tttatttagctttttctttttttgacattcattagatgaaatggcatcctatccaggggtctagatgcgccattgatcttagtccaggttctggaaatgccagtgtctcctgtcaccgtttggttagattctgttggaatgtgagttttttttagcttgaatccttttgttttgaaaccattttctattactatatattgaatcttagcttcagtgcagagaagacgctcacagtcctgtggactgtaaaactgctgcaaaatggttagcaatacacgtttctgatatccaaaacccggaacgtcggtatatttcccatttatgaaatgattcagtctttttggattatgattttaggctactagaaaatgcggtgccttgtcccaagtgtaagctaaggatcccacgaaatcaagataattcactgaagatgaaatgcttaccttgtaactatgttttctgttggtaatatacttgttcttctagctactattagctcttatgatcttgtggttaattagtatgatcttactagtatgctctttcatgaaatgtcctctgcaggttctgccatgtcgactggattgaagacatggaaggaactggtggtgatttacacttttgtaccttcgatgctgtcttggtactttatcagctgatgatatttattgaaaagtttcttttttattgatctttcatgtaccttaattttctgatgtttttgtagagtgatcaacgtgggaaaatgtcagaatctgattcaaatagatacgaagattgttatgaaaattgggacagtaatgaattggtatatatgcatttatttatgaacttcaaatccattatttacctatgaaaaatgcattgatttcttttgagtttgtttttgggcagttgatgcaaaaggaacaagcaaacctgccaaaactagatactattgtaagataaatctatattgtcttttgtttcaatctctgtagattaaagttgaatcatcttttttttaataatctattttccagattcaggaactaagtaacacacagttagaaaacgtatcgcagcttaagttcatcctagaagctggacttcaggttagcaaaagtcaaactagtgtgagaaatatcttatgttttgagttttggtttccgacataacttaggtgatgactgatgcatatatacatgatacagatcatagaatgtagaagggtcctggaatggacttatgtttatggatattaccttagagaggatgaggtcgggaagcaaaatttattgaaggatacgcaaggtatgtaacttttgtatatgtatatgcataaaacacagagaggttaattttaaggtaacatatttttgttaatcagagaggttgaagaagtttgtggaaaatctcaaacactgtttggagactaatctgcagccgtttcgttacgaggaggaaccgtcaaaggatttcaatgccttccgcatcaagttaaccgaactaactaggtttgatattccattgtttcttgtaattttaacaagatccaacaattaaaccctaaaaccaatcaacttttttatttatttatttctttctttcataatagcctaacgcggaaccactatgagaatgtggtaaaagatgtagagaatggcttagctagtgttgtctctgagggggaagcaagtggttcaggccgtaatcaataatcatgatgattaaatcgagtctaattgttgagttccaatttactaccgataaattggtttaattgcaaattgcagtttaggctggaatattggatatatattaattttataaaaaaaaacgagaatgttctctttttttaatgtttgaaattactgttgtaaaaatgtttgaattgactaattataaaagaaaatattgggtgtgagttatgtactctgttttctaggtttcaaacattaatatattatacataatataagaaaagtagatcatttttataatcttgctaggtttgagccaaaaacgttgtaattcatgcataattaatatatatcaatggtacacattcgttgcatttagattgattcttgttccctatattatatgttactcgaaattgtgaatttgataagaattttgtgttgctcgtttgtttgtgtgattcatctacttagaagtctattgaagctgatggtgccaatatgacatcggtccggaattgcaaaccctattaaatactcaactcgaggaagtcttcatttttttgagatgtttaatttggggtttaccattctttcaacattttgacaaatcaaatccgtcacatctaaaactatctcattaactagaagataaaacaccaaaatgcaacacgtaactcttttaatcatttaaaaacaatatactatagttgaattctacatgaaatcattttcagttcaattttggcttcatggtgcttaaacattgattttcctagatttactttacgttgaagaactaattatttttgtttttaatatcacgtgggtgacttctcaaagaaaatgtcaaaaatctttgtaagaaataaacaaaatttctttttttaagaaaaatatcatagactttacttttatagaatttccattgttcttaaaatcgattactttgttctttttttgggtccaaactttaaattgattacactaatagtattaaacttttttttgttggttactaaaaatcaattgaaaccgatagtggcaaaagtccatatatctttctctcatctactcgatttctgaatcgcgaacgcagcgagcgatccggaatcgagagagagagctaccaatttttccaacttgttcggttccttataaagctgtttactttcccttgcgaattctctctctctctactataaagcaatacccttttctttcttttttggtaacccccaaaccctactttgtccagcgagaaaggaagaggggtttcgtctgattccgctaaatctctagtctttatctaaagatcatg

SEQ ID NO: 24681 - DNA, 3003 bp, Unknown
  misc_feature (1)..( 3003): 2750-1469P.txt file - cDNA_ID_2183052; gDNA_ID_1972132; Annot_ID_179111
atgtatgctgctactactctatcatctgccaaatcaatctctgcagaatccctaaatcttcgttccgattccaattcaggtctactccgaatttgtgggaattttctactgatggaacttagctttctaactggtcgagttgttgattagatgcttttttttttttttttttttttgaatcagaggcagcgcatggtgcttctgagtctgagactcgagtctctttaaggaagaagaggataaagcaggatgatttggagcctgtaaagaaatgttccgccagagaaaccaaggcccgcaaggtaatatataatagggtttttggaaatttcaagtcttgcgtcgagtatgataatttttgagatttataggcaatttgttgatccctttgcttgagaaaagttactgctttttatgttcttaactaatcagattttaaagatgtgtattatatgatcctcttggtcttttgtttatgtaatgcaggacatgtgtggattacctgatatagaagactctccttataagaagactaatggaactgcttcatctagtaagtctcactatctatagttattagtgactgagccaaaacttgttctcactactcttcaactaacaccatgattacttgtatgaaattgttttgcagggacgagaaaactaaactcatacataaaatcaacagaagctagcccttctgcatcgtcgatcaaaacagcaggttttctttcacgagactctactctactactcttagtggcattttgggtacatttattctttacggaaaacgcgatgtccctaagatgtttatttagggctaggcataccacctgaaaactgggaaaaggtgctcgagggtattcgaaaaatgaaaccttcagaagaagcaccagttaatgctgtagaatgtgatagaaccggaagctttttacctccaaaggtagaaatatcttacactaaatggaattgaggtattgctgagtttgtgcctattggttttatgtggaagtatacaatgagatagtttcattgctttctcaaatattacttcccatttgcttttcattattacatggtagtactctatgcatatattgggaaccaagttccaagtggtttaccgtgaattagtaacaaatgctagcttatgattagaaaattttcatattctgaattcttgcttccttgaaaggtcgatggaaggtttcccttcttgtttttccttttgatcttatctctccctatttctaggaaaggcgattttatgtgctcataggaacacttctttcaagtcagactaaagagcacataactggtggtgagatttgaattacttatctctccctatgttgcaagaacgcttaatttcagcattctagtatctctgatttcatctggatctccaagtttcctgatattatattcaaacacttataatatgcagcggcagtagaacgacttcatcaaaatggccttctcactcctgaagccattgacaaagccgatgaatcaaccattaaggaattgatctatccggtacattatccctttttaatcttacttcatgttgttaagggctctttgactctgctatgcccccagctgccatatttttcatgagaagtatttaagaaattaaaaggaaaggagtgagaaactataaatagaaattgttgttatcgttttaatttcgataagaaacttactgtttcccctttacttttaggttggattctatactagaaaggctactaatgtgaagaaagttgcaaaaatatgtctaatggaatatgacggtgacattccaaggactttggaagaactactttcacttccaggagttggtcctaagattgctcatctggtataagttgcccatattattccgctttgtaagagagatacatgttttcaaagttcttaaaaggtttctttgatgtactgcgataggttttgcatgtagcctggaatgatgttcaagggatatgtgtagacacacatgtgcatcgtatttgcaatagacttggttgggtgtctaaacctggaacgaaacaggtgcttctctaacaccaggtttatgttgaagtatatatggctatgagattgatttcttaacacttggtaaaatttggttcttctttagtttgcttatctgctcttggtcacctatctctactttgttcttgaccagaaaacctcgtcccctgaggaaactagagtagctctgcaacaatggcttccaaaaggagaatgggtggctataaactttctgttggtgcgtcatcctgggatatcctaacttatagatgcatgaccatacatagaacaatctacttacactccacttaatcttcgtcctcacatttttgttgtctgaaatctcatcaggtaggttttggacaaacgatatgcacaccgctaagaccacactgtggaacttgtagtattactgagatttgcccttctgccttcaaggagaccccgagcacatcatccaaattgaagaaatctatcaaaagcaagaagctttagttgctttggctctggattctccttctagatcattgttaaacccattttttgattagtcctcggttaaagttaaattgtatccaagatattgtatagctttatggggaatgcaagagcatcccacttgtgtgtaaaactaaaacttatagaatggaaacttacccttatgaaagacactgggcaagtacacttttaactgaatattatgaaaaaacttaaaagatgattcaagaaccttttaaagtgtttccactaaaagcaagtgatttggattttggagtcatccaccttgtaatctatctaatttgttatcaaacattaaaatttttgaattccccttatatagaattaacagaaatttctttctttggtcaaactaaaattaactgatattctatgtaaagactaaaaagattatcaacaaattgaattttgcaagacggaagaatccttactgatgtgatg

SEQ ID NO: 24682 - DNA, 3000 bp, Unknown; identical to SEQ ID NO: 15022
  misc_feature (1)..( 3000): 2750-1469P.txt file - cDNA_ID_2183105; gDNA_ID_2684254; Annot_ID_138075

SEQ ID NO: 24683 - DNA, 3000 bp, Unknown
  misc_feature (1)..( 3000): 2750-1469P.txt file - cDNA_ID_2183167; gDNA_ID_1972137; Annot_ID_179163
aactcagaaccacaaaaaaacgcagaatctactaaccaaagtttatcttaacgagtactataggaacccctagaagccgaacaatgtacacgatacaaggaatctgtcaatacatttatatattccagcgccgtggagcctgagagagaaatgtcacagtgttttcatccgcttgtgagaatgttcagattcttcctcaacgcttgaatcccttccttgcgtatcatatgataatggattctgtatagaaaaatgtatcaacatcatgatatatggctattgttacaaaactaagtatgaagcatttcgaaccaactatttaccttacttgatggctcttcatgagttagaccttgattggctcgcttcccaagatcgatctgcacagaaagctttgcttgcgacagatcaatgcctgcattctggagtgcttgtgttaatgagctcaataacctggccatttcagaattaatgtctcacaagattagtacacaatgcagttaaaaaaaaagggtagaagcgaacacatcaatggcagcacagtaacagaaacgaggaagacttagaagatcagactcactcatgcgagtaggcactagagatgctaatggttccaccttcaataaccaggtcattactttggcctagcccatcactagttgcaggacattcattagcttgttcgccttgtaccattggaagaattggttgtagtggtggtaatcctttgtcgtctaactcaggttgactttcaatcgatatgccggttatagctcttgctttgtcagattcaatcgggatttgcggttctgcaataattgcaggtgtcgaagtcacagtgttgtcttcaaactttccaggaaaaggtatccctggaccagatccattatttatagctactgggtggttccccaaactttgaactcgccaatgattattcctctgttccaatcaagaaaacataaccttcagctaaaagtcacacaaagaaagccttgcgggtgcaaaaacatactcagaatctacaatcacagaaactcattgagaaaccgacataagaagaagctcaaaactttacccatggcgtcaactttgttggttcctgactccaacctggatacgatccttcatacttttgcaccttctcttgtaaatactgaacataatctatcacctagaatggaatagcggtattaagctaacaacatctaaaagacaggatattcgcacaaagcatcatcaaataccatgacatacctctaaaaggaatgaagcagtgtcacgtttttgttcactgttgggaattagttctctcaatatctgaaatctgagaagagatttatgaattcagcactcagaacaagaacaataattataatgtaactaagtcctatatcaaacaccacaaaactgaagcagagcaaaattcccaaacacaagtcctaagtattcttatgattttgttagcaaagtaattgaattttgattcagatatcaaaacaaagaatgtcgcgtttactcctaatctcaagttctcacaaaaacaacaatccaaaaagtttgaaatcctcactttatatcaacatacctttcattgattttgcttcttctacgttgctcagtgaccgaatgtttagaacgtatcgcactagctttatcattttcctttgaatctgctttcaaaatcaaacaccgaatcacacagagacaaaacttagaaaaatctaatcccaaactattcaaatccatctcgatacatatcaacaatagctccaaccaaaacacaaattgacgaaacaacaactaagaaaaattcaaaagtctcccaaatcgaacaatttacctctgttgctatgaacagtagtgttggaagaaggaccttcacgtttagagttaaagtcttcttctccgtaatcttcttcctcttgatttccttttccggttctcatcttcgccggagaatttcgactgtttattgttttattttcaacttttgccgtcgacgagctcttttttgttgcttatttgttttttgttttttgggtgcctcgtgactcggctgagttctagttagctgtgggagagactacgtgagtttacttgagcttttgtccgtcagtttcgtgatttggagacgtgtacgacttgatgtgattacccggttaggcctctaaatgaaccgtagcttgtgatgacacgtgggattcacgtgataagacgagattctaacctatcagatttaaggtggtcacgtgatgcacgtggtctctttctgatctgttaattttcacgtactatgtttgtttctaatcgaacggtgacatatggctatgtttccaaaacaatactataaagggccgaatggaattatcagacttgggccaaacccaaactttacaaaggaaaaaaagaagtaacatatgcctatgtttccaaaacaatactataccttattcgaatttatcagacatgggctaagcccaaaagttacaaaaaaaaaaaaaagagtaacaatactatcagagccaggtttcgatcctgggacctgtgggttatgggcccaccacgcttccgctgcgccactctgatttgttgttgtaatgttaattaggtatatatttatcatggtaatgtataactcgtgccagaatatgggctttgagcccaaataagagcgtaacggatctgataagcgggtcgggtttgacaagatccatgaaatgtgaagcagaaaccaaaggttttatgaagggtttatttcggcggctgtgtttgtacttcacggcgccttctcttttctccagatctctcttctcttcacccaagtcttgtttttaatctgttcttcgaatctgaactctttgatttctatgtttgtattaataactctacaaaatcaagtagctacatagcccgagattgtgctcgtggaggcagtaaactatctgaagcagccactattaccatttcgtggcgatcacaaaaacgattcaaaaaatg

SEQ ID NO: 24684 - DNA, 3000 bp, Unknown
  misc_feature (1)..( 3000): 2750-1469P.txt file - cDNA_ID_2183171; gDNA_ID_1972137; Annot_ID_179165
ggtccacgtacctatcagcctcacccacaggccactttatttaacctcgattcaactttatttagtctatacttgtgtctatagtaggttaattcattattacgattacacgaattaacatgatattatcaatacaaataataatatagtttggcgaaggagtggtcccgtcgggggcagagagtggtctctggctgcatacaaagatttgagttcgacaacaccccaaccatatattctttcgtacctatcactctccatcgatctatctcttcttctttttttccccaaaccatattatttctttttatggtctttttgctgaaaatcataactagttttgttcttcttgttgttctcctgctcaaatatagtaaaagcgtactatagttattggcaaaaacagttgtttcgttttctattgtactgtagaagattcacaaataccatgtgttagcaaatttgaggtctagttgtgctggttttatcgattatttggcgttcctagtaccaaaatctgcaacacaatatagttatcataagattattgtagtggatataaaatgttgttatgatgtaagtctaaacctaactttaaaaataaaaattggtagagttatggacttaattatggtgtcaagtatttcacactttcactttgtttcaaacacttattttatgtgaatacttcttttcttaaacttgaaacatttcatatttaaaattataacccatattttcaaacgaaaacaaaattatccattggccaataggaaactaggaatggtgcgaccaataaactcttaaaagtcaaacacctctgcgtgactcagaagtttccctccgcgtttgccgtaacgttacctttaatttcgtcagtaacgcaaaaataacagatccgaaagaaaaaaaatcaacacaccgagaaaaaaatggaagatctatggaagagagcgaaatcgtttgcagaagaagcagcgaagaaatcacaaaccataacactacaatcatcttcaacaacattcgtcaatctcgtcaccgaaaccgctaaaaaatccaaagagttcgctctcgaagcttctaagaaagctgattcgatcaatgtctccgagttcgtcgccgagacggcgaagaagtcaaaggaattcgctgctgaggtttcaacgaaagcggatcagctcaaagtcgtagcattgaaacaagctgatcagatccagaatataaaatcgattgccgacattatacctggaggattaggaggatcaggatctggtggtggtggttctgagatttctgaatctgagcttgttagttttggtattactgatgatttgagagagtttgttaaaggtttgacatctgctacgttccaggcttttcctgaacaaggtattgttgttttgttgttgttgttgctttatctttgttttggaattgaggatttgaaatgtgttatggtaaatgtggattagatgaatcgtcggaagtttctgatttggaaacaagtgcgtcgaatgttcggaaggatctttctgagtggcaggagagacatgccactcttgttcttggttctgtcaaggtagatttttcgaatttgagattggaattagtttgattagttggagaagctgatcttgcataattggtttagttatagattcatctcttctgtgctacattgtttgattttgcattttgtgtatgttgcagcaaatttcgaagttgagatatgaactatgcccacgagttatgaaagaaaggaggttctggaggatatactttaccttagtgagcactcatgttgcaccgtaaggatctaccatctcttctcaaagtctgaaaatgttatcgacactagactgagaattgcattaagcgcataggaggtggtaaagatagcttaagatctctatatttgtatgactaggtagtctcatagcttaatcactgcagcttaagtttggtaaaatgaaaccatacgtaattatatgggaaatggattataccttatcagcacggatttgatccagagacagtcttagtgaattctcttgtggctgcaaatcatctattctgcctctagcttggtccagtatatctcggaaaaccatgtaactcacaaatgagaatataaaaaacaaaggaacatgactgaaaacatatagaagatcttgacaccttagttgtttgtgtatttctgagaagtgattagtgaattgagcacccttgtctttcattcttatgagacttgatagctgcatgaattaagcggaaaggatttgttttgaatcagatatgaaaggaagtacatggaggaacttaggaacaaagcagagagtaaagatgaagaagctaagaagagtccagggcttggaaggacagaatcagctgaaaagaacagaatatctactgcatcgtctgagcaagatctcgatacattcctgctgggagatctagaagacagtgacgaagctcctggtgagacaccttgacttgatgtagcttcccaagttttagctatgacttaaatcctgattttgtctgtataatcgtaaaacttgcagatgatggtgatggtgatgatggaggaagcctgggtgatgatgactttgacaagattggcaactctgtaagtgaaaacgtttgattattctctcagttctttaaaacatacaacaacagaacatcttggtttaatccaaatctgccttcacgtgtttgcaggatgttgaggaagagaaagaatcaaatgcagcaaaaaattagaaatattattaagttttgttacatacccaattgttgggaagtaaatgaggatggtatatgatctgtttcatcatcagtgattcagtgtatagcttttgatgcaaaagatgaagacacattttattcattcgaattcgcaaattataaaaaaacagactttgattacaaaattatcctaaaaagcgaaactttgacataaatattagtcgctggagaggttaaagtttgctaatg

SEQ ID NO: 24685 - DNA, 3000 bp, Unknown
  misc_feature (1)..( 3000): 2750-1469P.txt file - cDNA_ID_2183240; gDNA_ID_2926139; Annot_ID_197346
cgaacaatcttttaaaacacaaacacctttcttggtaagatccagaattctcccaggagttcctaccagtaaatgaacaggctgatacaaacgcatgatatcgtctttcagactggtgccaccagtggtcaccatgacttgaatcttcaaatgcttacccagctctttacagacctgtgatgtctgaagggctaactctcgagtcggaacaattataacagctgcgtacaagaaaggtattgacggtaaactaagttagaaaggaagcagtaaacctttaagaaacatattaggctactgatagaagcaatgggtttagaggctcaaaggattcattacgatttacattcactaagttttatacagtaactagtgtttattgtggatcaataatctatttacgacgccagctttggtattctgttcttattagctatgaaaaatcactagctagacgatgtcaaaacttcagattctttaatagcattgcaccacgtgaaagaatcaactaacaacatggtccagtacacagttaccttgaataacgttgttatcttggtcaattttttccaagacaggaatacaaaaggcggcggtctttccagtcccgttctttgctctggcaaggatatctctaccagttaaggcaattggaatactctcttcctgaataggagaaggtctttcaaaacccttctcatatattcccatgagaagctcccgtttcaaaaagtaatcttcaaactcgttccctttggtggctgtcacatcctaaatatgataacaagtaacgaattgtgaacatctcatcccatgcaaccaagaatcaattcagtttcacaaatagattctcacgcagtttaagtattgagaaacaaatttaacaagtatttaggtattacgcttaagaacacctttaagtcacaccaatatagcacacgaaacagcaaaaataaagagtgaatgcatcctaatttactctatttcgtcaaaatatggaacattacctctgttctgtatcgagtatcaggtgcaggtagttttagccttgctttccaatcttccgagctgaagagaaattagattgtaaaggttatcaaacgcacaaaagtgaaaccaacactaagcagttcaataccatggtaacgtaagaaacaaggaattatcacttcaaatgaaaataatcacatcccagatttaactaagtagtccaagcttgaacagcactcactttgggtcgataacttcggattgaacagttttctcaacttctacaacagcgtcaccgttactgttaccgccggggatctgacctcttcgaagccattgttgttgttgctgctgttgctgttggtattgatgcggctgagacggcgcttgttgaaactgttgttggtgattctgagcgtaattaccgcgttgaacgtattggggcggcggatgttgttgataacccgaccgtgattggtaattagggttagggttaaaggctccacggccagcgccaattccaggagggtaccttcctcgattgttcatcacaaacctctaaacactaataaccaaaaactctgactaaggaagggatctgtacaccaagaataccaaaaaggaactagggttttctacggtaatacacaacctagggtaatgtcggaattttgaaaaaaaaatctcggtttagttacagagaaaaaaataaactcttccggagaaatctagggtttgaaaaatcacaaaatcggagatagagagtagcagatctgggagtttataatccaaaatgaagcgaaattctgggattgatatttttcgaaaaaggtccacgcgaggaagaaagcgagacagagagagatcaaaagggtcaataatatagagacgaagccagagttctcgcgtgagacagagagacagagagacagaaagatgattatctctatgtaatattataatgtttgtgatttcgtcggatttcgttagcggtattgggcttgggcttgagccttgtggtaattaaaacggagttttaagttttcatttctttctttctgaaatttataaaattacacattacttccttttccttacatatttaccctaacttaattaaagttttcagtctgaccccaaaaatctatctttcagcttctaaagctgtttttagctcaagattaacgctatgcaagatgttacaaacaccacctggtcgtcatagagtatccatccaatttcagagtatttctctaatgtttttatacttcatcagaattgcacttgatccatctatgcactggatttgtgacaagtgatgacatcttcctcgtttgctgtgtcatctgcttttattcattatacctgattatgtctcaaatatgattcttcaaacactaccaaaattatatgttgagtattcaatatgcgaccgagattatggaatttcaaactttcacaattaataggtttctactttcacacaaattaggcctagtttatttcatcagttaacatttacatccaaattttttatagcgactacatatctaccaatatgttatgattattgaaataatttgaataataaagagaaaataatttgaccaaaagtaagcataaattaagcaaaaaataagtaaaatacgtctatataatagaaaagttcactttcgatctacgatgtctacatcaacatccaagtcatcatattgtggcctgcctaaattttatttattgaaatcaaaacattacagctaaaattaattcacacattaaataaaacaataattgacaaaattaaattaaatattataaaaaattaaaaaataaatacacaacataaactatgaaattttttatatcagtgttaagaaaattaaaatagattgaacaaaaaaaataaagtgaacaaaaaactatcataaacatcacaaataaaaataaaaattctatgaatacgtaggctttttacagtctctcgaccgacacgtcgacattcacagaatg

SEQ ID NO: 24686 - DNA, 3000 bp, Unknown; identical to SEQ ID NO: 24685
  misc_feature (1)..( 3000): 2750-1469P.txt file - cDNA_ID_2183240; gDNA_ID_1972140; Annot_ID_179265

SEQ ID NO: 24687 - DNA, 3003 bp, Unknown
  misc_feature (1)..( 3003): 2750-1469P.txt file - cDNA_ID_2183253; gDNA_ID_1972140; Annot_ID_179271
tcttcttcttccttaaacacacatctctctacacttcattttctcacctttctcttctgatttcacttgtacacgattaagcaaagattcaatttccaacattgacgtttctctcgagtgggtgaagtagaagaaagttatgtttaaaccctaaaatatttttttcctgagaagtcgatctctaatggctcttgtacccaagattcgcaatcgcaccatctcggacaaaccagtctcttcgtcttgtactagaacatcgagtttcagacaaagacttctcgccagttgcaaacgatttctcaggttcaaattgttggttcgtgcttcttcagtgtcattaaaaaagaaagcagcaaggtgttcacaatctcaacaagttgttaaacataatgatgataggattgaggaacattcttctagtaatcggggttttaaagatggcaacaatttcttagtatcatcaacagaaacgaagaagcttgttgcggtactgattctaattaatatattgtatcaatgtttgtggatgcaatgcaagattgttctgtttcattgatttagtaagagagctcttgtattgatttctgttgaagttttgtggtgaacctttccaaccactcaacgaggaggaagtagctctagtcaatagtgccttgtctaagagaaacaggttttttttctttctttcagaattagcttatcatgtgatttgacttgattgagaatttaaccacttgtgttgctttgctatctcagaaagaagattttggtttcgcataaaaactccaatattgacatctctggagaaactttacaatgcctaaggccgaatcaatggcttaacgatgatgtaggttaagtcaagagttccttatgtgttttgtttgcaggaatcgtgttttattttcttctttgttttatatttataggtcactaatctctatctggagttgctgaaagagagacaaactagagatccgcaaaagtacttcaagtgtcatttcttcaataccttcttttacgttaaggtttgctttctcttttacttgttaaaaatagatttcaaaggtctatgtttcctcatgccatgacttactttacacattttcagctcgtaagcggctccggttacaattacaaagctgtcagtagatggactaccaagagaaagcttggatatgatcttattgactgtgacatagtgaggtttcctctttttgtcagaagtatatgtatagtccaatttgattgatgatgaacttgtgcagatatttgttccaatccacatagatatacattggaccctgggagtgattaacaatagggaacgcaagttcgtgtatcttgattcattatttactggagttggtcatacaattttgaatgctatggtataacttcttcatcatagaactctctgtccatttgcattttggagattatggaaccagtgttattgttttaggcaaagtacttggtggatgaagtaaaacaaaagagtcaaaagaatattgacgttagttcatggggaatggaatacgttgaagaacgtcctcagcaacagaacgggtacgtaattctcattttgctatgttattgatctcacttgacactagtctgttcgaataattcgcaggtacgactgtgggatgtttatgcttaaatacattgatttttacagtagaggattgagtctacaatttagccaggtaataagagatgtcatcaaggtctgtgtttgcttatgaatctgtaccaatactgttgcattttgaaatcgagaaatatcaaattcctatccggttcaaactagaagaaacattacttaagcacatgagacattattggtcatggaattaaagtaggtgttggtgaaacatgtattaagagggatactataaaatatgttcatttcgtctttaattctatcgtttgcagaaagacatgccgtacttcaggttaagaacagctaaggagatactgagactgcgagctgactaatagtgcccccatcttggtgacataaccttgctattttacaaagccgattcatattagtttagcagccttatttgcttgggctgtggagaatgctagatatcttcgttgctttcttgaaatatttgtttgattttttcttatctagaagaagttgttgataagcttttagaattctgttttattgtttagtgaaggaataatcttcaattttgtaccctggcctgaggaataattttaagtttggtggaaaattgcagattgttatgcaactcttagtctataccataagataacctcatgaatgaatgtggtaatagtggttgcagagcgtgtaattacaactgctttgtgttctgttgtttagtggaaatatgaatctccattttggcttgagtaattgcatattttgtgatgtatccatctctctaagtctctagactaacctgaggtgacaaacgcagcgatagagtcgctggataaaatgcgtaaaggaagtaagaaagcagcactgcagatggttgacatggaatgcagttacctcactgttgatttacaactcttatgcattgtgtttggtggataatgcatatcaaacgtgcagagagtactgatcagtttacaactcttaaccggaaactgagattctcggttcggtttaaccggtttctaccgaattcacaggactacaaatattttaagttaggtaagggaaaccaaaagtccacatgtttctgatccacgtcagcatgaaattctaaacgacgtttcagcgtaattcatcttctcttgtataacacttccgattctaattagggtttatcgtttgcatcgctcttgccactacctccggagtctgtttcatttgtttaaggtgagtgaccacattgattttagaatgattatatatgtatggtttgaattcttgcttacctcttgttagctaaggttttatcttaaccattaatttagtaatataggattcttgttttcaaacagtgaatg

SEQ ID NO: 24688 - DNA, 3000 bp, Unknown; identical to SEQ ID NO: 9522
  misc_feature (1)..( 3000): 2750-1469P.txt file - cDNA_ID_2183269; gDNA_ID_1972139; Annot_ID_179207

SEQ ID NO: 24689 - DNA, 3003 bp, Unknown
  misc_feature (1)..( 3003): 2750-1469P.txt file - cDNA_ID_2183284; gDNA_ID_1972139; Annot_ID_179211
ttatttaaaaccttttaatatagatcgatcctttgtttattttcagagttcaaaattttactctgaatttaatcaaagagaatgtattatatttgaatatagacaaatcataaattcaatgatgctaaatcataaattaggtttatgtggacacatcatcttcttctttttttggatcaaagggtgacatatcttttggtaagacgtaaatacttaatgtgtctttcttgatgatgttaatttctgtaaaacctcgtaccgtacacattgatgaaaatagtgagatcttgaaaatagagaggtcgaaaccaccacactacactagaccgtcttggagttactatagctacatctttgactttcattgttctttgcacgcaacttatccaaatcaacacatgttatcaggaaacgcggattctgtatttctcatgtgttacaaaagcgaaaagaatatatattttgaaaagttcatattataccaatttgacatcaaacaatttaataaatttgtgaataatttaagaatattcaatatattatgctgctgcagttgaaacctatacacaatatgaatttttaaagggggaaataaaagacaatctttaaagttgtaactcttaattagttgagcaatttttttttatccgggtatgattttgggatatccctatatatcggtttgtttgaatttgaaattatttttctttgtttaaacatggataaactgtaattacgatatattttttttgttttttcttaaactacaactaagatctatttggttttaatgttttataaattgagtctttgttttctttctagaaaaaagttatgaatcagtcgtagttaaaagaaaaatgtatagacaaacacacaaaaactataagatgaagaaatttcaaagatgtttactttccggaaaatttgacgctacaaaaagtgagaaagaaggtgagtcgtcgtcactctgagttggtagcaaagacgcggaagtttggaagtatctagggtttattaagtcatacataaagtaaatcataaataaagttaactcgtaattgagattttgtttaattactttttccacaactctcggtaaactgtattgttctcttctaataagtcttgggaatcagagccagattgttttttttccataatataatagtataatctctgtggaaactataaaaagtagcagtacaccatagactatgaaatttcaaattcattcatcctgttaagggctcaactagttaagtaataataattacactccaaatctgtaagtactaaattttgtaacaactcctaaattacacatacgattttatgtatggattacacatctattaatacgaaccatgaaaacatttcacaagaaagttttgattttaatttatatatcaaattggtatacgatgtatatcgtattttgttgttgtttgtttacgtcatgtatatctcatacttaccaaattaaatattgtttcggtcaatcataatggaaagtgtaaaaactattatttgaatctgaagatattcttatttcaaatatttgtcgtttttgctcgacgacgaactgacgtacatgttttgatcttacagaaaagaaaatggcgaccatcgaaattccgaaaagattccctaggttacggtccaaactcaagttaggacgtggaacatttgagatttgtaatgatttaccggccttgactgttaatagatatacatagacattgaaagggataacatgaacttctgacttaatttcacaataagttaaaccatgactgacattttggtgcttataatagtcaactcaaagacatatccatagatatgatacatttaacctgttagtcaagatttacaattgaaatagaattatttgtaagtttttaggaatgtacttatatattgatattgtcaaatgttaaagtatgtgcaaatatatcttgacccagtcgtaattataattaatgaaacacgaaccgggtacgtttgtgtgtgtgtgtatccaatatcacaatgtatagaccatataaactaaaattattgcatatcatagacttcgctctcacatcggatagagactgtttataaggtatctaatacaattaagaaggcaaaatcgctaaatacacaacaatttgtggtgaaatatataataaaatattttacataattttggtggcaagaaaataaataactgatccgttagttatgatattatccatgaagggttttgaatatattttatgtggtgaggttgaagtatgaaaccccataaaaaataggggagattgaagatagaaggtaatggctgaacctcattataaagtgttgattggaatttggaacacaacttagaacatacagtatatagttattgctgatatattccacacgtcttggttttggaagatatatgaagtctagactacaatatgatttttggaaaatttaaaattttatagaacatgaagtcaaaatagactatgattttttcaactacataagcaagagaacaaaaaaaaggagggatttaaattccaactcatgtctagagaaaaaaaaatcaactacttggtaccattgtgtcccactatttactattttagcaacggtacagatcaggcaatcaggacacactttcctggactctcttgtagtcttgtccctttgaatctcctaccgacccccaaaaaaaaaaaaaagtcttatttaattatttaataatcatttattttgtgtatatgtttattattattagcatatgcatcccgaatttgaccgtcatgcatgccgtaatctaagaaaaggataatcaaatttgagcacgttcatttcgaatatatatatagacgccaaacatagagactaaacctcatcaaaccacagctgttcaattcctatcccacacaaaaaaaaaaaaaacacgcacacaaaaacaagagctgtgagtttgatcaatctcttcaaaaagtgtaacacatg

SEQ ID NO: 24690 - DNA, 3003 bp, Unknown
  misc_feature (1)..( 3003): 2750-1469P.txt file - cDNA_ID_2183297; gDNA_ID_1972139; Annot_ID_179216
cttgatttgacaatctctgcatttaatgaagtatggatcttgagattcgtcccattcaacttcaaatccaaatctagtgaagaaatcttgaagaaaaccaagaagatctccttgacagccttgttcagataacgacccgtgggttgattcacaaccgtggaggatccgacccggattctttaggagtttacagtcccaaggacaacgagaacagttggggagagtaaaaggagagcaaggacggagaagagagagacgagagcaagaagagtcagagactctgaaaggtgaaccggttaagtcgatgaaccggtttggtgaggaggagaaccggagagaagaacagttgtttgtgttccggttagtgtttgtaatgggagagagggttagagaagaggagattgatgagtaatggaggatagagaaagtgaggtttttgattgtgatggtggcgcgtgaagatgagcattggatctggaagtttgggtggccacatcccggagaagctgagaaagggtacggtggtgaggagttgaacggtgggcaatgaaatgaagaagaacatgaagtagatgcagaggaaggtttagtactaaaaatggtgagaacaaagatgagtagagagaaacatctccacggtggttgagacatgtaaaagagaaaggaagagatctgattctaaatctgttgactgaactttttcgatgtggacagtgttgtgaggaagatgaagaagaagaggcacgtgaaggtttaggaacttgaaactgaagagtttcgattttattctataataactctttgttactgattttttaaaaaaaaattggttttcgactctccctaggcagtgagtgatactcgacctaaaaacaattattttttctgatttaaaaaagagtatatgaatgagagtaagaacaatatttttgcactccttgaaattaaggaaattgagaaagtatatgaatgtgagtaaagagcaaatgggaatatagaagcaaaaagaaaagtcaaaaagtgacgacagacattgtagacaaatggaaaaaaatagttcagattaaagtgaaagctttattttgtcaataatggaaatggatgcttatatcagtctttgaattattactagaaaatctaaggaacttctacttttaacaattttatgcagaaatggttggtgaagaagcagaagagccaaagatcaacaactctataatcaaattaaactcaactcgtttgaagggtgttttgagtggccttaatctgttttagtggagtaaaatgataaagagcttttgagtaatagaatatttaaaccaagtttttcttcatctgtttgggtcgatgggtggttgaatttttttttttatgtttaacacattatgggtcatgaagttgcctatgggatagtttgagtaagctcattgacctactagaactcgttatacgcactttatttttcgatatgaaaatcctgcggaatcacattttaatgttaaaccgtaaaatcacgtttgaaccatcgaataatgttttgtgctaattttccatcaaattacagaatcttgttttgacatcaaaactgtttattttctatattgtttttaaaaagtgacttgttttacctctagtttttttttcataaacttacaaacaaacagttttggattgaatactgcatggagatccaaaaattaaattaagaaagtaatctttgatgctacatctgaatgttacataacttacatacttacatcttgttgcatatcaggatgaagaaacaaacaaacatattcattaggatactcacatctcttggcttgatctgcaggtcctgctcattggtcgtatacattaatgaaaaacaaattatagcttaatttgttcacatatgagttttgtccttcaaacataaagattgcaacaaaaatctaaggaacaatgatacagccgttgatttggagcctttcctccagtcatgattcaaaaaaaagggccaattaatgcgatgcgatgcgacccaataaagctgaccttttttggtgtctcactctttaataatgtctctgtgattaagtttctccatttaatcatgagacttttgaaacttcaaattatgctttgggcttgtaccgtttgaaaaaatcgtattattgggccttcatttcgacccatagaaatctatgattgattttgttgaacagcaatataggcccatgtctagtgctaccgcgtatatgcactatccaagttttgaagcttgtttgcacacccaaaaataaatgaataaataaacaagaagattatgaaatagtataatatatcagattttagatttatttaatagacagtaattgataaaagtcatagtattttctatacttttttcttcttaaccttttatttatttttaagtttgcttatattgatactcttaactcttaagttaaaagcgtgttctacttaattataagagattttatactattaaaaaaaataatattagcaagcactgaaattattgccattaattttataatcttttttttggattccattattatatgaaacttacaaaacaaaatctataaatctaccttttaccccaaaatatagtcattgatctactaaatttttaaaagaacaaaaaagggttgactttttttgatatagaaatatcacaaattacaactagcttcataaaaaagacaaaaaaaatgtatcttgctgtgacatctggaccaagtcagggaggagactaatgatatacagcctggaaattaattttgacaaaatcatccatttattagagtaacaatataattgaattgaaataactaagaaaacacatatgtcacctaacaaaatctacgcgcaacatttcagtttaatgaaattgtaatacttggagaacaaatagtagactagaaaatattgtataaatagttagacaatcataacaaaatctcaccgtgtccttaacgaagaagaagaagaatg

SEQ ID NO: 24691 - DNA, 3003 bp, Unknown
  misc_feature (1)..( 3003): 2750-1469P.txt file - cDNA_ID_2183301; gDNA_ID_1972139; Annot_ID_179217
caatcaaagaagagtcaacggttaaactcatgtcgtggaacgagaaatatttacgtgggaacggaggagctccgccgtggaggaactctgtgacgtgtgatcgtgagccgcacatctcagcgacgaagaaatggatcttgtggtctgtggaggttgttgagaatcctgataaggttttgtttgctgatcggttttcatcaccggcttctagttttaactcgtcggtctcctccgacgggtcaaatctcgggtcaccgggtcagaaattgctgacttttggatcttctgaatctatcgggtcggatcctgggtcacttgtatcagtttcttcttcgaaacttatgtttactccgtcaaggtcgggtacattgtccccaaaaccaacagaggtacgcttcaattctaattcatataattttgtcacgcattatcacaacatactatactatataattaaaatattgattttgggggtattttgttttgtaacagaggaaatgttcgaagaagataatagtagaaaatgtatcggcgatggaaatattccgggatgcgaaatcggtgcgtttacgaagctatgcacatcatgggaaatatttgattgctgatgacgatgaagagggtgtgataatgggcaaaaacgggtcatctaaagaggctcgatggagagttgaaatggtaccaggatccgaaaaggcgatccggttaaagagctgccatggtggatacttgacggcgtccaatgagcggtttttgttgggagcgaccgggcataaggtggtgcagtctaggaagattcgtgccgatgagccggcgggagagtgggagccggtgaaagaaggttcaagggtgaagttaaggagcagaaacggcgggaattatttaagagccaatgggggagtgccaccttggaggaattcggttacgcatgatttaccaaaccggagtgctacgcagagttcggtggtttgggacgttgatgtggtcgatattcatgggaccggttgattcattactttaaaacttgtcttgaggctttgacattttgtttgcagcatgaataattttcatattttgataattggttggatgtaattggaaatgcgtttggaatttgtgaaaaaaaaatcagtaaacatagagttgcaacacttggtgtagagggtacttgttctgatttaattttgagagtaatcttagaagagtgtgacttttagacttttagtcctatgtcggaatgagctgtagggtcaatgggcttcaggttattgagatgactagtaagggtcctttgaggtttcttaatgatgatactctacgttttaagtgctcaggtttgttacaaattggtgatgatagcagagaagagagtgtagaggctgtacgaatgtattatatgtttccaaattccacccttaagaatatgtacgttagagtgttcgaatttctctatttgatatagcgtattgtttgtttgagaacgaacaaatgaagtcttatgagtttttcgtatagtttccgttttttgttgttctttcattttcttgttctttcgggtattttgatgtattttgattgttcaaggtttgatatgtagaaatacaaaaaatgatgtcccaaacaaacaaaatgaacatgcaaaattatgtagatgcttcaaaaagatcattaagaatagaagcccccaacctaaacaagatgggtttcaattttttcaagtagagcaagaagcgccaagcctggtgcaaaatatgccattgtacaaatatgtatataaagcatatttaaagcaaaataatgcatgtacaaattacgttaaccaaggaaattaacaatagaaacacaaagagtgtactaattgaaactatctacaaataactaatcgacgtctttttatttgaacgtctttttaattgttatgattagtgaaattatgacattaagtaaggttttcttagttagctaatgtatggctattcaattgttatgttaggctattttagttagtatatgaatttaggcagtctatgcaaatgatttcgttttcattttttcatatgtaaacatcaagatcaagtaacgccattcgagttgatattttttttttaaattagtgtgtgtaaattttggaccgcttatttgagtttgctaatgaagttgcatatatattacgttaaaccataggcaaactaatttgaaacatccgattcgatttcctgtaatttttcttggttaattgaccaaaatcaagatcttcagaaataaaataaaagacgaaagaaagctgtcgcaaagcagattgtgttaaaaaaaagtggattgggctcaaacgcaacttgtccagcccgtgacaattaccctatacgcaagtaagagtaacgtatcactggcaaaagttggtattagttacgatatctttgtcatgggggcatgcatgggcatggcttaagagttaagccttaagaagagtcccacactcgtgactctcatgatcgcttgttgtttcttacgggcaaatacatttaactttattcttcatttattcacctatattcttttggataataacttttctctatataaaataacaaacatcgtacgtttcatttatttacaacaagcgatgagaattaaaaggagaccttaattgatgatactcttcttttctctcggttacaacgggattattacagataatgataatctatatggatgctgacgtggaaaaacaaaatttggtgaaacacgtcaattaagcacgacttttccatggctagtggctaagatcgtttcatcacatggctatatcatataatacttggatgaattcaaaataaacgactgagaaaatgtccacgtcacggcgcaccgctttggacttaagtctcctataataaatacaacaccaaacattgcattccacattaattcgtcttgtgcaaaaaaagacacttcttaagcttcaacaagaaagaaatagtattcgcatagtattagaagatg

SEQ ID NO: 24692 - DNA, 3000 bp, Unknown; identical to SEQ ID NO: 9513
  misc_feature (1)..( 3000): 2750-1469P.txt file - cDNA_ID_2183305; gDNA_ID_1972139; Annot_ID_179218

SEQ ID NO: 24693 - DNA, 3003 bp, Unknown
  misc_feature (1)..( 3003): 2750-1469P.txt file - cDNA_ID_2183321; gDNA_ID_1972139; Annot_ID_179225
agaaaacaggatgatgatttatgttaaattagaagaaactatttattattaaatattttacatcatgaaaggagataacacctcgagtaattacaattagttttgagttaaacttcttttaactattcttaaaatcgaaatattagaaattgacattatcattttaaacaatttcccatgaaagccaactttagatattactcattatacaaaatcatgatctaatgtttttagacaatgactccaatgagtgctgacttaattagaccgtccaataattcaggtgcaattaaataaatggaaaattttaacattatgttactttctaacatatatatcattggttatacagtttgcagacccctgcaaggttggccccaactttagaactgataatataagaaataaaaaagcattaaaaagaaaaaaaatcttcccagcttcaagtcaggtccatgaaatggagaagtcagcagtcaaacatatcacagctcatatacagacgagattataaaagggaaatagaaaaagaagatataatttcacgggcagtctaaagaactttggttatgaatatttcgtataatttaatgtcaatttgttgtatgctttatgaaaagagagaaagagttctaaaaaattgaaaatgaaataaataatgtagagaaaagagagggtcggtcactgccacaattaagcggaagtggagaatggttggtatttgttgtgtccttcaaacctcaagaagcttcaatctcaagatccttttgttttattttctgcagattactttgtaaaatggtttattaggtatttttatatttgcaacagtctttttaacataaacagatgatatctaattctatcgatcttgctaggaaaaacaaaaagagaattttcttctcgagtctttaacactttagtgcagaaatttatgtggtacgcttagtcaaattcaataattgtttgtaaatgaatccacagagttgaatattggaaaattaatatattgcggctatatatttcaagataattaatgtttcggattttttttcggtacatgctttctaattcaccggaatattttatttctcattgacaattgtgtttttaactaaaattaacaccaaaaaaaaaacagtgttttaactaaaggatgtggtttgttgtttatgttaaccacaacaataaattctgaagagaaaaagtttgcaatagagactgaaccaggtttacaataaaattccttaatggaagggaaataaatcaagaaaacaaaacaaatattgcatggataagaaaaacacgacacttgtctatgcaacttgtttctttagttgcatgagatcactttaatgttaaagtcctcccaaacagtattggattcttcgttataaaaagacctcagggtgattagagccttgtccttgtgaatttgaatcatatactccaacatgtatacacgtacacacaaatacgtattcatatatggcactggaataatcaatatattcaattctgagaatagtagaatagcactggcctaaaaaaaaagcattagttaaatttcagcatattcttgtatccatgccatgataatggttactttgttgttttattgtctattatttctattatatatgaactttcaatttgaattttagatatattggcagtacaaatacaaaaattactttaaccactatagctcctccgagcattcgtcactgatcagtgagtgtgtgtttatatatgcgatattaaattaaataagtttttcttcacactgtgtgtgtgtgtgtgtttgtgtgcgtggtaacaataaagttctgcgtagacgacacgtatccaatattaatggagttccgaaagaaagatcttctggcaaaaccatcatatatagagacaacagtttattttatcttttaaacaaaaatacgatcacattttttttacctaaattgctaataaaaagtacatagaaaatggtttacaaatatcagccattaacatatatagttcaatattacccgacaaacaaaaacatagtttatttatgattctatctcaaaagaatttaagacgtcaaaagaggtaattagtaacatcattttattggagatattttgcaatgaaaactgccatgaatagaaagaggaggaatcagtaggtctagattaagtgaatgttctacttcatttttgttttagtcaaaaagatagtttcactaaatttattttaaagccattaagtggagggcttgattccttccatcacctttatcttgccctcaactttttttttttggatttacttgcatccttctccattaaacaaaccaaacccaaatatagtgtgtattttatttaataattatgaccagataaatgtggtagactaaaagtttattttacgtgaaacaatctatgtcattctttaactatctagaagaatttagtgttcattaacatgtaaatgtgaacgaataatataatgtgagtaatcgatatgcaatcaatccttaaactttgttaccactataccttgtagagaataatagaacaaaatcaattctcatatgttaattggtattggaaaccccatttcaaaatcaacttgcatattaagtaaagggaaaacaaacatgattgattagtctttattccaccactatattactagctttataaattcttggaattaatatcatctttagtgccctaaaaacaaagaaataaagctagttttctctagaggagaagaaaacaatgttatttcctaagaagagcataaagaaaactacaacatgaagtcattttctaataataaagagggcccaaattcttctttcttctcacccaattggacccttcctcaatcccttctcctctcctctctttaaattccgctaatacccttctcactttcactcttatatttcataaaaacctttttttatatctcctctacctcaaagtttgagagaaagaaagagagagaatg

SEQ ID NO: 24694 - DNA, 3003 bp, Unknown
  misc_feature (1)..( 3003): 2750-1469P.txt file - cDNA_ID_2183328; gDNA_ID_1972139; Annot_ID_179227
atataaactagaattatttttgtccaaatttttcgtaaataaattttgtaaacagcgattatgactctggcaatttcttaaaaaagaattggataagtactgataaatttgtattctctcaactaaaatctctttttaatagaaataaaagctaaatcccaggaatcccattttagtaccagtcgtggtataaatattaacacttactgattgccgagagacgaaagaggaaaatcccaacaataaagagcaaacgatcttacagctcataatatttcgttaattatcaaattgctaataggtaatttcgcggaatcttcctttgtaatttcctccaactttctctgctttgcttataattgcgtctttgcttcctcctttacctttacgcggcacatagattattctctccaagtgtgttaatttctcttcttcgtaatctaattttgttttgttactgttgatttgtgtctttctgtttcgtggactctttttgactcccatcaattttaggattcttcttcgtgtgtggattttgatttcttcttcttctctggtgggttttggaactgttaggcttttgggtattttgttgaattccttagggttttgtagtaagattttgataattattgaatcgtttagaacaagagtcaactttttaaagtcattttatagaatctgagtctactagtcgttgaataaatattcttaaagaaatgatttttataatcttcttctcgtcgactttatttattatttagaatcttgtatttgtttttataacccataatctagaatttgatgatttttcaggtataaagttttgtaatttacttttcaggagaaaaaaatgggtcaagctttgggttgtattcaagttgatcagtcgaatgtagcaatcaaagagacttttgggaaattcgacgaagttcttgagccgggttgtcactgtttgccatggtgtttgggaagtcaagtcgctggtcacctttctttacgtgttcaacagctcgatgttcgctgcgagacaaagactaaggtctcttgacacttcctcttgaatcaataccttactcgttctgtgtcattgaaggttgtaatggttttgggttactttgttgtttaggataatgtgtttgtcacggttgttgcttccattcaataccgtgccttagcggagagtgctcaagatgctttttacaagctcagcaacacgaggaatcagattcaagcttatgtctttgatggtttgtttcaatatccttcctttttggcttcttgatgttattgtgtttgccttaactaatcgatccaccatttttgcatagtgatccgagcaagtgtacctaagctggatctagactctacctttgagcaaaagaatgacattgcaaaaaccgttgagactgagctcgaaaaggtaaactactttccagccatctccttgagcaataattttgaaatttgtgcaaaaaattattatacataggttaagactctaactgctgttgtgtatataataggctatgtcgcattacgggtatgagattgttcagacactgattgtggatatcgagcctgatgtgcacgtcaagagggcaatgaatgagatcaatgctggtacgtttaaatcttgctatagaagttttcgacttttgtttgttgagaatctcacaatgttctgttctgtttctggtgtaaacacagcttctagaatgagagaggcagcgagtgagaaagctgaggcagagaagattctgcagatcaagcgtgctgagggagaagctgaatcgaaatacctttcaggtatgggtatagcccgtcagagacaagccattgtggacggtctgagaaacagcgtcctcgccttctccgagtctgttccaggaacatcttccaaagacgtgatggatatggttcttgtgactcagtactttgacacattgaaggaaattggtgcttcttcgaagtcaaactcggtgttcataccgcacggtccaggcgctgttagggacattgcttcacagatcagggatggtcttcttcagggtaactctgctgctgagtagagaaatgtctcaaagtacaaaaaggctttttcagagttttagagttgtgttactacttgctactcagtttatcttttagcggttggctctatatgggttcttaaatttcttatcgtttctctcttctaggcttgtggacttgatccattttcttgttttatgggtttgtggatagagtttgggcttgaaaaatatttgtgttattttgggttttaatgtcgttaactcgttattaatgtttaaacagtggttaaagaatttgttaacgagaatcctgattttactgaataacaaccagattgttaacatttaataaacatttcaatttaataaaaagaagcaaacaataaaataacgttataagaataaaaggaaaacaattaacttgataaaacaaaaagtagctactttttaaatctctacgataccaaaccactgagatctgtgcttcactatttttcagaaataaacgatttcacgatcttaacgttccaaactcatcgatcagccgtcagatggtaaatcagacaaaaaatagaaaacacaaaatctgagctactaaatttccttgtatcttgtatttagtaagattgtataataattaatatattaatatcgttgctcaaaaaaaaaaaaaaaaaaataaataatatattaatattttagtctaccgacgtggcagagaacgcggaaggatctaagctgacgtggcgttatagtttgataataacaagtccacgcattattcgaaataaaaaaagatcttttcctttcaccaaaccaaaagttatcatatctctctgccaaatactattttctcaaaaaataaaaataattccaacgactcttattaacctcttcttcagtaacattcgctgctacaaaatatcttcttcttctttcttctgctctctctctctctctcgccatg

SEQ ID NO: 24695 - DNA, 3003 bp, Unknown
  misc_feature (1)..( 3003): 2750-1469P.txt file - cDNA_ID_2183347; gDNA_ID_1972139; Annot_ID_179232
ggagaccgtttcatacttccaaactttcgatggtgttatggcagaatctgacaaggtaaaacaaaacactatttctcgatttaaccgtttaaaccacaaatttctctaattcttgttttattttcaatctccttctggtgtttcaatcggttagaattaatctcatgatcatatgattctgttatatatttacatatagttaccatataattcttatgtctgaaattaatacagttttactgcatctgataaaagtcaacttgcttgttcggaaatggtctcgagtatcgaaagttcattattttttttgggacggttatttaatgctcaaggataccaagattttccggtatttagaaaacttcggatgaaaacatttataattaagatccgctctaattaatataggtcggatcgatccattttttttctttttttctttattggcattcgatcatgttcacttttataatactatttactttgtgtgtattgagaactatttatcgtagaagtttagaagataggtccaaacagtttttagataaaaagtgaatataaatgtgtcttggatattacaggaagaggagcttgatgcaacaaaagcaaaggtggagaaagttcgggaagaaaatgagaaattaaagctcttactctctacgattcttaataattacaactctcttcaaatgcaagtctctaaagttctcggacaacaacaaggagcttcgtctatggagctagaccacattgatcgtcaagatgaaaataacgactatgatgtggatatatcacttaggcttggaagatcagagcaaaagatctctaaaaaggaggaaaataaggtggacaagatttctactaagaacgtagaggagtcaaaagataaaagatctgcactgggttttggatttcagattcaaagctatgaagcctcgaaactagatgatctttgtaggcaggttaagcttgcaaacgctgaaaataaatgtgtatcttcgaggaaagatgtcaaatcagttagaaatgaaaaccatcaagatgttttggaggagcatgaacaaacaggtttgaagaaaactagggtttgtgttaaagcatcatgtgaagacccatcagtacgtaccatcaaaaccatacattacatatatgtgtttatttaccatttcacatctaatttaattatttgatcatatacacgttacatgaatatatatagataaacgacggttgccagtggaggaaatatggtcaaaagactgcgaaaaccaatcctctcccacgagcctattaccgttgctccatgtcgtcaaattgtcccgttagaaaacaggtataatacattctataatttctcaatccaaatatctgtttattaacaattggttttgagtaaaaacttttaaaacgaatgtctataggtgcaaagatgtggagaagaagaaacctccgcttttatgacaacgtacgaaggaaaccatgaccatcctctccccatggaagcaagccacatggcagctggaacttccgcggctgcctccttattacaatctggctcctcctcttcctcctcctccacctcagcgagtctaagctatttcttcccttttcaccacttctctatctccaccactaactcgcacccgactgtaacattggacctcacacgaccaaactatcccaatcagttaccagacgactaccctctatcgtcctcctctttcagtctcaacttttcctctccagatcctccacctccatcatcgcatgaccacaccttgaactttagtggcttgcgaacacaagctccgttgagtacagattcattattggcccgttatcgaacgagactttccggacagcaataagccagtaactgtatcggtatagctagacacaagtctagaaagtaactgatttccgttttctttgtcattcatttgtttttcagcctctgaaagagagatctggttttggcatgatatgcaaaatgcttatatacttgtagatatccaaatgtttaaattagtggattacctatcatatcatggattatatatgtatatgaaggttttgtaaattaatggtctacacaaatttgatacaccaaatatttttttatgcttataaaaattttaaatacaatgttaattttttttgttggtgaattaagtaagtatgactatgatgacacaatgatatctaaaatggaaggtggttttcatgcagattgacaaaatctccctctttcacttttgcaaaattgtttgatttttacaaaataaactttagttagcatcacataaaatagtgggttatttgacaaattatcaacacaacgtattattatttgaaatcacatacgtattgtttactaatttgattattattattttttgctacagacatttactaatttgatggtcaaaattgtagtcaccattaaaattatttacataaaagaattgattattttacttccctcaattatcaaatataaatttgtgatgaatttgaccgaaatgaagatgtctgaattgtttgagccacctaaatgtttagatggtcgattcttaaaaaggaaagaaaacaaaatgaccaaaagaaagaaaacgtatgaaactatgatccatcagatattacttttaaatcaatcttgggctcaggcccgttactaccgttttctatcttagaattcggcccatccacgtcagcgactccggttataacgctgttaaactcttttgacacacgaccacttattataacgtcacgtgtcaatgcacttcatcaggacgcgcgtaaccgccagaaaagcgaaaccaaaggtccatctccgacacgttgcttatccgaccacactcaccactgttctaaattctctcttttttttttccttaaccaaaaaagctctctttttttcttctgggtttcatcgtttccaatctaaaatcatcgtagatttgtttgaaattcttcaaattgagccggtatcaagacatg

SEQ ID NO: 24696 - DNA, 3000 bp, Unknown; identical to SEQ ID NO: 9531
  misc_feature (1)..( 3000): 2750-1469P.txt file - cDNA_ID_2183380; gDNA_ID_1972143; Annot_ID_179284

SEQ ID NO: 24697 - DNA, 3000 bp, Unknown; identical to SEQ ID NO: 9538
  misc_feature (1)..( 3000): 2750-1469P.txt file - cDNA_ID_2183387; gDNA_ID_1972143; Annot_ID_179297

SEQ ID NO: 24698 - DNA, 3 bp, Unknown
  misc_feature (1)..( 3): 2750-1469P.txt file - cDNA_ID_2183387; gDNA_ID_1591899; Annot_ID_151669
  misc_feature (1)..(2): n is a, c, g, or t
nna

SEQ ID NO: 24699 - DNA, 32 bp, Unknown; identical to SEQ ID NO: 325
  misc_feature (1)..( 32): 2750-1469P.txt file - cDNA_ID_2183387; gDNA_ID_1563836; Annot_ID_148378

SEQ ID NO: 24700 - DNA, 3000 bp, Unknown; identical to SEQ ID NO: 9534
  misc_feature (1)..( 3000): 2750-1469P.txt file - cDNA_ID_2183399; gDNA_ID_1972143; Annot_ID_179300

SEQ ID NO: 24701 - DNA, 3003 bp, Unknown
  misc_feature (1)..( 3003): 2750-1469P.txt file - cDNA_ID_2183411; gDNA_ID_1972143; Annot_ID_179305
cgtcttctcaataacttctgatgtttataatggtcgcattttagttatatataacaattgaaccactgatcatctaacctcaagtgttcttaatttaatatcgataggtgccttatgactttcgatggtgggaagatcaaagatgtgtatatgtgtttcgccagcctcctcctggaacctatgacattcgaacagtctgagtaagatgaaatatcaaaaaaaaagagggaccctgagagctccatctaggtcccatgggtatgcaaatatttaaggctaggaaattaccgtaagagagttgcaaagaaaatcaatctcatcaatgaaattattggtcacggcccgttttttattgggccattactgggcctgttttataagagaatccagcaaagtcagcggtaaaggagttcttttttaataaaattaaaattttcttataaaaaagtgattaaaataacgtcacaccactatataacgcgacgggaccatcggtttcaaaaacataacataaaacaaataacatatttcttttaaaaattctttgtttttctttaaaatttttttaaagccatggttactattatactcacgtgattgtactgtagaatttaaataagtatgaagaaatggaccaccaccaaacatatccattatgtaaaatccaattgtatcctatcaattcatgttctaacaaatgtacatcttatatagttaatgcgataaggaggaatggagggaaaatctgagttcaaaacttgaacttggaccaaccaaacagtaaattttgcatgagtataaataattcttagatctctcttttaacttttttttttttgggtgactttgtttgtgttttgaatattagatctacctttttggtttgttgataaacattattaggtccatgacttcttgttgttatacgtccatctctcgttagtattttagagtcattattaaactttaagactttagagtaagtaagtcaaataaaataataagactttagatatacacaaccaagtttttagtttgaattcaaaactcgaacgaagtctgattatataatcacgtgttgtaactaatttcaaagaaactatgattgactcatcatactatgaaaatatcgttgacttattacagttttttcatcaacaaaatatatatacatctcatatggttgaagtataactactatcatatcatcattcatcaatcacttttgttgttactgttttcagagagattactacatagtagtacataacaagagaaaacaaagccatgacaagaaacatcaacaaaattctaaaaagcaagaagacgaagctggacaagatctctgcagcatttaacatacaccactccactcgcaatgaagttttatcgtgttgggacctccgattttggactttttttaattttacttactttggtaattaagtgatttttttttgctactacatgtgaaccaaaaagaaaatgaaaacagaaagttgtattaatggctagggattttaacttgtagctcggttgcttctcattaattagtaaacggtgtgaattaatggcatatataccattgtacgtaacaaggatcataaatgtggcaaaaattaaatcacagttgtagacaaataataaccccagatctcacgggttgatctcccaaatctatgtttaagcacgctactaaattcaaaaaattaagcactaatttaattaactcaagtctcccccaataaaaacacttcctttttgtctatctcccatatatgtaatggtcaacaagtcaaatttttaaaattcattatattctctgtacatgaaaacatttagtaatgtttctttttaaaaaacactgttttgatttaatgtcgttagtaaagtttattattttgatttctttttaactttccttaattatttctaaatgtgtcttctttatcgtttaaaccacactagtgtgtgcgtgtctccttcactttcaaagacagtctctttccccaaagagcggattcaggattcaccatctcgatctgtgtccaaagctcctatctttcttctttcttccctgaagaattttctggagcttctcaggtcaaatctcaaatctttttttaacttaattttgttatttctatcagaaagtttcgatttttatgctcatgcttgtgcatccgcgtacctgcatttcgttttgtgtttgagccgccaaagttttcaacttttttttttgggatttattgcaaatttgtcgatgttgaaaggttttctcaaggagaatgtgaagaaaaaggaagagaatgtgagttgattttaggcatagggttttgtgggttctttcagatttatgtagaatggtgcagctctgattcatgggtttgcaaatggtttctcacgatctgttcgttttcccaaggaaatgtagctgcttttttttttttttttgtcatcagattgaaatgtagctgcttttgaagagaaaagtctgatgcttctcttccgattttttatggatggtatttataaaagaaagaaatagtagttagattgtcgaatattggttttcctaatcttttttcttctctagattttataaaattggagtctttttctgcattactgtttgcattgttcaataaggaaatcaaataacttttgattctaccattgaatcttacggagttttgaaaaaaagtttgaagctttgaactttaatgtatcttctattgatacttttgttgatcagtggaaaattttcaaggaaaatcctctgtaagactcaattggttcgattattaagtcaaattggccatctttttttcagaacatttttatatgcatggttgcagattgctatctgctctgaatgttgatctctctattgccttaactaatgatctttgcgttcttttgacagatcagaggaagatgatgcaatcctaagactctaagacttcttcaaggctgtgttttatcgtgggatttttaaacatg

SEQ ID NO: 24702 - DNA, 3003 bp, Unknown
  misc_feature (1)..( 3003): 2750-1469P.txt file - cDNA_ID_2183434; gDNA_ID_1972143; Annot_ID_179314
ttggacataaaacctgaaatccaaaatccgatctgacatcgatccaaaaaatagttataaaattccaacgaaaaaataaattattctatctaaattatctgatctgaatccgatacgaaccgaaaaccgaaaagatatataaaacctcaaaataaaattatatatcaaaaattattagttatatttagttagagttttatattcaagattactaaataacaaaattatccaaaataacctagatatcctaaatttttttagttttatttattaaaattatacatttttttgtaaagagtaaccaaatttttcgtaaaactaaaacaaattttttacaaaattgaactgccggattatttttttttgcaaatgttctcatttgaaggaagaatttgagagaaaaataaaacactagttaacaattgaaacttaagaccggtcttaaaataataattaaagggaaacactagtttaatattgaaactttaggccggtctcaaaataataatttagcacgaaataattaaggcaacatgtgctttgcacttcaacgcggaatcatatgaattatacattgacttaggattattattgacgtcgattcggcctttaaattataatttagaaccaaccataattataatatcactacaattggttagtatcaaacaatttaacaactgttaaatatcactgcaattgacttttagaatagatcatgataaagatcggtctttaaataataatttagcaccaaataattagagaggctatgatttgtattttaaatcggttatttatggactttaatttcgagtgggaaaatagaagaaagcaaaagtgatcaatggaggggcctttgttgactaagaatgagcacatcctcgacgacgttacaataatccatggcgattcttcctcaaacgaagagcacatcgtcaacattacaaccaatgtcgattcttcatcagatgatgagcaaacacaggatgattgtggtgatcatttgagacgtataatagctctttttgtggatgaagggtgtgatggatttacatctagtcatgtttgggttatggtcgagtttgttttgactttgctccaggttgttgcagccattgctgtcctgactctgacaaaagatgaaacagatccacagaaagtgtttcgtacactgatcatctgttataccggtggctgtattgtcgtgctccttattctaggtttggatttctgggattattgcggaaggtataaactataatttgtttattctttgtttttaaggcattagaaaccgaaatcgatagataacagtttcttattgatttgcagattctacgaggtgatggagaatttgaaaaagatgcttgactatttcttcgtgggttgggttgtggtgttttcatggcatcttataaacaactcatcatctccagataatgctacacaacagtactggtgcgcaacaatactaaattttctaactatttagtatgtctcgaaaacagagtaaatctctctaatgatgataatccaccatgcattttcctgttgcaggttatgtatggctttccttgttgtcagttgcattctacatgtgcttcctaatctcccctgcgcggcggcttgttttctatatcctatgatacttcgtcttacccagtctatagacttctttgatgacattactgaaaagatagaggacattaactggttaatctttgtatacttttttggaatcttctcctgcattatctgttgcatttttacttgttgcagcagattatgtagataaaatgaagaatggatcatgtcgtttctcctttcttttgtttaacaatgttgtaatactcttatctatgtatcaaatataaagtcatgactcatgactgaatcctctcttcctgaaatcgttggcctgaaagacacgatgcttacgtcccaattacctctgcatggacgagcttgtgaaccgcatgtacaagtatccattcctttgttggtcctagagctgatccattcctgcatacgaattaataatccaattcaaagagagagtagtagaccgtgagttcaagtcttctgaagcagcatcacgtttgaaccacgttatcgatcggttcagtcttcaactaaagtgaagtcttaggtgtatgaaatgtaactaattagtcttccaacaacacttaaaactcataagagcaaaacttcttttaggaataagtaaaacagagcagaagaagcagtcaagttaatcgggattaccaagaaccaatggtcaacctccaaattcttcaaatttcctggaaaaacacataagggggaaagcaaaacaccaaatataaacacattcctcgagcgcttaactacgtaacaacaatattatcaatattgcatgattacaactctaaatctctatatattttgatgatctataattttttgctttgataaaataaagttatgatctttgatttaaaagtataaaaagatttggaataggagaaaaaaaaaaagcaaaatatagatataactgaaattcatagttgcaaaaggggaagtggagaactggagttcgtgggtgaacggttaagaaaggttggctggtttgacattattggtccatcatgcaacaataatatattaagagtttagaggataagaatttcaacaagtggacgtgccggagtggttatcgggcatgactagaaatcatgtgggctttgcccgcgcaggttcgaatcctgccgttcacgttttttgtttttattttaccttatcccagttttgtcctttttagtttcctcaatgttttcaatcccgcctatattttaccctagatttttaattaattgataccgaatcccgctttctgaaatcattttcaattttcaaaactcatctcctctctctctttcactctatctccttcgatctctctcggtgtcagtgaatttaactgaaatcccatcgccggggaattttccggtgatttagatg

SEQ ID NO: 24703 - DNA, 22 bp, Unknown
  misc_feature (1)..( 22): 2750-1469P.txt file - cDNA_ID_2183469; gDNA_ID_1592193; Annot_ID_152087
tggaccaaagtaccggaatatg

SEQ ID NO: 24704 - DNA, 3000 bp, Unknown; identical to SEQ ID NO: 9556
  misc_feature (1)..( 3000): 2750-1469P.txt file - cDNA_ID_2183469; gDNA_ID_1972144; Annot_ID_179325

SEQ ID NO: 24705 - DNA, 3000 bp, Unknown; identical to SEQ ID NO: 9544
  misc_feature (1)..( 3000): 2750-1469P.txt file - cDNA_ID_2183484; gDNA_ID_1972144; Annot_ID_179331

SEQ ID NO: 24706 - DNA, 3003 bp, Unknown
  misc_feature (1)..( 3003): 2750-1469P.txt file - cDNA_ID_2183488; gDNA_ID_1972144; Annot_ID_179332
ttcaaggtggaattttttgagttgattacatattttcaagacatatgctgatttaatagtatattgcaaatatgtaatcaactcaatgttttaaaattgttagcctaagtttaattatattctcacttgaaacaattttactgcatgtagtacgccaactggccttggacttcagccatgtgtttcacatggtggatttgtattcaacaagcctacccacccatgagttttaccagcaacgattaaaacaattgcaaactcaacgcgtctaagcaaagaagaacaacaagttgacgaaagaactctgagctttgcccacctctactcggtatggttcaatgttactatagattactttctaacattaaaacacacactgtttttggatttaaaattttattatagacttaaaaatttaataatagtatgacgcttttaaatgattataggatcaatcacaagttagtgcttccttaaagatattttcctgcgtgggttagaagaaagtgatatcctgattcacgtggttcggttgacccctacttttgttttcgctatggaattataaataaataaaagagaactaaacatgtattcattccatttcattatgtgagcctgaattgtgtgacatgatcagaataccaccacaaaataaaatacgaaactcatcacaatcctaaagctttgattgatacaataagacgcggctaatttaggaatcaaatcgaatcatccacagattggtaattcttagagtggagattatacgataaatcacagataatgggaacttcaacgctcaaaaatggattggttttgtaaactattacattgctctcgagggatattttatttagggtattttgaatttttatgaatcaaatttatttcctacccggccatgacacataaatcaaagataaatatctaatttttattaaatagatttagttctcaagattcagtaacgcatacatataaaggaaacttatcaatgagtacatgaacaatcatgtccacttgcttgatttatacaaacgcaattaggatagtaaggatccttagtttcatctttgcactgttgaggaccccgagcacgaattggactacaatatgttcccggaaagtattcaacaagtacaggtggacgatcttctgcctccactgtttcatatcaaccacaaaaatattagatggtggatgaaacgtgttagataaatacaaaattgataacacaaaaatttacattcataacattttttcatcagtcaatgttttcatattaagcaagtatataaacaatcgaaattatatgaattatatatatctcacctttagcattatacatcacgaaaaacatgagaacacaaagaaccacacacgcactaacagatttcatgatgcaaatgatatgtctatattttttcttttgttgttgtgtttatctggtactgaatattttttcttatcaacaatgtctacatatatatacagacaacacacacacagatatttttttattcttactcaaattaaaggcaataaagttaagtttgaccaaaataattaatgccaatttgagagtcaaaccaaaatatttattaaaagaataacctaaataagataaacacatttaagtaataaatcatatatttgacagctaatctacactcccaacgttccagattataatattttctaaataagcacaaagtttaagagaccataaatgttttgttattctaatattaaatacccataaatatagtatctaacatttattttaaaaattaaccaatagaaaaagattgcaaattattaatagtcataataaattatgcattgatatttgagaaaaaataatagaacgacaaagtgagtaatatgactttacttgcatatataattattttttttcttttctcttcttatgcatttaaatcatcatccacctgttaataataaattggttttaagaaattactattaaaaattatgacattgtttccttttttggataattaatatatatggattatgatcccttctcgttggaatttattaatattatcattactatgattagttttgatttacaaaaatttcacaattattttgtttccttttttgggataattaatatatatagattatgatcccttctcgttggaatttattaatatcattattattattattagttttgatttacaaaaatttcacaattttaagaaataatctaaaattaccattaaataattaatttgcaaagattcctaaagtgtcagttttattatggtcatatattgaaaaattataattgcagtaatttccctttaattgtgagatttctagaaatatatctttttctctgaaaaagaggttttccttgaaatatatatcatgataccagttagtgacttagtgttgtccataataaatctttgtttatcaccacaataagcatactgaaactgaagatatcaccaaactttggttatgattttctttcctatcgcatcgtatgttttatatagttgaccgttttaaaatttgtagtttttttttttataatcgtcgatattctattttaaccttttcgatgtgaagaaaaaaatgaaaactctgacgcatctttcattagttaacttttaattcgcatttgagtactactacacgcgtctcagtgcatggcactagtgtgaatctcgaattcaatcttctttgccattgttatctatatcaaaacaacaacaacaacaacaatcgcaaactatctacatgaaccatcatcttttattcaaaaaaaaatacatgaaccatcatctttttgtccatccccgtgacaataaattagtattaaacataatcagtccacttgtctttgggatttctccttataaaaacatcactaactgtgaaagttaaaaccacatcctcaaatcaactctacctttgttatcatcttcttcaatctttcaacctatatcgacaattatg

SEQ ID NO: 24707 - DNA, 3000 bp, Unknown; identical to SEQ ID NO: 9551
  misc_feature (1)..( 3000): 2750-1469P.txt file - cDNA_ID_2183508; gDNA_ID_1972144; Annot_ID_179337

SEQ ID NO: 24708 - DNA, 3000 bp, Unknown; identical to SEQ ID NO: 9549
  misc_feature (1)..( 3000): 2750-1469P.txt file - cDNA_ID_2183518; gDNA_ID_1972144; Annot_ID_179340

SEQ ID NO: 24709 - DNA, 3003 bp, Unknown
  misc_feature (1)..( 3003): 2750-1469P.txt file - cDNA_ID_2183559; gDNA_ID_1972148; Annot_ID_179376
ccacgccacaagatggtcaatacgtttgtgatattagtatccatcccaaagacaaaagatccagaagcaggtaaagtatcacctaaccatgatgtaagttcccatctcttcctggtcttgccatcgaaacctagtttcatcccaggaagaagagtatctgttggataatcgaaactttgccacaaaacccgcttcatcgatccatcagcatccatctcttggagctgaagatttccagaatccaaaagctgaagggttgtgtttcttgtggtttctatagagcttagctcaagcatggttgatgctcctcttaaaatcttcaatctgccaagagaatccactgtgaggcttccagagcggtctgagattggattgttacggttagcaatccagacaggtctgtcctggctatcagtattaagataaagattgttgaaccaaattccaagatacaagttttctgaattcttaaagttgaaaaacttgagtttgaagattttaaaagcagaaacgagctcttgcccatctttcaagaactgaccctgatgtagcgtatctgtttcactgcatgattttcctaacaagagagataaagtaagaagagagacaaagatgccatttgaacacatagtttcagaaagatggatgatttggcaaatagatttctttctaaagtggttttttaaagatatatcttgtttgtgatcaaagtcatatcagaagttccaagtctactacgctgggagacaaaattgaagtcttggccgttgaagtttctaagcaacagctgttatcacaactaattagcaagaaagtgaccacaaaattgaagttgactcttattacctaaaacaagacacatacataacagaaccagacgccatgctcttgagcaattgtttttgtttttaacgaacatctcacgcctgttgggagaatacaacacccaataaggatttaaaagggggagactacttacctgagaaataaaaagccaattgctaccaagagaggagaaacagagttatatcatttcttcataaaaagacaaaaaagtatttcatcatggttcataaaaccccaaatcttattggtaaagaaaaataaataatttataatcattttgttgaaagaaaaaaacccaaaaaaaaaaaagaaataagaaatccaaaagcttcttgtattgattgaacggaaaatgttgttagagtacataataataaccctgttttacttggtaaggagaccattttattggtttcaatggtagaaaagaatacaagaatcagacttagcttgtaacatataactggttagaaataaagactcaagtaaggtatatcatccgtggaattgttgaccttcgaatcttgggttacaagcaaacgtaacaatcgttgaagctatcgatggaagataaagacttcctcgaatccattctctagcttattaggtcttctctacaatccacaacaacttgagaaagacgactatgtatgaagtacctcgaaagaaagtgaaggaataatgagaaatgagagaaaattggtaactcaagagtgtgataaactgctcatattgtttctctactatgtgtgggttccgtggagaaggagaagaatatacgacatagttttgataaaccaatttaaaagttttaatgattttactattacagtattagatgttttcgaagctagaagattttctctctttttctttttttttggcaagaatttaggtaacaaatataacaactcaaaaacaatatttttatatttaagtctgatataaaataaataaatgataataattttcaaattataaatttaaaaatctaataaattataaatacaaaatgataattaaaaagacgctaaaaacttcaatccgcctgggtggatgggaagaagcaaatctttgagtgagtttttaattcaagaataattaaaatactccatttggtgatttggtggaccgttagaaattaaaagcaaaatgcaaaaatattcaagtgggataacataatttaactgacaatttgttcatgtttccactaacttttctgatggaaaaaaacgcactatttgcaactataacgcactaatctcttaaaaaaaaaggttaaccataaactctaaactcttccaaaaaagcttaaatactcctaactaaccaaattaatcttttaaacaaaagtcaaaaagttacaaattatatgaaaactcacgtcaaccccagttacaatattgtctctggaaaacttcctaaaactagtacattaaataaatatttatagaaagaaccgttcattagttttaaattagaatactaattaacatcacagtaatgccgttcttaacttaataatttttaaaacagaacacacagattcttaagtacttcctcctccactcgaatatctttttattctctctctctctctctcacatttaaccccaaaatcatggatcgccttaccaagaacaaaaccctaattcatcatcacttgtctgattcttctctattggtttatcttttatgaaccttcctccttggccggtctctcaatatccccggtatgtaaatgtttgacctctatcttatctcttctgttctgttctttgttttgtctttgtttgtccatttttggttgttactggttccacacgtgttctccgcagctttatttttagtgctctcttttatttttaatgtaattcgcaattttttctattaatcgtagaatttcccggtttttgtggatgtgtttcagttccgttattgcaatttttccaggatttgctgtttgaataaaaaattctgttttttttttctttctcttttctgggttaagatctttttctcatagcaaaggtaatttctgtgattgtagcatgattcattgtttgttttaataatttctctgaattcatgtattgattcctttgtttctgggagatttttgtagttttagagttgttttggtgaggtttgatcatg

SEQ ID NO: 24710 - DNA, 3003 bp, Unknown
  misc_feature (1)..( 3003): 2750-1469P.txt file - cDNA_ID_2183573; gDNA_ID_1972148; Annot_ID_179380
ctgatgctctagtgcattttatcggcggcattgctaactacaatgagagacacctacagcactatagcaagaatatactgataggtcacatcccttatgttcatttgtaacaataagcttctttgaacaaacaaacaaaagaatagtgagagaagcaaatataaaaagggaatgtggtgaaagagatgatcaagtctagagagttgcaaggaccaatgttgttagactagaggatccattatagaattataaagtggtgtcttttttatgttgtctctgtcattttttaatggcatgaagttgttagtggcttgcttgattcttgtggggtaaaagcatttacatcattatagaagcaacttccagaagacagcaaacagaagattattgtactgagctttcctatgaatctgtgatggttatcttctcctctactaaatggtgtgtgtcaccatcttgttcatgttcaatatcttcttcattgttttgcatttagagtcaattttaaaaacttattttattttcctttacgtacatgcctaattctattatagaaattgaacttattttaaaaaatttgccactttttcattccatacaccaaaaaacacaagtatatgatcctcaatcacattgatacgaatgctatcttgttctgcggtacagagcattttcaacaacatatttggatatctatctagaatcaacaacaatttttttttacatatatttgtatttttcatattcatatggggtactttatattcgaatttcatagaaaactaatatctttaaatttacatttttgtaaacaaaatttagttgtattttagaaataatgtaatttttgtgtgaaaagggacatgataagaccgaatttgaagtagactggttacctaacataacatcaatggatttggatttcaaaagagagaaaaagaagagaaattattaaggataaaaccaacaaatcaataaagtatatgcataaatttacagactattaatatcatgaatctatcggtttgttcaaaaaaaaagttgttgttagaatttctctttaaaaatagtatggttaattaagaaagaatgattatacatataaaaacaaaactcctaaatgtttaaatgatttaaaactgagagaatattgttttacaatcttttagaggattgtgattctcataatcagaagaaaataattgcagatacaaagatcttagctggctacgtgaagggcatgcttgagatatcataactctgatgtgcatccacacatgacaattgacagtcttaacatattttatgtccaaattataccattaggcggattatttagaacttgtccacgagaaacatattgtatgtttgtgatccatattattatttcttctttcttctaatataaaaattatttaaattttattatatggcagaaaagcagtagtttggttggcatgactcgaatttaagatcgcaaatgtaaaatggatctcccagtcatcgtttttgttcatatttatatgcggttcggtcacagttgacatgttcacacggttcctctatttaattcagatttcagacaaggtgtaataatttgaatggatatgaaacatttgtaaatatttataaaattaatgaaagaccaagaggtttggagaattagtttatactataataagcttatcactaaagaacataattaaacatcataaaaagaaagaaaaatagagagagagatatagactttattattaattgactgtacatcgtattttcgactaatattaattgactatacatcggctattcgaagtatatatctactgataccatttttttataatcaaagtgtaattcatgattttaccacttgacgagttcttttaggatgagtgtagccatcaaataactcatttatcgatttttttaatggatataaaacataaacactatttcgattggcgagatgaaaaagcttagatatttcaacgcttgttaagaatcgatttctgacttgcaacttttttacaagtaggaacgactaatttactaccacttggagtaaacacgtaccgataagattgaaaagttacaatttagagatttgaggatttatgtaccgttcaaagaaatcgccaagtttaataatttgtttattctgttaggtaggaatacaacgagcatgtgcataattaaaatataaaataaacctaaacttaacggcggtcattgcctccaatgagtatatgcatgttatgtggtcggagtttttaatgtccaaactgggtttattttttgacatcaacatgcactttttatagtacaattaagtttggtgcaggcgcagcaagcaagccacacccgtacattactgcgtacaaacaagaagcggtcaatttttcgagaaagacgatccatacgttctgtgtaaataaaaaaataatcagatttaacatacattttgtggaaaacaattcttcttatatgaaaacaccgtagaatgtaaagccagaggagatttaccaaggtggcttcgttgagatatttgaagattgttccacttgtgccttctaaaacgttagtgatctgttatatacgttacctcgctaacaacatgttcatatataacacacaaaaagttatttatgtttttttatgttagaaaagagaaaaatattttatagcgttgacaaaaaatttaaccaaaagaaattaaagtgtcataccacttggtttttggagtctgattctcacgcgctcttacacgcgtacgtgacaagtaaattcacaacccatttacggggtggaagtgacgacactctctcacggtcaaacacattatcctgtccgaaaagtgaaaactaacacaaaacgtcaccgtttttccttgactcagtcctctagcacgaggtccacgagcaacgtttctcgtttgccttatttatcatctctctctatctctctcttcacactgccaaactccaaacaaaagtaaaaatg

SEQ ID NO: 24711 - DNA, 3000 bp, Unknown
  misc_feature (1)..( 3000): 2750-1469P.txt file - cDNA_ID_2183581; gDNA_ID_1972148; Annot_ID_179382
gtgcgagctactacaccggttgggaggagtcctgtgacttcaccggtgagggcttcacaacgtggtgaggcggtgggggttgtgatggagacggtgacggaggttaggagggtagagagtaataatagtgagaaggttaatggttttgtggagagtaagaaggctatgagtgctatggaagctcgagccatggcttgggatgaagcagaacgtgctaaattcatggctaggtgattaacgttaattggttaaatttatggttgattttaatatgtgttaatgtgattcgtgtttgagagttttttttttttgtgtggaattaggtataagagagaggaagtgaagatacaagcttgggagaatcacgagaagagaaaggctgagatggagatgaagaaaatggaggtaagatgttctgtctaattgtggaaagagagttgtcaacacgtgttcaatccgaatttcggttcagtctttttttagttttttaaaagacaaagtagtgtggattggtttgatatggattggatctattaattgttaaagagaaaaataacgttatggattgaaaaggttttaaaacaatgtgtgaacgtgtgtttaggtgaaggcggagaggatgaaagcaagggcagaggagaagttggccaacaagctagctgcgacgaaaaggatagcggaagagaggagggcgaatgcggaggctaagttaaacgaaaaggcggtgaagacatcggagaaagctgattatataaggaggagtggtcacttgccttcttctttttctttctcctttaagcttccctctcgttgttggtgtcaataattgtctattttcattagaatgtaatcgtatggatttagtgatattcaataactaacgcaaaaaaaaaaaaaaaagttttgtttggggaagtagataaaagaaattgagccaagaactctcaaagttaatcaaggtcccacgagtggccaactatccgcactttaattgctaacttcacttaaaactatgtcgctaaccttttaattgacacaaacacatttggggaaactcataatctttgatgtgaccggtaaagcaaaagttttgggctttttaccagatgtctgatctcgcatttggcccgaccccgcaattttgggcttctaagataaggtcaggcccggctttaaggcacaatgtaagcccagcagttcaaaggttgatccgacattaatttggtaacggaggaatctcaacttaaatgataagcatttacgatccgagctgacgactcgtaacgtgcgaagttaatgaggcgagatccgcggcgtgaagtcagcgaatcatttaactcgtttgattcgatgtatttgtataaataagagtcaattgacattgtaaaaggggatacacattgtactgaaactatactgaaatacataaatacttttcacttgatcactgttcgtctaacaagatttaagaccttcacgaaacaaccacaaaattctaattgcggattacgacatccacacaaatcaaataaagataatctcagatatgatggaatagtactagtacttgatagtgattttgattgtcaaattttgtaaagagcaaaaaaattgaagtctagaatgaaagatgactcatatgtttcgaccaagctagtcatgaacacaaacaagaagagaaatgattagttcgtgattgagagattatgaatattcataatgttctaaaacggtttatgtggtcccctaaacattatgcagccacaaaccgtgacaatcattttttcggacattgaaattagacattttagttttgactggccttcggcaatattaggtacataattatcaaagttaacatgactccaaaaattaacatatgttttttgatttaaatgatttgatggtaatattaaggttttcatgtcttagagcaattttatttgtggtttctagatataagtttcttaacattaaaacaacaaaaataatattatctaactatgtgagtttcttgaatagttaagaaattctctccaaaatttcctatataaggtattttagagatgactttttcactaatcaaaaagcccacacattcttttataataaattttctttctttaaaataaaagacttatgtttagaaatcatcaatgagattgttcttatgttccaagtgctccaacatcgactttcaagataatagtctttgtggttaagatgacaataattcgattaattttgggtgtgagtcgtgtgactatcccacgaaaataaaattgttttgccaatttgatggtaaaatctcacgataaaaactcaaacaataacagcctaccaaaaaaaaaactcaagaccataacatgttaaatttaaataaataaatatatttttggtttcaataatattgtcgtagaagttttaaaatattttagagataaaaataaaaagaaacacattgattaattacaaaagttaggggctccttatacctttttttttttcatcaaggggctccttatactaaaacaataaaatagagggggcgaatacaaaaacacgattttagagacctaaagctttgagctttcgacgagaaactttcttctctctctctctctccgccattgttcgttccctctccacggtaatctatatccacccgtcgtcaatcggaactttacgaactccttatcaatcgtattttcactttccaattctgagttctcttctcgtttcgtcctctcttcctccgtatccacgggtctcgctttcggtttctagggtttcgcggttctgatcacaagttctgcttcaattgtaagcgatttgatcgcaagtagctgttaaatcggtgcgtaattcaacttttgaaatctcaaggtttagtctctgcaattctgattttgaacacagctagctagtagcagatttaagagttcgtcaaattaggattttgggtttgtttgggtccctttctcaccgaagttctgtatg

SEQ ID NO: 24712 - DNA, 3003 bp, Unknown
  misc_feature (1)..( 3003): 2750-1469P.txt file - cDNA_ID_2183581; gDNA_ID_1971795; Annot_ID_175649
ccggtgcgagctactacaccggttgggaggagtcctgtgacttcaccggtgagggcttcacaacgtggtgaggcggtgggggttgtgatggagacggtgacggaggttaggagggtagagagtaataatagtgagaaggttaatggttttgtggagagtaagaaggctatgagtgctatggaagctcgagccatggcttgggatgaagcagaacgtgctaaattcatggctaggtgattaacgttaattggttaaatttatggttgattttaatatgtgttaatgtgattcgtgtttgagagttttttttttttgtgtggaattaggtataagagagaggaagtgaagatacaagcttgggagaatcacgagaagagaaaggctgagatggagatgaagaaaatggaggtaagatgttctgtctaattgtggaaagagagttgtcaacacgtgttcaatccgaatttcggttcagtctttttttagttttttaaaagacaaagtagtgtggattggtttgatatggattggatctattaattgttaaagagaaaaataacgttatggattgaaaaggttttaaaacaatgtgtgaacgtgtgtttaggtgaaggcggagaggatgaaagcaagggcagaggagaagttggccaacaagctagctgcgacgaaaaggatagcggaagagaggagggcgaatgcggaggctaagttaaacgaaaaggcggtgaagacatcggagaaagctgattatataaggaggagtggtcacttgccttcttctttttctttctcctttaagcttccctctcgttgttggtgtcaataattgtctattttcattagaatgtaatcgtatggatttagtgatattcaataactaacgcaaaaaaaaaaaaaaaagttttgtttggggaagtagataaaagaaattgagccaagaactctcaaagttaatcaaggtcccacgagtggccaactatccgcactttaattgctaacttcacttaaaactatgtcgctaaccttttaattgacacaaacacatttggggaaactcataatctttgatgtgaccggtaaagcaaaagttttgggctttttaccagatgtctgatctcgcatttggcccgaccccgcaattttgggcttctaagataaggtcaggcccggctttaaggcacaatgtaagcccagcagttcaaaggttgatccgacattaatttggtaacggaggaatctcaacttaaatgataagcatttacgatccgagctgacgactcgtaacgtgcgaagttaatgaggcgagatccgcggcgtgaagtcagcgaatcatttaactcgtttgattcgatgtatttgtataaataagagtcaattgacattgtaaaaggggatacacattgtactgaaactatactgaaatacataaatacttttcacttgatcactgttcgtctaacaagatttaagaccttcacgaaacaaccacaaaattctaattgcggattacgacatccacacaaatcaaataaagataatctcagatatgatggaatagtactagtacttgatagtgattttgattgtcaaattttgtaaagagcaaaaaaattgaagtctagaatgaaagatgactcatatgtttcgaccaagctagtcatgaacacaaacaagaagagaaatgattagttcgtgattgagagattatgaatattcataatgttctaaaacggtttatgtggtcccctaaacattatgcagccacaaaccgtgacaatcattttttcggacattgaaattagacattttagttttgactggccttcggcaatattaggtacataattatcaaagttaacatgactccaaaaattaacatatgttttttgatttaaatgatttgatggtaatattaaggttttcatgtcttagagcaattttatttgtggtttctagatataagtttcttaacattaaaacaacaaaaataatattatctaactatgtgagtttcttgaatagttaagaaattctctccaaaatttcctatataaggtattttagagatgactttttcactaatcaaaaagcccacacattcttttataataaattttctttctttaaaataaaagacttatgtttagaaatcatcaatgagattgttcttatgttccaagtgctccaacatcgactttcaagataatagtctttgtggttaagatgacaataattcgattaattttgggtgtgagtcgtgtgactatcccacgaaaataaaattgttttgccaatttgatggtaaaatctcacgataaaaactcaaacaataacagcctaccaaaaaaaaaactcaagaccataacatgttaaatttaaataaataaatatatttttggtttcaataatattgtcgtagaagttttaaaatattttagagataaaaataaaaagaaacacattgattaattacaaaagttaggggctccttatacctttttttttttcatcaaggggctccttatactaaaacaataaaatagagggggcgaatacaaaaacacgattttagagacctaaagctttgagctttcgacgagaaactttcttctctctctctctctccgccattgttcgttccctctccacggtaatctatatccacccgtcgtcaatcggaactttacgaactccttatcaatcgtattttcactttccaattctgagttctcttctcgtttcgtcctctcttcctccgtatccacgggtctcgctttcggtttctagggtttcgcggttctgatcacaagttctgcttcaattgtaagcgatttgatcgcaagtagctgttaaatcggtgcgtaattcaacttttgaaatctcaaggtttagtctctgcaattctgattttgaacacagctagctagtagcagatttaagagttcgtcaaattaggattttgggtttgtttgggtccctttctcaccgaagttctgtatg

SEQ ID NO: 24713 - DNA, 3000 bp, Unknown
  misc_feature (1)..( 3000): 2750-1469P.txt file - cDNA_ID_2183589; gDNA_ID_1972148; Annot_ID_179385
attttagattttttggcctcaaaaggaaaatttcggtttatgtactatttcagaatacaatctagagtagtggttgagattataaccaaaagaagctatgtattacgatttatatttagtattaggttcatgcaataagaagcagtagagtattggccattgtactcttcctcgtataaatgtatccgaaagtaaaaccaaaaatcactctttattagttataatttagtttaatacatcattgatcactaaatcatctcaagaaaagttcaacttcatgatgcaccagatataactcacaagcagaagaaaaatccaagtcggtttcatcaccgaataaataccaaccacgattcattactaataataacatcctggttttacaatcgcacttgcacttctcactaacgtaggctgttttgagttgttccaccaccgtgttgtcagaccaccaaaaaccgtatctaatcttttgaatcttgtatcgaaattccaccaactcattcattgtagttgacatcaactgctttataacagaagacaagatctcgaaacccttttgttttgttttgcctccaagacagattagaatcaccccgtagacatattttgcttctttgatacctttttccgcagcttcagctaaatattcgagtcctcggtcttgaagtttatctcgaaaatagttaatgaatcctttctgaaacaacgcttcggggtttctactctcggtacatctctcgatgaattttgcactgttctcatgccatgggagaaattcgatttctttgagggatagtcggtagaaaacatacttttcatcacagatacgtcgaaacgatttcgaaactagtctgagattacgaaccgctgacaaggaagaagctccggtacatgaagaaatctccacgagaagatcttctggtaaagaatcgagacataagcttgcttttgttttcgatttcctaatagaagaagacgcatgcaaagacaaggataccaccatgttgagagagattcaagagtgtctgttcccaagtttgccaatttgattatttatattaagagggataaattcgtttcctttttttgaggaggagagacagattaatccttttccatatttaaaaaagaaaaaaaaaatagatagatgactaaattttttattttttttaagcaaagatattaaggaaaaaatagatagatgactacaaatattaaggagataaaacttaccaaaaaaaaaaatattaaggagataaatacttaataggctttaaaatcctcctattcttaactcgtctagactcgagaagtttatgagaaattgtatccatcggacaggatcaagaactcactttagccggtttccttttcgaattgttctttggtcggacctttacaaaaacgttttggagatcctgcaagaacaaaaaggtgtctttggaatcaataaagacattaacctaggctactgaattgttttctcaatgaatcgatgagaaaggtagacaaaagaaacagaagaatgtaaagagcttcaagagatcaggagataaatgtaaatcaatactaaaagagattctgtagtagcaagagaagcatcagatatgacatttaataactggctaggttcaatcaaatactcgagagacagtccttgtcgaatgctcatgacataatcaaatctcttatctccattatagacataaccccaagctaaaagtttcagcttttattcacgaaattagcagtaaccacttatcagccatacaaaatctatatgtaaggcgttcaattgtttacctgatctgaagtatcagtaccagaggattcagcagaccaaaggctttccaaattgaaataacctctggctttctcatcaagtgcatggactacaaactttcctacacgtatccataagagctaattacagccaccacaaatcaaaaatgaaaaaccaagacttgtagatacaaaaacgaaccgtagtctatgacaatccacttgctattgtacccttgcacagaaggtaacattacatgtttagctcctttctgcttttgcttggcctgtgattgaacacaaagaatataagaaaacaatgatcactcttatcatcttagtcttcaaattcactcttaacacaaaacacgtactcattatccatccttatatcaacaattgaacaatagcaacgaaggaattgaaaaagtggaaggtgaaatgtgtatgtaccctataaactaaagcttgagcgatgtttcttaagtgccaatcggatctaccggtggcgatgacagtgaaatcagcccagaaacaatgattatgtgtaggaatcacagtcacgttatcagctttcacgtcggcgagaatcttctccacttcgggaagtgtgagaatctctgagacattagagatcccggcggatgaagaaaaagagggagaggaagcgaagatgcgattgggagctagcttccatgattgatttagaagaagagacgaacaacgagatcgaagagtcgtcaacattagctaagcgcggtggagaaatgggggacggttgggtttaaaccctaataccgaattcgattgaccggaacgttggtcaacgctggtgatgcggctttaggtgtttaatttttttgattaaaaaacgctttaattattctcttatacaaaaataaacattaaatttaatacccttagcctattacacaagcaaaagaggaagattgtcacaagcaaaagaggtacaatgaacaaagaatagatttatggtaactagatgatgacatgtgtaatgttaactagggttttacaagggcttaactttagtataaataaggagctatgcctcatgtaatcgttaagaagagaacggatcaatatcaaaagaaacaatctttcttcccagttttagtatcttctacagacagaaggtgacacgcctccctcaatctcaggccacaaacgcgagaacccttgcgcctgataatg

SEQ ID NO: 24714 - DNA, 3003 bp, Unknown
  misc_feature (1)..( 3003): 2750-1469P.txt file - cDNA_ID_2183718; gDNA_ID_1972154; Annot_ID_179404
tttgacgatctgaaggcaccaatgatacaaacaggagtgttctccccacaaatggagtcaaaatttggtcttgacagaagaggtatcttttctgaggactcgttaggggcttggcccgcctgactcttagaagagaccttcttgttcttcttctctaatccttcaagcaatttaccaagttcctggacagctgatttcagatttttcacagtgatacctgttttcaagacttgcttctccccattcgataaccaaccaactattgccggaaacttgtctacccccaacttttgtatctttggatcagaagtatcatggacctacaagatcatgagaaaaaaatactttagctaaaaagatttcatgtctaaggaattctaataattaagttcaaatttgctgactcgtcattaaacgtggaccagggaaccaccccataatttctacgaccatcagactctcgcagtaacaataattgtaggaatagtgatgtaagtggaaattaaagccaaaatataacaaacctctgtgttgtaaaagacaaatcgtccattgtacaagccacttagaacccgccagatgacaggagtgtctttctttgttgacagaagcaaaactttaggagtcttttgtgagctaacggcagatacatcgaatgtattcagatcaatcttttttgagaatctcggtagatgttcctggcagaagcttttcaccttctttgcaacaagctcttcagtatattctgctaaggtagctttgccacttgatgtgtatgaataaacaaacatccttggagccctacgaggaactatgcctagttgtttgcaaagagaggattctgtttcacaatttaatcgcccaacctgtaaacataaagttaaatcacgtaaacaacaaaagaaactacacttcttcttttaagaacgaaacagaaaacccaaaatcaactaacttgacaagcatatgttttacctttaaagctccttgcaacgactcagcaacttcctctatgatggattcatggtactggcttcccctctgagatggaagatacgacaacaaaagccaagtcatcccttggtccacaacgtccttcttatagacctgagagttaatggttttgatagctgctacagtactgctctttgatttagattcagcattcgatgagctaccaaagccaccaaactgctcctttcctttagaactaccgcccgaaaacatggaaaagatatcatccataccaaaaccaaaggagctttcactaggaccgccaaacgagaaagaaaacgatttggaacctcccccaccgcccatattttgccaaccaccaggccctccaaagttgaaaccaccaccacttgaggagtaagaatacccaccattacctccgggaaaccccgaatcaaatccaggctgtcctttctcatctccataaagatcatagtttttcctcttctcttcatcagataagatctcatacgctgttacacatagataagggtttaaacttgtcaaagccagatcaacaaaaattcaatttgtgccacaaacacatggccatagaacaagaataatcttataatatactaaaagattcgattacaggacacatctcctagggaaatttgatacctaccattattaatctcagcaaacttctcctgagcacccttatctttgtttttatctggatgatatttcagagattgcctgccaaaaaaaatcacaagctacatgagtaaactatttgttgatcatcattcgaattattagcttaatcagcgactagaaacgaagggtgcttacttgtggaaagctttctggatttcacgctgctttgcatccttagatactccaagaacctgaagatgcattcattagttaataatgtttataatcaatagcaaaaactactgagcaaaacctaatatatcaaaaatccttcttttctataacacccacaaatttgtcagcccaaacttcaatgagaaaggggacaatcaaaagtaatcattatttccggccccaatcaaaagacttgtgaatggaaagaaaacaagatgaatcacaaaccgtaccttgtaaggatcaacgctcttcgctttcacattcaacaacaacaatgtcgacacaagaacaacagatatcgccaatcttgttctcaccatcccgaaagtacaacctctcaatctttttctcttttattgttttgttgtcaacgaatcttcttcttcctcttctaagcgtgtcttattcacgaaactcaacgcttcgagaaaaatcgagaaggacatcattaaataggttcgcagggtttaaaggaaaaaaaggaaatttctcgaatgacatatatattttaattaatttagagtattccccatatttaatagtcttacaaaagacaccaaaattgtcaattggattaagaaattggtaggggcaattactcacttcaaaaactagcaggggttgtttcgtatttcctgaaaataaattccggttgcttcccgttctcaatttaaggcgggtatcatacgtggcaaatttgatgcaatcccacgtatctccaccaataagattttagcaaacacgagcgatcgttgtttatttgcgttcacgcgccgttaagatcacgcgcgattattaatttgggcttatttattataggcccaataatctgtagttagcccaaaacgaaagtctccggttgggtgatcggaatccgatcagagcgacggtaagtatttcttttttcttcgactgttaaaaaaaaaagaggaaatcattttcactagtgacattgttacgtttcaagagcttaagagaagttgaaagacggaggaagaagaagacgatctttcttctcttctctgtctctactagcttcgcgttttccttccttcgccgtgagattttatcgtcgtcgtaacaaacctctagggttcatcctcgacgtttccttggttaattaggtcaacaatatcgtcggatctgatg

SEQ ID NO: 24715 - DNA, 3000 bp, Unknown
  misc_feature (1)..( 3000): 2750-1469P.txt file - cDNA_ID_2183744; gDNA_ID_1972154; Annot_ID_179410
tgcaacctacattgcacatatattgtcaactttgaagaagactttggtttgaccaaacagagtctaagaactttttcacttaagcataacatgaaatagagcacttacaaagcaatcatcatcaatggtgtagatgtacttctttttggagaccatgtaaccgaagcaacgacaagcagagtccttgaaggaaatgcaagaggccttgggacccaagattcgattgatgtcgttcctgttgtagagctcgtagtcaaaccctactggaatgttgatgactttcgaaggatcaccatcttgaacaatgatcaaatgatactgctcaaagaaaggtcgccacatctcaaggaagtcgaggtttcgaatcgtaggtatcacaatgtctagctcatctttcaacattggcgtgggtttcacggaagaatacaattgcgccatttgaaacgacaaggaagaaagagtagtttatgattaagcaaagacaaagagagatgtacgataacaaggatgacttcttggtatttatagagatgagattgagataatcattttcactcttaacggaagaaaaaaggtatattcatgccaaaacatgtttcttcttttcatgttttcaacacaacccaaattcacgactctcacccgctctacctctctaaacccaaatcacgtgaccgtcgtctgtttgtagaagatttgttagaacaaaacatgaaaagttttattaatatgttttttttatcaaaataattttaggaattgttttagttgaactgaaatagaaaagaatgcaggagctggtgccatagtggcatagtgccacatacatttttttccttgtatgtatttagaaaatttgaaagctctaaacaaactaaagaagcaaagaatctttatttagttttttatttttcccccaatctaataacaaatttaaaagaacgaaaaaaaaaaaaatgctaaaatgtaaaaccccaaacccaaaccaaaagctctgaaggacgttgagaaatctcaatgcgacatcgttcaagaacctcacaatctcccaaacaaagacccacactaccacatacctagtcataaccgaaaatcaaacgtagcagtaagatagaaagagacagactaggaagacgaaaacattcgtttgattccagatttctgctctgttgttagcctcgatgggaacttaacagtgaacttgattctcaagttccctttctttgatgggtctttagggattggcatgccttcacctttcaccacctcttcataagaagggctgatcacgttgttaattggaaccgttactgatcttccatccagagtcgagacctgagcagtgtatcccgtgagggcttccacaagagggatcttctgtgtcatcacaaggtcattcccgtctcgcttgaacaccgcatgtggcttctcatcaactatgaatacaagatctgatggtatgattcctcgctgctcgtttcctttctccgggaaggtaatcttcgtccctttcttccaccctggcttgatttctatcgtcaagatctcctcaactgttgtgggtctcctgcattgcaacaaagaatacactttcaacttgcattaccgataacaacaacatcatagctacaaaaaaaacaactctaatgagtccaacataatctatccaatggctaatgactaatttctagcactacatctttcatgtatttatccagctccaaagctccttaaggtaaaaattcctaagcaaatcaatgttttggaactaaatccataagaaggtgattcttaaactcaattcatgacaatgtagctgaaaaaaaactgacccgcttgaatcgaggacgtcccgagagatcttcatcttcttactgactcctttgtagagatcttccaaactacaaggaagttgtctctcaataggggcagctttcctcggtggaacaacatttgacgagaaaacgtcttccgcgaaccggaacccattagagggacctgcaccacgtgagtcaccaaatggtcttgtgaagccaaagaactccgagaagatatcatctgcgcttctaccgttgaaccggaacgaagcccctccatccgaaaacccgccgcctgctccgggaggcggagcctggcttgttagaccttcttctccatattgatcatagatggctctcttttgaggatcactcaaaaccttacaaaatccaacagcataaggaatctatcaaacacaattctacaagcaaatcaagattacttaattgccagagaagtaaccatagtgaattgacaaactacacaattgctcaaattcaagcaaaagatgggaatctctctgaaaagagaaaacgcattttgttaatttacatcgtaagcttcggagatctgcttgaatttggcttcggcgtcttttttgttgttagggttcttgtctggatgccacttcatggcgagtttgcgataagctttcttcaagtcgtcgtctttcgcattccgatccacctgaagaaccttgtaataatcgacccccattgctatacctcctccttcttcttcttcctctttgattcgctcttcgaatttcactcgatcttcttcaatgggaaaaactctagcggatcattccgtaccggttcgaaatatttatcgagatacaagaaatacccgaccggttcttttatttggtctttaccggttctgtttttggttcggcaaacctagctcaaaagtcaaaccttatcagaattaagaatcacggtgtcgtttcaaagagaggaaatttacacttagtagccctatatatttattatttaacatttgaccccactagtatatgtttgttactttactttaagcgagggtgatagtcaaattatgaaatatctgagggcctaaaatggaaataagtaagaagttttggggtgttcttaaaatgaaaaatctgaagaacaatatcattggttaaattcctctgaaaatccaaaagaattaaagatg

SEQ ID NO: 24716 - DNA, 3003 bp, Unknown
  misc_feature (1)..( 3003): 2750-1469P.txt file - cDNA_ID_2183772; gDNA_ID_1972154; Annot_ID_179417
cggcgcagacagaagaggaaaccacatcggtcttaatttcaacaacctctcctccaatgtacaagaaccactcatttactacgacacagaggatcgaaaggaagattttcagctcgagagcggcgaaccaatccgagttcttatcgattacgacggatccagcgaaaccttaaacgttacaatctatccgacgagattagagtttaaacccaagaagcctctaatctcgcgacgagtttcagagctgtcggagattgtgaaggatgaaatgtacgtcggattcaccgccgcgactggaaaagaccagtcgagtgctcactatgtaatgggttggagtttttcaagctgcggagaaaatccaatggcggattggctcgagatctcgcggcttcctcctccacctcgcttgagtaacaagaaaggttacaattctcaagtcattgttttgattgttgctttatcgatcgtcacactggtcttgcttgtgttactatttatatttgtgatgtacaaaaggcgaatccaagaagaagatactctagaggattgggagattgattatcctcataggtttagatacagagatctctacttagcaacgaagaaattcaaagagagtgagattatcggtactggaggatttggaatcgtttacagaggaaatctatcttcttcgggtccaatcgcagtgaagaagataacctcaaatagcttacaaggtgttcgagaatttatggcagagatcgagagtttaggaagattaggtcataagaacctcgtgaatcttcaaggatggtgcaaacacaagaacgagctcttgttaatttacgattatatacccaacggaagtctcgactcgttgctgtaccaaacgccgagaagaaacggcatcgtgttgccgtgggacgtgcgtttcgagatcataaagggaatcgcgtcgggactgttgtaccttcatgaggaatgggaacagatcgtggttcatagagacgtgaaaccgagcaatgttcttattgatgaagatatgaacgctaaattaggcgattttggactcgcgaggctttatgaacgcggaacgttaacgcagaccacgaaaatcgttggcactttagggtacatggcgcctgagctcacacgtaacggtaaaggctcaaccgcgtctgacgttttcgcgtttggcgttttgttgttagaaatagtgtgtgggaataaaccaacgaatgcagagaacttcttcttagctgattgggtaatggaatttcatactaatggtggaatcctttgcgtcgtggatcagaatctcgggtctagtttcaatggcagagaggctaaactagctcttgttgtggggttactatgttgccatcagaaaccaaaatttaggccatcgatgagaatggtgcttagatatttgaatggtgaagagaatgttccacagattgatgaaaattggggattctcggattcttcgagagacgatcataaatcgaatgttgtaggttatgtttcgtctgatagagcctcgagctcgaatactttttcgtctttctccaatgtttcttcaagctctatcgttagtggtagatagtttcatagcacttttagcatagcttatttattttctagaaacagaacattttgtatgtttttactatttatgctaagaaggaactaaatgtatgacgtgtgtgtcgattatgtcttattatggaccagtgaacccattacccatattactaagtgaatgatagatacaacttgtacaatacaagggttcattgtttccagctttattaggtacaatattatttttgcattactaaaaacagacttttcttttgtctaaacatttttttgtaaattataacataaaatgcaaatagcaaacaaaatatattttcttattccaatgcaaacaaaatatctttcttattccgttttagtttgcttttgttatcaactcaagactttgatcggtgacttaaaacaaatgttaaaaagacgatccaatccctcatatatgattgaaaactttgatacaaaatgagattgacagaagataagactaacaggtccgttctagattctttccaaacgtaacagcatgattggatcattttaagcaatttcaagtggagaaaatagaaaaatattgtgtgttgcccaattatttcaatcaacaattcaaaattattatgatatgggcttggtaggttgatggtttcactttcataacacaacgacaagtgaactacgaacctatgcctcagtttgtgtccaggttcatgatggacatgcctataattagaaacgtgtattgaaagaaagcgtctaaactttgcaattggctacagaagttttaaaacaatgattgcgttgtgaacattactgaattttcataacaactcaaaccattttttacaaatattacgacacagttgttttgttactgtgatatctgttgtttctatgctttaaaatttaaataaacaactgtgattcgttgtatagaaccgtgtatcagactatcactatcctacaagttaattaattacgccaaaaacaagttaattacgccaatcaaactaaagaaaactataataatagcgtgactctatggtttggtactttggttaatgtgctgcttacttgctcatcttatctatgattagaatatttacttaataagtggagttttaaactgtatttctcatgtattttagtgaatctcatattaacttattaggttatactttttgataaataatttaggttagacttaggtaagataagtacgtattaaactgggatgaagataaaacaatgccaaaacaaacggacacgcttcagctgatgatagatttaattttgccaatagtataaaccagttacgcctttttatagaacaactctgccatacttgataattcatacactctatctcttctctctctcaatctctcaaaagatctccggtaacgttttaacgtcggtgaaaaaatg

SEQ ID NO: 24717 - DNA, 1931 bp, Unknown
  misc_feature (1)..( 1931): 2750-1469P.txt file - cDNA_ID_2183804; gDNA_ID_1972144; Annot_ID_179348
ctttacacttggtttgtgctgaagcaaaaggaggtaagtgaattgataacttgcatcattctgatgcttcttgtgtttatgttggttaaggaaactcatttatttctttctctgcagatttttccgtgtgaagctagagtaatgaacttgggatcaagatttatgactgtttacattagcaagcttggcgtaagtctctactgattcatttaccacaattaaatttatctaaattcctgtttacagtctgctaaacacttgttgttattgatgctgtcacagattgaacggagaatatactacgaccaaatcgaaggcttgtgtgcagactggctagaggcaacatcaacgttaatcgtcgataaactctattccaagagaggtggaagaggctttttcaagcccatgaaggaagctgtctatttggtgagtccttgtgaagtgtgcgttgcaaaatgcagtgcattgtctgtccatgacactgagtcaccagaggccgtgtcaatagatgaggttgcccctgcggtttttcctttgaccatccaacttttctcgaccattcctgtggttcttcatgctgttggtggagatgatggtccgctcgatataggagcaaggctctacatgagttcatactattagatattggagcaaaagagggatctctgaagaggtagattatagcaactgttgtatattttttggattacagttgctgaaaaaagaaaatcatgtcggactagaacagctccgtagttgggatgatatagataatgtggggacttgccgttgtttttggttcggtctagaaaccccattggtttgattcgaagttgtgctaaatgtgtttctatttcctttgttttcatgattttgctcgcccaagatgttttagatttgggttcggccagaatctgtatatatatcgattagggagttttctctctttaccgtgctaaatgtgttacatttttaataatctttttaaaaacaagatcttcaaagtctacactcgaacttgagacattgaaaatcagtcttctaaagaaggagagtaactggagcttgaagaaggagagctttgctttgatggtcgaatcgatgaggtcgcgtcaaaatctgtaaaccggaatctgatccaactcgagaatttgaaacgatcaggcagttggattgggcctgataggctattaatatatatagcataaagaagcccaattatataaaatgtccaaactcatcatttacacatttggttataaaatacatcaattcagctgtaacaagtggtactgtagtacataattttaataatttatcaaaattcgaatttccaacacttaccaatttcacgagctactcacttaaaagctatacttttcgatgattaaaaaaaaaaagctatacttttcaaacttggccacacaaaaggcttacattaacccacacagagtaagtgtagtcagaagccaactttggtgggctttgccactagcctataataccctcggctaacatatgcttatcctctaccagtaaacattttggaaagaaaaataaatccacaatttatccttgatgttaaatttaactaaaattaggtacacttagactaatcaaacaaaaatgagattttcttggctgataaattagaaattcgtatttttttattttactttttgccgtatgttttgttatattattagaaaattgataaagaaaaggtttaacaacaaaactaaaacttggcatcgtcaacttcagggcggcatggtatggcccatgaagcatcatgagttgtgttgtaaaagcccacttgacgtcaaaagttgcaacttgttgcgacaaaaggcaaaaattcctaaatttcgaacgaatcaaaaaccctaaaaagcttaccgaatttttcttgtggtaatgcagagtcaatg

SEQ ID NO: 24718 - DNA, 3003 bp, Unknown
  misc_feature (1)..( 3003): 2750-1469P.txt file - cDNA_ID_2183928; gDNA_ID_1972158; Annot_ID_179490
ctgattgacaaggttttctcttgatttatgtattgttgttttgtgttgttgaaatgaatgatatttgggattcagattcgtaaagctttaaatctttatgtgttcttttcttggtaatggatttatttattttttgtatcgttgtttcagaggctcttgagaatggaagcagaaacgtcttggaccaattatccgtacagctacattacatatgtccctgaagctgaatcataccgtgagcagagcgacgatgaagccaaagtcgaaaccttttcaatggattctcttctccctgacgatttattagaacgaatcctctcgtttctacccattgcaagcatcttcagagctggtactgtctgcaaaagatggaacgagattgtatcttctcggaggttcttatgtaatttctccaacaattcggtttcccaaaggccttggtacttcatgttcactaccacggatgatccatctggttatgcttatgaccccattatccgcaaatggtacagtttcgatctcccttgtatcgaaacatccaattggtttgttgcttcctcttgtggattggtttgcttcatggacaatgattgcagaaacaagatttatgtctcaaatccaattaccaaacaatggaggacgcttattgaacctcctggtcacaaatcgacagattacacggcaatgtctacctccgtaaaccgagcgaaccaagcagtaaaccgcgcaaaccggagttactcagtctcgatagtgaaatcgaagcaagttccagggaatttcttccaatgggatctctctattcatctctacagctctgaaacaatgacttggacaacattagtaaacgatgtcttatccggatggagaggagggaacgagagtgtgatctgcaacaatgttctttacttcatgatatactcaacgggaggctcagatcatcgccacggcttgatcgcttcgaatctatcctcgataggatcaccgtcaagcggaatcttgatgaggagtttcattccaatgccgtgttctttaacctgcgggagattgatgaatctaagagagaggcttgtgattgtcggaggaatcgggaaacatgatcgaccagaggttataaaagggatagggatttgggttttgaaagggaaggaatgggtagagatggcgaaaatgcctcaaagattcttccaaggttttggtgaattcgacgaggttttcgcgagtagtggcacggatgatttggtttacattcaaagctatggatctcccgcgcttctcacgttcgacatgaatctcaagtattggagatggtctcagaaatgtcctgttactaaaaagttccctcttcagctctttactgggttttgcttcgaaccaagactcgagattgctccttagttgcaatgaagaagcaaatgggtctgtgaaagtcttggtcttttggattgtttttgcacagagaaatcgccggcggctttatgaagatgatgatacggtaatgtttttaaattttagttactggaaatgtttttcaggaatattgttatttgcaatttggtactctgttaattataaatttataaaatgaggcccagatacttttatttgaacaaacgaacccttctctatctctcagtgaaatataagaacatttttcaacatgtggcccacaatatctcatgtaaatgggtcggattctgaaactggaggttgtcttgttgctgttcctggtggataaaaataatgattttgttccttttttttccacatatattcataatgatttttcatgttttattaattaattattgttgtaaattattttaaagaattatgtttctgtacttgtataaaattgggacctattttcgtgatgggatttgtcaggtttggcagtgttaggtttacgggtaatggacaacagctattttattgtgtattttatcattttctcaagggtcacttattttcaattttcatagctataataatttactaaattttaaaatataacaaaatgtcattcattagttataatcgtataaaagttgacgaagtgatatatagattctacatactaaaaacaaaattaatttgtgtcattatgccaaaatgtcaaaaggaaaagaaaatttagacaattactctgacacatcaaatcagctaaaacctaactaaatataccaaactagcaacacatatttttgttattaaaagcatttataatgataaatcatgatcagaatcatagtaagcagattcgaacactagtctctcaaatttcggtagtaaagttttcaaccattagaagacaaatacgattttaacatcattagtattgttttttcttttttaatttaagcgttggctttccaaaatgaaatagtaacaagcattaacgagttaagttgtcaatgggggaagttaaaactctttaaaaccaaaaaattgaccacacaacacatatagtgcccactagttctctcaaacgaatatggaatactttaaaacccacctctattctcaagaattaaagcccagaatttcaacgttctaaaaatagttttgaaagatttgtttttcacgggtttttcgtaaaataattatgaacaaaacaaataaattcaaactaatttttacacgtacaaatctgactcctagcctcctagatgaaattcaaaattttgtaccagcagctcaaagctactaggtaaaaaatgtcacgagagaaaaccggaggaatattggtggttcatcaatacgaatcaaaccgaaccaagtcataaaccggttcatagaaagataagaagacagacaatcagtcatcactttggtctcgttgagcctttcgtctatctctcacctgaaagaaagacgttcagctttctctttccaaaatcaaaagctctccgatcagtttctccggcttaggaaattaattgaaggaaggtgatgagaggtactactgagaatacggatctgttcgatcccaaaacccaaatg

SEQ ID NO: 24719 - DNA, 3003 bp, Unknown; identical to SEQ ID NO: 24718
  misc_feature (1)..( 3003): 2750-1469P.txt file - cDNA_ID_2183928; gDNA_ID_1972163; Annot_ID_179648

SEQ ID NO: 24720 - DNA, 3003 bp, Unknown
  misc_feature (1)..( 3003): 2750-1469P.txt file - cDNA_ID_2183953; gDNA_ID_1972158; Annot_ID_179499
tagaagacacgcactcactgtcagaaatctacatcgagaaacacacttccactttccaaaaacatcattcatgaaaaagaccacagagaaaacgaagaatatggttgatgatgatgatcgtatactatgggattgtggaagtccactctatgattcctacgagctcgtttctcttactcacatcattgaacgccatttcatgtctctaccttctcttgctggcgccggaaaagtttgctgctctcgaagaccgtctgatctggaagaaaaggccaatcgtggggccaacaccgtcgttgatctgtgttgttcctctgattcgacgactggtaaactgttgtgcggtgcttttggaaccaaatggtggaagagaaagcaaaacaccgaagctgtcgtcgataattacaacaacaagaagaagaatatgttttgtcggatcctctctaagataaggatttctacaacaagatctggttcttcgaagatgtgattttcatatcttctttttctgtttttagtatttgtttgatccttcgtaaaataataattaagtatattacttgctcatgttttttaatttgaaaatttaatcgaataaactgtaatgaaacgggaaatacattttattgacttatggattaaatgcagagtaattagtttaagttgaagaatttcatggatttaatatccatcacatcatacgtctctgaaacgtttaggcaaagagtgaaacgtggatcaacatgcaatcaacgtttacattggggaatatgagatatatagcgatagaatgatataggagtcgtttagcaattgccattttactaacagttcatcggggtgtcagaagaaaaatatgaacttcatagaaaatcctcaagtgaataacaaaggacaaaacatgtgaagcaatttgaaaatttcatgattcttctgacaatattctaacatgcaaattgcaaatgattcttgactcagtcaatgatttaggtcttgggaacttggtaaatttgtgtaatttgttactctttaaaaaagtgttgagtatgcgcagatgggcttcttgaataaaagtctgtaacggcccatctctataactttgaacagaattaaaggctatattgtttccgttagaatttaccttttcttgttgagtatagtttagccgttacaacataaaatgcttcctcaataaagtattaaagcttatgataacaacgagcatcttcgaatttgttcctccatatactttagtttatatcatataagtagactatttttgaaacacttatattaacaacattgaggggtgttatattacactccaattcacatcatcaagagtacaaaaggctgctgaagaaagaaaagagaggaacaaatcacaataattaaaatcacaagaaagtgtaaaatgaatgcgaaatagaccaatagctataattgcataatccattaccaattgttgtctcaaaaagcagttaagtctctcgtttctatggttctccatcaacttcagagatcttttatgggctccacattttcattttaaagttttataaatttaattactttattaccaaaagaagcaattttgttaagatcaaagtaaaaaatcaaatccgtaaaatgatccacctaaattgcttcttcttcctctgtggttaacacttagacttagtagtaagataaagatccaatttcttaaagtgaaagtcataaaaaagagttagaaaaacagtcaaaagaaacacacacgagaaagaaaatgtggtgaagcttcgaatgggttgggtcgtttggtgtggcattgggctccaccaaagtatacacatggaccactttaatttaacgtttcgtcgtctttgaccttttaatttacgaatatttcctctctctctttatatttttgtttgccatttcatttctttactttgttttaattttctctgccattttgatttcgtgtaattgatgaatgctataaatctttattctgtcacatcttttaacaaaggccaaaaccctgcttttctttttacctcagtggtcgctgacatagaagctataaagaaaagctattatgtatatggttgttataaataaagcaaaagcaaaattcccccaacttatttattttcttcataatccactaataagtttcaaaatgcatactgaaaaaagataaaaagtaaaaccaaccatttcgtattttacaacaataaaaaacaaaaaagagtgtgtgaaaatggaaaaagtacacatcagcataaacactactaataacggcgtagaagaagaagcagacggaactgagagtttcgccgttaggaagatacggaccattgtggtggttgcgtcacagctcagagaggaataatgaaaacaaataaccaccaagtaacttacagtaaaaacgctcactgtaaaaaacgccgtcgtttcaataaatgttggtagctgctaaaacgacgtcatttattttctgaaagagagagagagagatgttttatactacttcttactctgtgccgtgtggaaaggagcgaaatttgcagaagaaacaaagcataaccccccagagaaagagagagagtttctcccaacaagatcaaacttcgaactctacgagaactactattatccaaaacgcgaaatagagagacagagatttcataaatttcttactttttaaccccaaagttcttttccagacagcgttttcctctgtcctttgctctttgtgggtttactccttcttccggtttggatatcccgagctagtaaagaagggatccagtagcagaagctgaagctaataaacccaatcatagagaaagctctctgaacaaaaggttcagtttttctctctttcttcaaaactgaaatcttctttgtgtgattcattcactaataagtcgtcattctttcttctccttctgatttctgtgtactttttctctgtcagacattttctgggtttgttttaattaaaaagaaatg

SEQ ID NO: 24721 - DNA, 3000 bp, Unknown; identical to SEQ ID NO: 9584
  misc_feature (1)..( 3000): 2750-1469P.txt file - cDNA_ID_2183969; gDNA_ID_2684110; Annot_ID_190566

SEQ ID NO: 24722 - DNA, 3000 bp, Unknown; identical to SEQ ID NO: 9584
  misc_feature (1)..( 3000): 2750-1469P.txt file - cDNA_ID_2183969; gDNA_ID_1972158; Annot_ID_179506

SEQ ID NO: 24723 - DNA, 3000 bp, Unknown; identical to SEQ ID NO: 9579
  misc_feature (1)..( 3000): 2750-1469P.txt file - cDNA_ID_2183981; gDNA_ID_2684110; Annot_ID_190570

SEQ ID NO: 24724 - DNA, 3000 bp, Unknown; identical to SEQ ID NO: 9579
  misc_feature (1)..( 3000): 2750-1469P.txt file - cDNA_ID_2183981; gDNA_ID_1972158; Annot_ID_179510

SEQ ID NO: 24725 - DNA, 2609 bp, Unknown; identical to SEQ ID NO: 225
  misc_feature (1)..( 2609): 2750-1469P.txt file - cDNA_ID_2184016; gDNA_ID_30983; Annot_ID_146894

SEQ ID NO: 24726 - DNA, 3000 bp, Unknown; identical to SEQ ID NO: 9581
  misc_feature (1)..( 3000): 2750-1469P.txt file - cDNA_ID_2184029; gDNA_ID_2684110; Annot_ID_190576

SEQ ID NO: 24727 - DNA, 3000 bp, Unknown; identical to SEQ ID NO: 9581
  misc_feature (1)..( 3000): 2750-1469P.txt file - cDNA_ID_2184029; gDNA_ID_1972158; Annot_ID_179518

SEQ ID NO: 24728 - DNA, 3003 bp, Unknown
  misc_feature (1)..( 3003): 2750-1469P.txt file - cDNA_ID_2184050; gDNA_ID_1972159; Annot_ID_179536
ggctcgtttgaagagtgagatattgggttgttttaggcccaagaagaaaagaagaaagagagtgttgaagaacttaaatccatctttttctttaatctctctttttcaagatcatgttcatctttcaaaatcttacagagttacagtgacatttgagattaccttttaaactgttaactcaaatcttataatggattagaagatactgaagatccttataagatattttgggaatattcttcatgcattttgtaggaaattacaaaatttagtgtgctaacagatgatctagccagaccccagaaaacaagatacataagccatcgattcggcctcaaaatttgaaagccattttaaaagaaaaaactgttacaaatatttttgagtttgtagaatcctactatttacattgtagtctgttatataatcccacatttgattaacactaaaattttggagcaaatgatgagattgactattatcttgacctttttaaaaaaaaaacaaattaatctcttctctttttattattgaaaaagtgtattaggaaactagctagatgtagcagtctcaagctctatataaacattatgtatgatcacttttattattataagtgtgaaagtaaatacaaattctatccattaaaaactcttatcaaagtctactagagagaacttgtgaattcaaaaaactatttttaactgtagttttttgaaaattaagtttatttgttcgattatggtccatacttttttcccttcaatattatagataaagacgatatccaaacctaactggaaatcaccatgcaaaattcatcacaaatttaagtttacgttgtcatatattatcactttcttggaaattcagagaagcatgaatatatcaacgtaaataagtttgtcagaggaaaataaagttcattagaggacgacccactaaagaagaagaaatatattagacaagtcgtataattagccaacaacataactattattattattccaatctacttcacgaaaagctcttctctataagcttcacaaactcataaaaatcaatttttccatctctattctcatcataaaccttaaccatcttcctacactccatctttgtacactcatcgtatcctaacaaactcaacacatgttttaactcattttcatctataaacccatcctgattctcatcaaataacctaaacgcctctttaactatctccttacccatcatctcattcttctcaagcaagtactcttctccttcttcaatcaaacattcgtataaagcttccgagtcatcgattatcgccttgacttcttccacggacgttttgatatctgctcgatttgggacaacaactttctttatgattgggagctcggtattttgcttattgtttcttattgaggtgaagagaatgtaggcattagagaagaagagatggaaacgaaagggaaaagaagaagagaagtcttgaattatcatcatgagattgagaatgaataagaagatgacaatggtgaggagagagattgggctaagaagagacgaatcctccatattgatctaaatttatgtgtgtggaataccataaacaaaatttctatgaagcttttatttgtcttctttggtttcaaaggttggataataagtgtgttgagttggtcctattttataattcctagttaagtatacgaagaccaaaacatatcttactcacaaagtctgcggaaagagtctccatgtaaattgttgagaaacttaccaaaggaaagaaaaatgctactttaaaactcaccgcaattcaattgaaagtattatattcatacttttatacctaccgagaaaacctaagaaactaccatcgactcaagctttcattaatgatgatcatactaataaaaacttaatgcttgttattaataattaatctgtattttcatttcaaaattaatatatgttcttgaaaatgtttggcttttcaagtaataggtggagtatatatatatatatatatatatatatatatatatatatatatatatatctcaaaatcaaattgaaatttttggactgaaccaaatggagacatggaagttaatcttgtcatataagaaaaaaacaaatgtttatatatattttgatagttgaataataaatgtaatcaacttctcatcatatccaagaacacaagacaatagagttgaaaattgagtgagagcatctttcattgtcttggattccaattcatggaaatttccatgcaatttccttgtaacgttttcctttaaatttattatcttgttgctttcaccgacccaagtaccctttggaatatttgatatgtagaaatattgagactcttcgtggtagttcagtttcaaacccatgatcagtttttgattcaaataaaaaacatttattattatagttgaatgatttgaaaacctcggaatctaaagttcacgtggtaattttcttaatcgtttttttatggagtataataggcttaaaaaattattaactaaataataatgtaataggcgctagactaattcaatttggttactattgaatcaaaatataaatagaaggctagcaaattaaattgaattaaatataaataagtttgaaaatattgaaatctacatctagccatctaaaacatagatgagaagtttcagttgcgataggttttagtacattaaattaaattcgaactaaccttataatttgttctattatatagttttgactggttacgaatatcgaaatggtttaaacaagaacatttggaagaaaaaaaaacatgagttgtaaaatatattaatcccaagagcaatgacaaagttttgtacttttcatgtctacttcttatctttgtagatagaaaattacgaatatcgaaataaccatcttgaatatacacgtatgagtaacgagcccatatatttatgttcgtatgtttatgggcctaatgagattaagagaatg

SEQ ID NO: 24729 - DNA, 3003 bp, Unknown
  misc_feature (1)..( 3003): 2750-1469P.txt file - cDNA_ID_2184068; gDNA_ID_1972159; Annot_ID_179543
caagtagacgagcacgtcccaagaggtcaacaacgcagccatagtgatgtaaatttggctttatcttaaattcaccactcctcattctatcgaaaaacatcattccttcagcgaccagcccggaatggctacaggcagacaataaaccagtgagtgtctgttcctctggagagattccaaacttcaacatttcgttgaaagcttcaatggcttcttttccaaacccattcatagctaaacccgagatcagagccgtccacgagactacgtttctttcacgcattccataaaatacttggtaagccttatccatagacccgcaacgtgagtacattgaaaccagagtgttactcaaattcaaagcaccactgagtccattttcatcgataaagtcatgaacttgtttaccaaaatccaacgcccccaagttagcacaagcttgtaaagctaacaaacatgttacaccatctggttttacacaaccatcgacatcgttcttcatcttatcaaacaaaactaaaacatctctcgtacgtttattccgcagataacacgaaaacagcacattccaagaaacagtatctctcttgggaatttcgtcgaacactttacatgcatcagtactgttttcgcaagtggagtaaagatccatcagagtcgtcataagaagactatccgagagaaacccatcactgaaaatcttgccgtgaatctgcaaaccaccgagtaagtcacctgatttgatacaacacttgagagcaaaagaagacgagagcggattagcaggaagagagctgtttcgtcgaagagatcgaaacaagcgaaacccttcgcatggagtttggctgagagagaaagctctgatcatggtgttgcagtgagagagagttgggttcaatctctgggagaaaactcggcatgagtaattgatgtctcgaggaatcagagagagagcgagacgagagaggaaatggtggaaaacgtcagagtttctgattaaggaagtgcggagtaagagggcgtgaatctgccggagatggagttttccggtggaagatacgatcagagaaagaagatgatcgtcgccgctgctgctgcttatggacttcaacatagtcttctggtgaaaagaaagtatactaagctttgatttaaaaggttttactaattttatttcgttttaagtattaaaacttgaagttttgatatatgcaagcacatgatgtaaaacagttttatttttggttttgaataaatattacattcaattcaaaaaaacattatgagcaaaaaattcaaaagattatttctaattgattatatgtcacaactttaggaaagtaaatgaggtttacataaataatacaaatagaataaaaaagagttgaaacatattcaatcatctgtattaccttttattcaaaaaatcgctagatgctaatattttattaattatatgtatttttgtataaaatcaaataaattagaaataagaacaaataaatagaaaagaaaaattatatatttatatttaatataagtaaaaagagtttagaaaattaactattaaataaatatagttcaataaaaaaataaattatattaagaatataaatttaagacaatgagattatatgtcacaactttaggaaagtaaatgagattttatagggactaaaaactaaataatatttattttagagatttttgcctcataaactttacaaaaaaatatatagatggaaaaaagacttccaaaaaacttatttcccattcacagcgttacattttgatttgttgtcttttttctatgcccattttgttattttctatttggttttcagttcctaaaagacggaagttatattatttttatttatttttagtatcattccgcaagtaattaaatctatacatgttttagattttaatataaattctgattgaaaaacatactaattttctctgaacgaaagttcattaaacaatgttggtgaaaaagaaagttgataaaaacaatgcattgtttgatgttaccatactaacagtacaacggcggcgccaaagtcttttccaatatactagtttcttttgacatcaagtgattttattaatagatggtaccataagaggttacaacccaaatttgtatcaactaccaactaaacctatttaaagagtaatgccgctttactctcaaacatatagaaataaaagtaaaaacttagcccaaagtttggtgaaagaagctcaacttaaagagcttaggaaagatcctacaaatgatattctatcataaaaggataaatccccgatgtactatttgaatcgactaaactacttttaaaaccagttaagaaactagaaactaaccctagaagaacctcagtcaagcttccttgttcattactgtaggataggcccatagtttaatctctttttaggtaggatcgacagaaataaaaaacagatgggcaaccatgcatggtaattctcgaccctgtctccgagggacagttgaatgaacgactcatgaatactgtcggcacggacgagccaataattcgaacgagtttagtctattttgaattttctagctaccttataaataaaaagctaaatgacatgtaacttcatttaaaagaaaacttatagaagaagacaaacaaacaaagaaaatatatataataaaaagaaagataaaggttgccaccacgtaacaaccacttccactactactctttcgtcgtaatgaagaaagctgaccgtgccggagtttcatcttcaccggatcaccaaattagtcttctttatatagccgatgaaaataccacgtgactccaacgaccaaaataccaaagtccattagtataaagaaaaacatttatttacaaaaaaaaaacgatggatatctcaaaaataaaatgaccaaactacccaaccattatccctatatgtataacacacagcctcttctttttcacccacaaacaacataacatg

SEQ ID NO: 24730 - DNA, 3003 bp, Unknown
  misc_feature (1)..( 3003): 2750-1469P.txt file - cDNA_ID_2184073; gDNA_ID_1972159; Annot_ID_179545
aaattagtcttctttatatagccgatgaaaataccacgtgactccaacgaccaaaataccaaagtccattagtataaagaaaaacatttatttacaaaaaaaaaacgatggatatctcaaaaataaaatgaccaaactacccaaccattatccctatatgtataacacacagcctcttctttttcacccacaaacaacataacatggcttccaccaaaatttccttagtctttttcctttgcctcgtaggtccttgtataggcgctggaaccacaagcgctgccgaatcagtcagtagcattgtgacacaaggtttctttaacaacattatcaaccaagccggtaatggctgcacgagaaaaagattcaacacccgcgactctttcattgacgctgctaataattttccaaactttgcaagttccgttacaagacgtgaaattgcaagcatgtttgctcatgtcactcacgagaccggacgtaagatttttttttccttttctctatgtttttatatattattaaaaacttattagttttgtttgtacatctactctagtcatgagtaaattattctcaaaacttttctctattttaaagtaaaaaatagagatttacattggagattgtctaagggttgaggtgtttcattattatttgagattatcaaatggtgattataatagttttattagagcacgttaagattaaacctgtaaaactgaacatttgacttaagctgattaaaaatcataacctttttttccatgtgatctctatgtcgtatagacttctgctacatagaagaaataaagaaaaggtcacgtggtaggtgcgacgagaacgtagagcagagaccatgtccatcacagagtaaaggtcactccggtcgtggtcatcagagtctcggtctcgaccttctacgccagcctgagcttgtgggtagcaacccaactgtagctttcaggaagggtttgtcgttttggattaatagcgtaaggccggtgctgaaccaaggatttggagccactataagagccatcaatgggatggaatgtaacggtgggaattcaggtgcggtcaaggcaaggattgggtactatagagactattgtagacagcttggtgtggatcctggtcataaccttagttgctaaaacgttttacaaacgcatacacgtgacgtgtcacgtgataatgcggaataagaagttacatttcaaacagggcaaggattcagaatcgcaagtacatgaattaacattctgtaactgttaattgtatcaagttgtgttaatatataagagctaggagaattggtctttcttatgtctagctagtaaccatctatgtttgtagctaggagctacttgttgtttctagttgtttgtctatctaagccaatcatacaaaatctatgcttattcacaaacatggagatcgatgttgcaaaattcatcatttcgattttcacaaacaattaaaatcacgctaccatggctcgcatgcactccatccgccgttggcatctccctccgagcagatcttgttgtcgttctcgtttcccttcaatagaggacttgattcctcatggtcttcgcggctatcttctcccgctatagattaaatacattctcatggtaggctaatgtatttgattgttggtcttccttatgtttattagtaacgttttgacgcctcctctaatcgtcttctcgggcatggggatgaccctttttggccaaatctagtagcactcgtctcaataaaaaaattgcacaaacaatcaaatacattagcctacccgagattctttcagatgcttagaaaccgatttgaatagtcatgttctaaccaaaacaaaaacatattatctttgacaaatcctaaaagtataaatggttcattcccacggtatttcaactcctctaaaccagtattagaaccatatgaatcaaatcgtataatcaagtatccacgaaacatcataatactaagctacatatataccttgatttatcagagttactattgtcattttgcaagtttcagatttgtctttgagaaaattgtcttactttgttgatattgagattatataaaccggataagcgaccttgattttacatgattttgctgttttaaaaaaaaacctaaccggtttcatttaattccgcatgttattaaaaaagagggaaaagtcaaagagtcaaacttattaggaacgtctagaattttccaacttggtccattttgcctactctattggaaaaaggaaacaaatatgtatattattatatgtcacataaattcttttccaacgaaacttcaataatttaccatatggaccaattttaattaattcctgtatcagatttaggtgaaacaatcttaataaacatttaaactcaaaaccaaaaaactgtaacacatttttccgtcaaaattgacgagaagaacaagcggctttctctactagccgttaaacagacgttatcttaccaaactccaaagctctggttcgtacaaacccgaacctcatccaatgcttatacacgtatgtatgtatacatttcttttagatattttataaaaacacgctcccaaaaatatttaatagagttgaattatgtttatctgattattattcagaccgaacacgaagaaacaaaaattcaacaaaaacaaagacaaagtttcgttttagcttaaaggttccagatttcgaaaaagctctctttttttttctccttcgtgttacacaaccatttctaggtaatgttttgatttcgaaagagctctctttataatgattttcatttgtgattctggaaatcaaatcgttctattgaaattggggattttttttcgattagggtttgtttggttcctgttaaattatcaaacgttcctgcatttaattgatttttggtcttctaatattttggagcttcttcttgttgttacagatatcattttggtgattaagttatttaagaaatg

SEQ ID NO: 24731 - DNA, 3003 bp, Unknown
  misc_feature (1)..( 3003): 2750-1469P.txt file - cDNA_ID_2184111; gDNA_ID_1972159; Annot_ID_179556
aagataaaaaaaaaaaagaccttatcttggttatttgggtgcaatgttgaaccataaacacaacagaaatccacaggaggaagaacacttaagaagctcgaaagctcatctttttgagtagtttccattcagacaaaaataacccttgtaatgtattcaactgggcagacctattcagatgaagaaacgtaataaaaaggttgcttctgatagattggtcaaatttgatttcgagtaatctaattaaagtttctacaattaagttcatgatcatttgatcattttgatttcagattgacacaaaccttggaaaaaaggagaggaacgaagccagaggaggaattaggaagcgttagttgatttaagaggggaattgaagaagcttacctgcgactgcgagtgaaggcggcgaagagcgaggaagaacaacaaacgccgtgaagctagcttttttgggtttgggccaaacgagattagtttctaacagatgtttttccggacccggaccggtaatacccacgatccgcttaattatttggtccctgtctagctctaaaatcccggtgcaaacgaaccggcaaaaccaacgacctagcggttcggtattttgtttctgaaatctgaaccctccgatttgttcttctttttttttttctttttataatgcaaacaattgatgaaaaaatatattatggtccgaatggtaacctcggtttttaatatgtgagaaaagtggtataacattgcagtacagttcaattacggtacgtgcgagaaaaatatatttgcgggacaaatatggtttgtacaaaataagcggtacagaataatgtttgattgatgaaaaaattatttgcggtgcggattataaattatatatatatatatatattaataattaattattatttttgtgttaataaataagcaataacatatatttataaattattaatacataaataaatcaaaatatacatttttaaagtttaacatacatattattaaattcgttgaatagtttcatcataaaaaattgaaaaaaaaatcataattttttactagtaaattgattatagaacttatataagcttatagtggataataattgtcaaaatttctataagtattatgatatttctatttcttgtaattacattttcttagattttaattaaataaaaagaataaaactataattattgcatatatatatatatatatatatatatatatatatatatattaaagtccattagttaagcaaattgttatgtcctacgtatatttttttcttttatgcactaggtaactagtgattctgatgcacacatatactctctttttttgtacatatatttaaatggggaagctaatggaaaaaaaattaaaatttgcttaagtaatggagtaataaacgagggatgtgtgtatggaagaggcaaaggctgagaaacttttggttgggacgtaggacataacaatttgcttaagtaatggagtaatgaacgatttttttgttggaatgcggttttgagcaaaaacactaggtaaatgatttttcttcttttgaaaagcattccagtgtattgtttttaggacaaaattgcaaacttttttcttttttttttcgaaaaacgcaaatttgttaaaagtattgattggtaactgtattgtagttttaataaaaaaacaagaaaacgccttttgtatgtttcttaatcacagtgtatgaatggtgacatagaccgcccccaaaaccgtaccgtaactgtaacagtataaaaaatctctatatatacatatatatctatgtatttttgttattatttgaaccgtcccatactttttccgtatcacaaaatacagtcatcattcgaaccgcaaaactatatatagtatttcggtttttgaattcaaaatgaaggagaagaggaataggcagattaatataatttcgttatttctttttaatttcctatcttcaatttttcctcacccactgaatttgactatgccattaaaaatgtgtatactaatcatcataccgtcaataaatagagtttgtgggaaacacacgacagacacgtcatcagctctcgacggcgcgtttccatgcctttattatccttcacgttgaccccacatgcccctgttttttttttttggtgttctacggtatatttttgtgaaaatgttacttttcatctactcgataaaattcttaaacagatagtacaactttttacccgattaatctgtagaaaatacaatgttatttacactcaacaaacatttccattaatagaactttacccgatttaaaccactcttccactcgattaatattattattttattaattaaagatacgatgacgtgtccatgagagatgagctttagtggcacgcaacgtaagagaagaagacaaaagtaaaaaagagaaaggcacatgtcgaactcacgtgtccacttaaacgcaccaccttcttctgtgctctccacgcgcctccacacgccctcctcaacttcggaccttcttcctccaaaaaaaacaatttcactcttcattttctcagattctcttattatttcttctactcgtttcgaatcctaatcgtctacagtttccgacgagattctcaccggagaaagaaaggtagttcttttctctgaatctgttgtgttgagaacttagccgtaatttttgagaattattcttcactatttgatttgacaagaatatgggtaataaagacagaatctaaaacacttgcttcagtttttgaggaatcaaaaatcacacgaaagttttttttttttttctgctcctatgtttcttggtgcgtttgtgtttatttgacattaggagtgattgattgattataaagatgaatgatttgttagattcattaagatcactgttctttttgattaatcatcttatgtctaaattttaggtgacttgacagagaatcttgttctgtaataaaagcaaagatg

SEQ ID NO: 24732 - DNA, 3003 bp, Unknown; identical to SEQ ID NO: 20192
  misc_feature (1)..( 3003): 2750-1469P.txt file - cDNA_ID_2184119; gDNA_ID_1972159; Annot_ID_179562

SEQ ID NO: 24733 - DNA, 3003 bp, Unknown
  misc_feature (1)..( 3003): 2750-1469P.txt file - cDNA_ID_2184150; gDNA_ID_1972160; Annot_ID_179585
ttacaaggtttttatttcctgttatttctccaaatgattcatatatgtaattaatgtcagtaaaacattattatgccaagacaaatgtcactatgaagaacttgctcggttgctccacgacattactttggtgtttgatctcatcatcaatcttatttgttacccatatctctttctttgatgtatgtgtacgctttaataatcaacaccgaaagtttctcttctctaacgactcataaagagatagtttcataacaaccacgctgatagggaagacgtaaacgttcaaatctctctgttgtataatcaaaactgagtaagaatataccgagctgttcctatttatcttcatcataagcaaaccagtaagtgtttcccttcaaaagataggcggtagtcagaatttatgaagtggcagtccagagtgtgacatcatgattcctccatgaattagagttcatatcatcgatttggaattcttggtcgtcacagttttagttcttatagctaaaatatcttgtagctcttattgccagatttgttgtcttggtactccgttggtagtatccaagaacaaaggttaaattctgatttgagtcgactctgttctcatcactttctcgaaattagactagtaaaagtaataaataatattcaaaagtccacatccaaaacaagattcaagattttcaaatcttgatgaaaaagaaaaaacaaacagcaaatattacacgaaatggctggaaaaactggttttaaacagtctgagaattgttttgttttaccttagtcatattattttagaggtctcgacgatggaccagaggtagcaacagctctttgagcacgctgcgtttcaccgcaatacagcatctttgtctgtttcttaattatccttgcttctcgcttttcggcttttacagcatttttccgctctttcttctcttctttcgactcttgaccatgagtcttcctcttgatcggttcagcttttgggatttccgctttgacatcggtttgttcagctctcctaccaggtaaaaactcgacaggaatcctctctctcccttggagattaatgattcttccatttgaactcaatgcgttagctaatgtttcactcagcttcttctgcctagctgactctgcagcaaggattttaccagggaggttatcgagattcgagtatgttgagactatggtttcacaatcatgcttctcgctttcatcgctgctttcttcagtcagctctacaaattcatcttcattcccgttatcaaaattttcaccatattctacagttcggcggataacatgagcagcagtgtccacttcctctttatctctgacagagtcactgttcttcagtatatccgcagggttcatatatttttcttcaagctcataatcttttgccttcccatgaataagattctgaacttcttgagccatgaagtcttcttcttcttcttcttctccatcttcagctatgtaaccatcaccgtcactatcacttccatattcattgagttcgagctgatcaaatagctcatcaatttgacgaggaactctcgggttttcagccacaggttcatcactttctctttctctaacctcacgtcttacagaaaactcgagctctccattgctcacaccagaagattcacccttttgagtaagattagcttgaacaacaaaatcttcttccaaatcctcaacatcagaaccaaactcagacccatcactgttttcaagcaacgcagcaacttcaggatcaatagctttctgcaccttgacgttaacagtcttggacgcaacactatacatcaacttattatcattaccttcttcattcaccataccagagatcttcacacgagacgcatcataagccttaacatcacgaggtaactgagcaacctcatacttaggattcacatagaaattagaaccaccaccagtattcttaatctctctcaaatgctccaagtaattataaccatcatcaggataccctaactctaaaatctccttcctcacatgagcaggtaaagaactactcgaatccccaaaactagagtaaccataatccatctcttcaggagcatcatcaaaccgtgagctgtctccttcttcttcttcatcttcttcaatgaaaccattgatgttaacagggttttgatcaactcgtaagaagatcttatcaccacctggtgcatcactgtatcttgggtctgacgtatcacgaggacacaactcgaaagtcgccgcctttttcttatcaataaacttcttcttccccattacttactaattcacaccttcttaagggttttgcaaactgtaaaacaattacgaagatataagatgtctaacttctaagtcacagcaatcaactagactatgtttcaatcctgactaataaaatgtaaatttttatcatcaatcaacacgaaaacatcgaaaagggagaaactttaagtctagaaacgattcaaaaacactaatttaatgaaattgaagaagcttacctgaagagtttgagagagagaggcggagaacaatgcagatgaagaacaaaaacgctgttgaagatttttagttttagggtagagccacccaaaacgcatcattttagggtttaaccaaaacgctgcgtttttgtgttaagcaagccaaaacgcgtcgtttttggcaacaagtcaaattaaatatttgttttatttccataactcagtgtatgccactaaaagaaataatccaccgcgggagagtgcaccgaatggttacatgcacctaatcttcttcttctcctactttcttcgacggtacctgttgttattgtgcgccatcttgatcttacgtgcgccgttggcgcattctcttataccaccattaacgtgcgtcaacaccggaaccgttgaatcagacgttactggtatcaggttcgatcgttgcctcgataccgattctctcgccaagatctctctttccaccgtcatg

SEQ ID NO: 24734 - DNA, 3000 bp, Unknown; identical to SEQ ID NO: 9606
  misc_feature (1)..( 3000): 2750-1469P.txt file - cDNA_ID_2184154; gDNA_ID_1972160; Annot_ID_179586

SEQ ID NO: 24735 - DNA, 3000 bp, Unknown; identical to SEQ ID NO: 9613
  misc_feature (1)..( 3000): 2750-1469P.txt file - cDNA_ID_2184182; gDNA_ID_1972160; Annot_ID_179593

SEQ ID NO: 24736 - DNA, 3003 bp, Unknown
  misc_feature (1)..( 3003): 2750-1469P.txt file - cDNA_ID_2184194; gDNA_ID_1972160; Annot_ID_179599
aaaaaaaaattgattggtcccatggattatttgcaagtaagtgaagatatgttacacaatgtcacttataactttattgtagtgattaatgagttttggttatttttatttttttgtttttttatgctaaggctatgcgtctccgcgaagccaatcgtctcatgattgcaaagttcaagaaagaatctccggctaatgactctcctgaacaggtgtgttggaaatctatcaaaacatgtttttgaggaatatgtttgtataatttgtaccgtaatatgtttgaaaatgttgttggttgtacagaggctagttcgattgaccaatgagaatccgcaatacaatgtcgactttttgtttcattcatactccaaggtttcttaaacaatagtcttttgatgtttaatagtatatccaagttttgtatatttcatgcgcttttttttaagacttcttaaattgctaaacaggactggtttgtatccgatgttggaatgaaaatgtcaaatgtgatgattccaaaccaaatgctagctcttgactgtgaaatggttctatgtgaagatgggacagagggtgtggttagagttggcgctgttgaccgcaatttaaaggtattgcgtatagatactttgagattttgaatcttgatttctttattggtgtcttttattggatccttgatgactcgggtgatcaaatttttatgtctttaggtgatccttgacgaatttgtgaaaccacacaaacctgtggtcgactataggacagctattactggagttactgctgaagatgtccaaaaagccactctctctctggtggatattcaggtaaatctatatatagaatcttcttctttattttattatttcaagagacaacacttcaagatgttatgtttattgtgcaggaaaaattgaggccgtttctttctgctggtgcaattttggtaggtcacagtttgaaccatgacttggataggtaaataaaacttttctagtagagtccttgttaattttaatttggaattttgtctaaaatcatgagtattttgttaccagtgttgaagatagatcatcccatagtgattgatacttcactagtatttaagtatcctaattcacgaaagctaagaagaccttctcttaataccctttgcatggtaagtctatatctactcttgaggtattcacataaaaatgttaacattcttaatatatactttctaaaaataaataaatttccagtctgtgttgggatacgaagtccaaaaggccggtgtttctcatcactgcgtacacgatgcagccgctgcgatgaaacttgcacttgctgttataaagaaaagagttgacacaacaatcacattaactaaagaggtgacaacaaatatttacctagctaacttgtttatgataaattacaattacaatgtttacaagttttttgaatagatggtggaggccgagaaatcaagactctttctacatcgaatccctcaccatctgtcatctgaagagctgaagaaagatcttgctctaaagttttttcccaaaaactttacaattgatgttaaggttgagtttaaaccatatatctatttcttttctctaaatcttaactttttttttttgatatacggtttttttttttttggcagccagcaaaaacacagggaggttattattgtgcagttgttatctttggaagctcagtagaagcaaatcaagcatttgagaacgttaatggatacaaagagacggtattatagaatcttttgatttgttttgaaatggtccaataataattaaaagtgatgaaataacttttttttttttttttttttttgtgtttggttttcaggattcatcggggctgccacagaaactcatttcttgttcaatatctacattttatgtccgttaaatggcttaagatgggtgggtttggttgaaggcttgaaatcttcttttaaatttgctttttaataatgttggcatttctgaatctgtttaaacattgattaataaatctaagctaagtttttttttttctatccttaatttttggtattttgtttgacatttgtttttgatacaaatcattggcaaaatatacacaattacagtattagaacacaaatcgaataaaaaaaatctttgtgaacatcatcatttaaatgtaattgaaacagagtcaataaaggttctctcaatagaggtagcaaacagagtcaactatgctataagaagttgttgcgttatgttttgcttttctgcaggattcatttgggctgtcacagaaacacattgtcttttggcgtctaagttatgaagtttatttttaagtccataaaatggtttacgatgatgatgtaacctcttttttttccatggatctatattttcaaattctatgtttgtaacctaaactgttttaattatctataaaatatttacaatttagcgaaagaaaaaaatgacgatggaacctcagatcaggtttaatacaacaatatgactaaaattaaatttctatttccactacatttttattcgctccaatccatctccctttctaacttagagatcttaatattttttcttcatatttggagatttcttttttcaaatttacactaaaatttgaaatctccagtttgttgggaaaaaactcaactccataactccatattgaaaataaaaaatgtttatgaagaaatgggagagatgttctaagcaaattttaaataattcctcttaaaataatggtaaagatgttactacattgaagtcaaagatgtcacaatttaagcatacaatatagttaaaattatatataaaaaaacccctaagaataaaatataatccagttaattatatattttgagaatataaccctaaactctgtttcttcttccccaaacagtttatgccaaattcactcccagctaataaaataaaatagaaaaactcgttgagccgccattgtttccgtactatg

SEQ ID NO: 24737 - DNA, 3000 bp, Unknown
  misc_feature (1)..( 3000): 2750-1469P.txt file - cDNA_ID_2184210; gDNA_ID_1972160; Annot_ID_179603
cagaaatcatggttttgttttccgatggtcgctcaacttccacccacaaaaggtacagacggttgtcatggttcgtgccaatccacagtttccatgaaattaccagacgtgatctaggccaaaacttgcacaaccacgtggagacttacgtggagcccagtaagatcgaagtaaaagaagaaaagccaagagagacacgagaagaatgggtgatctcgatcaaggacaagatggagaaagcacttagttacgacgcaacaaatagctgggacaagctctgtatctacagagttcctttctatcttcaagagaacgacaagaagtcttacttacctcaaactgtctctattggtccgtaccaccatggaaaggtacacctcagacccatggagcgtcacaaatggcgagcggtcaatatgatcatggcacgtaccaagcacaacattgaaatgtatattgacgccatgaaagagctcgaggaggaggctcgtgcttgctaccaaggtcccattgacatgaagaatagtaatgagttcacagaaatgcttgttcttgatggttgtttcgttctcgagctcttcaagggaacaattcaaggattccagaaaattgggtaagcctggctaaattttatctagtgatttttttctattgcttaaactgttgactctgttgtgtgctgaatagatatgcacgtaacgacccggttttcgctaagcgaggattgatgcattcgattcaacgtgacatgataatgttggaaaaccaacttcctctgttcgttctcgaccggttattagggctacaaaccggtacaccgaaccaaacgggtatagtggcagaagtagctgttcggttcttcaaaacactaatgccaactagcgaggtgctgaccaaatcagaaagatcgttagactcgcaggaaaaatccgatgaattgggtgacaatggcgggttgcactgtttggatgtgttccatcgaagtctcatccaatctagtgagacaactaatcaagggactccatatgaggatatgagcatggtggaaaagcaacaacaattgatacattgcgtgacagaactaagaggcgcaggtgttaacttcatgaggaaagaaaccggccagctttgggacattgaattcaaaaacggttatctaaagataccgaaactactaatccatgatggtgagttaaccggttttttcttctctacttttctattagttcctcacaaatttttactatccattatctttaagatcttacagtttgacaaagaatatatttgttaccaaaacactgtggtctcacttgtttcttgtaggtaccaagtctcttttctcaaatcttattgctttcgagcagtgccatacacaatcaagcaacaacataacatcctacataatcttcatggataatctaataaactcttctcaagatgttagctacttgcaccacgacggtattattgagcattggttagggagtgattctgaagttgcagatttgttcaaccggttatgtaaagaagtgatctttgatccaaaagatgggtatctatctcaactgtctcgtgaagttaaccgttattatagtcgtaagtggaactcgttgaaggctactctaagacaaaagtacttcaataacccttgggcatatttctccttttcagctgcagttattctgctatttctcacattctttcaaagcttctttgctgtctatgcttattataagccactctcttagttttcatttttttttttcattttatttacaatatttgtatttcttgttttttcaatattttctattcataattaaaaaaaaaaagacgttgtaaaatttggaattttaaatagttaatggattgaaaaaggttaatttcggatatttatttggactgcatatcctagacgtagtgaatattaagaagtagtaaatattgttcattcattgaaaaaaagaatgaaaaaaaaaacactaaacagtatagtgatagacatggttgtgagaactatggatttacaaatagttgtcattcaaaagagtaatgtgaataaacttagtggaataaacaaaaacaagaacagatgatcaagacagcgattagaaatgttcgtcgggtcgaggctgattaggttccatttgcttggaaatggggttgcacgtctgaacactattttttggtacgtcaattttttaaggcataagattttgaatatatcttaagcataaaatataatagatgacttgactttcttggagtcttttcggtttgcaatttgcatgtctgaataccatttttgggtggtcgagtttttttttaaggcgtaagattttgaatattccaagtcttaatatataatagctttataaaattagtttttaaggcatgtcatgaacactatttcttcgagtctttctataagagcacctcattatccattcgagaatggtgaagtcgtcagtcgtgccatgtgccgagtttcccatgtctacggttgataacacatcttaattgaaattataaacttgctgttttctaattcgtagattttttttctttcatatggataattcaagtatcaatcattgtcaataatgaataacgcattatatagtatatagtatttctataagagtacaacgcattttcattttttttaaataagagtgaatgtttcaaataaatatctcactctacgaaatatatatattacattaaagacttgtaataaagtctttctattaagagtagtggaagaaaagtccaagaaaacatcgctcgccaaagcattatatatccattacgtttaaagattgtttaagacattttaatgtataagtatgattagatgtcaatcactggttgttgtcattacagatcaaataatattgcgaccaatgacagctttagttcagttgttacatatttgcttttagactttttctatgtcactctcaatctcctaaaaaccttcaacaaacaaaaatg

SEQ ID NO: 24738 - DNA, 3003 bp, Unknown
  misc_feature (1)..( 3003): 2750-1469P.txt file - cDNA_ID_2184271; gDNA_ID_1972163; Annot_ID_179622
agccgttggtttgagagaggacatgagacttctccaatgataaacaaaaggcttcctcacacgagcttggttccaaatcttgctcttcgatccgcaattcaagaatggcttcaacttcgtgaattattgaacagaccctctgcttgcagagagatataagtgattcgccttaatcagagtgacaaatttatcataaatcaaaacattttcaaattttgtcaattcaactttctctaattaatgtttatattattatatcaatgcacagtgcgttacaacacatatgcttcttagttaataggagttgttactctatcactagtattattggtttggtcactcttttttggggtggttacgcacgtatatactaaatatagactatgatctacttagattttaatatttgtgatgaattgtgaactataagaatatagtggttatgactgaattttttcatagatttaataaatcttccctcatggcataatattagttagttaatatatagtggtatagtggtcactattttatttgttaaatttggtttgatgcattggtggtcattataacaagcataaaaaaacactaaagctagtattggattcatccacgtttttgtaattttgttatttgatggaataataataataaatttagcctgaatcttgcatagatttagttctcttaattaatcttccctcatgacgtttaatataacggaaatatggtggtttggttgcccactacacactatatattcctttgatgccgtgatagtcattataacaagcacaaggaaaaacactaaatcgtagaagaagaaaagaaaaacaaacaagcaatggattcaacagccaccgttgcaagtgatcgtcttagtcaactaaactctttcgaggagactatgacaggcgtgaaaggccttgttgattccggaatcaaagaggttccagctatgttccgtgagcctccagctattttagcaagccgaaaaccaccactagctttgcagttcacgatcccaaccatcgatctgaacggaggagtagtgtactacaagaatcaagattcagttacacggagaagcatggttgagaagataggagatgcagcggagaaatggggtttcttccaggtggttaaccacgggatcccgctcgacgtgctggagaaggtgaaagaagggattcgcgcgtttcacgagcaggatgctgaattgaagaaacggttctactctcgtgatcacactcgaaaaatggtttactatagtaacttggatctcttcaccgctatgaaagcgagttggagagataccatgtgtgcctatatggccccggatcctcccacatcggaggacttgcccgaggtttgtgggtaaggtttccatatatatatgagcttaattatttatagctaataacatttttagaaaggtttttaaaaaaaattttgtattattttttaaaaagtgaattatagaatttttaaagtaaatccatttgtatttttcatgaatctgaattgatgttttgatatgtggcagggagattatgatggagtatgcaaaggaaataatgaatttaggtgaattgatctttgagcttctatcagaggctctagggttgaataattctaatcacctcaaagacatggattgcagcaagtctttggtcttgttcggccagtactatccaccttgtccgcagcctgaccatactttaggcttaagcaagcacaccgatttttcttttctcaccattgttcttcaggggaatctcggtgggcttcaagttctccatgataaacaatattggatcgatattcctcccgtccctggggctcttgtcgttaacctcggagatcttctccaggttaaagaagtgactttttagctttgtaacattttagctctatctttgttaggaatatcatatatgaaataatatggaatttaaagtagtaagtaaaagatataggctagttatgatttgaatggagatgtgagttgattttttatttgaatttgtgcagcttataagcaatggcaagttcataagcgtggagcacagggtgatagcaaatagagcggctgaaccgcggatttcagtgccatgtttcttcagcaccgtgatgagggagagccatcgagtatatggacccataaaagagcttctgtcagaacaaaaccctcccaagtatagggacaccaccatctccgagttcgcaagcatgtacgcgtctaaagagatcaatacctctgcgttactccgtttagagatctgatacatcgaccaaagaaaatgtctttgtattaaataatgttcgtatgcgtttactcaatttcaagatttgagacatcgagcaaataaactgtacctttgtaacgtaatgtgtgtatgtgtgtcactccatgcacggatatgtcgacgtaaaacatccgtaaaatgtacccttgtaacataatgtatgtatgtgtgtcactctatgttaggatatgagacattgaccaaataaaatgtctttgaaaacacacaccgtttggcccattgacccactcttcttttttgtttttacatcaagtagtcattttttgtttatatggtgctagttataataacccattgctacctaatcttttaatacacacgcacatttgttttaagtatattttaatgatataatcgacattgattacttccttgagtttgattaggtcgttgacactcaaagggcttaaaagtaaaaccgcacaagaaaataatacatatacatgacattccagaacgaatattcgaaagaacagagtaacacaagaaagggatgacacatgccttaatcggatcttttctttcttaattccatattattaaaaacattttccggagaagaagacaaaaccaaagcttcttgtctgaaacgaaccagccattctaaagatttttacaaacaactttttcccgagaaaatctcaagtttgaggaagcgagaaagagcaacatg

SEQ ID NO: 24739 - DNA, 3000 bp, Unknown; identical to SEQ ID NO: 9629
  misc_feature (1)..( 3000): 2750-1469P.txt file - cDNA_ID_2184275; gDNA_ID_1972163; Annot_ID_179623

SEQ ID NO: 24740 - DNA, 3000 bp, Unknown; identical to SEQ ID NO: 9628
  misc_feature (1)..( 3000): 2750-1469P.txt file - cDNA_ID_2184283; gDNA_ID_1972163; Annot_ID_179625

SEQ ID NO: 24741 - DNA, 3003 bp, Unknown
  misc_feature (1)..( 3003): 2750-1469P.txt file - cDNA_ID_2184314; gDNA_ID_1972163; Annot_ID_179635
tcgataagaggtggaaactacaactctgattgtagtttttgattttctagagtgatacaactgtcttctgatcaagatttatttgtaaaacgtgaccctaaatgtagctcctcgttcaaagagcaaagtcctcatgttgcttctgtaaagagcatacttgaaagtcatgccagttacttgatgtctggtaaagaactttcaaagcttgttgcattcgtcaaaggcacccagtttgatattgtggtacgtatacaatttgtaccattcaccttttcatgcttggaaccaataaggtatatagtcattcactaacaataccaaaattccaggattttcttcaacgagaaagatatggttgtgcgcagctgcagaattttgctgcagggcttgaactgattgggcaaaaggttagaatcaacccccttgtggtttctttgatgttcaaaactcgttatttttccctctcattctgctgcttgaaacaatttgataactaaaacatagatccctatcgcatcgtaaaagtctgcatatttgagtaaacttatcttacatcgaagtctaactattgaaatccctcagctgcaaatgagtgagctacagaaccggttagatgcagagtttctattggctcagatgtgctccgtcaaattcaaagaatggatagttgttcttgccactcttttacaacggtctgaggtaaaaatcttttagatttccaccgtaatcacgactttaaagcattcacagtgatataaccagattgtttcattattttgtcacaacacaggttctttatgatattttccggtatgatctacggttgtggaaagcatatagcgtgacattagaggtaacaaactcttgtttccataacaatcgatatcgatttcatcacgtgcgggtctcctctttaaaacatgttctttgtttcagtctcacttggctttcgctcagtaccatgacttacttcagattttagaggcaaaactctcagcgacctcacgagaagaaagcaatagaggttccatctcttgataaatcattttatttttgaagctttttcacatcaaacattttctgcctgagttttcacgttcgtgtagataaacataatttgagaagaaataagaaatacatcacctcacatacttttactatttattttggtcacaatagaaaggaaaagaaatgtagaagtcatatcatgtttggcctaaataatcgaattgttacagcctgaaatcgaaaataaattgaaaaaaacactctgcattttgtgtaatgtgcgtgtatataaaaccattgttttgtccaacataaaaagataaatgtatatgtattttgatttactattcagtataacatgtttttattcaaatcaatgaagcttggaacaaaagtatatgagtgctgactaggtgtaatgttctggtcgttattattacaaatagtagattagaggtattaaaaaaacaatcggagaaagaaaaagagagttgtattaaaataaaactgaaaagtaagataagcgtaagcacccgtgaccgtgagtaagtatggaggcggcagaagtgggtcggcagaagtggggatgagtggagtgaaagtgggacaaccccaaagttcacaagaggctaattagaaaaccaaaaaaacaacaataacaaaattggagatgctcttttatgcaaaaaaaaaaaaaaaaaaaagcaacaataatgaaaattaacatggtttaacacattctcattcctatatatgttacatgcgtaactggagatgctcttgtatgccccccaaatttgcatagtccatgttacttcacttaaagatagttttatttctaactttttctttataaaaactaactgccgtaagtagtaactaccgagtagtataagatggtaatgtaaaatttagtagccacgtcgaaagtgacaaacaagtgatgtatctatactctactctcataagtcacaagtcacatagagacaatcacccattcttgtatcatatccttttcagatgcaaaaataacctcacacattaaaacccgtgagtaaacaaacgaagtaaaggaattgacgttgtactcacctcacattctctccctagtttaaacaaattatgattgttatatgtttggaaagatacatgcaacacattttaaataatatgttgtgattgagccgaatgcttatatgattttctattatacgtatagcaatgaacacgattatgaattcgatttagagtgatgatacaaccttaataccttaatccattcaggctagagaccataataagttaacttaatctcctcatcctagtcactactcgaatgccatctttacgtttaaaacaattatggccacactaacgatatacctatgtttgtttgctagtataataaggatatgtctctatttgctatcacttcagccttttctgaagacaatgttaccgctatatcttccaatcaattgataccactaaatgataaaatcattgctaatcttataagatcaccaaacactcagacaaaaagtttgaatcttgcttcttcgtttctccactctttatccgcttataaatactcttattctctcctcttaacatcctcatcaaaccatttagcctctccacactcacaaagggctcacaagtctcaagtaattctctttctctctctcaagcacaaacacacacaaatgtataaacaaacccaccatttttgctttcaaatgttagttgttcactatgtctcatttacattaaactctctttttctttttcccaaaagttgttcaccaaaaccaattgattagctctcattctcataaaaaaaacaaaactttacaacaattactaacctttcacatgcacccatttatttaccaaactacgaaaaaagatacaaccttttatatctctctctttaactaacttaaggaactaaccattctctcttcctttttttttttcagatacaaaacaatg

SEQ ID NO: 24742 - DNA, 3000 bp, Unknown; identical to SEQ ID NO: 9632
  misc_feature (1)..( 3000): 2750-1469P.txt file - cDNA_ID_2184563; gDNA_ID_1972164; Annot_ID_179670

SEQ ID NO: 24743 - DNA, 3000 bp, Unknown; identical to SEQ ID NO: 9633
  misc_feature (1)..( 3000): 2750-1469P.txt file - cDNA_ID_2184581; gDNA_ID_1972164; Annot_ID_179674

SEQ ID NO: 24744 - DNA, 3003 bp, Unknown
  misc_feature (1)..( 3003): 2750-1469P.txt file - cDNA_ID_2184618; gDNA_ID_1972164; Annot_ID_179688
agatcgatgccacaacaaaaaccgtaaacctctgttttctctcttctcttctcttccattactcgaaatcaaaagcttaagtaacgaaacgttgaaaattgtacagaaattcgtgaagcaagtgcttgagacgatcgaattagatgagattaaagattcattggtgggagtcaccggagttagtggattatcgacggagcaaaggaagagattgacgattgcggtggagttggtggcgaatccgtcgattatatttatggatgagccaacgacggggctagacgcaagagcagctgccattgttatgagagctgtgaagaacgtcgctgatactggacgaaccatcgtctgtactattcatcagcctagtatcgacatttttgaagccttcgacgaggtaaattgcataattggctcaataaactgaattgttatattttgaccccaaactgttttatcttataaaccaagtccaaacttgaatttgcagctggtgcttcttaaaagaggtggtcgcatgatctacacaggaccattaggccaacattcacgtcacattatcgagtattttgaggtaaatttgcataaattttacttttagtctatgattgtttttacaaagatatgttaacttcttttatttattggattgaaaaacagagtgttcctgaaattcctaaaataaaagacaaccacaatccagcaacatggatgcttgatgttagttcacagtcggtagaaattgaacttggtgtcgatttcgcaaaaatctaccatgactctgctctttacaagtgagtaaaagcttttaaactatgcattaataactgttattgttctaagaatgtggttgtaatgaaaacatgtgtgattgttataggcgaaactcagagcttgtgaaacagttgagccagccagattcaggatcaagtgatatacagtttaagagaacctttgcacaaagctggtggggacaattcaaatctattctatggaaaatgaacttgtcttattggagaagcccttcttataacctaatgcgtatgatgcacactttagtctcttctttgatcttcggcgcacttttctggaaacaaggccaaaatctgtaagtggagagtgaacatacctcttatatgacactttagatcccagtttgctaacattttgagttgtgttttgtcatttgtagagatactcaacagagtatgttcacagtatttggagcgatctacggtttggtactcttcttagggataaacaattgtgcatcagctcttcaatatttcgaaacagagagaaatgttatgtaccgggaaagattcgcagggatgtactcagcgactgcttatgcattgggtcaagtggtgactgagataccttatatattcatacaagctgccgagtttgtgatcgtaacatatccaatgatcggtttctatccttcagcctacaaagtcttttggtcactctactctatgttttgctcactactcactttcaactaccttgcgatgttcctcgtctccatcacgccaaacttcatggttgccgcgattcttcaatcgctcttttatgttggtttcaaccttttttcggggtttttgatcccccaaacggtaagatcacccatcctttagtttcttgaacaagaatctttaccaagaagaaaatgttttgtaatgtattcttttggtttgtgaaaattgcagcaagtaccagggtggtggatttggttatattatctaacaccaacgtcttggacactcaacgggtttatctcgtcccaatacggcgatattcatgaagagatcaatgtctttggacaatccacgacggttgcaagattcttgaaagactattttggatttcatcatgaccttttggcggttaccgcggttgttcaaatcgcttttcccattgccttagcttctatgtttgcattcttcgtgggcaaactcaacttccaacgaagatgatcatgccaattagtcttcatcaatcatcattttagaataaaataataaaataatggtttttatttttgtttgtgaaaataaacatataacatataacttttctttttggtatgtatatgattttgaggaaagtaaacaaagcattgtctatgcaaaacaaataaccaaatcttgcaagtatcaaaactatattacttattacttgtcttgacaaagacgagtacttgtttttccaagtcgaatacaggataagtaacggatacgggacaaataccatgtatttatgcccacccatatcgacagacagtcagtaatcaaaatttaccttcaaatcaagaaaaatgggcaatagttaacttgagtgacaagtaacaaactaaaatgaataatcatgcataaattataaagataacattaaaccattttccattttatataatttgtacaaataacttttaagttatataaaggaattatttagaaatatgcttgggtaattgtgttctcttctaatttcttattatatatctctagaaactttttttctcaaaagagatttctaaactgatattacatattttttttttagtttttttttgttgttgtaaattttagacatctatttttagacatctatattaaacgattaaatatttcattatcattataaaatcataatgtatttatgtataaaaattcaaaatatactactttttgtttaaaattttaatattacttctgtttggcaaattaaataaaatctttcgaatagttgacatagtataaattagagaatataaataagaaaaccaaagcggtcaacacaagaggatcggtttgttcctttcttcctcctcgtatacgaatcaatacgcatttctccaactccatagccaaaagctcgacgagatccaacagcacctcctgatctgcatcgttttcaacttagcttctcctgtcaatcgaaatccctaattatacattgatcggattcaatcgagcgattcgagagagaatcgcgatg

SEQ ID NO: 24745 - DNA, 3000 bp, Unknown; identical to SEQ ID NO: 9643
  misc_feature (1)..( 3000): 2750-1469P.txt file - cDNA_ID_2184640; gDNA_ID_1972164; Annot_ID_179693

SEQ ID NO: 24746 - DNA, 3003 bp, Unknown
  misc_feature (1)..( 3003): 2750-1469P.txt file - cDNA_ID_2184672; gDNA_ID_1972164; Annot_ID_179704
caaactccattaaagagaaaatctttgctcgtttctcttaaggcccattgctttttatctgaagatgatttcaagagagtgccctgtttttttgtataaataaaattttgatcttttgctcgctttatacacatgtgggaacggttttgtcggtggagacatttatggattcgtgaactgctgcaaaaattatgcgtttcttggacgtttctgtaactttctctttattagattttgtatcttgtgtctctgtgtccaccattgcgttgtgtgtattcaattgatttccccaggtgttgaagattgttatttatatatttaacttattttatgcacagagatctttagtataattcatgaaaatatggttttatcttccatgatctaggggaactaaaacatttgtaaagtttgagcccatattttgtgtttgttgcttttcagagatgcatatattatggttgttgttctgtttatgaattgttatgtgcattgttttgcagcaatggcgccaccgattgaggtttctaccaaaagctacgttgagaaacatgtttcacttcctactcttaatgagaggatactttcgtccatgagtcacagatcagtagctgcacacccatggcatgatctcgagataggtaagctatacgtaaaggtttctttttcttttttttggctctaagatcatttcattgttttttagtaataactcttataccttttttgcttcgcattcctttgtttacaggacctgaagccccaattatcttcaattgtgtaagtgttttgctaaagctctaaggattgaaaatatttaattatattgtcacaaaactgccattatgcgtattcggagatgctgcagttgtttactatttctacagaatttacatatttgtagcattcactcaaagaaaattaaaacattcattggctatatatcttgaaacctgaattgagtctgctgtagcatatgaaatgatgttcatcgcctgattaggaaaccattttatgggtttaatctttgagatattgttgtgggaatcattaaccaagcatacggaggcattattacaggtggttgagataggaaaagggagcaaggtgaaatatgaactcgacaaaactacgggtctcattaaggtataaatttgattgcattaactttcttcgctgtccctttcattattagaggtacgattgtctaaactttacacatattctcaggtcgaccgtattctttactcatctgtcgtatacccacacaactatgggttcattccgcgtaccctttgtgaggacagtgaccctattgatgttcttgtcattatgcaggtaacatattttttcatacaattttgagaacctgcataattcattacataatgtttcttgttctattttgatttgtgcatctgataagctttgaagaagttcaagcgctcaactcttagctatagactctactttataactgtgtagcttaggaatgaatgtagcagatgagaaatgttgccagtcagttatcgagcagttagtggctgctaggcttataaaggtgtctcagcatattgtttagagtgtggattttctagtgtttactctggaatttaaaacctcttattaatcaatcaagtctataagcatcatcagcatctcagtctgtcttatttgactggtagaaaacacatctcatgtgaatcttgttgaatattttctacaggaaccggtgatcccaggatgctttcttcgggccaaagctattggtctgatgccaatgattgatcaggttagatattcaacgtacttgtcatattagtacttataaaagtaacagagattgaaactagaagctctttctgcttgaatagggtgagaaagacgacaagatcattgctgtctgcgctgacgatccagagtatcgccattacaacgacatcagtgagcttccgcctcatcgtatggctgagatccgccgtttctttgaagactgtgagtgttcttttcttacaaacttttggttggttaaggatgatatgaggctcatactcttgtaatcttgttgcagataagaaaaacgagaacaaggaagtagccgttaacgacttccttccggcaactgcagcctacgacgcagttcagcattccatgtaagtagccttcatgaaacttactgttatttacttcatatattatgaccttgtaaatagccgcaatttgtttatatcaaagaataactaactaatcaaattgggacaactcttttgtgtcatgtagggatctctatgcagactacgtcgtggagaacctaagacgttgaatcaccacctcaagcaatggaatgaaagctcacaactgcattattcacaaatataaatatacatataaatgtcaggcttctcaaaggatatatttgttgtgtatgtcctctgatgaatccggtagatgatgccgataattcttttttttttttgtcgtatgaaaccgataatcaaagactaaaacagggatttttctcatttgtggtcatcactttttaaattttggtgtcatttctcatcttaatcaatttgtttttgagttttattcttctattagatcttttatacatcaaagaatagatgaagattcctccctaaaaccttatagtatgtcatttattcacaatatgttatacgtgttaattttctctcttttagtatactctttttttttctttcagattccatcccaagttgcttaaattttgttaaaaccaactaaattccatagttcaatttacaaatctgtgatcagatgctatctaaatgaatattaccattttagcccttaccttttctgaaatttaccacgtttacctcaatgaaccgtcatcgcaaaaccaaaaaccctttcctatccctaaaacccgagagagcatcttcttctcctcttagggtagaagaaggacgaaaatcggaggaggaagaagaagatcgattcgatttgtgatcaacgatg

SEQ ID NO: 24747 - DNA, 3003 bp, Unknown
  misc_feature (1)..( 3003): 2750-1469P.txt file - cDNA_ID_2184682; gDNA_ID_1972164; Annot_ID_179708
caaagatatcatcactgaacatgtcactctttgggctgcctgcggaagctagtgtcatatctgagtctgatatcacaagccgtgcaggtgtttccccaactgctgaagatagcttggcgacttcaccatctacggcctcagtatccaacccagctttagcttgaacatctgccacagtagaggactgctccaactttttcttatatttctccaatatggcttgcgtaatcctcttgctttcctcgattcttttcatctctgcagcttcttgttcttcaactccccaaacaacatcttcaccgtcatcatcattatcaacttcagacctttcaacgttgccctgagtttcaccgttaggtttatggctttttaaagaatctaagtcatcttctgcatcatgcctaacttccccatatccatcaccaccacttttatagatctcctgatcactctggtcttctcttcttcctctatccctatcttgatccttacgtctctctctttcattctccctcccagtctctctactactagacctagctttatctctactactcctacctctgtagttgtctctattgctttctctatcaatgcttcccttcttcttcaaattctccccttcctccaaatcaagttcaccatcgttaccaggattccccaaaaatggataaacattcttttcattgccgtcctcatcaagatgatgactgtgtcgatgcttgtgatgatggtgcttgtgccgcttggaagatttaacgacttcgtcggaaggagaatacgacctacggtgtttgcggtggcttgattctactatcttatcgctcaccatcagatcgtcggaaaagatagacaatcgcaaaattagggttagggttcgattttctcccgcgctctctctgtctccgtgaacaacagacttccattaaaaaaattcacattatataaaaattacagtcggcatcggcaaattaaaaggaaatcagaatcgtctatttaaaaaaacaaagggcccaggcccattaataataaatgattaagaggatagagccatcatgtccgttgattattcgaaacctttccgatggatggatgacacgtcatcgatccgcaagaaactcgggtaaccaatgaaagccagcagaagcctctatataaacaaatgtctcctcagtttttccatcagacgcatctttcaattgtcaagtgattgtatttaaccacaatttcttctcatctctaaagtcagcatcaatggctccgaaagcggcagagaagaaaccggctgggaagaagccagcagaaaaagctccggcagagaaattaccaaaggcggagaagaagatcaccaaggaaggtggaagcgaaaagaagaagaagaaatcgaagaagaacatcgagacgtacaagatctacatcttcaaggttctgaaacaagttcatcctgatatcggaatctccgggaaagcgatggggatcatgaacagtttcatcaacgacatcttcgagaaactagctcaggaatcatcgcgattggctaggtacaacaagaaaccgacgatcacttctcgggaaattcagacggcggtgagacttgtgttgcctggagagctctcgaaacacgctgtttctgaaggcactaaggcggttactaaattcactagctcgtagggtttatatctcttaattctctttccgcctttcgaatcgtttaggtgttatcgctttcttctacatctttggtggtaaatctttgaatgaaaagtttcctttgttaatgaatatcgttttcttcataagaacaaaaaattatttgatcggtgatcaatatcttcttccgtttctgagggttttttggcctttttttctatccataactcttttggttcttcacgattccactaatttggtggggagcaacactagttatattttgcagagatttgtgggcacaatggtaaatcatatacttgagtaattatgttaaagaatgtttcactttaacaaaatcatactgatccatttggttttatcttaatcccttgatttaatcacttcatggtgatttctaactgtgtttagtgatgacgatgttgatgattgatgtttaaggttttcacttttcagtgaacaaacgttacaactgggcctatttatcattcgtgacccattttttccctcgtgatcgggctctagcgggaaaaattcagacacataaaataagagtattaaacacgagacacgtgtatatttctgattcgctccgagtaaggtggccacgtcttcgtctccctagttgacctttctttgcatttctatcttaatataaaaaaaactcgtttgatccatccgtcttctctcagattagctttttaacatcttggctgggtttcgtgtgatttcgttttggatatggttgttcggattcttgttaccatgattcggctatagtgtttgtcgcctctgattgtctcaagcatcgttctttactgatttttagatagctctgagatctgtctctgcgattcgtcggatttgaattcgtttttttttttgggtagctcttggatttcttcttctagggtttccaagaggatagagaaaatgcgggtgtcctctgagatactccttctttctttggttccggcgttgactttttatcattctggtttaagttctaatcgtttgaaacctcttcaaaagagtgattggcgtggtaatcttagttaaacaacaatttctctgtttttttgtttctccgatctcttcagatcttttcaattttctcttcggtttggtttgttttcacgcatttcctagctcggagtaagctaatcgaagaaaacaagcttgttattgatcgatctttcggtttttgttttgacgttttgtgtgaacgaggtaatttggctatatgattttttggctaaagtgttgtttgagctagagttctcttgttaatggtatttgaatttgtgtttgttgcagttacttttggatatg

SEQ ID NO: 24748 - DNA, 3000 bp, Unknown; identical to SEQ ID NO: 9639
  misc_feature (1)..( 3000): 2750-1469P.txt file - cDNA_ID_2184686; gDNA_ID_1972164; Annot_ID_179709

SEQ ID NO: 24749 - DNA, 3000 bp, Unknown; identical to SEQ ID NO: 9634
  misc_feature (1)..( 3000): 2750-1469P.txt file - cDNA_ID_2184702; gDNA_ID_1972164; Annot_ID_179680

SEQ ID NO: 24750 - DNA, 3000 bp, Unknown; identical to SEQ ID NO: 9663
  misc_feature (1)..( 3000): 2750-1469P.txt file - cDNA_ID_2184742; gDNA_ID_1972165; Annot_ID_179740

SEQ ID NO: 24751 - DNA, 3000 bp, Unknown; identical to SEQ ID NO: 9653
  misc_feature (1)..( 3000): 2750-1469P.txt file - cDNA_ID_2184752; gDNA_ID_1972165; Annot_ID_179746

SEQ ID NO: 24752 - DNA, 3003 bp, Unknown
  misc_feature (1)..( 3003): 2750-1469P.txt file - cDNA_ID_2184760; gDNA_ID_1972165; Annot_ID_179749
gaaagcatttttaccaattgaagctcacaaaacaaaatgatctcatatctgcatcaacaactgtttttcaatattacagagcaaaagtgaaacaattgagcaaaataaaagagatattgaccttagacaagctcaatgtaagccattggagcattatcacctctccttggaagagttctgatgatcctcgtgtatccaccgtttctctcaccgtatctatcaggaacctcagcaaacagagcgtgaacaatctgtttctcgtagatatatcccaaggcttgtcttcgcttgtgcaacgaaccgtctttagccaatgtaatcatcttgtcaacgaacttcctcatcgcactagctctagctcgagtcgtcttgattctcccatgcttaagaagctgagtcgtgagtcctcgcagaagagctttgcgctggtccggtggtctgttcagcttcggaacacgtcgtccgtgtctcatcgcgtagatacgaccaccaccgtcaacaattttgaatccattctcaaagctttgccaatctgcgttcgaaattcgaaaaccctaacgactttggagattcaaattgagccaaatctctatgaaaagtggaaatttacctggaagtccgattgagaggagaggattgaccggagagagaccggagaaagatgggagtgaaggagaagagattgggagacgaagagtaaccggacggcgagaagacgaggaaggtaatcggagtgatgcggtggagggaagagctgatttgagagaagacatactccagactctgctcacggaatctgtaggagtcgccattgccatggacattggaatcgccattagattgtgatcctctgcaacaaagcggattttgctggtgttgaatggataagggatagaggaagaggactttgtttatcagaaaccttttgatgggccttaatgggcctataaactgtaactctgtagcgctttgccaacaagagactttttaaggtttttgttgccaaacagatatttgcatttgggctatgtaatgttagaattattttataatgtatgctattgctagatattgtttaagtgcatttgtgatttacaaacatttcatttttattttggttttaatgagcatttctattatagagactttgatgttaataaatggtgttctaagatatattaaaatattttatatactttcttaaaattggataaattttgggaaaatccttaatatcagttaaattgaagataaagagtattaaaaaaaactatgtagtaaaatacatttcacattttttgtgtataatagtacatggtattcgttaagatcactcaaaaattaacaaattaagtctaaaagggcagaaaagactattcaaatatggacttggagaaagacattcagctttttacgctgagaaactttcatattgagccgtgtgtttgtgttgtgaagagaagtaataaaaaataatttgaagtgaaaaaggagaagaaaaaataagatcgtagaaagcgtggatggtttcttcttgggttcactgccatgcgattattaaattggccatggggctagtgtttgacgtacaaaagtctaaaaattgtcagtcaaacaggtccaaaactttgtaagaaaaataatataataatagcaaattttctaaaaattgttaaaaaaagaacaaaagggaaaagatgaggatgcagatgaaagcaaaatgtcaaacactagtttcagattttatcgggaactggggtttgacagttggtgtatgtatgtaatggcctctcatcaaaacatgtgcatctttttccttttttgttatttactgttttagctctacgtcttgtccaattcctctcaagtaaaatgcctttaatatgatactaatatacaaggggactaatgctttttcccttttcttatccttgttttgtctaaatctttacttggattcctttatttttctcctctctttagattagtacggtttaaggaataccatctttctaattttagcacaaaattgcaagttggtgccccatcttagtaagcacatcgtaccacactttgattgtgtgagagacttcttcatcccatctctcataccaaacctaaatcaaatgactagtggtgcaacctgctgactccatatgaccataactaataaatcggtttatgaatccaactcatgtagctctatagaatagaaacccattcatttcacataatgaactgaatctgacattttatttacatcatttactactcaattttgtaattagcaagatcatctttttcattattcaacaattttgatattccataatttattaactttgtcatacatcataatattctgaaattttgttatatattgtaccggttccacgaaatagagctctattattatagaccaaacaaacaaaatattatcttcttgtggttagttcgagagagaggtcaagaagaaacgaaatggatcggcaaacggaagacgtcaaacacacaacgacgaacattttccgatcacccacctaatctcttcccatttttattatttttcaaaactcaaattaattaagaagaaaaaaacagaaacagagagagaaagagttaagatgaatagagatagaaagagtcattaaatgtacgaagcgacattcacaataattcgaaaggtggaagacgacttagatacggccaggcttcactgtcctcctcgtcctcctcaattacccctaacccctttttccgggattcatctccaacccacatccttccaaattctcaccccctcactgagtttttgctttttctcctcatcggagatcgtgaagacgatcaagtaatttaagaatcccaccattgataaaagagtctagcttttctactaccaaacctttttctgtttggaaattttcgattttggatttaacccttttcttaccttatttataaccatgcaatctcacgaccaacaacccttcaatctccatg

SEQ ID NO: 24753 - DNA, 3003 bp, Unknown
  misc_feature (1)..( 3003): 2750-1469P.txt file - cDNA_ID_2184864; gDNA_ID_2213671; Annot_ID_132784
tagtgttaaaactgcaacaagtaaaagatagaaattttatgcagaatataatggttccttttttctactatggcagtctttgaaaaacattgcgtggggtaaacgtactcgggtcatattggatgttggatgtggagtggcgagctttggcggtttcctctttgaaagagatgttatagcaatgtctcttgcaccaaaagatgaacacgaggctcaagtccagtttgctcttgaaagaaagattccagccatctcagcagttatgggctctaagcgactgccattcccgagcagagtgtttgatcttatccactgtgcacgttgtagagtcccatggcataatgagggtggtatgcttcttctggaacttaatcggatgcttaggcctggaggttattttgtctggtcagcaacaccagtctaccagaagcttgaagaagatgttcaaatctggaaaggtaatgactaaagtaaaatgcttgaacttaactagagttcctccttcttttgtttgtttcactgaacctgagatgttttgagtgatgtagaaatgtccgcgttgacaaaatccttgtgctgggaacttgtgacaatcaacaaggataaactcaatggtattggtgctgcaatctaccagaaacctgccaccaatgaatgttacgagaaaagaaagcacaacaagcctccactgtgcaaaaacaacgacgatgcaaatgcagcctggtatgattgtttccacaatttgcatagggaatgaataaccataaggttttaacagaacaaagaaagtcaaaacttgaatggaaatttcaggtatgtacccctacaagcatgtatgcataaagttcctaccaatgtggtcgagagaggaagcaagtggcccgtgaattggccccgtcggcttcaaacaccgccttactggttaaacagctctcaaatggggatatatgggaaaccagctcctcgagatttcactacagattatgaacactggaaacatgttgtaagcaaagtatacatgaatgaaataggaatcagctggtcaaatgtgaggaatgtaatggacatgcgagctgtctacggagggtgagcatcaacgaaaacaaatcaaactaaaatctcacttaccaaaactaaacctttttttactaactacgtaaaaatgcaggtttgcagcagctctgaaggacctacaggtgtgggtaatgaatgtagtaaacataaattcaccagatacactaccgataatctacgagagaggcctattcggaatatatcatgactggtgtgaatcatttagcacataccctcgaagctatgatctcttacatgcagatcatcttttctcaaagttgagaacaaggtataagcgtaactcataatatccacaccttttggtaacgtttcatcaacaataagtctcttgttttgttttgttttgaaaggtgcaatcttgttccagtaatggcagaagtggatagaatagtaagaccaggaggtaaactaatagttcgtgacgaatcaaatgtgataagagaagttgagaacatgttgaagtcactgcactgggatgttcacttaactttctccaaacaccaagaaggaatcttaagtgcacaaaaaggattctggagaccagaaacttctcaatgaaagacgctctgagaatctgcatttgaaagtagcagaagcatcattataatacaacacactactcatatctataatccccaaaagaatttgtcagtataagaaatagctttagtcttcttaaactatatagactaattagaacatttttgttttccttacttcatattgctttttttaacatggttatgatattctcttgtaaggctatgaatcatttcactgggaaaagtaaggcacaccaataaatgaaattttgttccaacaagtagaaacatagcagtaatgaagaagagattatgatgctttagcgataccacaagccaaattcaccataagctattgacaggtagcgaaaagtcaaattacaaaaggaataaagtagacatgaaatgaaaccaacaatcttaagcccacatatgaattcaaaagagaggttaagaaagaagagaatctgacatcatgggcagagtaggagctgaagaagatgggtttctgcaaatttgaagcttttaatcgcatatcgctgagtaatcatcacaaacagttttgaattgaagaagacgggaggagaaaagccattgttaatgagatacccaaatcgtaaaatttcagaaagcccagcccaacatagcccaatacagcccaaatatgtatgtgattgggtaacgaaaacgagaccgttcttttttcagtcatctctcgtttcacagtagcgcgtatgtacgctttgaatttacaaaaagtagacatttttatgaatttttgccggttgagtaaaaaggtaaaaaaaaatagttcccaccaaagcaaaatatttcaatttttatcttttttttttggttcttgggaaaataagagattgagaaagaataaagaagagaaactcacaacttttttagttttaggagaagagggctttggtctggagtcactatcatattcaatgctttaccaaactcacctcttcttctaaattctcaccactcttcttcttcttctcattcaccgacatatctcctctcttcactctctgtctcttctcatctcaggtaattccaattttagttttttttgaaggttacttactcgtcacattgtttgaaaaagattgaatttttatctgtggcttagtcaaatcatggttcgtttcaccaagttgtggttctgggttttcgtgatttttcttttgggtttttctgtttgaatttggaaaaataaaggaacgttttttttttcggggggagttttttttttaaagataatttttggagagtttttgataattctgaggaagccaaaagaaaagaagaaaacctaatttgtgttggtggggtttgataggaaataatg

SEQ ID NO: 24754 - DNA, 3003 bp, Unknown; identical to SEQ ID NO: 24753
  misc_feature (1)..( 3003): 2750-1469P.txt file - cDNA_ID_2184864; gDNA_ID_2213671; Annot_ID_182297

SEQ ID NO: 24755 - DNA, 3000 bp, Unknown; identical to SEQ ID NO: 9713
  misc_feature (1)..( 3000): 2750-1469P.txt file - cDNA_ID_2185251; gDNA_ID_1972174; Annot_ID_179957

SEQ ID NO: 24756 - DNA, 3003 bp, Unknown
  misc_feature (1)..( 3003): 2750-1469P.txt file - cDNA_ID_2185273; gDNA_ID_1972172; Annot_ID_179858
acgtgcatcatcattcgtctgatggtaaattccacaatgggaaaagagtttatactgattactctatcattggtaagtgtccaataatattgttgctcatcttagtcttatgtcgaccgttgtttgatcagaaaatgacaatggttttttaggtattccgggggatggcagatgtttgtttcgttctgtagctcacggattctgcttacgctctgggaaactagctccaggcgagaagatgcagagagaactcgctgacgaattacgtaccagggtaagtatctatggttaagagtttttatctgtcatactttgccaccaaagatcaaagtaactgttgaattggattcatatggcatcgttagtactttttctctctgcttcagcaaagcctaggtcttaatttcatctatcaaagttcctatctatgtgttatctttgaatgtgataggttgctgatgagtttatccaaagaagacaggaaacagaatggtgagtttttcatgctttcagaccaattttcaacttcattcactggctatggactactcttaaacttatacatcacatttgttgatctcttattaattacgaactactagcagctttttctttgcatctactcattctgatgattctcatcaggttcgtggaaggagatttcgacacctacgtcagacaaattcgggatccacacgtgtggggaggtgaacctgaactcttcatggcttcacacgttctccagtaaataacctcatcctctctgttctttttggttccttaacgttcatgatttcagtttctcatacacaatctagattgaaatctaacaaactccgaaattgtgatcataggatgccaatcacagtgtatatgaaagacgataaagctggaggactgataagtattgcagaatatggtcaagaatacggtaaagacgacccaatccgagtcctataccatggttttggtcattacgatgcccttttgcttcacgagagtaaagcttcgattccaaaatctaaactttagtatacttagttttgcatctttgacttttgtcaggtgttgatgatgtttttgtttactgacacaaccactatctgtatgccttgtagaatgtaacctttttttaccttttactttgaataaaaattttcagtttcaaatgatatgctcgcttcaaaatcttagcttctggatagatacaaagcttattgtagatactcgaaaagagtatatgtggtcagtgtgatatcaggccattgtggttgaaaagttgaataatgatttaaaatggtcccaaacgtgacaaaagttagttctacttcatagaattgagtggattacacactagagacattgtagctaagaaaagtgtaaaaatgtcggactagagaactattggtcacccttgaagtcgttgacgacatcgtatgggatgggagtgatagtctccaaggtcataccttcgaccatgaatcctagtttgggtcctttaggctacctctttgtgctaatggtttctcctctggctttggatgcagccttgagctcatcatttttcttcttcctcagcttgaactccacagcacatcttgactgctgcacatgctccacaagaacatggatcctcttccttatgatcttatcgccaatctgataaacccacctcaagcaaaaactcaaaaatcagtgtagagcagatattgtcatagcttctatagagacaaagaaagaagagtaactaaatctaaactgtgaaagtacaaggttagtgtatttgttctttgatgattataggttgctaatcacagtatatatgaagcacaagaaagttagtatatatcgcaagttagggtgaaaagtaaaggagatcagattaaagtcctatatcccatggttttggtcactacactgcctttttgattcatgttaagcaaaacttcaatccaaaagtaaaggatggatatgcttgttttgaaccggtatgaatgccatccggtacggttgttgttggggacataagtgggatattcacatgcatctttgtaattggtgactttttgtcaggtggtgatatattttttttttttttatgtttctgacacagccaccacaatctatagtatgtcttataaaatgttacctttcaagtaccatataccctttaatttgaataaaatttcaaataatttggtcgtttcaaaatcatagcttgtgtgccacacattgtcaaaatcgtgataatacaaactacaaagttcataatatttgtgggcactcaaaagatatggtcagtgtgatataagtagtgttgttggtcaggccactgtgcttgaaatgaaatgatttttttttttaactgaaaaatgaaaaaaactaaaaacaatacttcaaagatgttctgtttgctgatcaagccaagtaatgttcaccagctaagtttagtaattagtgttgtttaggttcatgtctcctactacaaatgcaaattcaaaatcttgtcgtcagactcggtttccaagtaataaaaagcctaactcgtgctcattttccaacaaaaaccaaaaccaataatcatctacatcaccatcttaacaccaacaaaatttagaattttttaaacaaacaattaaaaagcacagagcaacacacctgcatcagtcaataactaaaaactttggatttatcaatcaaaataactaaactgtcacagagcaacaacacattattttattagtatttcaaatttatatccattaccaaatacatcttccaacactttttaagctcccacaagaattcaaaaaactttcctatgtctacattacaaccacgttgctactttggaaccccatcaccctaattcctctctttcgtcttcttcttccctcgtctctctctctccgcaactcctcgttgcatcactttacattgaaacataatctgtagatattaaacaaagtcttttgcaagattctgattctctagacaaatatg

SEQ ID NO: 24757 - DNA, 3003 bp, Unknown
  misc_feature (1)..( 3003): 2750-1469P.txt file - cDNA_ID_2185338; gDNA_ID_1972172; Annot_ID_179879
ttcaacagaaacaacaaagaaactctaatttgagtctgcttataaatccataattctcatccttggaaaaagtaaatttaccgagtttaggagtttgatgtttgctgttgcctttgtgttattatctttaatgaatatttccatattggatagactcaccaatgtcgaagggaacctcctgccacaataccaaacagatgtaggaatgcttaaaaactctctagatataaaacgaatgtttatttgattatcgatgagcaagaacactgactcgaacataacccgaacagcaagagaaccaggagtgttgactccaaaccactcaaaactccatctaccttcaagataaggagacctgacaaagctagctattaggaagcatcaaataacaccttaaagcttaaaactttgaagctcaaaatcgagcaacatacgtggttggtctaggagttggattaagccgctcaagattcgttatcctttcattgacatcaatcttttgcatatcagtgatcttccctgtaactagagcctcaaatcctccagcatcattgaactgtaatctcaaatggtttcagaactccaacagagagcaatcaaattattcactaagcaatctaatgatgatttccaaaaccagatactaaattcaacctaatttctaaccaatcacagttgaaagtttcaatttttaagaatttttcgaagacttacggcgagaataagcgattccttagcagagagacgctccatttctctggcgtaaactgaaggaatcccttgaaccgagtcttgaaccatagctctgcatatcattctccggtaacaactcttcttctccgactgaaaattgagagaaacccttgacagtggaggagaagacgacggtggtgatacagaggatgagaagctcaatcgaaccgcagaggtcccagaaaccgaaccatgttggatcaatgccattgaataagggggaaaaggtcaaagattggctttttattagtctgaggaatgagtaggtagaagaagacgagagcagcagcagcagaagaacccaactaaatttatcagttttaatttaaattctgaatttgcataaataaagataataatatctgaaaaaaaaatcttgtaacaaaataatattagaacatacaataaaggtctaataaaatttttgggaaatggttttaaatgtaaaatgcaacaaaatattaattttttactagaatactaaaagaacattcatgatataaaacaggcaaacaactatacgaaatttacctccacaatatgattttgtgcatttatttccctatgacactcaaaagatattagatccaatagaaaacaataaatatgaatgaagaacatttagatttcacataaagaaagtctaaactctaaactatgaagaaggagaagtagagaaaaggaaaaaataatgttggcattattagtggttaaacataatcgtaattaatgatactccgcgtgcttcatatcgaattaatagaggttttaacatatatttatttccattagctcgttttcttggtccaaaaaaggaaagactcgagcttattaaaggactttagacattgcagtgaatcttctttttccttgtctcatcacttggaatccgagtatattaggtgagacttgtttatgtgaaaccctaattaagttaatattttcttcaagttttctcggtatatatagagattaaactcaagatcggtttcctgtttttgtaggttattatatattttctctgaagaatatgatgaagtcttgttcctcaccgaagatgatgatgatgaaatccgtgaccgcttgtctaattttaacacttttgatcatgtccgtcgccgcaaaaggcggtggtggtggcggtcatggtggtggaggtcacggtcgtggtggtcacggtcgtggcggtggtggtatttttttctttggcggtggctctcatcatcgcaacagcgcttccgttgacggttcaaacatgggtctaacggtgacatgcttggtgtcttctcttctgttcatgttgttccaaagattctgaaccttttagaatgtgaagaacttatcatatttctagctttgtttttaatagcttttcataagataaatatagacactttcgagttcttcttctttttttgcgtgtaagtcacgacaccaatcataaccaaattttttatattagcttgtgttccgatgatattttggatctcgtgttcgttttatttgaaacaagagtttgcttcaatattgtgcacgtctaacacaccgtgtaatataattagtggaggaatctcgaaacaggaaggtgaaaaaggctagtcaagcttgacttatgtaagttcatcacagtaacagtttcttctcctctttacatggcgtagaaactttcttttgtgtgaactatcgactgtccacatttactgtaattatctttcactattcacatccattcacatatacatcacaatgatcacatcatcatccctactcaacattaggttcacaaatcacaattacattcgactacacaccaaacaaaattacagctctatgtattattggcttaaaaaactctctacgtaatttttgtttgttttggttttaatgttaagctcgaaaaagtctctacttaattcaaagactttcttaaattttaacaatgaacttaacgatcccttccgatacaagcaagcaaacatcaatcactctctcgaatggtgttttactcgtcgtcatacaaaaacagcgaaatatcgcattgtcaaagttaagagggcttgcttttgtgacaccaaaaacaaaaaacaaaaagcgatgggtaagtacgttgggctttaaagataatgttgggctttattattgaggctcgaattgggctttcttctctgttttgcatttgttgcgttcgacctctgcttgaaatgctggtttggcaacattccggttagatctcttcggccgccggagatg

SEQ ID NO: 24758 - DNA, 3003 bp, Unknown
  misc_feature (1)..( 3003): 2750-1469P.txt file - cDNA_ID_2185351; gDNA_ID_1972172; Annot_ID_179885
taggagtaaattatctgacaagagaatacaaagggcaatttcattttagttgaattagggatttgggctcgtcatggctcctggaggcagtgctttgaaagaagtcatggaatctaattcaacgggaatggattacgaggttaaaacggcaaaagtggaagttaataataacaaacctacaaagccagggagtgcagggattggaaaatatgggatccattcgaacaatggtgtttacgagcttcttgaatgtcccgtctgtacaaatttaatgtaccctccaattcatcaggtcagtagtatatgagcttgaacagatttgtaattgactaattgcaatgtttcatgttctaaatgttatttaattctacagtgtccgaatggccacacattatgttcaaactgcaaactgagagtgcagaacacatgccctacatgtcgctacgagcttggtaacataagatgcttagctcttgagaaagttgcagagtctttggaagttccatgccggtaccaaaatttggggtgtcatgacattttcccttactacagcaagcttaagcacgagcagcattgcaggtttaggccttacacttgcccttatgctggttctgagtgttcggttacaggtgatatccctacacttgtcgttcatctcaaagatgatcataaagtcgatatgcatgacggatgcaccttcaaccaccgttatgtaaagtcaaatccacatgaggtcgaaaatgctacatggatgcttacggtaaaactttctttcgatatgttttcttctttttatcaaaggtttctaatttaaagtctgattcaggttatttcttcagatgaaatttttatgcaggttgtgattttatatcatcatatgactaagcttttacattcaccttctttcgctgttatcctcaaccatgaaatattcctggctttagctcttttctacaaaatacagattggattctttagaaggaactataggaatctctggctctgctcttttatgctatttttggatttctattttgcctattaaattttgaccttgaacaatccggtgccaaactcccttactagctgctattccggttcccgctttgctcttctttgttagtccaattttacggtctccttaagtacctaccatagggtctcttagtcccactttaatcctcacacttaaacttgaatctcagttactaaaattttgtttccaggtgttcaactgttttgggagacagttctgtttacacttcgaggcgttccagctgggaatggctccagtgtacatggcattccttcgttttatgggagatgagaacgaggcgaagaagttcagttacagcttggaagtaggagctcatggacggaaattaacatggcaagggatccctagaagcatccgtgacagtcacaggaaagtccgggacagtcaagacggactcatcatcccaaggaacctcgcactctacttctctggaggtgataggcaagaactcaagttgagagtgactggacgaatctggaaagaggagtaaacgaaaaacgaaaaacgaagaaaagaaggaatcgattgaaaaatgttgtacataagaagaagcctcgtggaagagctaatgatcatatggaagatttgaagtttgttgtctggttttagtgtggtataatggattcttctccaatgggaatgaagatgagatgatgataatgacaaatcttctatgatgaatcagtttggaggagccattgttactattttgtggctgcaagaactatattatctctgtattttttgttttttttgttgggatttcttttgtggtttcagagaatgtaggaaaaagtaagacatggttttggctatgttcttgttgtaaaaccaagttcaaaacagattggtgcactttttatcttttcacaatggtgattttcattcagtttagacttgatatagcaagctcgatgtttaggcattacagcatgatgacaacacgacaacaccttacccacatagacacacttttactcatttgaggaaaggtaactaacaaatatgaaaaccaagcaaaattttctatatctacaacgtaaatatcttttccttttgtttttcgtttttgttgaatcaactcttttttctattgcaaagtttgatattttgattctccatttgttattcacctgttcattctctttttggtgcacgatctcttggctctcagagtttgtagttagtcgtagttgtgcaatcatagtaagtggtctcatcatatcttgttgcagagagaatttagactttgtgttcttcttcttaatgtttttgactttgtgtatgattttgtctggtgtatatatagttactaaaactcgtacgaatagtttctttttcacattgtgtttcttgtatgtcgccatacaaagctagatatctctttccctgcagaataatacagagcacacggagacggagtacatattgttcagcgcaagtgaaacctggatttgaacctgatacataaatttgttatcgtttggtcattttaaccgctccctctaatatttacctcctttttataagttacacatcttttacatatctctctctctctctctctctctctctctctctctctctttctttctagaatatattgacgcagccgcgaatctcatcgtcatcgtcatcgaccaagaggaaccctgatttgcggcttttcttcctttcaatctcaattcgattcgttttctttctgttgaaggatctgaccatccagattttcccgggaaatttcataatcagactcttctctttttatcttcattttatttccagaaatcccgattcatcgcgatcgattgttgattgctgtatttctccgattggatttggtgtttttgtagtccgatttcacggacttgaatccgataggattgttttgtttgttgttgataatgaaaacattggttgatgaatacaagagactgtaaatgatg

SEQ ID NO: 24759 - DNA, 3000 bp, Unknown; identical to SEQ ID NO: 9690
  misc_feature (1)..( 3000): 2750-1469P.txt file - cDNA_ID_2185355; gDNA_ID_1972172; Annot_ID_179886

SEQ ID NO: 24760 - DNA, 3003 bp, Unknown
  misc_feature (1)..( 3003): 2750-1469P.txt file - cDNA_ID_2185379; gDNA_ID_1972173; Annot_ID_179907
ttcaacaatcgagattgcaaaactttctctccgtttagagttacagagcctctcaagcttccctcagcaactctccccgctagtgcatcgatcaacgttgattttcctgctccacttgcaccgagaacggcgaggatatcgccgtcagaagcctctccggaaacatcatcgagtagagtctttactccgttttgccgtgagaagccaaaccgccggcgaagtgtgacatcgtattgaagattgttaaagtttaagacgtacgggacaggttttacgtacaaggcttcgacatctattatgtgatgtgcaggatcgtcgctttttacgccgtcgccggaatctccttttcggaaactgtcgcagtctttcagcaactcgtcgagggttggtgatccgatgggagtgatatactgagtttccgccgaaacacgtgtcatggcaatctttctaccgctgagtgatagattcatcggacggcgtcgtttagagttttggcttaagaaatcatcaaactgattgtgaagtatatatggtggaatctgaaagttcttagtagtgatattttttatgatgggacgtatagtttcatacgttggttatttataagaaaaatgtaacatgtgttgtaacttctgtaactaaaaaaaaatattagatagaaatttaacgttcgtgtgggtcgtggctagtaataagagtgaacaataattcagaagtttcgttttcgacattaaatgtatgtaaaaagcaaaatactgtgaattacgtggtcattaaattcttgataagtcttaaaagaaaattcaaaattgtatacagtactttgattttggcttctgctctgcaccacgagtcgcatttaaatttgacatatgtgtctcatcaaccaaatttgaagaatgtgttcttgtacatacagcagagaacgtttgttcatagtaaccataacacattctttggttttaatatcatccaaaacagttttctactcctaatcaccaaatcaaatattaacaccgacacgcaaaatgatacaaaatatgtatctccctttattaatatatgtcgaatcaattgatgaaataatccaaaaaaggaaccatgctgaacctagtgaggaatgcgttgacaaatatgcatgtatacagtagatgtggatgtcaaaactactaagagaacgactctctcttcaatgtggctccacaaaacggttggtaatttgggatggccgtagtttccattaattggttaaactccaatttcccaattttgttggattcatgattaatctatcttcgtagaatattggataaattgtgatatcagagattcagtatataactaataataggttagaaattaattcacaaaaaacaactttttcaagtcaactatagtttataaacaaaacaaataaagagagttaactaaaatttgtgtgaagcatgaaggagcccacgaaattatctcaaagtgtgtggctcgtaggatttgacaaccaccatcatcatcgccatcccttactgattacggtacatgatttcatttaatgttaatttcttaattttcttttatttcatgaagtttcattttcgacataaatgtatatttaggaaataaaaaatcgtgattttcgtgattgttttttttttgaatccgtgataaaggcaatttggcttcgtcaactcgatggccatttcattattatccattatcaaagctaagatagttaccaaattttgtttaaagccttgtttcgatgtatatataaaacatgttctctctcgttagtaaccaatcagtttcaaagcataacatgtaaaattaatacttttcttttctttgtcggccacaaacacattcctttgttttggaattatggttcgagtatacacaatcgctaattcaacagttctactcctaagaaacaattcaagttttaacatcaatacacaaagccaaagggaaattccattttttatatacatgttggatgaatgattgacgaaaatatcgaatcgagtcaaacgatcgacaatgaaatgataaacatgtaggaaaggaaccgattgagatatgaaattcgagagattactaaaaataggaggaggaagccggtcctaacatttatgtggcctaaagcatattttaaaaaattatatataaaaaaaacattatgaaaaacaactaaaaatcatctattgttactcgaacatgggggagattgaagatttactaatggagtttagtacaatttcaaaggagacgttaatggctaagttttgtttgaaattgactattggatgacgactattggatgatgtaacccatacaccaaatttgtactagttacttcaaagctgctgtgacatctaccaaattgtgtttaacgcgatgtttctatatcaaacatgtcactcgtaagtcccaagtactctaataagtagtctaagtttaaaaccttatcgcctataacaagacatgtaaattagtactatcatttatttttggtcggcatggttgttacggcaataaatacattttactctgttgtttctgaattatgacagtaccggtattgagattttgggggtcccaaatatgaaaaacagtcaatatttttctacaaatataataaaatttgaattttaatatttcaaccaattattgagagaccgttaaacttacaaaagataccgtcaatggtaaacgagagattactaaaaataggagaaataagtgcaatttcaaaggagacgttaatggcaagtttttctcttccaaaattgactagtcgatgatgttaattgttaatgttgtccacgtgactcatacataaaccaaatactgtatgtactaaataatctacccggtccaaaccggtttggtaaactgaatcaccgatctagagaatcaaccttacttgtgcctttctcgctcaagtagagaagctcgacggtaaacagaaacacttgatacgacgtcgcataacaacgaacgatg

SEQ ID NO: 24761 - DNA, 3000 bp, Unknown; identical to SEQ ID NO: 9707
  misc_feature (1)..( 3000): 2750-1469P.txt file - cDNA_ID_2185411; gDNA_ID_1972173; Annot_ID_179916

SEQ ID NO: 24762 - DNA, 3003 bp, Unknown
  misc_feature (1)..( 3003): 2750-1469P.txt file - cDNA_ID_2185436; gDNA_ID_1972173; Annot_ID_179925
cgaatgaccggtttttaccaaattctcatagaccatatttgattcttttgatttacttctggtgcaggactctctgtgcttatggaagttgatgttgggggaaacaactctcttgtacagtggggaaaaaacttcttcttcttctttctatcacatgaaaatcctcaagggccattattagtatgatcagattataaaattgtaaggttaggggctttatgaggattttgatggacttgttacaatgtttacatatacactcagcagcacaatagatttttgttaaacttacatgttattcaagtaaaagtactatgtagatgttgaagtctaattgaagaattagttaatgatagtcttaaacacttgattcacttgtcatccaattttggttttgcgcatagtttctcttcttttatttcctctctaaaacaccaaaaccaaacaaaatgtcattttccaatccttaaggtttcattcattttagtgattttttgggtacaaaattgagcaatgtctagtgacgtttttactcaaactcataaaccaacattctaatcagaatcacgatttggactttggtttgggaccttctttctacaccaactgggcttgtaatcagttggtagagaaagcccaattatatattatttaaggcccaaaataaatcgatctagggtttacggttttgtttcattttcacttcccttagaataaataaaaaccaccaagcaacttggatctactctagggtttctgtttcgccgctcaggttcgtcaatctctcgatatcctttctctaccttctcctcagctttctgagtattgaatgttgttgttaactgtctctgaatacgattgattttgtgtcatttttctcgtgcttcgtatttgttgattgattgatttacatgtcatgatttgaaatctttgtattgctaattgctattgctctgtttactgattttcttttctggggttatcaggtttcgtgaaaagaatctatcttgagcaatgtctccagctaaaggtacgcctttttttctttcattgttatctgatttgattctacatcgtcttctatttctcttttgcgtgtaattactttgtttatcattattcaatactgtgactgaacttactactgtatacagctttctgaaatgtatgattcttatctggctctgtaaagttcgtattttttatattctcttgctcgtacctactctgttatggattcatctgattatgtgcttgtttgtctgttatttgccaatgatcaaactttccttgaatgagatttgttaccagtagtgtaaatggtttaatgttccattatttttgcagttgatgtcaccaagaaagccgaccctaaggctaaggctttgaaagctgcgaaagcagtgaaatctggccaaatcgttaaaaagcctgcgaagaagatcaggacaaaggttactttccacaggccaaagacattgaccgttcctagaaagcctaagtacccaaagatcagtgctactccaaggaacaaattggatcattaccagatcctcaagtaccctctcactactgaatctgccatgaaaaagattgaagacaacaacaccttagtcttcattgttgacatccgtgctgacaagaaaaagatcaaagatgctgtcaagaagatgtatgacattcagaccaagaaagtcaacaccctcattaggtaaacactaaaacttcactgagatatgggtttatgtaaacatggagtgatgagtgtatgtttgtatgcaggcccgatggaacaaagaaggcgtatgtgaggttgactcctgattatgatgctttggatgtggctaacaaaatcgggatcatctaatctgatcattgtcgctctgtgattttactttttctggtttttctcttccatagtctcagttttgctagagaagttaagatattactatcaccatctctttgttatgcttttatctttggattcaaaaagattatatgtttggtatttgttgatgcgtcatagtttctattcagatcgtgttccaattcttaatgctacctctctaatcccggtttaacctggttatatcgtaccttcgtaaataactaataagtaatacccaacccaaaattcaagtggtccattggacccatctctttgtttagatgctttcaaagtacagaacaagttcactgtggtctgtggagcccaatctaatcaacaaaacaatcgatccgcgagaaactcgtggttgtaaaaaacttttactaaatgaattattgttgcttgttgccggaaaacgacagaaaacgtcggtatcattgaactaacgtcggtattattgaaccattgattgatagttggaaaaaaaagaaaaaaaaaagaaatcatatattccttttgttcctttttgtttgattttctaaaaaaagatatatatattaaaaaaatatattaaagttgattttaaatgtattattttttttgtgttttacaattttctataattttaaaccaataatattcaattatttttattaaagtttataatttatcagtaataactaataaatattgtataaaaaaatctaaaaaatcaatcttcttgaaacaaatatttttcttagaaaatcaaataaaaaagaacagatggagtatctatatattaataaagataacaataaataaaatcatcaaacctaaattgtttcccacgaatcagtttcgagacattggcacgttaaattgtcgatctggtaatgaagtaggctttacatgtagtagactaaagtgttaattaggacctagaccctacagatttgggcataaaccgtcctttgttatgggacgtgttctacttggtatctctagaaccgcggtctttggcagatggatcagattatatctttttgacacttgtatttatatatgttatatgttattggcttctccttccccattggccatcgaacacaccacacagagaaaacaatatg

SEQ ID NO: 24763 - DNA, 3003 bp, Unknown
  misc_feature (1)..( 3003): 2750-1469P.txt file - cDNA_ID_2185443; gDNA_ID_1972173; Annot_ID_179927
tttgtattttgttttttttttgggggagaaaagcaggtgttgaagctattggagccatggtgtgaacttaaagacaaagtggttcttgtgacaggagcttcctctggtattggaagagagatctgtcttgatcttgccaaagctggttgccaggttattgcagcagctcgtcgtgttgatcgactcaactctctctgctctgaaatcaacagcttcagttcaactggaatccaagccgcagctcttgagttagacgtttcatcagacgcagccaccattcaaaaagcggtcagggaagcttgggacatctttggaaagatcgatgcattgatcaacaatgctggaatcagaggcaatgtcaagtcgagtttggatttgtcagaggacgaatgggacaacgtcttcaagaccaacttaaagggtccttggttagtatccaaacatgtttgtatgttaatgcgtgacgctaaacgaggtggctcggtgataaacatctcatcgatcgccgggatccggggtatgttgcccggtggacttgcttatgcttgttccaaaggcggtgttgacaccatgtcaaggatgatggcacttgagttaggtgttcataagatcagagtgaactcgatcgcaccggggcttttcaagtcagagatcacacaaggtcttatgcaaaaggagtggctcaagaatgttaccgagaggactgtgccgttaaaggtgcaacagaccgttgatccagggcttacttctctggttcgctatctcattcatgactcttctcaatatatatccgggaatacatacattgttgattccggtgctacattgcccggtgtgcctatcttttcatctctctgaaaatcgaaccttataatatcttatcttgtgcaataataagtgaatacatttactcattctctactactttttaagatttacatacatcgtcaaaaatttgcaataacaaaccagcagagacacaaaaagaaaggacagaaaaataaacagcctcctgattgtgatgctttggttgtggctaacaaaatcgggatcatctaatttgatcatgcgtcactcggtgatttcacttttgggattgaaacagacttctggtttttctccttccatagtcttcagttttgctagagactatcatctctttgttatgctctatctttgaatttcttgaagtcaaacaagacagctctatcggatgtactatggaatgtacgaccagagtccataacccattctttgcatgtgctttgagtgctcacagttaacaccaaaggttgcggaggctcagttgcaatattagccaattctgcatgtttctttctttgagggcattcccttttccagtgatcttcctttccacagataaaacaacttgtgttgttacttggccttgactggaatttcccatttccacttgaacttcctgtacatggccttttatttcccttattgtttgatctgcccttaaaatcacccaataatgcttctgaatctggttttgacacgttcagcaatcccttttctttcaactcaatttctttagagtatgctgaacttatgactgcatttagtgtcagggtatccttcccactcccatacttgagtgtatcaactagtgaatcatattgtggtggtaagccagccatgaattgtagagcctggtcttcatcactagtgttgatgtctaaacttgctagatctgcaactagcttgagagaagtatccagattttcttcaatgcttttgttctccaccatcttgaagcttgtgaacttgtgcttcaaatagatcatgttggctaaggtctttgtctggtagtttccttcataaccttccttagaatcagatcgcttagactcatgcttatcagactcttagctattttatctttctctgctttctttggatctaccctaggttcgcatccttcctcttgacttcccgggtctgatggtgtagcatcttcaaccaagacagattctaagcctagaatctccaactgacatagcatcttatgcttccacaacccaaagtctcctttgccatcaaacttctcaatatctcaaatcttgcatttgttggttccatagctagatgtcttccttacaatcaaacctggattgctctgataccacttgtagagaaaactgagaataataatagcttgtaaaagaaacaaacacaagaatttgataaccgagttcacggctaaccgctacgtctcggggaaggactcttatttccaagcttcactatatgatcatagaggttacacacaccactaacttgtgatgtccttggttctttttcagattttacacacaagaagaacaagattcaagaacaacaaagaggaagaagaaagcttgcttcggaagctctttatctatcttctcttgaactctctttagcttgtcttgtcacacaactaccaccacctctctttgtacgttgtaatagaaatgttatataggtgatatgtgatggaccacttttgttattctctcttcatgccattttcgtcaggcccactaaggcccaaaggatgtgtttagtcaaacccaaataacaaacttggtccccaaacaaaagaaaaaataattatatacagtatttgtttagattcttcacaagtactaaagtaaagaatcaataaaccaatcaatccgcgagaaactcatggttatataatatttttgcttgaagtattcatagttgtcaaaagaataaaagtaaataaataatactaaggataacaataaataaaaattatcaaacctaaagaatcagcggagacattggcacgttaaattgtctatttggtgatgaagaagagtgttgactaggatagaagaacctacgggttgggcataaacccgccctttgttatgtattatatatctaagttctatttgtacatcttagttattttatgggcttcttcttctcctccatcgagcacacacatagaaaacaaacaatatg

SEQ ID NO: 24764 - DNA, 3003 bp, Unknown
  misc_feature (1)..( 3003): 2750-1469P.txt file - cDNA_ID_2185478; gDNA_ID_1972177; Annot_ID_180042
gtacaagtgtcaacaccagatctagcgtaaaacacttaagctagtacttaaatagattatgcctattttttcgaccattatatattaaactttccagcctttcgtgaaaaaatgcgcatgttcttgttggaatctaggaatcttcttctactaaagattggcatgcacgtggtaacgatttccattgtatactatctcgatattttcccaccttaaatatcttgaaaattaagatcaaattatatgagaacatatattgtatcattgtttgtaatagccttatatagtgtgtagatgtgaactatggatacaaaaaacaataggaaagaaaaagctgcagagaaggtgttgctttacaactatgaatatgggctcatgagatgtacactacagataagcgaagattcctgttgcatgaaaatgtgttactaataaaaaaaacacatgcacatttctataaagacgaatttcttttaaataataaatttctataacaaataaagataagtgctcctttaaaaacatgcaaaagaatatatagatttaccgtatcagattttcatacaatttttatattttttgagcttgaaagattaacatgacaaactgtatcgtgtgtcctcgtctattcacccctagaagaagtgaaacatggaactttatgtatttgcatacggcgagctagcttcttccctacttgtccaatagatgaagacattatcactcaggttcagctacttcgaagcgcaacatatcgacaaaaaatcgttttagctctatcatctgtcttttgaagaaaaatatcaacatatcaaatacatatacacactccccacaaatatataaccacaatatatattggttactacgaaattccaatgatattgctctttgaaacaactaaactgtgaattacaagctaaggcaatatatctattatattctttctttgtgtctcaacttcatccctttctaagtaattcaaattaattggaagttttgtcatctaaattgaagttcttcttaccggatcattttgtctcaggttgatatatactttcttagtctgatacgaaaaacttataaatataatgattagagagagacatgtttgatgttatatttttctggtaaaaaacatcttgattatgaactatatagttagggatatgtttgatgttgtgtgtcgacatagtgaggtccattaaaaagaaggtctgattaaattttacgtttggaccacaaatctttcttttagaaatcgcggactgggacaccttcctacaacatgtccgtctttactaatcttacgtacccctcacattcgtaaccataaaatcatcaaatataatatagagactggtgatcataattcgaaatatttttcactaattcaatgttatcggtaagttatattaggggtataacatcaagaatcacgaaagaattaaaaacaaccttgtcgaatcatgatttgattttttggcttatactttctaatttttatatcttgtgctgcaaattagcaccaaaatatatatattcttcttcttcaacatcgaattctttattttgttaaaggcatttttttcttaacagaggaattttacatcattcttagactgaactttcgggataaaaaatctcgccatgcaaaggtaatttattttttcatgacaaaagccacaatggcgataattataactataatactatgcaaaacgaaactttacttgggtcataccgaggaaaacaaaggtacactcgattgtgacaactccaccaaagaccaccccactaccaattcacctttatttgtttctttattcactcaaaatctttttaatttttttaattaattcaattattcgcttctctcgttgttttttaaccttttaattaaaaattgaaaggaggtgcctagggtttctctctctgcatggccactctcgctcttcacatctttttttgggcaccattgttaacgtatgcaaaaaaaaaaaaaaaaaaaaaaaaaacttacatgctaagaaaactctctttccttgtcgtttctctcataaaagaaatttatttaaacttattttagtccaaaatttatcgttgctgatgaaaaatacaatataggaagtgggatcggatcggacaaggagtgaattatctaccaacttagatttcactcgtcttttgattgacaagtaacatacacaataaacacatatgcataattatttccatcttcaaccaaatgttgtagtgaagtaatttgatctatgttatacggacatctatctactaaatttttgaaaaaaaaaaaaaaaactatctattacatgctccaaattattacttgcttatgtaatttatgcgtatattagagatgttggtgtttttctgaaatttgatatatgttcttttatctctgaaatatgatatgtgaatcatcatagcattttcagtggttacaaccttatcgaatcgacaaaagattgaaacaaattggaaaaaaataaaatagttttactattttctaagcagcgtgaaatgaatatcagtataatatatgaaacaaattcgtacgtgataaatatgtatacagtgatacaaccaagaacgatgacgtatatgattgacttgcaaaaataagcaaacaaaatacctgttcaaatcgacacttaattccaaaaaggttagtaataagtaagaaggcttttatttatgaaaacaaaaagaaataaagagcctaagagaatgatgaaaattgaaagagaaaaaagagcattgttatagaaaagaaaaaaaagagagagtaaagagaattaagaaacacaataaattaaacaaaggaaacttcatttcttctctttatcccattcagctcctcccttctctctctctctctctctctctctctctagatcaattctttcttctatgatgtgattatccaccatatctgcgacctcttacctaaaaaggatacaagtaagagattcaaagatg

SEQ ID NO: 24765 - DNA, 3003 bp, Unknown
  misc_feature (1)..( 3003): 2750-1469P.txt file - cDNA_ID_2185490; gDNA_ID_1972177; Annot_ID_180047
agctgtttcttctaaaagagaatggtttggtattgaggggagtgttaaaaggctttaaaaaagagagggcgttatgaagcgaagtgtttatcctcgccgccattgatgaaagaggacatccaccggagaagaagcagaggaaggaaatgaagaaagggactgctaaaatttggagcgcaatttaggtcatggttcggttttatcggtcagcgaagcgagttatccggtataccaaggaaaatataactaataaagtcaaatttttaaatttttttatctatttcttgcagagcattgagaatatgttaatccaattgacgcccactcttccggttaagagagccgtggttgatttttactctccaacattgcaaaataattacatgttggtcatctaagatcacctatcaactaagtaccaacagcccatacgtcaagtgcttcgttcgtgataccatgagaaatggactctagtgacatgatcaagttttatcataagtggcgatttacagggctccaccagctagttttattaatccgtttggattttctaaagtcgctgagttttgcctctaatccttcatagctatgaaagagtaaaatattaccgctgtgaaggtccactgaacaaagttacctcgatgtacatattgaagcccttgaaggatcatcagtgtgaaacggcgaataaagtgtatgggaagagttcctgcagtagcatactccataaagtgtatggaaatgcttttttatctcatggaaaagggttcctgcagtagcatactccataaggaaaccataggttgtcggagtaagcttatgtatgcactttcccgtgcattgaacaattacagttgaaccttggaacactgagattagataaaattcttgtctcgcctcagactcggatttacaactcttatagacataatacaccacattgccatccggtgtataaattgcagtagctccaccttagcagaatccgcctcagacgttaatatcttcttcattgtcctagggagtaactctagatctatttgatcacacaaaatctcttctgctcctacttttggtcttgctaaagccatctgtttcatctctttcacaaagtctgcataactatgagtagggctggacacaagacaagtacttgcaaaattgaagatatttgtgacccgacttgccttatacaagtaattggatttttggcttgttttgtcaaaacgagtacttggtcaagaaaattgatttcaccgctgattaagtcttacggaatcaagaaaattttgttgaatcattaaatttattttgcttccaagccattgtttcatttcttttattaatttgtgtgaaattttattaatttgtcttctgctctagccctctctttcacgtatataacatacatagattaaactcatccattttaacatgtatccaagtccaattttctcggtggtcaaagtggcgttcttcgtacaaattatcgataaattttatagagaaattttacaaattatgtaatttcttacaaaaatttgatctaaaaagtagttttttctttataatcaataatgtttatgaaaccaattatacgtagaaacaaatattttgttttaaaaaaaaaaagaaaatcgacatagtaaaagtattagaattgaactttataaagaattaatacaaattgaaaaaaaatagtagaattatatttcactaaatatttcaaatttcatatttatatattaatttataaagattttactgtatttttttgataacatttacagcaaatccaataagtccattgaaaaatattcagaaaatcactaaaacattctatttctcgtcttaaagttgtcaaagattaatttttgtttgtataaaaaaaagctcacttctgttactaacttgttggaccttttattaatttgtcttgtgatttagtttagacccctctttcacgtatataattttgttacatatgaaaaacgagacaaaaaatcatccaatgaaattataacacgtgtagatatttatttcaatctgcttacgaaaaacgccactttgaccaccgagaaaactggacttggacaaaaagacagtctttgttctggaacggcgtttcacacaggtggaggccaccatcaaatatttaattacaaaactataacattatatattccaatttataattttgttactttcttatttgtttcttttttgtttagagaagaaatagtaaacgattgattattcacatcgttgacttgttaatctattttaggactatataaaatcaagagaaaaatattcagcaaatcactaacacattctatttctcgtcttcaagttgtcaaattatggtatttgtttgacatttccaaagaaaaatctacatttcataatttcatatatattaatttccttacacataaacctctaaatattttcatatttacataaatagaacaatattccataataattaatagcgttatcattctagaaaaagggcaaaactttaaaaaccaaccctttcttcctcctcctccgagttcttctttctcttcttcgcctcctcctcctccaaggtaaagtattcagctttttcaaattcagtttcttcacaatcggaaataatgaagctttcttaatccaacattttctctttatccaacaacagatctattttttcctcatcagattcatagatttcgtactgttttttaaatccagattgtgtttaggtcaccgagttgaatcttaggtcgtattgatttgtagattttcctctttcgtactcttgttcttcgttttatccctcagaatatgatttgagaaaaaaaaagatctctttgatacttcatttcagttaggacgacattaacgtgtgtgtgtctgtttgtttgttgtgtgcagtgtagaacgacgattgttgaatgcgttattgtaattgttaagaattgaagttaaagtgttgtttttgaatctggtgaaatg

SEQ ID NO: 24766 - DNA, 3000 bp, Unknown; identical to SEQ ID NO: 9749
  misc_feature (1)..( 3000): 2750-1469P.txt file - cDNA_ID_2185513; gDNA_ID_1972177; Annot_ID_180054

SEQ ID NO: 24767 - DNA, 3003 bp, Unknown
  misc_feature (1)..( 3003): 2750-1469P.txt file - cDNA_ID_2185522; gDNA_ID_1972177; Annot_ID_180058
attataggtatgatatgatatgacacaaattaaagttggtgactattgcataatttgtcgtctaacggatagccaagagagtagtcttttctttcttcatcaaatatgggatatatacaaattaaagctctcgaatatataattctgttaagtgttgtttatttggatattggcttaagataagttgtaggtaaaaagcgccattcgatgagaccaaatagcaaagatgatcactttttagaaaaacgaaaaaggaccaataaaacatgaaaatgtgaaaacccccaaaaagtttttcaaacactcaataattaaatatgaagaaaaaaaagaaaagagagagacagagaagcagaaacggtaagaggagggaccaaaagaaaggaaacgtctgaagaaaaccctaaaccctaaatggtgacgagtgatagagagagagatgaaggagctgtcaaatgtgtcaattccatcgatccacaaaacttaatgcttgtgggctacgcaacgcatctctctgctctcttcgttttttaacactcttgcttgctccattaatttactctatcttcaattcctttctctttttatccctcagatttgcctttttaattaattatggccacagtgagtgttaatgagctttggtatatttggtatcttcgattacgatgtgcaactgtttccctaatctctctccctctctctctctctctctaatattcaagaaaatctcaaccgttgatctctttctctttcttctatttaaacactttaccctttcctactttcttcaccctaaatctcttcctctccttcagatctctttagtctttactattagggttagcatgttgatgacttcagattctgaagttagtggcagtcattgtttgctattgcaacatcttcaagattcagaaatcagattctcttatgggttttcttttgagcctttattttttggtttgagaatcttgatgatgctgcagcggcaattaaatggcttacttatctagggtctttttttccattttcatcatgtggttaatcagaaatccagatcctcatatgtagaatcctccgatatgataacttgaggtgaaacttatttcacaggtatgcatatgattatatatatataagcacacatatatatataatagatttgtgtgtgtataaacatatttgtggacaaaacgatgatgaatgatttgaaaaacgaatatgtatatactactctcaattgattaagtgaacccttgcttatagatctttttttttttaaaaaaactttttgctgcacgatggatagatcctgaaaatttccaaaaaggttttagggttttctttctaacgacaaagtatataagacctgtttctgtagactcaaggtgattcataaatgcataaatttgatttatataataatgactgaaagggtttggaggaattggacatatgtatgaaggagcatgtatatgtctgttgttttatgttcggttacatctggttatgtctcttctctttgtccactggttaatcaaatgactcatcttcatgtgaaaccaaaccccttgtttttcgtgtccatgtttctttatgtatgtgattagatctctatatatgtttctctaatgtagtagatgatgatgtgatgtatgtgacaggtttgtataattcttataagagttctcgactttggatctatacatatatttcgaatttgattcctaaatcggatttgagaagaatctcatttctttttcttgttttttatttcttattgttttgtttagggtcttaaatctgaatctaaatgtagtagtgccaactcgaactatgatctacctgaatctgtatatgaaatcgaaattttacatatgagaaaggtttatatatgagaaagagattagtttgtgtacgttgcttgttgtgcagttgttctctgctgcaaagattcgctcatgtatttgtattaacatttaagatctactaagaatttttaataacatggataccattttattgatggaaaagtccacatctacgtaaaaacaaaactgtgtgtgggtaatcttgattttcaaagatttatacagatgagaattctaattaaatcaaacttgcttcctaattataaacgtttgatctcactgatgtgtgaatttctgatatgtggacttggataaaaattacaacaccaaaaggttttagtttgttttgtcgagcatatgcatgatgagttactccaaacatgaagcaagtgatgaaggtttgagtcatggatccttttttcaatattccaaacaaatgagtttatctacaaataatcatcaatggaatggttggctaagatgtaaaataatactagaaggtcaaaaacttggataaaaattaattcagactacccaaattatagttaggtttgaaaacgcgtttttatccgatatgggtctaacgtcaaaattggggcttaattactaaactaagcaattttgcaagattatcattagtacgagtttttgggccggttatgctgttaaagtttgggtggtctgtgaattcgtttattgtaatttaaagtgtgcgttttaagttgcaaacgtcgaccttagtgatatcgtaagatgtaaagactttcgttgtgaatggtggtatcattatttagacgttgttaaacttttctaaaggtaatgttacgcacatttggaatcttagggatttaatctggtgattggtcgtttaattttatgcttatcccaattaatagcattggacaattaaggcctttgtaaatttgggcctttaattttgggcctcaactatcggtgtatgcacatactactatttttcttaaccctcggtcctccactcctcctaagacacttttgctaatcaaaatagtttttgttgagttcactactttaatctacgaaaatctagtgacccaggggctaggttaaattggagactcgtacgatactcgtgagataattagtaatg

SEQ ID NO: 24768 - DNA, 2083 bp, Unknown; identical to SEQ ID NO: 9755
  misc_feature (1)..( 2083): 2750-1469P.txt file - cDNA_ID_2185570; gDNA_ID_1972178; Annot_ID_180087

SEQ ID NO: 24769 - DNA, 3000 bp, Unknown; identical to SEQ ID NO: 9767
  misc_feature (1)..( 3000): 2750-1469P.txt file - cDNA_ID_2185574; gDNA_ID_1972178; Annot_ID_180088

SEQ ID NO: 24770 - DNA, 3000 bp, Unknown; identical to SEQ ID NO: 9766
  misc_feature (1)..( 3000): 2750-1469P.txt file - cDNA_ID_2185582; gDNA_ID_1972178; Annot_ID_180090

SEQ ID NO: 24771 - DNA, 3003 bp, Unknown
  misc_feature (1)..( 3003): 2750-1469P.txt file - cDNA_ID_2185586; gDNA_ID_1972178; Annot_ID_180091
gatagttaaagagtttaaagaatgccttactcaagtgctcattgctaccgatgtcattgcaagaggttttgaccaacagcgggtaaatattgtcctttgagccttttcctttcttctcgttttacctcaaagatgcttcgtagttaatacctcttgttggttatatacaatacttgcaggtgaatttggttgtcaattataatcttcccactaaatatgaaactggagagccagattatgaggtgtaccttcacagggttgggagagctggccggtttggtcgcaaaggtgagttttgattcttctttttttctttctcaagtgtttccataagttcttatcagtttctgaactatgtatttgtattgtaggagcggttttcaacttgctgcttgatgatggctgggataaagaggtgatggagaagatcgagaagtattttgaagcaaatgttaaggaggtattataagatttctgaaaactgctatatatctttcaagtgtttgttaaaacagtatccaacgattttaaactttgctgcagatcaagtcgtggaactcagaggaagagtataagagtgcattaaaggaagctggcctgctggacgagtgaggaagagagacagcatgtgttcaaaccatcttaaaagactatgtcgtctgttttcttgagattgttttaagaaagaaacttgtatacctctttgaggttttcttgtaatctttttatctgattgctgagagtttcagactttgtagattttttgttaagggaaaaggaaaacattttttatgtcaatgtcaatcactttagtatgaacctaaacagtaaacagcaaagcattttttttacaacaatgggtaagagtcataatacacaaccaaagtctcgaattcaatgtgtaaagctttttaatctcaaatgtttgacgttttagcggcaagatggatcaatgctcgtcgatgataggtagtacgaagcttcttgtatttctgcacaaatgctgctgtatcaatctccttctctaggaacttttcttgcagggcttcggattcttcatccacctgattcatagcctctgcaaaacaagtaaaaggtgtttagaacagtagagaaaatgagacgaggggagaatccattgcaatggtaaattgttaccttgaagtttatgaagaagagaaccaggggagtagaatttgaggatctcttctttttgcctctcaagctcattaagcttttcttgcgcagttgcgagctcagttgtacggataattctgcactgtaaaataagtaaagactggtaaatcagagatatcgaaaaggtataacatggtaaaactgaacaagaaaagttggttcttgatacacacttggtttctgagctccattatctgtggctccttctccaagttgtctcctgttacatttgatcaaatggaaagttctagatttctggattgaactaaagtttcctgtagaattacatgaaccatagagtacttactagctagctgcaatgtttctctacggagctcatctttgatctgacggacagaaacaaatcacgaaaaaattaacgtccagagactataacaaggaaccagaaagctgatgacatgatacaggctttatcaaacaatatcaatgtatagacttgaaagagcactaatgaattatatcaacacagaactaaagaagctacatattcttagagctacagataagaccctcggttatccagaaacaaccgactgttttagagactataacaaagaaccagaaagctctaattactggcaacatgtagaagatgacgccatgataaaggcttcctcaaacaatatcaatgtatatacttgaaagagcaccaatgaataatatcaacacataactaacgaagctccattcttaggactacaattaatagtaatactcttagctatccagaaacaactgactgttttagagacttacattattctggactttgacctggtcaagagagagcagaaattgctgatacgcatctttgtcagagagaagcttcctgagttcatccacgctacagaaaagtatacactattcaaaaagaagacatacaaaaaaaacgcacactcgagagaaggataacaaacaaacaaacaaaaagagcaaaccttttgtctttcaagaagacgataatgccagctgcttcacccggtgatacttgtgctgaaatctgacctgaactttgaggccgggatgagcttggcgagctaactaaagaaggcgagtaccatggcgactgtgaagaagcttcctgaggacgagattgcccttgttgttggtcttttgatccccttcacgtacacaacaaaaaaaagaaacatcatcaactaactatctcagcttccaagttaatataatacatcacctcataaacttgaaaggtgcatttatacagcacatcattgtaaacctaatatcagtaactatgaaccctaaatcagtagctgagcaaaatctacacttgtcaattcacctcaaaaacctcaaatatatcattatagctcaacaaactacacaacaacaagatttccttaatcgctaacagacctaatgtctggatcacgcaatttcatcaataacatatgaatcagatggcaaaaaattcgcaaaatcataccagaaattgaacatcgtttctagaattcgccgactaacgaaaggaattgactttttcttgttctcttgtacttcttcttcctaccagatcgacaaaatttaacaactttacagaaacagagtttacagagtttcaaagaaaattcgatcttctctgtttcgtttcagattttgctacttgcttttaaaaggcccaaatacgaggaggcccatattaagttttgattaacaaaacgtagtcgttttatgcatcgtcgtccttatccacgcgtaacggttcgcgtttctacacagagtcaaatatttctgcacggaagcttcgaaaagaggtcatcaatg

SEQ ID NO: 24772 - DNA, 3000 bp, Unknown; identical to SEQ ID NO: 9762
  misc_feature (1)..( 3000): 2750-1469P.txt file - cDNA_ID_2185598; gDNA_ID_1972178; Annot_ID_180095

SEQ ID NO: 24773 - DNA, 3003 bp, Unknown
  misc_feature (1)..( 3003): 2750-1469P.txt file - cDNA_ID_2185602; gDNA_ID_1972178; Annot_ID_180096
tatagctacgataaagttttagatcacagtttgttttgacccgtctaaagagcctgcgtaagaaaattatattttactttaccaagaaaactttgaattgagttttggttctagacagctgtcccaacctatacgatgaaaacaaatccaaaatatacagacacaatatgtgataatattttctaatacatgtgaaaaatagaccataacatttagactagtgatggcttttattacttacattgactggaatcattacgttttctccccaatgctgatttggttatttcagaaccgacccaaattctcattagtaatggccatgcctctcttgggatcttgctaaccaacgctccaaacacctgaacaaacacttaaacttacaagcatgtgtctccattttatcttgaagtttagagtaaaaataacagtttataacaaaaaggttacctcaagtgattctcttagttggaacaattcacaacttctaaattccttctgcattagatttgctcattcacaaactaaagcatcactccgtaagcctcttcttgcctatatcttaaaacccagtaaaggaagaatagttcagaaacaaattcaaccaccaaatagagctgcaatactcaagatatatctcttatctcagttattatatttcttagaggatatctaaattctcaccagaggaaatcatttgtttctcgagttcctggactgcatcgaatatcccatgagcagtataggttttgatcatagtagcaaaagtgattttatcaggcttacattttctctcttccatttgtatgtataattctttcattgtagccaaatcaccagcctgaccatatgcattgattatgcaattgaagaacggtgtatccagtaccacatctgaattcacaatttgcctcaaaaccgaatctatcttaacgacaagacctgctttgctatacgcgttaacaagcgaacaataagtgattgagtttggtttcactccttgatacttcattttcctgaatacatcatccattttctcaattcttccagcttttccaaacgtctcaatcactatattgtaagtgacagtcgtcagggagaagaaccttttctccataaaatccataacagagcacatcttcttatacataccagcttttccaaatgacaggatcagtatgttaaatgtagtgatatccggttgcacccccatcagctggaaccgactataccagctctccatcttcctcatgttgcgaccatttccatatgacccaatgatcgagttaagcgtacaaacatccggaagagaatctccgtcctcgatcatatcagccagaacactttccatttcctcaaacattccagcctttccatacccatcaataatagtattgtaagtaaccgtgctgcatccaactccaagatacgacatctcaagaacgatacttttaaccagatcaaaccgacccagtttgcagcaacaactgatgagaacagtaaaggtgaacacatctggcttgcagtcactaacagatttcatatactcaagtgtagaaaacgccttgtctagaagctcgcttttgccataaacagagataagagaggtatacacatcaatggttggtttcaatccttcagataacataacttcgaaaagcaagctggcttgatcaggctgtttacaattcccaagcactttaaacagctttgtataagttttgcatcttggttcataccaatgctgcttcctaagaagattgaaaatctataaagtagagaaacaggaaagtgaattctatcgaatctatgtccaagtatctgtaagaatgaagaaggattaaagagctgtaccttgagagcagactgccatcgattctctttgatagcttcgtcaagagcttctagaacagcttttggccataaagttaagtacttttcggaattggctttcctctcaatgcccttcacagcagcatctgttctcagaatccgagacaattctttcttaggatctacttggtgtcttgttgagatcaaaccagaattcattttctctgtacgttcgttggggacctttgtcgaacacattgtgggcgttattgaaatagttggtatacaccgaaaataaacaggggaagatatatgttgctgaaccacgcttctgcaagaatgagaaacagagaaagatagatttaatataaacacaactgaagaattaaagaaacgtaaaattcaaaacagtatgattgtatgaaatatgagaatgttaccgagaaaaaccaagttgtgcgatctcattggcgtacgcggaagtagttccttgaacaggattttgtatcaatgccatcgaagaaaaatggtagaaagataaggtggagaaaaagaaactgcaaattttctgggtagaaagcagagctagaagacgacgacgataccgttgtttttccttcgtttttttcttcttctccggtttggtgtagcttctcttcggtttgtaaaatataatgaaatggttttagttttgatttggatgccggtttaatttggatttacaaaattaaaaatttagcattaatcagttttttcttgtccggtttaaaggattggattgatgaaggaagaaccaaatggagctttttccaatttaattttgaattcgaatttgttaaaacgagattgtccttggcaaggaaccggaatttggaaaatgaaaaaccaagaacacagttgaaagttatccacactagttaggacacgtggaggctaatgtatttcacgtggacacgtgctcatcactctcctctaaacgccgtcgtgaagtttaaaggtcagagacatcggccaccgaccaaatcagacaaggaaaagtcaacgatttgattggatcttcttcacttatgctttaaaaccgttcctgtaataaactgtgaagattgtaagaagattaacacgaatcaagaacatcgaactgttgactttagacagagagagacggagatg

SEQ ID NO: 24774 - DNA, 3003 bp, Unknown
  misc_feature (1)..( 3003): 2750-1469P.txt file - cDNA_ID_2185612; gDNA_ID_1972178; Annot_ID_180102
ttaattcttgatattatttgtatatttctaacagaaaagaaagaccggcgatgaaaatcagttttctgattcaattcttccttcttggactcgttgggtatgatcttgtctttatatcttggagtcaagatcaatgacaaaaaacttttgattacaatactcatttttggttatagaataacgttaaaccaaggattttacatctttggattggacaatacctcaccaacattcgcatcagcaactgaaaatgttgttcctgctgtttcattcctcatggcagcgttgctcgggtatgttcttgattctttattggagataacttgggaaacaagatgtgtatcttgcggaccaattattgtggaccctcaaagtgggctctgataccactcatatctcatttttattatgacacaccaacaattgtagaatagagaaggtggaatggaagaggaaagatggtatagccaaagtggtggggacaattgtatctgtcgcaggctctttggttataacactctataaaggaccaaccatttaccaaccgagtctgaatatagtgaaccaaactattaaacctgaagaagcagaggaagaaaacaagaactggacgttgggatgtctctgtttgatgggtcactgtttatgttggtcaagttggattgtgttacaatcaccattgcttaaaaagtacccagctcgcttctccttcgtctcctattcttgctttttcgcagtgatacagttctttggaatttcggcttatttcgagagagatctagagaggtggaagataatatcaggaggcgaattatacgcgttactctacactgtaagtgtttgtttattttcttagattaagactcttttgaatggtgtgattgattttggtgtgagtttgaatatatttcagggtttagttggttcagcaatggtgtttgcaatacaaatatatgtagtggaaagaggaggacctctgtttgtatcagcgtatttgcctcttcaaactttgattgctgctgttttagctactttagctcttggtgaacacttttaccttggagggtatgttatctatatgttttgactcattatgcgttttattttcatatcttatagttaagtttcttacacattttttaatgtttgttttggtcagattgataggtgcaatactaatcatgagtggactatacttagttgtgatgggaaagagttgggagaatcaagctctttgccaacaacaacaacacatgatttcttcagcagcatcagattttggtgatgaagaagactaccataataataaaccaagatctcctattagtcaaccattaatttcttcctaaattttgttagatcctatttatgtcttaaattcctagttcctactctcttcctcattaaaatcgaaatggacccggttgacgaaatagagataaaaataaatttggttaaaatcggtttagaattaaatcgattggtttgggtttagtgccacagtggttaggtgagtagagttgtggttcggttcaggttatgatattataacctggagggatcaaaattggcgcttttaaaaaccaaacaaacaaaaacagagaggaaacaaaaaaatgagaaagcaagaatcagagggagcgaatcttgaattcgaatccaaatcaaatgacaatggaaatgtgaaaatcgcaccaaacgaccaaagtttcctcacaattcttgacgacataaagtcttccaaatctccggttcttacacacgacaacttatacatttgtacacgtttttaagaccgaagctggttttttttcgtaatctgactgttcttcttgtttttgctttgttatattcaggctgttattaactatggagcttcttggtacaccttattctctgtttttacgattacgcttttcatgcttataaagtgttcgatgaaatgcctcaatgagaacggttttgttttgaaactttcaggtgtggagtttgtagccagattcttcctgcattccgaaagctcagcaacagtttctcgaagctcaagtttgtttatgcagatatcgacgagtgccctgaaaccactcgtcacatccgttacacacccacgtttcagttttacagagacggcgagaaagtcgatgagatgtttggagctggtgaacagaggctccatgatcgtctttggcttcactcttgaatatgttcatcaaatattaactatgaaaatctgcattccttttgtgatactttaaatgccaacacaaaaaatacttggctcttcgacaataatcccctgaataagtttggactttggtagattaatgttagggataaacttacagaaacatcaaaggttaaacagaggatggagctaacattcatgatacaactcttgacaaataaatatgaacaccgagctcctcacggcggctctttccctctcaaataatttggtttaaccgggtataatgaccttgagaaacattgaagtctctaaatcacactcttgccaatctcaaaagcaccaagcttcacctctaaacggttttgttttccaggaatgaattgggttaatgtaactttctaatttgggtcaggtttgagattggacggtcttccaccacaaaaaatatcaaccattaaaacttttattgttgcccattaagaccgaccttcttttcgtaattttttttttaaaacgtaactttgttgaatttgtaaaaaaaatctcttgtgaaattatcacaatgtttattcaaaactaaataagaacatactagaagcttttctaaattggaagatgtataaaaaaaaaatagaagaaaagaataataataatggaaaacaaatactataaaataaacgtttctttgataacaagaaacggatttgtcttctatataaataaaacacacacctgtctatttatttacacttctcgaatcttctttttcttctctgcgaagctctctctctctctctactcgattatcaaacatg

SEQ ID NO: 24775 - DNA, 3000 bp, Unknown
  misc_feature (1)..( 3000): 2750-1469P.txt file - cDNA_ID_2185634; gDNA_ID_1972178; Annot_ID_180110
tgtagaactttgaagattttactaaaggtattatttatactcaccgacataagtcctttgagatgatcatcggtgactttataagaaccaacttcggtgggtttgttgatcatatccaacatgacactgatgatgtctgagtgatcttcgattttcccactcttcaaatgatcatcaatcacaagttcaaagaaattggtgagtttggaaaaggctttcatcaccgtggaatgctgaccggagatccgatctatgatccaccctgcaggtaagaagtcagcaaacgccagggagccgaggttggtctccgattcaagcaccaactcttccactgtctccatatcgacaaaatcgcaaaaattttgtccaaaagaaagtctacaaatgatacttgccgcgaaggtaaaaatgaccttcctcaaattaactgatgaagttggtgtctcaagagcagattttgataccttccggaccaacaattggctctcgtcctctctaatatacctgaaagatttgagcttcttctggctaaagagctcggaaaccgcaattttcctcatctctcgccaattctcaccatacggagcaaaaccaatatctttaaagttgtaagtaaacaacccgctccccaccgtcttaggtcggctacaagtctcaagatcgtgagtcttgagcacttcctcagctccttctttggaagagacaattatcacagggaccaccccgaaatggagaagcatcaccggtccatattcttgggagattttgtgaagagatttgtgaagaaatcttccaaactggtgcaagttaccgatgatcggaagacccttaggtcccggaggaagcttccctttcgacggtaagagctttttcaagaagattaaagagagtggaagaagtaagaggaaacaaagaaagatagacattttcttatctgtttttttttctggctaactttcttcttgtctttgattgaagtgaagagtaataaatgagttcttaaagacacatatatatagagccaatgcatgtcgttggcttttgaccaaatcaaagtttcccttcaaagtttctttttattttactcttctctttttttcaccaacaaaacttctcacttattattggaataatattattaatacctagctagaagaatgtggtagaagaagaagttgtcattatctaaagccttttagccgactctgaatattattttgaatcaataaagttaactcgttcacatctttttttttttcgttcagatctatttattgtgtttgaagaaagccaagtctctcgaggctcatataacagccatatgtaaggttgatggtgtgagaaacgcaaacgttttttttttttttttcaaatgtattgtaattggtaaaagtcttaaatttcaatcttcaacatttatagacccaatgaagtgcagcacattttatcctgttggaacaattctggcgggacgactaaaatcgagatactcaacaaatccaaactaaaaacaaagcatactttcttagccaaacaaaatcatattttaataatttgagttaacgttattgttatgttactattttcggaaatccaatctgattaaatggatattattgaaagaaaaaaaaatttaaaacaaatatctgattttaatacaaatctaactttattgtacttggggcataattgtttttaaatcaatatagcagatttattttctaatatataaaattacatagacatatatatatatatatatatatatatatatatatatatctaatcaaatgaaaatccaaccaaaccatattgtagttaaatctaatctcctaaatgtagttttgacaagggacatgatttggttatgtataagaaaacctagccgaaatgtagattatcatcatgaaaacatatactaccatagtatttttattttgcagaaactatatatacaaaagtagttgccaatgattatcgtttatcattctatttatagacggttgcgtacattttttgttactgtttttttgttgcacaacatataaacggttaacagttatttgtggagtacaactatatttggatagttctctatgatgtactgtatatgaatattcgatcgttatctgaaattgatggatgagaaaattaaccttaaaaaaaatcattacaagactcgttccattattttattttattttatgttattttgatagaaactcgttgtattattgctatctattactccattaacgaagctcaaccaccagacagctactttgatagtcctcttaaattccaaattgatccaatttatcactttttgtaacctacggttcatttttttcaatgcgatattgatactaatttaattagtttttgattttatcaattattaaacgttttaaaaaggatgcatttgtacggaactatgaggaggtttaccccatatatacggagtcgttggtcaaacaacgtcgcgaaaaaattgtacgtgacgaggtctgcgttatataaacaatatcaattcaattgtttctttacgaatctatgaaaattttaggatctcgtacttcagttcaaaaattatatattgactttataagcgattatcgatttatttttattagaaagtcgcaagttctcttgcaatgtgtaaaatttcagagagataactcgtaacgtgcagagcggaaacaaaagaagaaacagcgattccgaaatgccaaactcgaaaatttgcgtgatttccacaattcaaaggagctggagtcccatcctagttgtcacgagcaaacccaactagaggcccgtccacaaaatctccggatcaagagcatacagcttctccgcaaactaacgcaaaaacgcgatgacaacaatggacttaatcacaaatccgatggttataagagcatctacggaaaactagagaaaccacctccggtcgccattcttataaaaacgataaaaaccagctctcacggataagcaatg

SEQ ID NO: 24776 - DNA, 3003 bp, Unknown
  misc_feature (1)..( 3003): 2750-1469P.txt file - cDNA_ID_2185638; gDNA_ID_1972178; Annot_ID_180111
tcacaagcaatacatatttctctgaaactaaacacaaaatcaaagagttttgtggacagaattcatttaggcatatcatcgaacacttggtatgcaatatataataagctttatatcttgagtcaaaagctaatgaatccaccattgactatactacaaaagctaatgaattgataaaaagcagtttctaaattccaacttctacaatttcaacattgtttgtaaacgaaaattacataactttacctattagagaataaaatgcttcgaaattgagaagatgatgatgttggagacgattacggagagagacgacggtagtggcctcaaaacaacgccggtaactatgagatcgatgaagaaacgatgctcgtgagagagagaccacagaggggaataatgttttttgcgtttcataaatgaagaaggaaagaaaaacccatatattatatgcacatatatttaatatgtatgtataagtataacctaacatgtaaagtctaatacttcttgactttttagtcgatcagattttgacacattttttgaagaaaagtctatacaatctctcaagtcccaaaagtcaagaccgaaacttttgagacaactacacgttacgagtttttttttttttttggtaaaatataaagtatttatatcattttcaaagtttcgacaaaaattacaaagagtacaagtagcgaaaaaataccagaaatctacagaaagaacatacaatgacaatcgttggtgtcagttttgtcttccgttgttgcttgtttgtggctcctcatcaggttcccttttctctgttacagtggttcgatgttggtgttttgattttgtctttcagtttttggaggtgcatgtcttgtctgagcggagatttcttgagaagaatagaggcggcgttttggtctatgtggcattgcttatccgtgagagctggtttttatcgtttttataagaatggcgaccggaggtggtttctctagttttccgtagatgctcttataaccatcggatttgtgattaagtccattgttgtcatcgcgtttttgcgttagtttgcggagaagctgtatgctcttgatccggagattttgtggacgggcctctagttgggtttgctcgtgacaactaggatgggactccagctcctttgaattgtggaaatcacgcaaattttcgagtttggcatttcggaatcgctgtttcttcttttgtttccgctctgcacgttacgagttatctctctgaaattttacacattgcaagagaacttgcgactttctaataaaaataaatcgataatcgcttataaagtcaatatataatttttgaactgaagtacgagatcctaaaattttcatagattcgtaaagaaacaattgaattgatattgtttatataacgcagacctcgtcacgtacaattttttcgcgacgttgtttgaccaacgactccgtatatatggggtaaacctcctcatagttccgtacaaatgcatcctttttaaaacgtttaataattgataaaatcaaaaactaattaaattagtatcaatatcgcattgaaaaaaatgaaccgtaggttacaaaaagtgataaattggatcaatttggaatttaagaggactatcaaagtagctgtctggtggttgagcttcgttaatggagtaatagatagcaataatacaacgagtttctatcaaaataacataaaataaaataaaataatggaacgagtcttgtaatgattttttttaaggttaattttctcatccatcaatttcagataacgatcgaatattcatatacagtacatcatagagaactatccaaatatagttgtactccacaaataactgttaaccgtttatatgttgtgcaacaaaaaaacagtaacaaaaaatgtacgcaaccgtctataaatagaatgataaacgataatcattggcaactacttttgtatatatagtttctgcaaaataaaaatactatggtagtatatgttttcatgatgataatctacatttcggctaggttttcttatacataaccaaatcatgtcccttgtcaaaactacatttaggagattagatttaactacaatatggtttggttggattttcatttgattagatatatatatatatatatatatatatatatatatatatgtctatgtaattttatatattagaaaataaatctgctatattgatttaaaaacaattatgccccaagtacaataaagttagatttgtattaaaatcagatatttgttttaaatttttttttctttcaataatatccatttaatcagattggatttccgaaaatagtaacataacaataacgttaactcaaattattaaaatatgattttgtttggctaagaaagtatgctttgtttttagtttggatttgttgagtatctcgattttagtcgtcccgccagaattgttccaacaggataaaatgtgctgcacttcattgggtctataaatgttgaagattgaaatttaagacttttaccaattacaatacatttgaaaaaaaaaaaaaaaacgtttgcgtttctcacaccatcaaccttacatatggctgttatatgagcctcgagagacttggctttcttcaaacacaataaatagatctgaacgaaaaaaaaaaagatgtgaacgagttaactttattgattcaaaataatattcagagtcggctaaaaggctttagataatgacaacttcttcttctaccacattcttctagctaggtattaataatattattccaataataagtgagaagttttgttggtgaaaaaaagagaagagtaaaataaaaagaaactttgaagggaaactttgatttggtcaaaagccaacgacatgcattggctctatatatatgtgtctttaagaactcatttattactcttcacttcaatcaaagacaagaagaaagttagccagaaaaaaaaacagataagaaaatg

SEQ ID NO: 24777 - DNA, 3003 bp, Unknown
  misc_feature (1)..( 3003): 2750-1469P.txt file - cDNA_ID_2185690; gDNA_ID_2213660; Annot_ID_181829
gtggttaactagatgtccttgttgtagtcttcttgttttcattcttgtccattcttattatgtgaagtatatatatgatagatttatttctacttttcctttaacttagtgtctcaagttcaagacagaccaagcacaagaagcgaagaagatggagaaactgaataacatatttttcaccctcatggccagaggacctgatggtaaaaatttcattttctgcatatctaacttaaagaaagaacatgcatcatctatctcttagtgtttgagaaaaaaacctcctttgttttattgagctatgaggttatttctattatgagacaatgtatcacatcgtcaccggctattattttctcaaaacatcgcttttctcctaccaatcttgaaagaatggaacttgaatgtgcatcatctcacaacctttaaaaggaaagctccttttgtgctgtgtaacattgggtgtattatagcttactttgtttatttatgttggttgtataatgcagtcgatctctcagaagtcaccgggaaagaacagatggagacacagcctgccaagaaaggaagaggaaggaagcaataagtctcaagatttgttttccgtttgtcttggtatcaagattttgatccatttttgtttgatattttgagatggtagggttgtcaagattcgttctaaagcttacgacttttttttacactttgatcgattaatcacttttggattagcctaaacccaaaagctaacctttttaacttggattttgaaagttggccaactccttatagcttgattagtaagaagactaaagatagtctttgaaaagagaaaaacacctggtcaattatgatggagacagagaagaaaaacgagatgattttcttaaccgatgatctatcagcaaatatcatatcgagattaccgcaaagaatcatcaccacttccaaactagtttgcaagcaatggaaatcactcgctgattctccgtattccagccaaagtaccatcaaaactcgcattcatgactgtcatgtacacacactcacaagaagaggtcatgggttactatgcacgcaagatttggggacttccacaaaataaattaagtatatttagaaatgtaagaattgtgggacccactggtaggggcggttggggcgatacaatacgattcgagaataatatcagaccttagaacttaagctttagttgacaccctacatacaaatacattttgtgtcacaacgttagtgcaaaatataatattaaatctggtatctatcttatacattttgaacataagagaaagcacgtaggaacatccattgattgttatatgaagcaatatggtatttcatggggaaaaagcttaagaagagatcaaaatcatggcatttgattcaaggaagagtcttaattaatcaaagaactaatgacgagagatcactcttttccttttcctttccctatcgtcatgtgattcctaaacctctcgagggtcgtagaagttttctacaaagagactgacattttcacacatcctgagttgatgaaacatcacgttgtttcttaattccttaacaatacatctcttttgatcagaactatacgactatgcaagttctttttttagtttctccgtttaatcttttatgttgtgtggaaataagcggttttcttatgtgacaatgtgcgtttttttttgtctgtttcgaatcctcaatatgacgaagattaatacatttatggttgtgtttcttttgtgttgtataaatatgtgtttgttttattttcaataataagcttggtttggtttccattgtttgaatttattgggtatacatattagaccaattagaattccacttgtaaatgcatattctggaacaataatgttgactatactaataattttttcttgggtctaaaacatttagtatacttttcttgaattttatgtaaagttattctgtttttaggacttttatcctcactgaattatgttgtgttaaagtagtagcttatatggtcacatatctcacacgtgtttccattttttttctatctaagttttcggtttttacattgtatacaaaaataaatggcatgccttgggccttggccactgattcacatgatcacgtagagtttgtgtgtgattcaaatcctagatgagaagatcatccaattgatctaagatgtgtctttcttatatcacacgttttattttaataatactcttcagttgggtttgattccatttatgatttatctatgaaaacagaatatgtcctcatgctgattatttcgtttgtggttgcattttaccatctgtagttttttttgtttactgacaaacaactaagattttatgaattcatttgatgataaatagttaatcaaatatattattatgagtgactcgatggcgaaagctggtattatcttatggctgctaaagtctacttttagaagaagaaaaaaaaagggtctgttgcattaccctgttgttgcgactctcctacaataactctcacgtggcccgtttcttggtttttgccctattttcacaaaagtaaacagagattttcactagcaaattgggcccaattggagacaacttcatgtggtttgaatcgtatatttcagatagattagacatctagtcttctttgatgtgcggtgaggatcttaagtcgctataacgttgtgaaaaaagaaaagaaaaagtcactataacatagatcgcaactaaacaaataaaggacactatacatgtacgtaataatattcatttattttcaacgacaatgttccctagggtggtaacccaagtatttttcatagatattatacttctagcgaaaagccatcaattgagaaaaaaggcctccacgtttgacccgttttgcctataaaaggattctttaagatatggaccttactcatcttctccgttaaacccatttaaatagttttcattgtccttgtgaaaaatg

SEQ ID NO: 24778 - DNA, 3000 bp, Unknown; identical to SEQ ID NO: 9779
  misc_feature (1)..( 3000): 2750-1469P.txt file - cDNA_ID_2185690; gDNA_ID_1972181; Annot_ID_180131

SEQ ID NO: 24779 - DNA, 3003 bp, Unknown
  misc_feature (1)..( 3003): 2750-1469P.txt file - cDNA_ID_2185698; gDNA_ID_1972181; Annot_ID_180134
ccgttcttcttcgaacttctgcaactttgtttctcccaaatctgtgaatctcaagtgttcgtcttcaccatcatgctctctcgtttattccttagacattcgaatctccgtttcgtaaccctagtttcatcgaaatcaaattctcagatcttctcttcgtttattcgtccgctttcgactaacagtagcggcggcggaggaaatggtgacgggaatggtcgtaatcggaatgatgttccgtggagtttcactggagtaaacgatgataagtctggacctttctcttccgatgattcttttggttcttctggagttgcaggatctggtttacctggtggagaggggaaatggccggaggagcctaagagatggaatataaaggaggaagaggaaaaagttgtgtttgatactggtggtgaagtaggtcaagggattgagactagtcgcgagaggaggggtaatgaatgggaggagactaagagatgggatatgaaggagggagaggagaaagttgtgtttggtggcggaggagatgaggtggatgggtttggaatcaggggagaggtgaaatctaatgaatgggatgtgtcaaagccatggaatttgaaagaggaagaggagggagttgtgtttgatactggtggtgaagtgccgtttagctttgagaatagcttggaaatggcggaggaagagcgtgtgaagaaggagttgattgagaaggaagagaaggagcttcttgaggttatcaagggtgagacttttttaatttgttttgctgattcttaagttttgatcttatatgcaatgcaccagtagtttcgatatgtgtctagttttggaatgcagtgacaaatgggtagcaaatttgatctcatgactttccttgttaaggttagatttggatttgagggttaagtcaagtagcaaaggttgtgtaatcaatctatttataggcatgcttgctgagtggaggatatgatagtttttggagtaagctcggatgttgaagaggaataagcatttgggtagaaagacttgtgtttgaagtggatagttttgtgcttactgacgctaaggaacagtttagtgcttatgtgtttttgctattaacaatgttcagcacaataaattgaagaatttgttattttgatcacattggtaatggattctgctgctagtaaaacaagcgctagaagtagagtaattgatttgaaacttactattgcaggtcctgatcgagcatttggagaccttattgctaagtcaggtataacagatgaaatgctagatagtttaatagccttgaaagatttccaaggggtcgaaggattacctcctctgactgagattgaaaacctgcgtcgtgagaaaagttcaaagaagtcatcaagagctgagatagaactccagatgcaagaggacattgccaaagcacgggtgagacaagttgacgaaacaggtagagcctatggaactggaagaagaaaatgtagcattgcacgtgtttggattcaacctggggaaggaaaatttcaagttaatgaaaaagaatttgatgtctatttccctatgcttgatcatcgcgctgctcttctacgcccacttgctgaaaccaaaaccttgggtcgttgggatattaagtgcactgttaaaggcggtggtactacaggtaaaacctctccacaatcacttcgttttcttcgacgattagtcccaaagttctctatttacactagcaagtatgatttatgcttaagctagaggatttggtcataagttaacaaattagattgccatctctttacaaaaatcaacaattatccaagcatttccttctaatcgttgttaaccatgtactcaaatatttggtttaaaggtcaagtcggagctattcaattgggtatcagcagggcactgcaaaactgggaaccagatatgcggacatcacttcgagctggtaagcaagatactacaggcatcttagcgttattaaatctgtttagtcttattgatgttcattagcagagatacaacttattgtctgaccaacgttgtcatttgatagccggtatgtgtgttcatgtctgttgaatggattggtcttgatctcgatctttttcatcttcgatatgtttcagctggtttcttgacaagagactctcgagttgtggaaagaaagaaacctggaaaagccaaggcaagaaagagcttccaatgggtcaaacgttgaatccgaaaatgcgtactatatcttctcctttttgtctctgtcattttcattagttcgtctacttatcccgggtttagaagaatcaccggcaaataacttgttcttttggttcaatcccgtagttatctttttgtaccaacacattcttctcttacggctctactcttggaaacttgagtttcgttggtttctgagtcggacacatatttttgtatgtttttttccggcaaattgtcatgtttcttcaaaaggttcattgatgtttaaacataatgatcaactccttatatggattatattattaggtgaattttgattcttttgatcaaaatgttaaggaatgtccaattctcatagactttacaagagttggttacatttgctatatacaaaaatatctaattggataaactctattataccatccaaatatctaattacaagagtttgtgtaaagactttccataacagagcaatggatagattttgacgttatgttgataaattttattcacttgaaggttctattttgtgttacgtgcaagcatctactcattgaatttcttcactcctactacaagtactaacaaaattatcaatttcccaacaaatccatagatatcctttctctagcaatcgaagtaactattttagtttcattaaaataacatatcactcttaaggactatataataacaaattaccttcttgttgttctcagtttcttctcccaataccaaaaatattttgcttcatccaaggtcttgaagatg

SEQ ID NO: 24780 - DNA, 3003 bp, Unknown
  misc_feature (1)..( 3003): 2750-1469P.txt file - cDNA_ID_2185701; gDNA_ID_1972181; Annot_ID_180135
atgtactcaaatatttggtttaaaggtcaagtcggagctattcaattgggtatcagcagggcactgcaaaactgggaaccagatatgcggacatcacttcgagctggtaagcaagatactacaggcatcttagcgttattaaatctgtttagtcttattgatgttcattagcagagatacaacttattgtctgaccaacgttgtcatttgatagccggtatgtgtgttcatgtctgttgaatggattggtcttgatctcgatctttttcatcttcgatatgtttcagctggtttcttgacaagagactctcgagttgtggaaagaaagaaacctggaaaagccaaggcaagaaagagcttccaatgggtcaaacgttgaatccgaaaatgcgtactatatcttctcctttttgtctctgtcattttcattagttcgtctacttatcccgggtttagaagaatcaccggcaaataacttgttcttttggttcaatcccgtagttatctttttgtaccaacacattcttctcttacggctctactcttggaaacttgagtttcgttggtttctgagtcggacacatatttttgtatgtttttttccggcaaattgtcatgtttcttcaaaaggttcattgatgtttaaacataatgatcaactccttatatggattatattattaggtgaattttgattcttttgatcaaaatgttaaggaatgtccaattctcatagactttacaagagttggttacatttgctatatacaaaaatatctaattggataaactctattataccatccaaatatctaattacaagagtttgtgtaaagactttccataacagagcaatggatagattttgacgttatgttgataaattttattcacttgaaggttctattttgtgttacgtgcaagcatctactcattgaatttcttcactcctactacaagtactaacaaaattatcaatttcccaacaaatccatagatatcctttctctagcaatcgaagtaactattttagtttcattaaaataacatatcactcttaaggactatataataacaaattaccttcttgttgttctcagtttcttctcccaataccaaaaatattttgcttcatccaaggtcttgaagatgggtataaaagtttcatcaaagatcaaaagaattctcgcatccacaggttatattcctattttcatttttaaataccgctattatttttattttttctactgcaaatttgcaagaaaatttgtaaccaagaaaataataattttgaaactttcctcgattggtacagcttcaggtagttcaaatcccaaagatggtgctgacgtggatgtccgagaggaatatgcaaacgcctttcgtacggaatcatacaatcacttttggacacgtgtcgtacagctaagccgcaaaaagtccgcagtgtcttcttcttcttcttctccaccaatcgaatcatcctccacgtcagctcgtctcatgtcttatcgcctattcgcgcacaatcttctagacccggatctgaataccattactcggatactagatgtatcccgggtcgggcgacacacccgaactcttctctctgattacttcttggagacggcaaacgctttcttgctttgcacgcaattactaaaaaacattcatcatcttcgttctaaatacgagtctttgaaaccaaaatttcattcggaaaatcataattcattggctttaatagaccaattcacggagatatcaaaatggttcgacccgtttatctcgtcgggttctaggatccagctaatcagatccggctgtttatacttgctaaaacggctagagtcgagacgagacaagacacgagccaaacttaagcttatcaacggactaactcatagctcagggcttctcgttttggctctaaccactacattgattgtaaccatagcctctcacgcttttgctttgtttctagccgctccgactcttttagcctctcaatttaaaccagccggtttaaggaataagttaacaaaaacagcggctcggctcgacgttgctgccaaaggtacttacattttaagccgtgatttggacacgataagcagactagtgacacgaattaacgatgaagtgaaccatgttcgagccatggctgagttttgggttggtagagggtcgggtcgggttcgaggcagtgaagaagttgctcgagagttgaagagatgtgaagaaagctttagtgaagaacttgatgagcttgaagaacatatttacttgtgtttcatgactattaatcgggcaaggaatcttcttgttaaagagattttggattcggatgatccacctaattgttcattcgctcccaaatccaaaaaaaaattgtagtatttctttgtttcgttttttttctcatgtcaatttttattatttcttttgtttttgtctactacggtatgtatatatatttctttttaccctcaattatataatttttaattcctagaaatattagtgtcggaacatttttatttctatttggatgatattcggattctattagtagtcataaaaatgccaaatgcaagagtcttttatttttgggcaagccaaatacaagatagtctaaattatggaatttttaacatttgtcaaaagaaatcccaaaatccattacatatgtcggaaatgtaggaaaaccgattttaacaaatattttagacgacctctttgttttgggtaggagagactattcatcaaaaaatgaaccaaccataacatttttttttcctatatcttctaattaggtaaatcggttgactcataaaccgagtcagcaactcgtccgaaccataaaaaaacgattccaattcgacggaatctcacgagtttccacttttatataaagtcacttttgcaaatcgaacaaatgcttatagaagaaagttatcaaatctagagatagagagagtgaagagggcgaaaaatatg

SEQ ID NO: 24781 - DNA, 3003 bp, Unknown
  misc_feature (1)..( 3003): 2750-1469P.txt file - cDNA_ID_2185747; gDNA_ID_1972181; Annot_ID_180147
atctccgtaggagctgtacgaatccccagatcgtgaacacatctcttgtctgaaaagcctcacgaaatttctcgacgtagattctcccgttgataatcgccaggcggaaaatcgccgtcgcattggctcgctccaaggcttccctcgtgatcccggtcttctcccatggccgtagatcctcgtgaatccatcggaagtaatctgggcacgtggcggatggagaacggtcagattctccttctccggcgctagatcggaaactcgtcggataattgtcctttgggcaagttccagtgtcgttgccggagaaagcagcgcagtttagcgtaaactcttttggtttttccgtaattagcttagtcgactgagggtattctggggattgagtggtttctctctcagtcacggacaccgcttctttctctatcaaaacctatagacgaaaacgaagtcgtttagcaaaaaccggtagttagttaatgactaaaaacaatcacgtgattattaaagctcccgtgtagacacgtgtcaagcgtaggaaacttgtttgacaaaaaagtaatggtgacacgacaaattaggcgcgaacgagttttagcgccactaataccgtatacgacgtggcaaacgacaaacgggactgtcgttttgatgtaattagaagagaacacaagaatctatttatagtaagatgttcgtacggagggatcgaggaggaggcgcgtggagagaaacgcgccgaggaggaggaagagaaagatggagaagaaggcgtaggatcggttagaagcaccggtgccggttttgacgagtggagacaaaatggtgtcgaaattacgagagtgcgttgcagaggtatatgacggcgagttcctcatcatctctccttgctgttgcatgccaatttgataatcaatgatcgtgaaacgaaagatgaagaagagagatgtgagagagagagagagagagaaagagaaaaggagagctttttgtgtgtgagaaaaggaaaggacagagaatcatgtgaaccagaataggaaaaggtttggtttataactaaagtgttttaatgtttgcaagacttttgatgggtgtgtcatgttgtgtgtaccaggaataaatgtttaaagtttctaggtgaaatgtgagacacacaagtgcaactcttctaattgtttttgtaagttattcggtaaataacaaaggaaaataacagaatcgttactataaaatcctgtttttttattgctttacacgatttataagattcgaaaaagtttaagatatatttgataagtagtatttttgaaaaaagtactataaaggacattttctattaaaaaaaaacttataaataagatgaattttgggaaaataaaaggcctaggacgacgccaagatcaaggactaagcccaagcccgaaatagaggtttttgtaataaagttttgaaataaattgcattttgaggcaaagatagacaatctatcgtaattatccgaaccaatcaaataattgacatagggacatcagtaatcatgtatcttcttttccggttaggttcatgtttaaatatcagttttaaaaagtgacaacaactaacaaaccgagcattgatttggaccacaataaagcacacatgtgatttagagaaaatggaccctttttgtttatccctttttttaagtgattagttctactatatcatatagtttcgacgattttgttacgacatgacatttgcatatatagagctgtcttggtcggagttcactgttcaataaagggtttaggctttcgtggtgcggaagcttaatatatcacaataatcatttttgtgtgagaatattcgttaccaatttcaaagttaatggatcattataggtctcatatatttaggaatatgtactcgtcatttgaaaatatcatcgtcttgattcttcttaatcaaatggaaacagaatgatgaggaaaaagcagctaataccaattatgatggattaacaaatctttttaggagtgtcctctttgacatttttgaattaaagctcatgcttcagaaaatatccatgtccctaccttaatcacaacttcacatcaaaaatctgactatacgctcttgcttttacattttcacaataatattcacaaaaaagttgattaatttcatataatactactatcaatgaaagtcaagtatcgaaattcaaattctaaaccgaatcctcatcatgtatcaaaaaaacctttaatggttattcaaaaagttcattgtattatcggaaaatttagttactcgaaacgatctttgatatataattttctttatcaaattatttcatcatgattcatgaatcatgcctccaagaaattgcatttaatttaataaaccaaaaagataatgtagtttataggtttctcgatttttgttattttcctaaatgagatttctcaattatttcattactaaagtatattaaaacatgataagatatttgaactaaaaaagtgaagggttcacgaaagctttgcataaatccgtattttcatattagtttgctttatagtagggactgcttctattatcattatcaattaaccatttatcggtttataaatttgatgcctaacttaaattatatttgttggcaaataaaatagaaagtaattggaagggagtgagagcgatatgatttggggcagagaagaaaacctaaagctcacactcacaccttttttgttactatttcacgcgtgctatgctcttcctttgtctccctatttcacaacccaagaaccctttccataataacttatactatcataaaatatgaaaatactaatcaaaatattagtagtatttattcacacacatatacataatcgacctatatatatagacacacacacttaggagactttgtgcactgcttcattctctataaccaagtataagcttggagggggttatttttctaaaagggattgagtttttaagatcatg

SEQ ID NO: 24782 - DNA, 3000 bp, Unknown
  misc_feature (1)..( 3000): 2750-1469P.txt file - cDNA_ID_2185816; gDNA_ID_1974074; Annot_ID_180308
caagacatcagcacataaacatcgagatcataaagttacacatagtggccctcgtgatattgccgcaaaacatggcctcttctctcacatgtcttacctttattcgctttgtcctctactctctcaacgtagatcccttttccgtatatacttatgtttatttttgtaatgtattatacaacaaatacgcacacatgccggccactaatgtacatgcatttatacatgtgtccacttcgttccacggagcggaaaaagaaaagttatgtaggatatttgtctaacaacgactatgcgaacaattacaaatacataatttttccaacgcactatattgagtcaagagtagttataaatcaatgatcccaataatcaaaactgaattcaattcaaaagaggtctaattgatgaacttctataatgatttcaaagcttcactaatattaatgtaggatacggaaaaatatatagtagtaaatattattatatctacatttttttgcagctattttgtaaaataaatcctgtagttagaacttatttacaattgttgccactggcttttaattattgttttttctggcaataaattgattaacaaacgaaaaatattccaaatgtattccaatccatatatcacgcagatttctccaaaatttaaactagatttcggcaactatttaaaacaaaaaatatttgacaaaccaaaatacaattgcaatctcttaaaatgagcaaaacacacctaaatacatttcttatcaattcactaaatcttatttctccaaaatttgaactagattttgacaactatttaaaacaaaaatttgtttaacaaactaaaatacaattgcaatcctgtaaaatatttattttaattatttatttaaattagcggtgtacgtcttttttttttataggacaggtttggcgagacgggtttggaagaacgttacttaataagaattataaaatataaaataaaaatattttatagatagatataattttcaaacttttatatatactaattttaaaaaaaaaaatcttcatggtgtactacgggttaaaatctaatagttgtagaaaactcttaagcctaaggaagttaattacctaaatggtaggagttataataaaaataacttcttaccaaaaaaacaacgttagataacttgtaagatcacttttagaggctataaattcctcctcaccttttcttttgtataaaagtagaaaaaaggaaccaaagtaaacaaataaaaatgctatcgactattgtaaattcttttttagtgtttccatatttttttcattttttatttactgtttttttcttactgcaccatgacaagtgaagtagatttcgcgttagtgcacttgaaatttaggacaacaaaaatgcaactagacaaactttttctgtatgaatatctagacgaacttacatttatatggataatcttgttttgtttgtttgtcacagttaaactaaaatataatataatttttctgatccatggctacaataaattttaaaaatgtggataatatgtcttcacaaatatttttctaaataaaatactctttcttttttttggctaaaaagttgtcacatgccatagggacgaaaatgtgtgttttacattgtttggtacaccaatgtttcagtctctcagatctaaactaatggaaattacgttgatttaagccatcatgatatcatgaagggattttttctcgtcatatttgtccagttttacgaaaacaagttaaggtatcaaacttatgcgatacgaaaactctttgaaataactcaattatatttacattcctttaatatgttttgtttattcaaaatcatgattaattaattcagtattttgaattcctatttttgttacatgatgcaattggtaataatacaatgaaaaaaaaaacagtcccttgtgtagcgctatacaccaagtttgtgtgtttgtcgtcaatgcacccatcgcttccttataacctaatataggttttgattggtaaccactttacaaaacggtactaagcgttacaaagttttactcttagtttattgtacagcttaatacctgtagtagagttaacaacttttggttaccaatcagacccataaacatatattaagatagacaaaaaaacatatatacatatatagtacgacttcataaaagatggtataattttcacataatttgatattaattagatatcacttactcaagtactcaactatgcagaagcactcttcattcttcaattgtttttatgaaaatattaaagaaaaaaagctagaaaaatgataccagagaaacaaaatgaatcatgggtttagaaattcattctaatttctaccttttggcaaagaccatgaactctaaactactttttggtatgataactggaccaaatttgggccgttcatagagtttattggtgcagatggacctcggagattaggactcccctgtaaactcaatctagcaatgccgagactccgtatttatagattcgtgaaccatgaatgtcgatcattaacataaagctacaaagtatgaagctctagaagatatgtaaacgtcgtaacattattaagcccaattcaagcccaagaccaagcccaagaccaagcccaacaaatagtcaaaagagtaaaataataagcggaagaagttaggcggggcttaggcagaattcgaaactctctccaacttctttcgcccaccgctcttttaacataattccaatatttctttcttatattaatctttttaatacaacaaaaagacacttttacccttcctcttcttcccgctgtttcctctcttctctctccatctttttctccatcttccctcttctccttcttcatcttcccccacaaaaacctaaatcacgattctccaaaatcgcttcaaaaaatcactctaaatcccatcttctctaccaccggagatacaccgccgttacatg

SEQ ID NO: 24783 - DNA, 3003 bp, Unknown
  misc_feature (1)..( 3003): 2750-1469P.txt file - cDNA_ID_2185824; gDNA_ID_1974074; Annot_ID_180310
aacagtaaataaaaaatgaaaaaaatatggaaacactaaaaaagaatttacaatagtcgatagcatttttatttgtttactttggttccttttttctacttttatacaaaagaaaaggtgaggaggaatttatagcctctaaaagtgatcttacaagttatctaacgttgtttttttggtaagaagttatttttattataactcctaccatttaggtaattaacttccttaggcttaagagttttctacaactattagattttaacccgtagtacaccatgaagatttttttttttaaaattagtatatataaaagtttgaaaattatatctatctataaaatatttttattttatattttataattcttattaagtaacgttcttccaaacccgtctcgccaaacctgtcctataaaaaaaaaagacgtacaccgctaatttaaataaataattaaaataaatattttacaggattgcaattgtattttagtttgttaaacaaatttttgttttaaatagttgtcaaaatctagttcaaattttggagaaataagatttagtgaattgataagaaatgtatttaggtgtgttttgctcattttaagagattgcaattgtattttggtttgtcaaatattttttgttttaaatagttgccgaaatctagtttaaattttggagaaatctgcgtgatatatggattggaatacatttggaatatttttcgtttgttaatcaatttattgccagaaaaaacaataattaaaagccagtggcaacaattgtaaataagttctaactacaggatttattttacaaaatagctgcaaaaaaatgtagatataataatatttactactatatatttttccgtatcctacattaatattagtgaagctttgaaatcattatagaagttcatcaattagacctcttttgaattgaattcagttttgattattgggatcattgatttataactactcttgactcaatatagtgcgttggaaaaattatgtatttgtaattgttcgcatagtcgttgttagacaaatatcctacataacttttctttttccgctccgtggaacgaagtggacacatgtataaatgcatgtacattagtggccggcatgtgtgcgtatttgttgtataatacattacaaaaataaacataagtatatacggaaaagggatctacgttgagagagtagaggacaaagcgaataaaggtaagacatgtgagagaagaggccatgttttgcggcaatatcacgagggccactatgtgtaactttatgatctcgatgtttatgtgctgatgtcttggcttctcctacttgaactttagcttctaccgcaccttctactccgagtatcttatacttttttctttatcaccaaagactttttaggcattaccaaaaaaaaaaaacattaggtatattttggaccatttaaaaaaacatttcaagttttatatatcgaactattaacaacacaggagaacctatattttcaaccattacatttttattatgataaagattttgaacttttaatttccatgtcacatttcccttttgaatattatggatcagtcatacatatataagtatgcaattactactagtctaatttggtctaattagataataagtattgagcatatcatatttatatagtgaaatactggataatattaagatttactcatttcttacaagctagatttatataatttcaattagatggggagtgagaacttatgtacactaatataacatttcagtcatatacagtacatgttcaccatgtctttatatggcataatatactcttgaatatcaagctagctggtaaagtacgtttacccttttgattttaatagaaagtaactttaaagtcgttcgcaaatgatgaataagataaggataatatgtgatgaaaataccgagttgcatgcatgtatttgcaataaactaaagtactgttccgtatatgtttagccagtttcactttagtataattccatgattttttgggtcaattttgatttttagcatacaaatatatttataatgctataaaacttgaaatgtttagtggagagcttgagtaatcgtctatatagtttgtagatactggtgcagtttttctgtatttattgaagtcaattagttgatatattcttatagataaattctgtgaaaatttgataaaacattgctggtacattgaagacattatccacaaagactaattattaggtaatcaaggagagtgatctcccacaattgtttttcattgtccaaaaaaaaaaaaaaaaattctattattacttttctaaatctaaagttgtgagataattttggatttatttttttctaaggtaagtttggaaaacaaatcttactgatatgctaattcaatttagacttctttagggtatttggagtactttaggggatactgtctttgcattagtcctaagaacatggagaaacaagaagacaaacataaaggtggccaactccactacataactaatatgcatacgtttttaaaataatcaaagaatcatataaatgtttgcagttgatatcacctactccaataataatcaattaatttttatatattacgacgagtgtatacgccattatacaccaaaatctaaatctggatctgtgtcaacattttgtatggttggatgcaagtaaaaaaccatcaaatactatatgcttatgactattaaataaatattgcatcaaagtgtacgttaaaaataaaccaaactctatatatatgtatggattagttataagaagagtttgatcccactcgatcactttttcttctcggatcctttcccaccaaaaacacaagcaaaacaacaaagactctctatctatcttctctttcttctttatcgtttattctatatattaacgacattgtaatctaatttgcactgtcttcaacattctctttttctatg

SEQ ID NO: 24784 - DNA, 3003 bp, Unknown
  misc_feature (1)..( 3003): 2750-1469P.txt file - cDNA_ID_2185846; gDNA_ID_1974074; Annot_ID_180314
aaggtcgtatgtcgagttaggcagttttagggatgatccggcggataagtgacgagttgaatggcttctcgagacgtgcgagtaggttagttactttgggcgggcaagttggcgagacacttcggacggacgagtaaacgagctactcaagatggatgggcaaacgaggtacttcggacgggtgagctgacgagctgcttgagacgggcgaacggatgagctacttgagacggaccggctgacgagacgggtgaactatgagctacttgagacggaccggctggcgagatatttcggacgggtgagctgacgagctgcttgagacgggcgaacggatgagctacttgacggaccggctggcgagatacttcggacgggtgagccgacgagctgcttgagaccggcaaactgataagctacttgagacggaccggctggcgagatacttcggacgggtgagctgacaagctgcttgcgacgggcgaactgatgagctacttgaggcggaccggctggcgagatacttcggacgggtgagctgacgagctgcttgagacgggcgaactgatgagctactctttgtctctaagtgtcctcctggcgagatacttcggacgggtgagctgacgagctgcttgagacgggcgaactgatgagctactctttgtctctaagtgtcctcctcgcgagatacttcggacgggtgagctgacgagctgcttgagacgggcgaactgatgagctactctttgtctctaagtgtcctcctggaatctcctttgacaagacatgctattccgtatttatagccttctgcgtgtagggcattcctccagggttttgacgagcctaccctcttgacttaacattctgcttaggcctttgacttggatttgggccttgggaaaagcaagcccaaatctaacccctaacagctggtatagttgcaattgtggagaagattgaagaagagaccaaaagaatggattcaggtaaaagaaccgttgtggctatggacggttcactctacgagaactacccacagtatcaacagtatatggaagaagcactagtcgagcttcttggcgataatcgaagttacattgtgatcatacatgccaaagacgtatctgggcttggtgctgctcttttggctgctactaactctatttatagtacttgaacgttgaacctctacttcatgagtatgacttttgtccatttgtttgtgtacattatatatatataattaagattgttcagaggagcaagtcgagcaacaaactagaagagatgagtaagtcttggcagaacaatttccaaaatgaacaatcttgatgacaagataaataattttggataaaagtctttccctatttgctaaatgaaacactctaaatgactttagaagttttgatttaagactaatcaatgttataatcatacatatcggtcttggaaaaatatctatagagctagatcataacccgttattgtgcagcacggtagaactttaaattttaaatatttattgaaagttgaattattgtttgtttatagtacattttaatcattctatacataatacattgacatataagataatatcattaaaaatgtattttatttttctaatttaattaaactaatgaaattaattaaattagtattgacttgtttattcttgttgagatgaattaatttactctttcaagtttgatttccaataactttctaatataattacttacaaggggcaatgttacattatattttgtacttcccaaatactagtataaaatatatttattcgacccattatctactttgatatgattcgaaaattgctgatatttgtaagttcataaagcaaagcaattatttaaatttaaagataattttcataaatagcacttaaatgagtttttgttccaaatataccatcactagttttctttctaaaaaatactattaactttttccccaaaaatactacaaaactaaacctactttaaactttcacaatatactaaatccatacccaaaatttcaaattataaacacttgaatattattattagtgtttgtgtgtatccgaaaatcttttatcggatatacacataaacaaactcattttttcgcttccaatcactaaatcctgtgttggtaggatatttctagatttaattctaaccataatcatgaaattgaaataaaatcaagccttttagatagatagatagatatatatatatatatatatatatatatgtgacttttatgaagtttgcaaaaaccaaaaggacaacatttttcaaattagaatacaatttttttaaaacaattgtagaatcaaatcgcatcctaagttcctaactattgttaacaaaaccacttactaaatctttgtgagaaattacagaaattatacctatttaaactttctataattaatgtaatttttacttttaaaggttaagtgattaacccaaacattttaaaagttaagtatttatttattatatgtgtatctataaagtatctataagattttcaggtttttgcaaggaattaatagatctaaagtggaaagagaaactattgtttttttctcaccttttatgcttcttcttctaacaactaaacccaaattgatcattagtccacaacccatagtgttagtttctttatttttcactttatggtgttatacgtttaattaagttatcaaaatctgttattcttgcatatcatctttcttatttaaagagaaaatagaaaattagaaattgctccctcttgttaaaaaaaaaaagaaagaaaaagaaactgtatcttctagtggacaaaaaaaaacttgttcttctcgtaaaacccaacaagagaataatcaaataagtaaagtaagcaagtagcagagcaactagaaagttttataaattttagttgaaagttgactttgagatcttcgttcttacaaaacagaaccaaacttcgacaatg

SEQ ID NO: 24785 - DNA, 594 bp, Unknown; identical to SEQ ID NO: 9805
  misc_feature (1)..( 594): 2750-1469P.txt file - cDNA_ID_2185922; gDNA_ID_1974073; Annot_ID_180281

SEQ ID NO: 24786 - DNA, 3003 bp, Unknown
  misc_feature (1)..( 3003): 2750-1469P.txt file - cDNA_ID_2185932; gDNA_ID_1974073; Annot_ID_180286
aatcgatagtttggtttattatacagatgtcattaggaaactctgaagaagatttcaacttaccctgtggccaaacagtaacagacacaggattgaccgctccaaatctggagcttccattagggcggggagaatcgtcatcaatttcatatccatgtctggagggtgaagctttctctgttgattccatgataactaagcaacaagctaaagaaattcccatcgcatagggacgaagattctgaggcatcatggtaactgaaacatcttactattctgttttgttttgttgcagcataacaagagaagcaatctttattgatctatcaaataacctgaattacaatgaagagaactgcagagtttcaggctctgaaacacaccaattcaatgattggataatcaatctctcacagaattagagactctctatatatatactttaaagactctcaacatttagtcataatgttgactctttgactttgttcttccttcttttataggtcatcagggtcagcaaagcctttttaagtctccaactctagagcatggtactctgttcttacatctttgtatctacttctctaaggcttccgcatttcctgaaataataaatacatgttttgaatttgtgagcttagggtttgcagacttaaattagtcctgaattttctaaaacacacatacattgcaaatggattttttaagcaattaataaatcagaatttggatcaacaaaaatttaaaacttgtgccgtgagagttgaccttctaaccaagggcaaggattggtatccattcttggaggtaaacgttgccttcaatggcacacagtattggggatcaatttataaaattgaagaacggcagttgtgtaagaggaatgcttatctgttttcttgttccttcaaattccagcatgcaaatcttccatctaaatcggctttcaacgaagtggagtttaagttttcttactccaggaggattaaagaatgcggtgtacgactcttgaatgtgtcttcataccaagatgatagtgatggaagctctgaaaaagagtacaaccagtctggagaaaaaggtgactttgtagtagagacatcagtaacatctgaagaatataacaacttaccctgtggcctaattgtagcagactcaggattgaccgctctaaatccggaggtttcgttagggcaggtagaagcatcatcactttcttcttatccatctatggagggggaagctttgtgtgtttattccatcataactgagcaacaagacgcagatattccgatcttgaacagactcattagctgtcatcatggtacctgaaacatcttcttattctgttttgttctgttttaggatcaacttgggattgactatgactatagtgataatgacacgagccattttttactgtagatgatggagagctctcggagaaccaaaatccgtttaattctccaacttcggagtctgaaagtgtttgtaatttcttttttatctgaatgcagaaatactctgtgtttgctttgaaaattttgcatttttcctgaaagaataaatgtttcaaaaagccacactttagtatattctggaaaaacatcttggcttggttttgtattgtaccatacttagaaaccaaatgctccttaaagagcagcaaatgcaatcgcagcctacagtcgttgctgacgcactaagccaaactttaaactaataatacaatttttgaaaggaaaaatgataacaatcgccatttattctgaattctttatgcaatctaccacaatcattcattccttacacatcataccacatttcgatctgaaatgtcagtattgccctcaccatttcttctctactttatctctccttcctcgaaatccgtgcgctttaaccatacatcattattttcccgaagacaaaacgaaacgcttttgtctctctctcacttcccctgacaacctgcacagattctctacatgtaactttcaattaaatttgtcccccaattttattcatcataaattctctgttgtatctagatcttgtccccgatttcatcatctttcaaaattatcatgaatccaacatcttatccaccaattgttatcatttaaggatttcatattttatttagatttttcaccatctattttggtcaatagattagttgagcattattgtcttcaccgatccgaatttattcatttttttcttctattgtaaaataacaaaaatatccagttataacatattatcttgtctaccattcgatctaaatttgtcccagatctaactctatcactcatttgatatgaacttgtccccgatataacatattatttaaataaaattatatgcaattgtaaacgtgtaggtgaagacaataacgttcaactaatctgtggaccaaaatagatggcaaaaaatctaaataaaattcaaaatccttaaatgagaacaattgatgaacaagatgtgagattcataataatagagcaagatgatgaaattgaggacaagacgtagacgtaacagagaatttctattcagggacaagatctggagacaaaaaaaaaagtttgtcaccaattgtcctttatctgacacatcagtctgtcaccatcaagggcaatttcgtccacaaatgtgcatgtgataatgaaatgtgatagattttgtaagagaaagctttttgttgtatgaattgtaagaaaacttcaaaaaagtggtagattttacaagattcccttcttgaaaactaaaagagtagttttttttttaattattatttatttttatttttttaaagagtaatttagaaactagagagttaattagtattttagtgttaattagtattttcactgtattatttgaattaaaatcctcataatcgatatacttattctcctaatccatgtgcatgtatgtattgggaaacaagactttgatattaaacaatcataagtacattcttacgataaaatg

SEQ ID NO: 24787 - DNA, 3003 bp, Unknown
  misc_feature (1)..( 3003): 2750-1469P.txt file - cDNA_ID_2185940; gDNA_ID_1974073; Annot_ID_180288
atcttatggaagttgcacggtcaatgatgtttcacacaagtgttccgaagaggttttggggtgatgcggttctaaccgcgtgctaccttatcaatcggacaccaactaaagtcttgaatgacttatctccctttgaggaactaaacaacaccaaaccgtctattaaccacttacgtgtctttggttgtgtatgttttgttttagtacccggagaacaaaggaacaagttagatgcgaagagcactaagtgcatgttccttggctattcaacgactcaaaaaggatataagtgctttgatccaaccaagaatcgcacattcatatcccgagacgtcaaatttcttgaagatcaagagtatgataacaagaaggattgggaggacttaaaagatctagctcattcaacctcggatcgcgttgcaactctaaggtttctattggatcatttgggtaatgaaacaacaccaacgaccgagaatacgcaagaaacacattcaccaaatcaagaagacttgcatcaagggagtgatagtaatgaggaagagtatttacaacatcaagaagaccttctcaatatacaagaagatcatgaatccgtccaagagactcaacatgactcaagtgactcaagtgatgatgaaaaacaagaacaagtcctagttcttccaactccatcacttagaagaagcacaagaatccgtcgcaaaaaggaattctttaatgctcttgcggtagctcatccattccaagcaacatgttctcttgcccttgtacctaaagatcatcaagccttcctctccaagatttctgaacatcgaattcctcaaacgtatgaggaggcaatggagatacaagaatggcgggatgcggtggccgaggaggtgaatgcaatgaagcgaaatcacacttgggatgaagatgagttaccaacgggaaagaaaacggtgagctctcgatggatattcacaatcaaatacaagagtaatggagatatagagagatacaaagctcgcttagtagctcgggggtttacacaaacctatggatccgactacaaagaaacctttgctccggtggccaagcttcatactgtccgggtagtcctcgccttagccacgaatttatcatggggattatggcaaatggatgtcaagaatgcatttcttcaaggcgaactcgaagatgatgtgtacatgactcccccacccggcctagaagacacaattcaatgtggaaaagtgttgcggcttcgcaaagccatatatggtctcaaacaatctccacgggcgtggtaccacaaactaagtcggacactcaaagatcatagcttcaagaaatccgaatccgatcacactttgttcacactacaaagtccccaaggtattgtggttgttctcatttatgttgatgatcttatcatcacgggggacaacaaagacggtatacaaaccacaaagacctttcttaaatcatgttttgatattaaagatctaggtgaactaaaatattttctcgggatagaagtgtgccgctcgaatgcgggtctttttttatcacaaagaaaatatactcttgacttgttgaatgagacaggttttatgaattctaaaccggcgagcactccacttgaagatggctacaaggtcaatcgaaagggggagaaagaagatgagaaatttggcgatgcacctctttaccgcaagcttgtaggtaagttgatttacttaacaaatacaagacctgatatttgttttgctgtgaatcaggttagccaacatatgcaaatcccgatggtgtaccattggaacatggtggaaataattctaaggtatctcaaaggcagctccggacaaggcatatggatgggaaagaactcaagtaccgagatagtaggatattgtgatgcggactatgcgggtgatagaggagatagaagatccacaaccggttattgcactttcatcggaggcaaccttgcaacttggaagacaaagaaacaaaaagtggtctcatgttcaagtgctgaatcggagtatagggcaatgagaaagcttaccaacgaactcacttggctcaaagcgcttctcaaagatcttggcattgaacaacacacacccattaccatgcattgtgacaacaaggccgcaatatacatagcctcaaactcggtgtttcatgagagaaccaagcatattgaagtcgattgtcataaagtccgagagaagattgtcgaaggggttacgctaccgtgttatacaagaagtgaagatcaattggcggatatcttcaccaaggccgcaagtctcaaagtttgcaacttcatacatggcaaactaggacttgtggatctatctcactcttgatctcaagttcccctaaccatgaacatcacactctttttcccttagtaaagttttctcccatgtggttttctctactacggtttttaatgaggtgatggatcatgtgttccaagcttagacttgcgtgagtcttacgcttgagggggagtattgagcaagacctaataaaaagcatccatccgtacaaataaagaaaagaggccgagtgttgtgtgtaagctacaaggtgttgggccgaacacattgagaagcctatagggagcttctagaatgagtgaaggcacacaaatatctcttgtagccgttgaagagaactcacgagtggtcttagcttcatggtcaaccaaggacctgtcactctcaccattaagaccaaggaatctcttctctcatgtctctttcattcgcatgttatgtgtaaacggctatgttccctttgtgtgtccttaaaatacaatgtaaacacacaaaggtaactaaccaattctagtaatatgttttggtcattctcactcataacaatgctctcttgttcctcatgattctcttacccttactcttactctttccaaactacaattccgcatattctttcaagaagtccctcatacgtattacaccgggtggatatatagagatg

SEQ ID NO: 24788 - DNA, 3003 bp, Unknown
  misc_feature (1)..( 3003): 2750-1469P.txt file - cDNA_ID_2185956; gDNA_ID_1974073; Annot_ID_180297
ttggcgcttacgtagggaatcctttagcttctgtaattgcttcaaattggaaagagatgcgcgagaactcatcctacgatcatgcttcaagcatgtggccttaccaggtggagaaatccctaagtatttcacgtatcgagcttatggagattccctaactgtcactttacctcagagctctctttctcaatacttctttccatttaaggcttgcgtcgtggttgaacctccctccgagggcaagggtttttatccatccttgaaggtaaatgttggcttcaatggcaaacagtatcagaaatcattttttgaagatgcagacctgcagttttgtaagacggatcatctgtttttctgttccttcaagatctggtctgaatggactttcaacgatgtggagtttaagttttgttgctccaataggatcaaagaatgcggtgtacgactcttgtatgtctatcaagaaacagagtacaaccaacagactacgagaagcgagaagcggatgggggtatcttttgacttttgattagagctgaaaattataaagctatcttttgacttttggtttgatttttcaggatcgaaacaccatagggacagactatttaatagaatcgatcgtttgatttataatgcagatgacatcggggacatctgaagaatatatcaacttaccctatggccaaattgtagcggactcaggattggccgctctaaatatggagctttcgttagggcagggagaagcatcatcatcaacatctctagagggggaagctttgtatgttgattacatgataactgaagaacaagatgaagaaattcgtatcttgtctactgattctggtaactgaagcatcttatcattctgttttactctgttttaggataacttgggatcgactatgactataatgataatgataattaactgcagatgatgaagatctttaggagaaccaaagtccgttacattatccagctctgcgtttgttttgaacatttcacttttcctgaaagaaaaaatgtttcagaaagccatactttagcatattctggaaaaacatctttggcatggttttgttttgtaaaaacatattctatttttaagaaagacattgaatttgggagcgtacctgcttgagtgcaggtactacccaaaatagtcttgcctttttaaaacatagatctcaatgtttatgttagtaaaggttgtttttctctttattagcaatgaataaatcagactttgggtacagaaaacaacaagaatgtgttggaaatattttacatagcaagtcactcgtcatcagcaacatttgcatatccgctgattcaatagccaaaaggcaaaagcgtttttggcctaacttcggccaaagatgtaaccagcataaggagcaaaaggcagatgatggagcactgacaactagaaaacttttatggttccatgtccagaacagcagaagcactctgttcttacttctctctgttttgcttctttgaaaaattcgctttcctgaaaagatgtaaatataacagtcttgtcttttgaaacacacatatctctctacgtgtatgttaccaaaggttatttttctctctttaaatcaatgaataaattcggtaaagaaaaatgtatttcacaagagaattatcaacaacaaaaaagtgttggaactaaatttttaaatagcaacctcatcagcaacaattgcatcactgctaccgtggcgtttcctacactcacagtaaaaaacagtgattacaacataactcagcaccaccactgccccatacatacaaaaccagcttccacccgtcctactcaccggccacaaccaccaaactcaatcacgaccctgaggtcaagtgagctagtcattgtcacatttaggatgtgaaagctaatttctctggtgcttattttagctgaattggtttgtgcaggtttgcttcagatatttgcaccaatgacctaataataataaataataatataatacaccatcagtcgattccactcttttttcgttcttgccgtcttacaacgaccttgtgattcctaggaacataaaggacattgagtaactacgaggcagtgaagacttatgggaagtagccaagctgcaatcgtgaaacctctttgcctgaggtaaaatctcatcttacatcccttataaactctccattcacttgattgctgaatttgtgtgacataatacaaatgctctgttcttctttgccaccagcatatggattcaaatatcacataaaatggttttcattgttagtccagaacatgatataactttaaaatgtaaattactgataaagtgatttgatagatgatcgtgagagatgaattcacatagatttttgtgttgttgtttcaggaattgtacgtgtcaaggtacttgaaggggatggagttgagaaaatggggagaactcaacacaaaacgcagagagtttctagaaatcttcactccactgtccatccacaccacaccacacaactctagaaagctaaaagagttttttttttaacaaactagatagttagtgttttcactatattattatgtgaattaaaatcctcataattgatatacttacaaattctcctagtttctatgcatgtaagtatagggaaacaaagactgaattccccactcaacatgtttacgataagctgtcctttttacaataagcaaagaccttggacaccaaaataaatctaatattgatttaagaggcatcataacttgtagttgagcggttgaatacttgaaatcaggttttaaatgcttcattggccttggttcgaacctcattacaaacatttcgctacatttttatatttatggcctatgggcaaaaaataagaagtttccttgcgcatcccacccttaaggaccggcctcacagtaatcactctaatcaataatcactgtgtattcgatttactgtacttatcttctcctcatcatattccatg

SEQ ID NO: 24789 - DNA, 3003 bp, Unknown
  misc_feature (1)..( 3003): 2750-1469P.txt file - cDNA_ID_2185964; gDNA_ID_1974073; Annot_ID_180299
ggagcgttttgggtaagtaactaagtatgattaggcatgaaccttccacattttcaagcataacgatctgaaactgctgaaattattgctttatttagggggaaaaactgtataataaagcatcaaggctgtctcaagaatggagattctgattgcatcatccttgagcaccttgaacatgacagacctgattcattgaagagagaaatagatgtgtatcagctgcagtggtacggctactgcatgttcaaagctctatcgagtctgcataagcaggtatgcagattttggactgaattatttttagcattcatatttcaatcacgcaactaactagttctattttttctcttcacaatcttgaagggtgttgttcatagggatgttaagccaggaaacatcctcttctctaggaagaccaacaaaggctatctcattgattttaaccttgccatggttagcattttttgtcacccttctcttatcaaaattttcctggcgacggtttttggttagtgtttcttactatagaatttgaagtaaccgaaaaaaactgcttattcaattctaaggtcagtgtctaacagaggcactgaaaaacttgaggaacacaaacgttcatgttaaaatttactgttatgttcccttccccacccactgatattaatctcttttttttcctgcatggttcaattaggatttgcaccagaagtacagaagagcaggtaaacttctcccctcatgcatatgtgctgtacttggctataaaatatggaaactaaagctatctcttgttatgttctgtagataaatcaaaagcagcttcaggtcttcctaccgccagcaagaaacatcatacattggttaaatcactcgatgcggtaaaccgagggaccaacaaaccttctcagaaaactttagcgcctaatagtatcaagaaagcagcgggaaagacaagagctcggaatgacatgaccagatgggagagactcaatagccaaggggcagaagggtctggcttaacttcagctaaagatgtgaccagcacaaggaacaacccttcaggtgaaaagagaagagagcctttgccatgtcatggaagaaaagcgcttttagattttctgcaagagacaatgtctgttccaattccaaaccatgaagtatcatccaaagctcctacgtctatgagaaaacgggtagctgctcttccagggaaagctgagaaggaacttctttatctgaccccaatgccactgtgctctaacggtcggcctgaagcaggtgcagttctggtgtaatcattgacttttgtttttgtttcagagtttaatttaaaccttaagaagagtttttctgactttactaggggacgtaattgagaagaaagacggtccttgctcaggaaccaaaggcttccgagctccagaggtacatcaactgtaactatagctcacttctcttaatacgagttaaatatgaaaatcttgtgccttcagactaaagttgtaggcctgagctactcattagcacatctctgatgggaaagctaattctctggggctgttcttggctgaattggtttgtgcaggtttgcttcagatctttgcaccaaggacctaagatagacgtgtggtctgcgggagttactttgttatacctcataatgggaaggacacctttcactggtgaccctgaacagttaagatctgacttgaatgagtacaccatcactcggttccactcgtttcttctttcttgccttcttacaacgaccttgtatttcccaggaacataaaggacattgcacaactacgaggcagtgaagaattatgggaagtagccaagctgcacaaccgtgaatcctctttccctaaggtaacatctcatcttaccactcttctgtactctccattcatttatgagacacatatacttgctctgttctttttaccgccagcttaaatatcacataaaagggttttcattgttagcgttttgtgttctattgcttctactgcactcccattacagaacatatatatcttaataatgtaaattgatgacaaagtgattaaatagatgatcgtgagagatgaaatcaggtagagttttgtgttgttgtttcaggaattatacgagtcaaggtacttgaaggggatggagttgagaaaatggggcgaacgcaacacaaaaagcagagagtttctagacgcaattccacggccgcttcttgaactcgttgatagatgtttgatagttaacccgaggcgacgaatcagcgcagaggatgctctcaagcacgagttcttctatccagtacatgaaacccttagaaaccaaatgctccttaaacagcagcaaatgcaatcgcagcctacagttgttgctgacgcactaagcgaaactttaaactaattatacaattcttaaaaactaaaagagtaatttagcaaactagagagttaattttcactttagcaaactagagagttaatttaatttagcgaactaattatattttcactttagtatacaattcttagtgttaatttagtattttcacttatattatttgaattaaaatcctcataatcgatatacttattctcctaatccatgtgcatgtatgtattgggaaacaagactttgatattaaacaatcataagtacattcttacgataaaatgtcttgtacaaggacaactgacacccacaaaatatgtgtgtttcaaaatatctgtgtagaggaaacgaatgtaagtttctgtctaattgcctagaacttgaaatattatttctgtcttgtacaaagactaagacttatcataattaagtgacaaccacaaaaattcaatctctaaaaatatctttgtatgtagtgtaaaaaagctttcgaggaaagtaagacgaagtttctcctctctttctcacactatgtcttgctgatttacttctcttaaaaatcttcgtctcttctctgagttcgctctatcatctcccatg

SEQ ID NO: 24790 - DNA, 3000 bp, Unknown; identical to SEQ ID NO: 9844
  misc_feature (1)..( 3000): 2750-1469P.txt file - cDNA_ID_2186077; gDNA_ID_1974087; Annot_ID_180577

SEQ ID NO: 24791 - DNA, 3000 bp, Unknown
  misc_feature (1)..( 3000): 2750-1469P.txt file - cDNA_ID_2186177; gDNA_ID_1974086; Annot_ID_180568
gtatattttttttaaaacaaattttaatcttatatatgttattttgcaatatattataactgtttattttatcataatatattggactttgattctacccatttcatattaatggataagtactaattttttatataaaaaaaatatgtatattcatatcaaatctatatcttagtaataatattttttaaaataagaaaacatttatttacaaaaaaaaattgaaaaacacaaaaagtttggaaaacagacatttgttaaagtataatttttatatatgttttaatctcgttttgaatgactaaaagtaattcatataataaaaataggttttaaaactaaaactcctttacttacaatttttcaaaaaaaaatgtagatctaaatactcaccgtttttcaccaacatcgaaatgatttttttttctccactcaatgagcaacgactaacaaaatcgttcttcaatgatttttaatattacagattaatggagacaaacgtacaagaaatctccatcgatctataattagaacccttcattgtgattatacgtataaagagaaatgtcgtaggtcgtagatcgttgaaagtttccaaaatagaaaaaagaaatatcatatgtcgtagatctaataaagatcagaagatattatttatgtaagagttatcataatttgaaattaataataaatctatactattaacagagaatgaaatatatgaaccatttgagccgttttcgtttttcgtggtccaggaacaaaaaaacaattaagggtataagcgtcatttacccatcgattgttgtcattaatatttcattaaccctatgatacaagaatcggaagataaaggcaagtactacaagaatcttcagaagaaagttctcgaatctgtgaccgaggtcagtgacatcgacgccatcattgagcaagctgaggaggcagagtgatgcagggcatatttcctcttcttaatagttttctattctttttttctagaagtttaacattatctagagtttagtatttttcctttatttagtttccaattccttgaaagattaggtttgatgttttattatatatagttgatagcctaagctttgtaaggacacaacattattaatttaatcaaagagcttttaaactctaaaaacccttattgcggctagaactcgagagttctcaacggagtaagaagacatagattcttgggcattcttagactaaacaagtttctttgtgttatctatcttggtttacattacagagcgtctttacaccattaatcatagctcctccacacctttgtccattaatctgtaagctttctcttcttctaatttcctcttttttattgttctttgattgattaagtttttgtggttctgtttgtataagttcaatatggtagtgtcatcttgatgttcttatggtgtgctgtttctctaatgtttttggtgaaacagagacacaaattccagctcaagtgttataagatacatgccaggtacctatcttcaagactctttcatttagtaacgactatttacctcactcttctattcattctactcctgcttgctcttggccttggctgcttactctgtggttatttaatctctttattgcttcagaacatgtctgttattggattcgatatcgaccctgaatctcttgaaacagcaacactaaatgcagaggaacttgaggttttttttgaaatgaaatgagttttcttttggttgtatagcaaacaccattgctataattggtttgttttgtaggtgcagatagatttcgttcagtgtgacagtacaaagctagagttaaaaggtactatcctcctttcatttttggtacaatcctactcgtaacttttttgtggctctatgaatttttttaggtacaattgttgatactgttgtaatgaaccctccatttggtacacgaaagaaaggagctgattcgatttggtgatgatgatgtctatgtttgagtaggtcagctactgttaggcttatcgatggccaacaaaacatggtaaatgtgactcaaattcttggaagtgtagctttgattctgcacaataggactcataaatttccagtttgttttgctctctatagcttggtttagtgtctaaagacgaagccgttcgaatggctgatgatgctgaacttgatctggtatgtgtttccattgaaatgctcttacttgtggacattagctattcggtatatgcaatggtttttgtacgatatgagtcagaactcgaataagtgaaaatgagctaatagatggaagattgaactagaattaaagtaaatattagaagaaatgctctgataccgtattagcataactgaatttggatgaatgatttatattattctcttcttgaagaagaagagaatgtacattggtgaatagctgctgctgcgtcttcgtctactgggtagtgagatcttgatgcctggttcaaagtacaagaattatcatttgccattgctttagctacatatgcagtacactattcatgatttagatatataggcatatactttggctattgtatacgttacatagataaactgaacgtacaatactgagtttacatgatctatactatttgttgtcatcaagagaaggttacaaataaattgaacttacaagcttcccattgttacacgcttccaccattgaaatgagtttcttcccattgtaaacaagttaggctaatttcaatgctcctctgcactagactaaacaaaaaattatcaaaatgacatccataagcgttggctgataggctcacatattgatcaaaatgtgtagtttatccattattcactgctaaaatctcatgttctgtttagtgcaattggtcaaatctataatattgaaccattggctaacgattgatccaatgtcttgaacagcgtgctacaatcaaagtgaacggtaaatacgcatatgaacaaggcttcagcaatg

SEQ ID NO: 24792 - DNA, 3000 bp, Unknown
  misc_feature (1)..( 3000): 2750-1469P.txt file - cDNA_ID_2186181; gDNA_ID_1974086; Annot_ID_180569
acgagaaaaaattttagcgggaaaattattttttggcgggaaaaaaagtttggcggaaatatttttttggcgcgaaaaaaaatttggcagaaaacttttagtttctaattacatgttcttattagatgagggtaatttggtcattctgttcaagggaagagaaatttttaaaaatgaacaatataaaagggtattgttgcaaaagggtagtaaaaaaagggtagttttgtaaatctccttttttttttgtggttcgagtttttaagaggtaataaagatttaaaacttgtattatctagaggttgacccgcggtataccgcatgttaatatttttgttcgaaaattagagatttttcttttatttaatattatttatatgtaaataacatattcaaggggtacatcataagcctatatttttattaaataaaaaattgaattcttgtttttaagatgatctacaggtacatgctatttttttatgtatgatactatgatacaccttaggacgattttattaactaatttgttttttgaaattttaagttatatatttgtttggttaatatttttttttagtgtttaaaattgtataattgtattttgattgttaattttaggatttcattcatagtataccatcccgtattaatatcaattcaaacccgtcccaccatataacctagttccatgaaattagtcataattttgtcatttttatgaagtttgaatatttataatattagaaacttcaaaaaagttttaattcgatccaaatttcataattgcatattgattgttacatctaagatttcacccgtagtatattgcccgtatttatatttttttaatatttatatgtttaaacttctaataaagtttaaatatttacaaaatttaaaacttcaaaaaaaattaaaattattaatacttaaaagtttttatggtcttaaaaattttaatacttaaattttaataaagtttaaatatatataatattttaaactttttaagtttttagttatttaaaataaagaaccggagtaaaccgaataacacttttaattttggatgtctgatatatcaaggttcctgctcattcatattcaaaaatattttagtcttttttatagtatgactctaaacgaattcctaattttaagcaatgtgaaatattgtacacttatttttttccatagattgagtattatatgtctgttttttaaaatttgaattgcatcatatgcagaaaaattaaatattttattaactatatgtattttataaataaattcaaaataaattagatataagaacaaatatagtaacataaaataatatatttatatctaatgtcgatatagaaattttagaaaattagccttaatcgaatatagttcaaaaaaaagatttaattaaggataaaagtttaggaaagagttaattgaagtatttaatgaaaactaacaatttgtaagtatttagacatataatatttggttgagtttaaatctgtaaggactaatattgacaataataaaaaggtaagagatttttggccaaaaaccctaccaaaaatgtatatatatatatatgtccaaatatatttttttcagaaatttccaaatacgtatccttttaatactataaaaacacgttccgtaaacgtcaaataaattcggaaacaaaaacattctcccccgttgtagcgcagatccaatcctagtaagctaatacaaagtagtatccaattcctgtgaaacatttgcaaacatatatagagcatacaaaattgagaactttgtttaaagcccacaaaaccctatcgaaattgtgttctcatcattctctttggaactttgttcaaacgcaaactaaattgagaaacaagattaagatactatatgtgacaaagattatctccacccacatgattcacaacatataactaaagttaatattattatatttattggataaagcctgcctaaatagaaggatgtaacaaataaatataaatatttattaataatatttgaattctaaatagtaattcatacctttttaatatttaacttagtcatattatcttaaaccaaattaatatctaaattgttgatattttaattctatacagtaacctccacattttttaattttaatttagtatattttttttaaaacaaattttaatcttatatatgttattttgcaatatattataactgtttattttatcataatatattggactttgattctacccatttcatattaatggataagtactaattttttatataaaaaaaatatgtatattcatatcaaatctatatcttagtaataatattttttaaaataagaaaacatttatttacaaaaaaaaattgaaaaacacaaaaagtttggaaaacagacatttgttaaagtataatttttatatatgttttaatctcgttttgaatgactaaaagtaattcatataataaaaataggttttaaaactaaaactcctttacttacaatttttcaaaaaaaaatgtagatctaaatactcaccgtttttcaccaacatcgaaatgatttttttttctccactcaatgagcaacgactaacaaaatcgttcttcaatgatttttaatattacagattaatggagacaaacgtacaagaaatctccatcgatctataattagaacccttcattgtgattatacgtataaagagaaatgtcgtaggtcgtagatcgttgaaagtttccaaaatagaaaaaagaaatatcatatgtcgtagatctaataaagatcagaagatattatttatgtaagagttatcataatttgaaattaataataaatctatactattaacagagaatgaaatatatgaaccatttgagccgttttcgtttttcgtggtccaggaacaaaaaaacaattaagggtataagcgtcatttacccatcgattgttgtcattaatatttcattaaccctatg

SEQ ID NO: 24793 - DNA, 3000 bp, Unknown
  misc_feature (1)..( 3000): 2750-1469P.txt file - cDNA_ID_2186192; gDNA_ID_1974085; Annot_ID_180515
agttgcctgtgcgtatatttctagctagttttctacaaatatagatgaaaaataattaatactaacagcgatgtgccgatgtgtactataatgttcaatgtatctttacgatatatgagttatttattgacatggcaggtttcgaaatgtagaaaacgtccacgctgacttttgcagaagtgatccatttgtttcgtactcgtacatatacgataacaaatactatcctatcatgcactaaaaaggtttagttctttggttcctaatgccaattaagtattaattttaagactctattatatactatagtctatggatgatgacttattgcagccgtaattgtatattctggttataagttcgtaaactttagattatacacaattaatccatattccataatgttattgaattttggtttagcataaaccgtgcctcaacaagtaggatgagattatatgcgcatggttatcggaattgaaaaaacaagcaaatcgtattggtaacactattttagaaaatttagttctccattttacttgatatttttcatcagacagattctacgaatctaaccaaaactcccccaaaaagataaacctcaaaatgtacacgtattagaaaatacacgtaaaagtgacatcaccatgtatatatgaaactagtggaagtgtatttgttaggtgagcatataatcgtatcgagaaaacaatagtacataattgtctaaaatcatttattattaattcgcttatcatggacatttgctgttgtttatcttttgtaagcatttaactatcagtataatatgtcatctatgtttgcttcttaacattatattaggatcatgcgacacatttggccatgttcgacggagcaaaagcgtgacctgatctctttgaaaaactaacaaaatcacgatctttaggacacatcacccattgaaagactatcgtagagacgtgtgtgataactaaaagaaagttgtgttaattaagaaactatttttggttgaatttttgtttggagtattaagttaaactaattaatggacataggacgaatatttagacatgtgagaaaacctaataagaattttcaattagaggataagatttgatttcataatatatcattgaatatggactaattggtcagcaccactccttgacagacctaccgtgtccttcaattttttttccaacaaatccatagtagttttgttttattttacgttcctcaacaataatacttgcctagttattaattcttgttttaaaagcgattaaactgtttcttctcacatttatatcaactaatttatttttattttatttttgagaaaaatcaacttaatttcagtctataaattagtaattagttttagttttagtttttttttctaatattctaacttgttgtttctgaaatgagttttttttttcatatcatgattttaatataaaccaaaaggatagcgatcaagaaacgaaacataatgtacccaatggaagagacagccaacatcagaaagtcttcgcatctcattttaaatgattaactcattcatttgaattattatatttaaattgtcatcatatgatatggatctctctggataataattgtcttaacaatcactttaatatttcgagtgcattttttagaaattttttcttttaagttttattaatataaaaactatattataagccttttttctaaggtcaatattttggttagggctttcgattaattatacgtatggactttaacttaacaaagtctaaatttgtgtttaatctataactacgatagttttgtttgcttgaattacgatagttgtttgttttgtttgtaggtttttttaactctgaggcttgttttgtttgttttgtagatggttaattatgaatctcatttcttttaaaggtttctcaacacttgaaatgattgccatattgaatcaaaatcttgatattcttcaaaattggaagtgacgctcttactctattagctgagagtaagttacgctccagcaaattcaggatcatcataggaatcttataaaaaaaaaagcttccgccgttccgcccctgaattatgaagatgaagttcagaattcttctcatgagtcttgagtctgaatcttgaccaaaaaaaaaaaagtcttgaatctgcgtacgtaattactacatttttttaaaaaaacgtcttctcctaaatcatgtaattactacttttaagaaaaatgtcgtctgaatcttgttattagtactttattaaaaaatcttctctttttagtctatgttctgaaatgagtaacctcatttttgcatccaatgcgacgtaatactagtgcttctttaatcaaaactataaccccatttctgtaggtactttttttagatagaactatccctagtgaaaggtgcttgatatgaccagccttcttctacttatttaaaaggtacttgatatgaccaatcacttgatataaattaaagaatatgaccaacagaaattaagaaaaaacattgtaccggccctgctctcatctctttccaatcttatatatatgctttgttcctttttccctcaaatggttcacttcaatagtagatactgagatacatcaactttttatttggttgtagaatgttagcataagtcgtactaactacatttacaccgcatgtagtagattatagactttcatttcttcttttattttctcgtcaccttttttttttttggacaaaatcgtcaccaagtatatatactctacagttgtagtccatcatctttttcctttattgggctttaatatggcccatattacatttgattgataatatcggcccaaattagtcactggctttctcttcaagctcgaccaaagaagaagaactgttctgaacgcaggcagagattcttcgaacttgatatttgggaaacttgcaatccgattctgtcaccagtgttttgccttcataaatg

SEQ ID NO: 24794 - DNA, 3000 bp, Unknown
  misc_feature (1)..( 3000): 2750-1469P.txt file - cDNA_ID_2186237; gDNA_ID_1974085; Annot_ID_180529
acttgtccagaagaactagacaaacctttatacaacgaggcataaccaccagctctaacagttccagtcccatctaacttccctctgtaacaagatcctggaggcttagatacactcttagtaggcgtattctgagtcgaattggtctccgaataagctctcccaacaactctaccagttttaggagtcgtattcaacaaagccgcgttcgttgtattagtgatagaatcacacttatctccccaaccaaaccgattcttagaaaacgccgctgcggatcgatacttatcaggcgtccgtaaaggcaatgctggatctgggttctttgctctaggcttagacggagttctatcaatcttacttccacactcgtgtttaggattcttcaatgaatcgttgctggttagagacaaaagcgaagctcggagattttcaggaacattctcgatttcgtcatcgtgattgtctgaatctctacgggaaagcttggtctcctttgacattgtattaccctaatctgaaacaaaacccagttcaaaatttatgaaatcgacacacgagaaatgataagtttagaaacttggaatccatagctaaagctaagaagctcgttgggtttaaaggctgaaatagatctcacctgtgtagtaaattgagcaacaaaatccaaaatttgtcgagcttctaaagagttcgctctctctctttctctctcactccctctctctttctagattcgcatgatttgagcagtgaagcaggacggagaaaggaatgtaaaagaaagaagatgaaatggacggctgagattgcatctttatgttttgtactttgaggcgctgttcgaatttgaatttggaaagggctttctcacgtaataaagtaggcttgtagaggttagtttcgtaaatgagaaacctattttcttttattttttcaaaaatattcaaacggctaagacattgaaaaaagcagtagagactagagagggtccattttaattcgaattatctcgcctcgtgattaaaatatatatttcctagcggcttatgtcaaagttcgagataaaataaaaaaaatagactaattttgcgtaggatttggtttggtttgggtctgttactataagaatgaaataaagagactatacaatatacaccgtaacaagtatatcctttaattttgtcatatgacaattattgttcttctttttctttttggacatggataattatattttgtttcattttggtaaattagggtcctgttcgtttgcctgtgttcgtttgcttgtctgtgttcgtttgcctgtcgctgacgactgaaaccagcgacaacgaccaaaagttgtttgtttgcatagcgatcaaaagtaacgacaatcgccagcgaccagcgaccgcaatttttggtcgctgaaatttttagcgatcagtcgctgatttcagcgattagtcgctggttttagtcgctggatccaacgacatgcaaacgaacaatttagcgatcaaaaaatataaattaaagaataattaaaaataattaaattaaacagaattaaattaaattaaacttaaaataaatgtctttttgcactctgaacggttgtgtcttttaatcgcaactttccgtaaaaaatattgatggttgttttttctcgcttgtgtcttttattgcaaccttcctatattgtaattttctgtcaaaatatttacagttattttttccggttagttatatatatactattgaataactacgaaatttagaatatgcatcatttggagttagatttgttttaaagaaattattatataaataaatttataatatttttctctgcgatatcaagaaaggtttgagttctagtttaattaaaataattcttattaaattaagttaaaataaattaaattcaaataacataaactaattatagtcaaattaaatttgataaaactaaaataaataaatctattaatttatttttctcatggtgtatgatatatatgatttacattttgattttaaaatataaattagtaccaaaaataattaattttaaaaaaaaatatagcgactgtttatagcgacagtcaaacgaacaacacaacgacaattattagcgattgttgatgtaattggtcgctgagtccagcgacagacaatcgaacaatatatgttgtcgctggttgctgtcgctggtcgttggtcgctgtcgctggatccagcgacaggaaaacgaacagggcataggttttgtttgttttatttagtatttctaacgtaaattttaaaaaagcgccaaaatctagaagaagagtaatatgcgagaaaatcacttttactcttatttatttacttgtcttgccaaatttccatcaaaattattaattacttaattatataatttttgactaattatttactttattggacccgggatatgtaactaaatgggcttttattgggctgtattctgtggaccattaataaacataatctttgaagtgcaaaaaaaaaaatgggacccgggacaactaaatcagaatcggggcgggttataaacttttccctataaattaccactccgatgttaatacccgcctctttgatccctcagacgatttcttctttccgttgtatcttccaatcacccgattgagctccgcttcacttcctccggctaaatgtgtacatactctcaattaggaaaccgccaatcccacataacgttgaatgtcgtcgtctcggttagatatcaacgagggttttgttcttggttccttactaaacaacaaaatttgacgaaaattggtacttgggtatgaacgttgttattccctaattgtaccggaaaatttgatggtggtatgtttcccttgtaggttttcgttgagtcgtggatttgttcttgctcctgattcttttcagtagttcctttgctatttgggaagcaaaattgtcacgccactctttgcattcgagggttttattatg

SEQ ID NO: 24795 - DNA, 3003 bp, Unknown
  misc_feature (1)..( 3003): 2750-1469P.txt file - cDNA_ID_2186249; gDNA_ID_1974085; Annot_ID_180533
ctatttttattattataaatgcttcatatattaagaagaaaagttgtaggcttgtagcaaccgattcatagtggaaaatccttttttttttttttatgaaaatcagatcggccgcaaaaacaactttcaccatgcacgaagctagaaactgcattgatgtaccgtgtacgctgtttttaatataaaataattgcagttttattagttaggctacaaatatgaaatcaggagaaatataccaattaatgtacgtcctaattgcttggtatgttacataaccttaagttgtataatatttattaatttattttatactggagttgatagctttaaaagttgagagcaaagtaacttgagaccattttagagttagcaaagtaatggagaaaataagaaaaatcacacgcatgcagcatgatgtataattattggaaacatgtatttccaagaaagtaatcagttctctgtacgcctgaattcgattttcataaagctcacttccttggattgctagagcaaacatttatattgatatctgcgttaacatcataacatgtgggtttttagtaattctcaacagtatgggtatttttgctctctctagagagggtaaatttgtgattccatctgcaaattattcctcctatatatatatagaacgtgatgaatcaaatttcttaagttgcaagccatgactaatcttgatgagtttcttgaagagctaagttctattgaatcacattctcagaaaatcgtgaagatagatgagcatttaaaaaagttggatgaagagacgaaagaagatgaagatgaagatgcggcgaagataattcaagatcggagtaccgcgagagaagcaggttaatttcttctccttcaccttgtaatttaaagttgttcctctctcattctcaaatcttgttgggtcttggaaacgcagaaattgctctacttatggatctccgtcagaactttcttccaccaccatcgatgtcatcctcctctcttcaaccaccgtcatcgtcaactctcgcaccatcgtcatcatcctctcttcaaccacccgcaccgttgatagacttctttcggtcatcagtgtcatactctcatcaaccaccgtcatcttcaactctcgcaacatcatcgtcaccgtctcttcaaccaccgtcgatgtcatcctcctctcttcaaccacccgcatctttgagggaattctttacgtcgtcagtgtcatactctcatcagccatcttcatcttcaactctcgcaacatcttcgttctttccgtcgtcaatgccatactctgttcgacctcccgattcgtctgatcgaccatctttgagggaattctttccgtcgtcaccatcatcctctattcagccacccgaatcatcatcatctaagcgagcacggcttagtaacatctttccgtcacctttatcctcctctccgtcaccgtttgttaacccgtttctccgtccgcaggcccaagaaccaacaataccaaatttcataaacccaataccacagatctctccaggcctacctgctctattcccaaaccctaaccctaatcctaaccctaacccaatcccaaacccaatccgaaacccagacttggtgtggacaaataggcttcaactagtgtttgatgacgcagttgtcagacttgggggattattcagtatgcaactttataatttttttatttattttgtttattctttcaactcctaactattttcctaattttttttttttttttcaggtgcaacacccaaagccataaacgaactaatttctgaagagggtctcactggtgaccagatccgtagccacttacaagtcttgcgggatcgtcaaaaggctattgcagacaaattagccttggagtgaagaaaatattgaagatgagagataggattaaatagaaagagtgatagtatagaacgtttctttttcttttgttgttaatcttgcatattacaaacaattactatatcataatagaatttatgttaatgttggagttattaaaaaaaaaaaagttaaccataataacattcttactgtacgcatgagtgatcatttatcacaatctattagagcaaccccaatgggtgggatgatgacagtccctaaaaaaccaaaaaataataatattttaattttttaacatagtttgacaactaaaaaacctacacatgtacatttaatcttcaggtcccttatataagggtttttggagcccttctctcctgtgtcccttccattttaattattttttttttttttatattgtaagggaccttaagagagaccaccattgctggtgcaggctgtagaaaaatttgtttagcttctccttcttttcttaattttgacagataagtctcagcctctctccccccataagggtatgtcttgacatttagattcgttgaatcaaaagtttttcatgtttgttcatattgtggtctaatcttcttaggcagatatgacctcagggaagaaagattattatgagttgctcaaaactacaatctttaaataaatatttgggtgatgaaacttctagttcttttttttttttggtctaaaatgaaactattacttctagaagagaaatatccaactcttttttttattccaagcaaatgataaccaaaaatgcaataaaggtgttaatttttatcataaatatattctaactatggtcgtaacttgtaatggaacacctaggcattttttatttttttggtgcacacctaattcgaggaaaaaggttgaagtaatcataattacataagtttctaactatggtcgtaatcgaacacatctaaggcgtagtaataattaaggaaaaaggttgaagtagcaaaacgacgaggttacgatttgtaaattccataaatgccctctctcattttcaacctcaaagaatcgtttttggctttcatcagccgcttcgtatttttgttttcttcagtaacggaaaaaatg

SEQ ID NO: 24796 - DNA, 3000 bp, Unknown
  misc_feature (1)..( 3000): 2750-1469P.txt file - cDNA_ID_2186276; gDNA_ID_1974095; Annot_ID_180679
attcctatgttgtatgtgcctaattggtagctactataatgtacgaatttttaatggctaactactataatgttatgtatagtaatatactctaaaactaaaatttaatactgccgaattctagggttcattatcgacagattcaatttcagatctaatcatctcttctctcccctttcctcttttctcttctctttccaaactctcgataatcttcaagggttatcagattggttcgtgattaaggaagatggcactccaatttgttgatccccttgggtcggtaagagtttatctcacttgattctcgttcctagatatgacctcttgaggacggataccggtgttctctgtggttgatgctcgatttatcctgtggagttgcaatcttgctggaaagtgttgtttgattgggtaagttctctgaattttaactgttttttttctaagtgactaaaatattgatcaagctggtgttgattttggcgctggattgaatatgatggttaaggaattcttcagaaggttacatgtaacgttccgacacgacgagaacgcctctgttcatttatcaaagcaacactttctctggtatggaaacgatagaaaggtatgttcaacgcttcaacacttagcatttcggttttttgcttattgtatcaaaagtcgggtactactcatatggtaatctattttcagaaaagtatgcattcaatgtgtccaacgttgtggtcaaagcatcaaagatggcttatgatgtcaattttccgcctcaatcttttagggacggatggcaagtgttttcgttcctttatgtggctgtcttcttcaagcgcaaggtcaatatccaggcgatatgagatattgtttctcctgcaaggttggttaataattgatcaagtatagtcaccattcctttattgaagagcttaaaaacctgcttttttgactttgatgaaatagagtaaataggaaacatgattcacattgggtgtttctgaacccttggcttggcggaggtccggtggcatgttgaaacctgcaaatcaacttaggtaagttaaaacctgcttttttttattatcaaaattctttttttaacttgcaaatgtggaaacagcgtgtttgagtaagcagactagagttggataattagacactgttggcgtgtgttcttttaagatgttatatcattgccttctcaggtagaggatatccacgaaaccaataactaggaggcagcgtttagagaaacaaaagcattaaaagaaatgaaagacaaggaagagttaattaagccaagttctttcttgaagattgttggtgtgttctattaagatgttatgtttttaggatgatgatgtattatgttctgttaagacaagctctgttaagatattttttaattatctttttaattttattttgtaatacagttcttttttaaatatcgtttcacaataactaaatgtagtttcagtactttccaaaaatatatttaaaacaattattaacaaatataaatattattattaatataaatactgcataaatacataaatattgtatgaatacataattacgactgtagccgcaacatagtcttcagttagtcacttaaattaacgactattctatcactacactacatctatttatatttgtgaaatttaatcgtaaattagtcattaattagtcactaaatttgacgactacgttacgactatacttacgactacaaatattagtcgtaaagtagtcgctaattggcgactatttttacgactatacattttagcgactctcgatttacgactacatgatttagtcgctatttagtcgtaaatgaccacttaacgactatttaacgacttttggtgtagtcgccaaaacccagttttcttgtagtgtgtgctaatgatatcatgtaatatttggagacttggagtgattgatgtttgaatccattttgtgtgtggtcatttcaatcatttcgaattatcgatcatccatgcacattcaccaaactctgacaacatggttggcatacaaatgagaagggcaaaaaagtaatttgtatacatatcatgctttccttgaaaccctagccgcctatcattctgctatcatcttcttcctccgacccattaacctatcactacaagaaaacaggtaaaagacaattacgaagagcgacaatcaacatagtcgtattatcaagcgaccatttggcaacggtttgacgactacaatgcgacaacacgaaaattagtagtaacatagtcgttattttacgactaactcaatttgtcggaacatagttgtccattaacgactatttgacgattctattattgaagggagatgttagttgttacgtagttgctaattgacgactatcttaccgactaaataatttagtcgctaatttagcgactaattgacgactacaattcttaatcaacctgtagtcgtataagagtcgcataggcgtcgcaaaaagtagttggaaaacgtgtttcacattggcaagtaggtacacctaattaattagttgtagtcgtaaattattcataaatattcgcctatataataaatattcacgaaactcttctttcaccaacaaatcaaaacaacaacaacatcaaagaaaaaaacgatttattataaaaaaaaaatttagttagtttattgtataatggtgggaaactacaattatggcggtagtggcggtttctatcaagattggatgtacaagagatttgatgaagtgacggggaatttatcagcgaatatgtcgcatgggttgagcaattcatgacattcgctaatagtcagccaatagtatagagtagtcgaggaaaatttcattgtccttgtagtgtatgcaagaatgaaaaacacatcatctcgagtagaagagttagtactcatttgtttagtcaaggatttaagcctgattattatgtttggtataagcatggagaagaaatgaatatg

SEQ ID NO: 24797 - DNA, 3003 bp, Unknown
  misc_feature (1)..( 3003): 2750-1469P.txt file - cDNA_ID_2186372; gDNA_ID_1974096; Annot_ID_180703
aagaaataaagggccacggttaggtatacgtacttaagtcggaaaattcaacatttgttaattgcagagtctctatgaagctttatgttataatatatgtttacttataattgtatggtttctacatactcaagagttgcatgagttcacacttgcttttaaaaagaaatacttctgctaataaaacagtaatctaatacatgagttcatatattaatatatacaccactataaatgagtataggccttgtcattatcattattatttatcattgtcaatgtcattatacttgttaattcttatagtataatattagttatgtcccctggctcgaggtcaaaatgaaagaaaaggcaaaggtcaacggtacgaagcaaggaaccaccgaattcaaaggctctctaatttaacatgctcgtctataaacacgtgaagatgacattgacatgcaagcaatgatattattatacattcaaattaacattaccggaaacagaaataaactagatgtcccaattcgtatacattgatcgttttatgaatagattatataaattaagggcaaaaacatccaatttgaatgtcgttgatgcgttacacatcttactcttaatcaaaatcgtactattttttttttatgatctaactatttatttttataatatcatattttaacagctaatgatttacattaattaagtttgtgtgtgattattccattacgcattgtgcctacggatacgctcttgaaacatcaaaaatctaacattaatttgatgcgacgtaaaaacacaaactaatcaatgtttcgatatttaaacgcttcatttttctcataactaccaataaatagaatgacgaatacatgtaatggttaaatacttaatttaggtctggagcaaatatttttgaaattatattattcgaacagaatcatatctcacaaaaatatactttgatattgcatgttcacctaatataatcttcataaatctgttggttcataaactaatatgtgtataatacacgtaccttatatatgataatatgaaaaaatcatgggatgttgatttattttatacattatggtttttgtgctttacactgataaaaatcataacaacgcgtttcacaaaagcctaacgtgacatcattatctccaatctgaccgttaagatcaattagctgacgtgttataacacatcattgtcctcttgtcatatacttttttttttctattttcacaagccacccaatgatttggaagtgttttcatattctaatcttctgagaaaaaaatcattataaaagtcagcaactaaaacttagcataaatcaagataacaattctcaaattacaaaacaattcataacttatcccataaatcaagattatttttttcctcaaatttctcttcttgatcaaatcatgcaattagaaagaagaagaaacatgacacttttgtttaggttcgaatcaatcaaagtatggtatttttttccactcaaacacctaatgaattggaagtatttcatattcttcccatatttgagaatattactataaagtaccaaaattcaacaaaattagcatagaatagatcaagcaaattaatctcaaaatgtttactaatcttttatcgttttagatcaatcatagacgacaactaagaaacaaaaaaaaaagatactactcattagcttaattagtccaatgatcaagactcaaaatttcaaaacttttttcaattatggtaaacaaaatatatacacaaaaaaaatcagaacaaaatcggagttctgtcttttcattttttttttttacaagttctgtctttttcaaggtaataaaaaagttataaaaaatcgaaataattaattaaggatgatgttttaattatcggttataatcaaaattagttactactagtacaaagattaacgcaccaaaggagaagaaatctgaagaagtgaatgctttcttcaaacgcgctctctctttctctctctctctctctatctccagttcttattctctctctctttctatctctaccaaatttctgagaacctcttcgtcttcttcgttatctcttcccttcttctgtgtcactaactcacttcactgttagtggaagaagctcttaccatattcacacttgtaagcaacgattttagggatctgaaacgctttcactgtttctgttttggattcttcgattgcttttgagctttcgatttgattccatttcaagctgctgaatctggtaatttttccaagaaattaggtttcgattaagctttccctcactatcaattttctccatgaaattggaaaacttgcttcgggtggtgttttgttgtcttgtgttaatcctccaattttgtgtgtgtagatttgagcaattggttgttctacttagggttttcgttttgttgttgtttctggggtttctggaatttttctgtgtagatccgtttgtgaggtgggaattttgagttactgtttggaaatggatcttgtgtagcttaggttgaagatgatcacattgatttttgaaactagctcaaactaatctgaagatgatacttttttattatcatcactcaagatgctattttttttattatctcttgggtgttctatcattttagaatttgctgaaaaaattgggcttctgtgaattctggtgaattttgtatctgtctgtatcttcaatttcacacggaatcatagttgttgtaaaccctaacgctgggttttgttgttgtaatcagatctttcaggttcttcttggtattgtggtcaaaacaccaatgggataataataaaatggtgtttatattgggacttttcttcgtttgttgacctatgttgggtcaaccaagtatgatctctgaagtggtcaaaaggagagttactttgtaatgttgaacaagagcttttaaaagagtgatagtgtgagtgagtgtgcctcttggtttgtgggaagaagatcatg

SEQ ID NO: 24798 - DNA, 3003 bp, Unknown
  misc_feature (1)..( 3003): 2750-1469P.txt file - cDNA_ID_2186387; gDNA_ID_1974096; Annot_ID_180707
agttgagttggtttaatacaccctttgtggtcccttcgtcttgggcctcacttctacactttcttcagcccattttcataacacgtgacctacacatgctataatgtacatgatttaattatttatctcttaattgtgttttctttaaaaaagaagaagatataattctctttattttctcttgatcttatgaaaaaaaatgtatggaaaacttgatagacattcatcatttataatgtaacacttcacactggatattttaacaaatacaactacgctttatcgttctcactatgaaatatatcatcttataagctctttttttttactcttattttggatcttttggacgcttatcagtgtcccttgacaatttttggacaatcacatatactatctttggaaatgtaaatagaaccttagtgaaccacttagtttgatactcagttaatcacataaacttacttttcattctagaacaattgttttcgtaccaaattaaacaacgagttatttctgatcatcctatcccaatacgaaagtattggaagacccttggacagtttcctggtgttccaagcaactttacaaatttttttccagttagtactgaaagtttatctattcttttgatctccaaaagtctatacgaacaatatttatatacatacgcatgttagacttcatatgtcaacgaggaaaaatgttatgtatgtgcgtgatatacaatttaatttgttggtacactatctcaagctcttaagtataattcatctactgtgttcacgtatgttaatgttatataacgaataaaggattataatatgcgtagccaaatcgacataattatattatattgaacggcagagagaaactttggtgaaaagttagatggatttgattattaataacataagacaagtggacaaccacacgcataccgttacaagtcaaacaatcatatttatgttccaccaatttctatacaataatacgaatgcaatctcaaattttaataactaagtcatattgactaaagagttagattcgttactggcgataaagggatgaacagagcaacacttccggtttgggtaaacatggaataagtgaaacagacgaaaaagagtggattgattcatcaataaaaatcatttgtactaattaacaaaattaagagttaaagcaatcaatgtcaccatctcaactacgacaaatcacatgtcaatagctagtattattactaatcaatatgagaacaacaaacacatgtaaatttcagattattttacgcataaccttattaaaaataacatttgtaaagatattacagacccggtagcaaataccaaacacataaaatagaaagaaaaatggaacatgccgtattgggatcggctactctataattatatactccttgatattcagatattaacttcttgatatatacacacacatattaaatgtgcatgtgtatacacgtactaagacgtagatggaacaatacaagtctttacgttactaattttataaagattaatctgcggaaaataagactaataatattcatttaaggactcgagaaccaattggtaaatgtcaagaaagactataacagcaaaatattatacgtaataaataataatcataaaagcagatgtactactttatttcattatttgagtttgattccaacggttacatttttcgataaaataaattttgggccaaaaaaaagtacttctaccttttattgacagtgataagttaatgtttaaaatcacataaaacccatggtaatatttactatgttttactcaatatactgtatgtatatatatttagagataagaagaggacagaaataaaagctttatttgaaagcattgtcttatatgtgaaaccatctgcaaatttcaatgtctctttcattctcacgtccctctcctcctttctcattttctctcatttattttacaaactttaggaaaaaaactatcattaaccattttttttattttaaaataataatttcaaattattacagtataaaaacaaaaatgtacactaaaaatgtctgatcgcctgcaaaaaaaactgtctgaacatctaaaataaaataaaaaacagtaaatctattggtcttttgtttttttcttttcacttattcaaaaaaaatatttcctttaagtttataagtttgttattttcttcctcttcttcctcttcttctccataagccaaaactaaaaccctctttaatggcgagaggacccatctccaagaataaacagtaatcttcatttattgtcattacaaatttttctttaagtccaaaaaaatccccaaattaaaaatcttttcttttttaattacatgggcagatgaagagacaagggtccctataattttctctttagatcttcaaaacccaaacctcaatcatgttggtcactttttcttcttcttttataatctatgtagaaacaaaaatctatggtttttaacttttcatgtttattcagtctctccatcatcacaaagctgagtgcttgattggctccacagacaaacataaagtttgcatctttttttctgactcatttcaaccaaaaagctccggtaagcaaatctctcttatttatgtaagatatactcacttatttatgataaagattacatttttaggctaaaggaagtttcttttttcatgaatgtctgaatgagaagttttttttataatgaaaatctcagtttagggtttaggggaaggaaaaaaaggtaacccaggaagtaaaattgacagttttgtatacaaaagaagcaatttttggacactatttgaagaattctctgtttttgttgttgctatgtttgtaagatttttagtttaatgctaaaagatataaaaaaaaattgtttttcaggtctttgagaatcggttttactagattgaagacgagagttttgaatgattggtgaatttgttgatcatcaatg

SEQ ID NO: 24799 - DNA, 3003 bp, Unknown
  misc_feature (1)..( 3003): 2750-1469P.txt file - cDNA_ID_2186407; gDNA_ID_1974096; Annot_ID_180712
agacaaggatcccaaatccatgaataaagctgcacgcttctcataacaagacaatggatcctaatccatgagtaaaacttcaaacttacgaaaacaagaccatttccttaatcatacgtgaatcttcaaacttttatgttgtgtgtttctatttttctatcagagacggtagaaatttgaaaccttcagtgattcaaatttcaaagttgttttcacttatagagacatcagaacaagttaaaattgaccatcacataacatatctcatttcaacagtgaaataaataagcacgacaaataaaaaaaaattaacaagtggaaacatcagaatcgaaatcgatcaagcaagaagcaaaatggcattgaatcttccattatttcattcatcctccaaatgatgatcctgcaaagcaaacacactaagctaatcagagagggttaatctagactctgtatcttaaatttgacttggacaattcgatagcaaacttctccgaaacccaaaatgaaagagcataaactgaaaagaaaaaaaatgagacgaggacatacctcactcttctgcagatcctccaatattgcaaatgcttttcgtaattctttcttactgcataagccggccagcatacagtggaaagtgatgtaatctggagccacaccacaagaaatcatctcattgagaaggtcttgagcggcatcgagatcacccacttgacaaaacccatgaatcaaagtagtgtaagtaactgtattagcaactattcctcttcgatgcatctcacagaaaatctccattccattgtcaacccttttagccttacaatagccattgattagggtgctaaaagtgactacatccggagagcagcccttgctagccatcgaatctaacatgcgctttgcatcatctacacgatcctgcttgcaaaatccatcgatcattgagttatatgtgattgtggtaggaaatatactccaacgaagcatctccttgtatatttcttcagcctcggagacctttctttctttgacaaatgcattgatcaatgcactgaaagtaacaatatcaggattgatttgcttttcaatcatatgacgcaacaattggtcggcatcactccatctaccagagtgacaaaaagagtctatcatacaattgtaagtgagaacattgggaaaaatacctttctcatgcatttcagtgaaaaggttttgagcattgatgtggttcccgtccttgcaaaggcgatcaacgatggcagtagagattacaacatcggctttgatgtggctttgccccatcttcctaagcagattcaaagccgagacaaccaatcttacacaatccatttacaattgttccgtaagtaaccgcgttaggttgatgaccttcttctaccatccgatcaacaagagctagcgcttcaagaactcgaccctcacgacaaagactgttcatcagtgtgttgaaggtgacaacattgggtctacatccagtttcaaccatataatcaaagaaagctacggcctcagaaatcctacctgattttttgtttgaacattgggtctacatccagtttcaacattgggtctacatccagtttcgcctgattttttgtttttcttctcgatatctctcttttctttttttcacacttctcgatctctctaaccataaaggagtgtacattcaaacagtgtgagctctgagaccgagtgagcgtagtaaaacataatcagaaaactaccggttccattaattggtcggtacattgaccggttaagattaatctagccggaccgggactttaactctggttttgccatctaaataacgtttttttcttttcctataacatctacttaaattttgacattagttaagttggagctattgaagtcaatatcgttcttctttctaaattttagtgatttttttttaagataaattttagtgaaactaaataacctatttttctcctacggaacaaattattgggctctgtaacgagtttcgcttcatactaaaccgtacaagaatctgccaaatatatattcaattcttaatcaaatcttctaaatatagtattgttaaatataaaatatttagtgtataagtgggataataatttgaaccaacctattatattttctatgaataaaatttataaacggatggacatctataagatccgatagtattttgttccacccaacagtattttgttccatccgcttaatgcattaaacgtaaaatatgaaaataaactaaacaaatatgtcgtgagcaattacaagtctcttgtaaaccaacgtttggttcccaagactcaaatcaaacagtgacacacaatggtttcttctcttagtatgatgtgagatctaaccatatcatcgaacaaatcagtggcatcatcttaaattttgagataatgaaacccacttgtcaatttcaaactctctccttctaatgttccttggccctttgatgaaagtatacatgtcttgacggaaagaagatgaatcaatctcgtgctgatcaatcaggtagaagcagtagcagattccgatttcaaaaccctagccaacatttttgttgttgtttcgcctgtttttgtttttttgttctcttatcgatcttactctaactctaagcgagtgatgaccgatgatgaaggaatcccagaaaaccggtaattttaaatttgaatcataaaaccggttcgatctcaacgattccgaaaccggtttgattggtccagtggacttgtcacaacgtcgtaaacaaatactattttccttatccgaaccggttcgtaccaatttcctgatgaaatcaaatcaattacacaataatcaaattttggaagataaggaaaaaagaaaaggagcgtgcaaaaaaaagtcacagtcgcgagataaaatccgaagctagcgaaaagcttcgatttccagcgatcctagtgttggattctacgattttagggtttaaatcttgagatg

SEQ ID NO: 24800 - DNA, 3003 bp, Unknown
  misc_feature (1)..( 3003): 2750-1469P.txt file - cDNA_ID_2186452; gDNA_ID_2096293; Annot_ID_195462
tttattttccgcagacactgtgttcttgacgtttttgtaatccggatttctcttaatctattcagtattcagtatttgcttttgatttggtttaccaagttgttcatcctattatcatcctgctattactttgttgctatcatgttgataagtgtgtattttgcaagtttgagcataccatttgtcatcactttagcaccttatcatcagtgttttataccattctcatcatttgtcatcactttgcatgtttaggataggtttgcatgcatgttgcatatttgtgttgatttcaggtgatttagagctgttgacgagctaactggaagaagcggacctgatcatgtcaaaccactcgaccccgaggtcgagtagaagcttcaagacctcaacagaccactcgaccccctggtcgagtaggggagttcacaatttcatctcatcactcgaccctctggccgagtaccaccacgagagatactcgatcacctcactcgaccacctggtcgagtgtattcacctccaccacctgaccagtcactcgatcacatcattcaacccccaggttgagtgtcttcaccaccaccactcgactacatactctatggcaagctttagagtcttcttcattccgcactcaactagacactcgagcacaaggaagaaaagaagactctagcatatcactcgacctctcactcgaccatctgggttgagtatagttcttaatatgtcccaatactgcatcgttttgagtattagggttttcgaatattttgctataagtagcatgtactttacattttcgagaagaggtttttatctagttttatttcgcagacattgtgttctagaccttttgtaatctggatttctctttatctattcagtattcagtatttgttcttgattttgtttattgttgttcatcctgttattgttttgctattacactgttgttatcatgttttcatcctgttcaacgtttatgttctcttcaatgatgtctgagtagtgaataggtttctgaggatgggttagagtagtgtagaattctcagtatgctaggtggttgagtattgattgatagatcccttctggattagttgttcttaatccctattgctttttgatcaactggaatttgagcccagacatttccgcgcccaaaaggtgttcgatgaaatgtctgaaccactaattccagagattcgtggctcagtaccaaggtattggttgcagggagtgttttggctttaacttgttgattcgtaatgcctataaggttagctctcgtcaatggtgattgagtctgggactaggttaagttgagggtctctattgcggtggcacttagatttggttaatgaacttgttgtctagggataatttattgagcatgtcaatcacctgtaaattgaggaaacgaaactactcaattaccccatcctcgggaattctttatctgattgattttattgtttactctactgttgtttactgcatcttttcatctgttgcttagtttctgcaattctttactgttactcgacctgttacttgaccccccagttgtccggcaacagactgtgcaatcgagtatccctgttacattttctgtctgttactcgaactgtcactcgaccacacccagtgctctgcaacgagctgtgttggtcaagtgttttattgtttctgcttgattttctgttttctgcatgttcacttaggactgctagaacacaccaaaacctgttattacttggcttgacttagtgacttagtgacttagtggcttgctagaacactgctagaacaccaatcatacacatgccatcaagtcatccttattgttagcatcaaactcatttggattgacaacctaaaatattacaacgacatgattggtgttttaagataattgactaaaaaacctattatcaatttgtccctgttgccaattgggtgtttgtttgttacatttgagatttcagacttgcttagatcaagttctttttcaattttcaatttggttgctaactgtgtgtttttcttgttgtcttcttgttctaggtacacctctgctgtatgattggtgttctagcagtgttctagcaagccactaaaatactacaacgacatgattcgtgttttaagataactgactaaaaaatctattatcaatttgacgccgttgccaattgggtgtttttttgttacatttgagatttcagacttgcttagatcaagttctttttcaattttcaattcggttgctaactgtgtatttttcttgttgtcttcttgttctaggtacacctctgctgtatgcaaactcgatcaacaggcaatccgaacctccttttcaacgacaacatcgaccgcatagctcgcgaactcagagaaaagagaaacacagtcaacctaataccacaacaaccactcgaaatggctgacgaacagaatcatcaaaaaggccctgccaacattggtgctggaaacgcaccacgtgatcaccgttagcggaaaggaattgcacctcctgctatctagaacaacaacttcgagattaagagcggtctcatctcgatgattcaggggaacaaattccatggtctgccaattgaggatccactcgaccaccttaatgaattcgataggctctgcaacctaacaaaaatcaatggtgtcagtgaagacggattcaagctccgtttgtttccattctccttgggcgacaaagctcacatttgggagtagaatctgtcccatgactcaatcaccacctgggatgattgcaagaaggcttttctatcaaagttcgtctccaacgccagaactgcaagactcagaaatgagatctctggctttttacagaaggctggtgaaagcttctgtgaagaatgggagcgttttaagggttatacaacccaatgccctcatcatggcttcactaaagcctctctgctcagcactctttatagaggcgttttgccacgcatg

SEQ ID NO: 24801 - DNA, 3000 bp, Unknown; identical to SEQ ID NO: 9934
  misc_feature (1)..( 3000): 2750-1469P.txt file - cDNA_ID_2186563; gDNA_ID_2096294; Annot_ID_195476

SEQ ID NO: 24802 - DNA, 3003 bp, Unknown
  misc_feature (1)..( 3003): 2750-1469P.txt file - cDNA_ID_2186574; gDNA_ID_2096294; Annot_ID_195480
gaagctcgtcaggtactgtttcgttctcagttcttcttttctttagaaaattcatgttgttcttaatcttagttagctcctggcatggaatccattcccaatattgagcctgagctgatttgtgttatatggttttgattggatcgagtaggtttttgatgaagttaaacaatgaaactgtgtctatcgagctgaagaatgggactgtggtccatggaaccatcactggtaagttcttattgttagcttccggtttctttgtagctcttctcatcttttcttctctctcgatttctccgttgctaggtcttatacaagtcgcgatctgttcccttattttcaattggccctaatcgcgtccttgtgatcacatgaataggttgagtaaacacacagttagagccagtagtcataaaggtatatttattgaagtttaagcttgatgatttgggcaggtgttgatgtgagcatgaacactcacttgaagacagtgaagatgagcctgaaggggaaaaacccagtaacacttgatcatcttagcttgaggggtaataatattcgctactacattcttcctgatagcttgaacctcgagactttacttgtggaagacactcctagagttaaacctaagaagcctgttgctggtactgcttcattcatttttggtgtttgtaatattcgtcttcataagctaaaagacttctttatcagtccatttattcgttctctctttctttcttctttagggaaagctgttggacgcggtcgcggacgtggccgtgggcgtggtcgcggcagaggtcgttagatgtagcagcgctctggaacatgttgaaggtttgtgagtttaatttttaggagaatgtacgagttatgtaactagcaactctggcaaaggaaagatttgattgagaaatagtatgattgatgctctagtaaggagttactttgtaatggaattccatggataacaagatttggctttacatgttataagagcatctacaagtagagaatttgtgtgatactgatagctcaagactttttattcatttaacaaatctgactatcaaattgcattaacatgttgacaatcttagtatagaaaaactgctatctcctccgttaatcttccacatgaaacctatctcacatgatcctgcaattgggatcttgattgtaaacgggttccccgatctgattgtagggatcacacgggtagggataggaagatggcacaccatatccatcatgaggccatggttgataacatggctcaggtttttgccatggttgacaacatggctcaggtttcttctcttcaggtttcttctcttcgggtttcttctcttcgggtttcttttcttcttctggctttttgtcaccatccttaggtggttcaactttagctacgctaacaagctccgcaaatgcaacttttttcctgagtgtgttgattagagcaatcatatcgacttcaacaccggtcacctcaatctggttcctgtgatctccctttatttccacagcgttcacgcctataaaccaatgcgataaatctttagattcaacaagaattacaatcatcaagttctctagtgtttgtatcattgttacctttaaactgaaccgcagttttcattgcctttgctcgagttgtgtcatcagtcatagcaattcttatcaggatcttttgctgagtacaataagagaactccttaacatcacaaagagaagtctctctctttcacaagagaatcgaagttattacttgttgttgagtacacaggagacataccttcatgttattgtcttctgagaatccgcgtgatttgtttgatgggagtttgctccgaacttttttgtgtcttcttcgatcacaaattagaggaaatataaataaggatcgattttatatattcatttgttccatgagtcgttgtctcacacaacggaatccgatagtttgaatatcgttgtcaggttcatatcttcggtccttacgtgttttattggttctagttgccgattcgtacgagcttattaccaattttttaattttaaaaagcctaacaaaaatctttatttgattgagtcaaaaaattagatgaaatagttatttgactgggtcaaaataaattgattaaataatggtaaacaacacaaataatatttgtttactacaccgttgcctggtagttttagacatgtatggcaaaagacttaataatttttgagtcgatatgtcaattatgatgattaataagttttgtttgttcatcatccagttgtgcataacaatgaatagaacagatgcgttaaaagtcttggtcttctctagagtacatgtttccctctaacttccttctcaataaaaaaaaagattaacttgactactaatctgtcatccatctgtattaacaaatgttatatgcttgacttgcaatacgtactttcgcaatcatattgcagttttctaacgtaatgaaacaataagcttttagtttatactaatgtgtgttgtctaatgctaatttgactttaatttcttaacacattacacattgatgatgccaattgcagtgatatcagcaacttgcaaccgtttgatccaatgatatatcataggtaattaggtatcatatctcatggagataaacgggtaaataaatataatcttatttgctaaataaaaaataatcaagtttaagttttaacatcttcatatacaatctggtttctgtgatctccctgtattagcaaaaaaaaaacatgatttaaaaaagaatttggaaagaaaagaaaagagcgggaaataaatccaaagatttgaccaagttaaaccaaaacttttttactatctgagaaaaccattcagtttccccaaaataaaataaaaaatcagccttaaatcccgtgtctagggttttctttcgtagctgattgggggctgcaagagtttcgccgaggacgattgagaattttgattttcgaaaaatg

SEQ ID NO: 24803 - DNA, 3003 bp, Unknown
  misc_feature (1)..( 3003): 2750-1469P.txt file - cDNA_ID_2186592; gDNA_ID_2096294; Annot_ID_195485
cagctgaataacgagtttgtgttgttgttgtcatcacaggtgatccatgaaacaggggagctcgtggctagttggacaggactgtctttctcaagagacagaatcaagtggagcgcatcaaagacatcaaaagaagaagaaagtccgtggcgtgctctttatggctaatcttcacaggtcaggtctttttcatggcccaacactgctacagtctttgcttggacctgcagtaaatttccctattgtagtagtacccttttgttaaaattcttatgctcagcagaaccaaatccacgtcactctgctttttctaggatatttatttatgaaagaaacagtttctttttttttgggctgacttggttcaaccaaatcttaaactctcagaagcattttgatttaaaggtacatatatttggtcaactcatgggaggatcataacataggagtgggattacttaatataatacaaatgattagagttatgattggtgggagaggcataaaaaaagagagattaaaattggtgtgaagtccataaaaggcactcatgaagtatagtaatagagatagttaatgttatcttaagagaaaataagtgaggtgtcgtcagctctgctaactgctaagccggttgtttaataataggatattgatgaagaagaaggaatacgatgttttgtaccaaagtttttcggatcgtccgagaatcttatcctactgacatttcagcatcatatgttattttttttgtttgttgtttttatatatcttgttcgatctttttagtgcgtcttatcgtcgccttttcgctttcattatcatttgattagatgactactattcacttatttgccaggcagatttgttaatattttaaccaattagggtctttgatcattcgtctttgattggatacatacgagtctggataaagagcaattcattttgatgttttcttaattgagaacgaaacacaatattaactcaccattaactaatactatattatatgagtttaaaaattaacacttgctcaatttcaaaaacaatagttttctgattaacaatgcatcatttcaattcgacttctcatcttgtaattataaactttgaactgaagttatgatcaattatttagtggtactaaatcgtatattcaataggaacttaaattgtaaacatgtgaaaacagtcagacacttaaaaaaatggaggtggggtttcatccaagacttaaccatcattctttcatatttggtctatcatgttttgcttttttatattactcaatttaataaatcgatatcgagtacccaagaaatcgaaataaagaaatgggtttaagtaaaccggtgaacaatattaatatgaggaaagaaaaaggacaaaagagagatctatcatattgatttcattatttttcagcgactttatgattattatttttatgaagaatattggggcaaaggctagtagtacgtagacgtagtgtgaaatatctttctggtctgaaagagttatacagacgtatctaacttggcagatattttttggttttcattcagttctctctcccctcaatgataaatatcattaatttattttatttgttctaccaaaagaagatatttttgttatatacgcccaccgaaaaatgaagaagaagaagatatttttggcttttgtaaggtcaaagcaaacagatttatcaattattattattattatctgagactgagagagagagagagagggagattttctgaattctgattcgtcgaaaagcatcaaaaaagtgaacgcttgagaatccattatggcacaaactagccacttggtaacttccacgtcgcgagtagattatcttcaatactcgcatgcgcgtgagtaaaaaacatacaacctttttttcttttctttctaatagtaatatctttaagaaatatccataaaaattttattgctttcactataaatacgagagggacccacaataccctacacgaacttttttgcactttttcgtctttttaattaataaaaaaaagaaagagaaggaaggaaattaggcacttttgataaatcagattatgtcagaagcgcctacatgtccctttgcggacacacccacccattgtctatccattcatttttttttttcatttcttcctccagagagagagagagaagccacaacaagaagaagaagaagaagaagaagaagaagaagttctggaatagtcatcatcttctctgtttctaggctttgtttatttgtctctaaagtttctggattcaacttctgaagaagatagtagtagtccacaagaaggatcttctttacgtgagttgtttgtttctcttctccctctgtcttttcttttctgattttaataatcccaagtgtgttcttattttcttgctatctgttgtataattggtgttagtgattgattattcattgtatatcgatgaagggttggttttgatttttgttgaattggatcttttgatttggggttttaaaacttgttcggatgatgatgattgggattgatccaaaagttttcgttatttattggaaattcagattttttcgattcagttccatttgaactagtaagtcaaacaaaatctctagatttactgatctggggtttatactttgaagcttgagttgttgttgttttattaatttatttcgattttcagtaatatccatttgtaggttttggtctctgactcttgtttataataaaagctctgtattgagtaaaatctcatgaaagtaggtttcctttcccttttttatccttctcctttggttattaatctcctacaacctttttttagaaattactacctatattcagaaagattccatctatttcttcttcaaggcttgcttttttgaaccaaaagtctctctctttttcatctaataatttgtttacttttttggacagcagaaagttgatttggtcagagccaaggaagatg

SEQ ID NO: 24804 - DNA, 3000 bp, Unknown; identical to SEQ ID NO: 9941
  misc_feature (1)..( 3000): 2750-1469P.txt file - cDNA_ID_2186596; gDNA_ID_2096294; Annot_ID_195486

SEQ ID NO: 24805 - DNA, 3000 bp, Unknown; identical to SEQ ID NO: 9941
  misc_feature (1)..( 3000): 2750-1469P.txt file - cDNA_ID_2186596; gDNA_ID_2684204; Annot_ID_191328

SEQ ID NO: 24806 - DNA, 3003 bp, Unknown
  misc_feature (1)..( 3003): 2750-1469P.txt file - cDNA_ID_2186609; gDNA_ID_2096294; Annot_ID_195488
catctctctctctttgtgggaaaattttcactccatctgcttatagtttgctttgtcaattatctaattgtaggaaagtggatcaatggatttggacataacatctccaaaacagttgaaccgaaaagcgtttctgaaacagctagctgtagacttgtccactagtgagcgcaggatactgtaccgtgctcaatacgtaaggaacaactttctagccaatacgatagataagagtctgtggatcgatccatgatattgtggaatctgtgtttttttttttgttttgtttgggtcagattctgaggaggagactgagagatatcagaagtggtgagctgaaggctctacggctcttcagtggacttaggaacttcttcaagtgaatgttgaatgaggacatttcaacagctttaagatggatcaaaggtaggcctcgttgtgcttcaaccaaaaatgtagttttttattacaaaaaaattgaacgttggtgtaggcatggttggatctgtctcactcgtataggaatatattggtccagccatatatgtaatttgatcattttctataaactcaaaacctgaacctaaattgattaattaaggaaacgcatgagagagtaagggtagaaacatgttcttcgtatttgatccgaatcgaactgaaataatcgatccaacaaacaaagataatttgaaaattaagaatatatctgactacaactcataacgaaaaccgtaccaaaactcacactccttgttaccgcaaacaagataatctgatggtacacgtcagaacatttgtttctttagcaaagcaagtaaacattccactgtggcaaagtaaaaaacgagaaacctataaagtcttcctaatgaaacgtactgattttatggagtttccattttcgacataatatgacgtggcaatatctaaatggtttaaagatgttttatctccaatgatataacgccacgtaagcccgctgaccaaataacccaaagagtaagcaagcgacgtcgtttatagtttgatgatcttgtcgggtaacgaaactgccccttgagtcaaaacaggcttcttcgtgtccgattctgaacgagctcgctctttctcatccaattctctccaccgtcttctactccgatcaatcttcaaattttcttaacactcatcgaccagatcgagtttccatcgatctaatcaatcaatcatcagatttgatcttctcaagaaggtaaatccctctcactctctgtgtcaaacctaatcacctcgtaggaatcgaaattggaacaattcaatttggtttggtttggaatctctagtcgattcttcttctaaacgattgaattgcgttttgtgctttgatataattcgaaattattgtggcagatgagcttgaagggtacgatcgtattactagggctcttatggagcttccaggctacgttagggattagattcgtgatagaccgtgaagaatgtttctcccacaaggctgaatatgaaggtgatacgcttcatgtctctttcgtcgtcatcaagtctgactctcaatggcattttaacgaggatggtgtagatcttgtggtatgactttttttcttctaattgaacttttctacattctacattgcaaaatcgtcgaaaatcaatagaattggtattcctaaacaatgcttaggatttccattgttaatgttggtagataatttgaagtatgtattgataaagaatttggttactctttaaagctgttatattgtaccatctggttaatttggtggttgttgttgttgttgatatattttggatgcattttgaatagatacatggcccaacaggcgaacaaattcatgacttcagggagcagataagcgcaaagcatgattttgttgtccaaaaaaaaggggtttacagattctgtttcacaaacaagtctccttatcatgaaaccattgacttcgatgtacagcttggtcactttgcatactacgatcaacacgcaaaggacggtaaggattatctgtttagttttgtttcagtttcgtttggtgatgaggtatttagctgaagatggtttttgtgcagagcatttcactcccttgatggagcaaatatcaaagttagaggaggctctttacaacatccaatttgaacaacattggttagaagctcagaccgatcgtcaagctatcggtaacattttttcctctaaaaaccacatttgttgttctcacttcaatattgagtgatggtttgaatatggttgttccttgtgcagtgaacgagaacatgagcaaaagagcagtacacaaagctttgttcgagtcgtttgcactgattggggcaagttttctccaagtttatcttctgcgtcgcttgtttgaacgcaaactcggcatgtctcgtgtctaaaagtatcgagtttattatgactttgaacttattttgccttaaaatgtaccagggaatctttacttaaaacctttttacagacagatcgtagttcattggaagatttgctttctcccatgttcaagaactaatcctctcgtgatgataattcttttttttctctttattaacagacaacttttccacaagctaggttttcatttcaatagagaaaatagtgattccttaaaaccttttttccctaaaacaaagagaataacaatgtgatcaagctttgaataagacgtgtcaaaagtactcaaaatcccttaactggattcgaactcttatagagaaggttataaaagtggacactagactaagttagttgggcccagagtagatagataaagccagctatcattttcttagtcgtcgtacaagttacctgaaaataaaataaaaacacaaactttcctgaaaaagtcgtctccagttttaagcattgataaatccgacaagaagtccgattttgttccatagcttgcttgtgtttttagtggattgagtcactgaaagagaaatcataaggctttgttgatgatg

SEQ ID NO: 24807 - DNA, 3003 bp, Unknown; identical to SEQ ID NO: 24806
  misc_feature (1)..( 3003): 2750-1469P.txt file - cDNA_ID_2186609; gDNA_ID_2684204; Annot_ID_191330

SEQ ID NO: 24808 - DNA, 3003 bp, Unknown; identical to SEQ ID NO: 24806
  misc_feature (1)..( 3003): 2750-1469P.txt file - cDNA_ID_2186609; gDNA_ID_2684204; Annot_ID_137268

SEQ ID NO: 24809 - DNA, 3000 bp, Unknown; identical to SEQ ID NO: 9939
  misc_feature (1)..( 3000): 2750-1469P.txt file - cDNA_ID_2186625; gDNA_ID_2096294; Annot_ID_195492

SEQ ID NO: 24810 - DNA, 3000 bp, Unknown; identical to SEQ ID NO: 9939
  misc_feature (1)..( 3000): 2750-1469P.txt file - cDNA_ID_2186625; gDNA_ID_2684204; Annot_ID_191334

SEQ ID NO: 24811 - DNA, 3000 bp, Unknown; identical to SEQ ID NO: 9939
  misc_feature (1)..( 3000): 2750-1469P.txt file - cDNA_ID_2186625; gDNA_ID_2684204; Annot_ID_137273

SEQ ID NO: 24812 - DNA, 3000 bp, Unknown; identical to SEQ ID NO: 9975
  misc_feature (1)..( 3000): 2750-1469P.txt file - cDNA_ID_2186672; gDNA_ID_2096298; Annot_ID_195588

SEQ ID NO: 24813 - DNA, 3000 bp, Unknown; identical to SEQ ID NO: 9976
  misc_feature (1)..( 3000): 2750-1469P.txt file - cDNA_ID_2186712; gDNA_ID_2096298; Annot_ID_195603

SEQ ID NO: 24814 - DNA, 3003 bp, Unknown
  misc_feature (1)..( 3003): 2750-1469P.txt file - cDNA_ID_2186720; gDNA_ID_2096298; Annot_ID_195606
atacttagttttcattacgattaatactatatttttctctcttagaagactaaccaactgtcttccagttagatgataggcttttattgactttccccttcattcgacattctttgacttgaaggtattttctcttctgcaacacagttttttccacatcaacctgatcccccaaatacatgtaaagatacccaaaatcgttttcttgtagagggaaaaagaagtggagaatccttccattatttaccaaaaatttcattcactacttggcgtttgacagttggcagtaatgtgttcttgaaacctttgatgcagaaaattttatacctaccaaccaaaaaaggtaatttgcacaaatcaattaatttgtttctaaatcaaatactaaataaccaaagaaatgctaaacaacttacatcggatatgtagacctggtaagactaatagttcgtcccaccaatttcacttcattaaagttttgcaacgctgccattgcttcttcgtgagatggaaactcaactctaaattctcgtttcttgtttaaaaccacttggcagttgcaaccttgaaagaactctagactgttacaattccaatattaaatcataagagaaccgtcaaaaaatctaaacaaaagattaatatagagacaaagaaatcaacttacatctctagttcggagattttcctatggacattagagagcatgagaatattactttctaagaattcttcaaactcttcatccgaactggaggcgtatttggcatcccaagtaacaggaaataatccgctgggcattctttgtttctctatccaagcaatatcctacaagtgaatactaattattaagttgttggaaacaagttagtttaagaagcataatatataaatgacgtcattacaagaaatatctacattattaccaagagagaagagctattatatgttcttaggtgatcacccgcgctacgccgcagttttttcagattttttttatattgtttaatttaaatattttttatatatctaattattcactcatgcaataagaaaatatttttagtattaaaatatttttttctaacaacattctcaatatttcatcatatacataattcataaacaacgttcatcttaaaccaatttaaccgagggtagtgttcaattctagaatcctaagaatttgatgatggagctccgtacgtattttgcaccttcggtgatttattatataaatattaatttaagagaataacttacttaaatcattaactaatccacgattattatatactcatactttgagtttggattaccaaaaaaatctttgataataaaaaaactattaaaatagttttattgaaaaatcatgtaatattaaaataaatttagtattagtatattaaatatttaaaataaaataatatataaaataaaataatatataaaattaaataataaatgttcactaatctataattattagtacattacattaattatttaatagacacatgacaaatactaaagtgatgatgtagcaatcatatggttagagttgaccaactttcatatatatgattaataaagctgtattatgcccctgttaagaccaatcaaattgtcatacaacgaaaattcaaaaagtagactctagctatattttgaacttagtgagtagaaaccaaaacgttttcatcatattgtatgatgagctaattaccatcataacttcctaataaatacaattccgtttcatttccatttaatcagatttctaccaactaaattttgtaatcgtttttgtaatcgttttatttcaaacacccttaacaattcccttaatgtttccaattaatttttgccgttacacacccttccttcatatcaaattcaaacaatcatcttcttcccatttctttaaaaaaccttaagatcttcttccaattgaattatttggtctccatttttattataaaacctataaagatgtttccaacctcactcgtctatttgtttattaaagtttaaattaccatccaatagccccagtttctccaataacaaatgacgatcaccactcatatccatcctcgaagcattaaatttcaaaatcaacactcaaaccattgttgttcgtccaatccaaacgttggaagtttgtgatttcaaacgttataatattttgcttagcatcgacagtcttcttatggatgaaaagatatagtaaactaattcctaacacaattcatattcccttccgttccacactttaatttactattttcataatattcatgtatgtagccatgtaggataatgcatttgtaaacaaaaaaaaattatgtactacaacagtgaagttaaaaaaaaaacaattaaagaaataaaatcaatatcatgcaaaaatttctaaaatataccaaaacaaacttgcccaacaggcaggctttttttctagtctacaataaacgagagttgcgatacaataatagttgtcgattaaaagaaacaaagatatcggaatcaaagtcaactaaattaatcagagtaatagaaaaaacttttttttttgttgcaagacatcaatcaaagtattataaaaagactccatcgacgaaagatctatctaatagaaaacaactcaacaacttgttcaagcctaaaacaattataaaaaaaaagttatataaaaaaaaaaacactcaagatttagaatctaagcatatttattaatgaacgtagacgtccaaaaaaatgaactgtactggattacaatgatcagtatttctctgtagttctaacaatcccaatttttttaaaaaaaaaaaagaaaaaaaaatcctcaactatttatttgatatatttttccaaaaatgtggttattatggaaagtgaaattttaaatgtggagggtgacaagcatctttgcttagtatataaaaaaagcctttctcctttcttatcctccaagatttaacaaagagaacgagagatatg

SEQ ID NO: 24815 - DNA, 2277 bp, Unknown
  misc_feature (1)..( 2277): 2750-1469P.txt file - cDNA_ID_2186741; gDNA_ID_2096299; Annot_ID_195615
gaattcttcaaactcttcatccgaactggaggcgtatttggcatcccaagtaacaggaaataatccgctgggcattctttgtttctctatccaagcaatatcctacaagtgaatactaattattaagttgttggaaacaagttagtttaagaagcataatatataaatgacgtcattacaagaaatatctacattattaccaagagagaagagctattatatgttcttaggtgatcacccgcgctacgccgcagttttttcagattttttttatattgtttaatttaaatattttttatatatctaattattcactcatgcaataagaaaatatttttagtattaaaatatttttttctaacaacattctcaatatttcatcatatacataattcataaacaacgttcatcttaaaccaatttaaccgagggtagtgttcaattctagaatcctaagaatttgatgatggagctccgtacgtattttgcaccttcggtgatttattatataaatattaatttaagagaataacttacttaaatcattaactaatccacgattattatatactcatactttgagtttggattaccaaaaaaatctttgataataaaaaaactattaaaatagttttattgaaaaatcatgtaatattaaaataaatttagtattagtatattaaatatttaaaataaaataatatataaaataaaataatatataaaattaaataataaatgttcactaatctataattattagtacattacattaattatttaatagacacatgacaaatactaaagtgatgatgtagcaatcatatggttagagttgaccaactttcatatatatgattaataaagctgtattatgcccctgttaagaccaatcaaattgtcatacaacgaaaattcaaaaagtagactctagctatattttgaacttagtgagtagaaaccaaaacgttttcatcatattgtatgatgagctaattaccatcataacttcctaataaatacaattccgtttcatttccatttaatcagatttctaccaactaaattttgtaatcgtttttgtaatcgttttatttcaaacacccttaacaattcccttaatgtttccaattaatttttgccgttacacacccttccttcatatcaaattcaaacaatcatcttcttcccatttctttaaaaaaccttaagatcttcttccaattgaattatttggtctccatttttattataaaacctataaagatgtttccaacctcactcgtctatttgtttattaaagtttaaattaccatccaatagccccagtttctccaataacaaatgacgatcaccactcatatccatcctcgaagcattaaatttcaaaatcaacactcaaaccattgttgttcgtccaatccaaacgttggaagtttgtgatttcaaacgttataatattttgcttagcatcgacagtcttcttatggatgaaaagatatagtaaactaattcctaacacaattcatattcccttccgttccacactttaatttactattttcataatattcatgtatgtagccatgtaggataatgcatttgtaaacaaaaaaaaattatgtactacaacagtgaagttaaaaaaaaaacaattaaagaaataaaatcaatatcatgcaaaaatttctaaaatataccaaaacaaacttgcccaacaggcaggctttttttctagtctacaataaacgagagttgcgatacaataatagttgtcgattaaaagaaacaaagatatcggaatcaaagtcaactaaattaatcagagtaatagaaaaaacttttttttttgttgcaagacatcaatcaaagtattataaaaagactccatcgacgaaagatctatctaatagaaaacaactcaacaacttgttcaagcctaaaacaattataaaaaaaaagttatataaaaaaaaaaacactcaagatttagaatctaagcatatttattaatgaacgtagacgtccaaaaaaatgaactgtactggattacaatgatcagtatttctctgtagttctaacaatcccaatttttttaaaaaaaaaaaagaaaaaaaaatcctcaactatttatttgatatatttttccaaaaatgtggttattatggaaagtgaaattttaaatgtggagggtgacaagcatctttgcttagtatataaaaaaagcctttctcctttcttatcctccaagatttaacaaagagaacgagagatatg

SEQ ID NO: 24816 - DNA, 3003 bp, Unknown
  misc_feature (1)..( 3003): 2750-1469P.txt file - cDNA_ID_2186749; gDNA_ID_2096299; Annot_ID_195618
ttgcgagaacatgttttgttaagttgtgttttgatcttagggtttagttgagtaatgagctttgtgagattgattagattgagaaaatgtctgaattgattctttgttttagtctcgtgttgtgttggtctttggtctttgatattttgatgttctttgcagccacaatctattgcaatgtgtttgaagagccttgtcgtctaggtctctactctacttgttgtttgcgagaacaactgcttgtggctgcaaagtatcgtgtctgtcattgtgtaagtttagttctagatctttgcagccacaatctatgttctgctctatatgatctgtttgtactttgcagccacaatttatgttttgctagtctttggtctgatatttagatattttctgccatataataactgcttgtttttcttgtgtttggaggtttactcgggacacaaactcacgacttgttaggaatatcactagagtgtttacaaacaagtttgatggtccctactacagctggacatgtgtgcctcaagagagacaagagaaatacttcctcgagtttgctgttaactgttctttcagcccttcttttatatagttgattacacttcttttttttactgacattaccttttctatttgtagaaaacacaccattgggatcctttgatcacagggactgttcagttttacttcaacgagatctgtttaaggcgaatgaaaggcatggttagcactgtaagaactagtcgaaagaaacctaaatggattgggaaaactctatggaaggaaatgactgcgtactgggacactgaagaagctcaggaaagaagtcaaatctattcaaatgcccgtatgtctgaccgtaatggtctaggtcctcacatacacttcttagggtctaagtcatatcatcaaatccgggacgaattggcaagtcttctctctgtttactcctttgcaactttaactcgatgtttcaatgtacttttctatgacttgttttttttttcattacaggaagaccaattgggcaaaactgtcagtattggtgacgttttcatcaaaacacatacaaaacctgatgggacgtatgttgatcgaaaggcagagaagatttcagagttatatcagaagaatttgcagctgaggcagtctgagctcgaggctgaagcttctgctgtttcagatggcacttcgcgggtacgggagctcacagctgaggaatgtacaaccatatttcttcaggtaacgttttatgtttcccaatttagtgtttttgagttgtctttttcagtctctaatctcagcttttatcatactatgcagtccactgagagggattcgagaggcgttccttatggagtaggaagcctcaaagagtctcttgtcaatggcaagcggaagcaagcaggtgactcaacttcttttgtggctttgcaagaacaattacttgaagctcaacgcaagatagaagagcaggtctcttgcattcagaggcgtgaagctgagaattcccaagctgcagatgagcagaagaagaagcttgagcacttgtccttagaggagaagtttttgcgcgaaaatgatcctcggttcctcaatttcctcgaatctcattcagctaaggagacaaccacagatcctatctcaccctctccagctgcctctccctcttcatctgcttcataggtctgaatcttaactccttcctcaagactcaatatcaaggctcaaagtttttatatgtgtacttgtgttgcttgtgcttatgctgaacaaaattctaagttgtagtgaatcgaacatgtttctgtaatttgggttttgtacttttctgaaatgacaataaatttgttttcatgcttcttgtatgtgtttatgcttattgtaaagttttgttttctcaggaaggtttcaatctttataacaatcatatagatgttctaataacaacaatagtcgcaaatttagtcatcaaaaatgtaaccaagcagtcgtttatttataacaattcagtcacaaaaatttccgactaagtgctattttagtcgcaaatcagtcttaaaaatagtgacaacgtagtcgtaaattttaacgactaattaccaacaacgactaaataaccctcaagttaatcgttaatttgtcgtctaatagtcgctaaatttagtgacaacgtagtcgtaaattttaacgactaattgcctacaacgactaaataaccctcaagttattcgttaatttgtcgtctaatagtcgcgaaatttaacgactaaaatgtctctaaaaaagcgattacccaaacttagtcgtaactttgtcgctcttttgcgactaaaatacgattacgttatttagcgactctcgattagcgactaattttaatagtcgtttatttgtcgtaaataggagtttaacgactacagagtaactaatactgtagtcggtaaatgacaattttcttgtagtgactggattatcagccactgtaaatgcgggttactattagtttataagaattatgttttgggtttttatgtgtgtttaaactatatttgagctagttagacttacttaactctttagcattttcgctatccttaaagtgtgtcaataagaaaagaaaacttattaaagcaatatttttacaagttatacctatcaaattttggagtgcatgcaaatgagatttcgaagataggattcgatcggtcagttgcatatgtgatcgtaatataatgatggccattggccaacggacccgacaacgtgacctgtttttacattattgatcctttctctctagttttcgaataaaaaaaagactagtattaatttgatattttccaattgaacattaagaacgtggagccaagtggctgtggttaatacatatatgtatgattatatggtagtggcatcgcttactataagataagctaaacaaagaaaaaacttttatatttcctatccaaagaaagactagagagtggtagagaaatg

SEQ ID NO: 24817 - DNA, 3003 bp, Unknown
  misc_feature (1)..( 3003): 2750-1469P.txt file - cDNA_ID_2186752; gDNA_ID_2096299; Annot_ID_195619
agtgcatgcaaatgagatttcgaagataggattcgatcggtcagttgcatatgtgatcgtaatataatgatggccattggccaacggacccgacaacgtgacctgtttttacattattgatcctttctctctagttttcgaataaaaaaaagactagtattaatttgatattttccaattgaacattaagaacgtggagccaagtggctgtggttaatacatatatgtatgattatatggtagtggcatcgcttactataagataagctaaacaaagaaaaaacttttatatttcctatccaaagaaagactagagagtggtagagaaatggagaataaaactgaggaagaggtatcaatcatcaaagtttcttcccttacttgcatcgatctcgacaactctgatcttcatcaatcagctgttttactcaagcaggtctacgtccatttatttttcttaaaactgattacagtatgaacattataccttccgcgaaaaaacattattaattcggtcattatgtgttatatatatattcttgttccaggcatgtctcgatagtggatttttctatgtcataaatcatggtataagtgaggaactcaaggatgaggctttcgagcacagcaagaagttcttcgctcttcctttggaagagaagatgaaagtcttgagaaacgaaaagtatcgaggctatgcaccattccatgattctctcttagaccctgaaaaccaagtccgaggtctgtcagatcagctttcgcttgcttaggctaaaagttttgttgttcatgtatatctcactcttgttgtaatgtgatggggtttaggggactacaaagagggttttaccattgggttcgaaggtagcaaagatggtccccattgggataaaccattccatagccccaatatttggcctaaccctggttagtttttaccgtctcattgtttgttaatttatgctttgatctttaaataaactctaatgttttttgtagacgttttgcccggatggcgggagaccatggagaaatattatcaagaagcattgtaagtgtcatgtttgtttagaaaatatttaaatagggaaatcaagtgggaaaatttgctaatgacttaaaggataaaaatttagttggaaattaggtggaaagtttgatttaaaacaacttgactctttttctcccaatgaatgtgacatctctctctccacattagttataaacaaaaatattccacatatagaattccctcagagcatccacattggacatacctttgtaggtgtttcaaaagtaaattaagattaaatttaaagacatcttctattttgggggtctgaaatgtctttctaaatactctattacacatttaaagacacaccttcttgtttcttctattatttttaactagatgaattctcacggtacgcgtgggtttgttttaaaaattgttaataaaaatatgttaattgttttaatcgctaatttatgtttatttttttgtttattattgtataactaatagaattagactcataatagtatttacgtttcgacagttgttccaaataccaccacctcagtgataatttaagtgagtgtatatttaatgttatgtatatcgatattgtgaacttgagttgtatctaatgttttcattttttaatttccgtataggttatacatgatgatggttttgtatcctatttatggtacttgtcccttggtaaacatttactgatgttgtttgaaacacatataaaaataaattggttatgatgttgtcccgtggtaaacaatgtctgtttgaatatttatagagcttatagtagtgaaagcttgtaatcccataagctgggagtgtgaatatgttttagtgaaataaattgtgcatctatttaaaagacagttacagctgcttgttccttgattcagttctgtgtagcttctactgtggcatccattctggcagttacaaggtataaaacgttttttctaaataaatatgatgtacagaaagggagactacattgttggatttagaagcattaagccatcattgaaatggggccgacctattagtattgcactctaatagattctaaaacacatatggcccatctggcatgagctattttgtttactctatttgacacttataattagaagctgatgtgtaaaaaataaaagctgaatcatattaatgaaatgtttttattggaagattagaaagctgatgtgtcatctccagaaaagcttaaaatgctgacgtggcaaaatgatggagagagttgagcttctttcatatatatgatttaaagacatcttcatacaatctccattgcacataaaaatgagggtatttaatttgaaataagattataaaaagaaaacaatagacatttttagttagagagagtctagatagagacatttgaatactctctctcttgtatggttcttcccgtgtcaactttttatttgtttttaaattttaaataattaaactaaataaaaagtattattattaaattttaaagatacacttatcattagttaaccaatgcagatgctctcaaagtatcaccaatgaagatggtctaaacgacttcagttacttttggtctaaattttttgttatattgcttttttggtcacaaatatcagaccattaattaaggggatggtaaaaaaaaatatcatagcattgagtaacaatgatatatcactaattttcctttattcgtcattgtatttatagttaaaacttaaatacgaaaaaaagaaaaacgttaggcaaatatttagaattctgaactctagtatcatgtcaaaacttatggatatgcatcttaaaattaattgacaatactatactaggtgccatacatatattttctgtggaactcttaaggaacaaagtttttcaaactgtatacttatgatgagcccttctacatgatcaggagggtttgtaagtctattgcgaaaataatg

SEQ ID NO: 24818 - DNA, 3000 bp, Unknown; identical to SEQ ID NO: 9988
  misc_feature (1)..( 3000): 2750-1469P.txt file - cDNA_ID_2186763; gDNA_ID_2096299; Annot_ID_195622

SEQ ID NO: 24819 - DNA, 3003 bp, Unknown
  misc_feature (1)..( 3003): 2750-1469P.txt file - cDNA_ID_2186767; gDNA_ID_2096299; Annot_ID_195623
atctccaccgcttgaagcaaccatttcatgcagagccactgattcttgagctaggtcaggaatctccatcaaatgtaacttcttcgcaacccgctctagcacaggctgataagcatctacatcactacttttgttgcaaagcgactgaagatcttcatatagctcatcatctgatacatctactcttcctttagctcgccgaaactgactaagaaccagctcaacctacaacaaccaaaaaaacgctatgaatcaactacatgtcgtctttactgatccagacactggcctagccagccttgggtttcaagaatttacctgttctctaacttcatccgatatatcgagttcttcatatggaatctggcttaaagattgttctaacttaacagacacctccatcaatttacttgtcacttgttccctctccatcacctacacacagaacaacaacatctcttgtgtatcagagcacaaattctcaacaacttccatagatcaatcaagtcacatcaaccactaccaaatctaacatctaatcaaataccaaagaagcattgatatcactcaaacactaccatagcaaaacaaagcacgtggctctctcattcaatgaaaacaccaattcgtcaacgagaacaaaaattctcagtgaccacacagatctaatcatagatgctaataaatcgaagaagaaacgcaccagataaatcttgctcccttggctacaaaatttgagataatccttcgctgaacacatagcttccttcaaattcatcaaagtcttcaacgtatcttcgctgatcggttcgttactttctctaatttcctcaaacataggaacaagcagctttaatctcctcgctagattataacaaagcttcttcactgttatacgataatcagaaatcgcagcaatctcgttaactacatcgattaagctctgtgcagcagaagctttctcttcctccattgaattgattcttctctgtttaaaaattcacgatttacggatccgtttttcctccggagaagatggagatctttcccgattgagactccagtggcgagattgagcttaaaggaagaagagaaccatttgcagaaagtgcgaaagagagagatttctgagaaagagagattgtgtgagagagaagacgaggacttttcgaaaacggcgtcgtttagctgacggctttagcttattgcaacttgtacgattctctcggcttaagaactaaaccggaacaaaggtaaattcgaccacgaagccgcgggaccggttacgattgtgtttgttttattttttacattaatatattatattatcatttaaattatttctctataaaattactaattttcttgtgaaattttgaatatttttcaactattatattttcacggattgaatatacgaatttttacggatatagtggtcacttttttgctgtagttggtgacatttttggggtgtcatagaagaacaaaattgttaatgcatttataattttggatttagtgataattgaagaattaaaaaggttttatacctctatctctctaatcatgcaagaaaatattttaaaaagaaaaattaaaaatagttcaactggacaacgaaattatcctaaaatagttatttcttttgatctaatccttcttcttttaaacttttttttacttgtttctactctacatgtttcttgttattaggtaaagtattaggctctttttttaaaaaaaatgcttaatcctctgggtacctcgaaaagggaataatactctagttagataagtgcagcgatcaacatgacaaaatgaatgaatgtttgctttaattggtggctaaaagctaaatacacagaaaagtcaaaattcaatctcaaaatcaacccctctgtctccaatgtccctaatctataccaaaatgtcaatttattttcttgatcatatattccactaattaaaaataaatccttctctaatgaaatttgtcaaggccttggaagcctagttttaaatattaaatggaaactatttcttcaacaatcacactgttatttagtattgttgtatgttgttcactactttcttcatttgttttgtaagaaactataataagcaaaaacacataataaagtctcatgtcaaataatgaatcttatgcacatgcttgattattttacttgcacatatccctatcatcattatcacatttgtcaattaccgttatcatcattactctcattcttcccagaactttttcagcaatttccatacctcacccactaagatcttttaccctttttcttaattatagtttggatagcactcttttacatagcactgaaatttcggttgaacacataaattactagaaactagaaggaaatgttactgaaatttcactgattgtctaaaattgaataatctaaagaaaatggccttttaacctttttcttaggcccaaatgggctcattaccactcatgcttgttcggtgacccgattcttccggtaaaacagagcctaaaccgtattttcaggttaggctggtgttttcttaattctccaacctaaaaatagatggacacgtgtctatagaggctgagatattggtctcaatgaagaaaactaacggctcagacccgtgtatgaacgatattaagggccaaagttgcttctgttttccagaaatttttgaaacccaatttcagggcacgattccacaacctctttcttttcttctagatctacgtaaattcatcaggtacatgttattttttttgtttatttgatgtcaaaattttgatcacaaggaggcaaaaccaatataaatgtaacgctaatgcgtttgattatggtatacgtaacgaattagatttaatggttacattttattgttttagatttagttatgagattggcattaattattggtgtttcctttgaatttgctatgtttcttatgttgatgtaatcagctagagattgaaaaatg

SEQ ID NO: 24820 - DNA, 3000 bp, Unknown; identical to SEQ ID NO: 9986
  misc_feature (1)..( 3000): 2750-1469P.txt file - cDNA_ID_2186836; gDNA_ID_2096299; Annot_ID_195645

SEQ ID NO: 24821 - DNA, 3000 bp, Unknown; identical to SEQ ID NO: 9994
  misc_feature (1)..( 3000): 2750-1469P.txt file - cDNA_ID_2187026; gDNA_ID_2096300; Annot_ID_195674

SEQ ID NO: 24822 - DNA, 3000 bp, Unknown; identical to SEQ ID NO: 9998
  misc_feature (1)..( 3000): 2750-1469P.txt file - cDNA_ID_2187036; gDNA_ID_2096300; Annot_ID_195677

SEQ ID NO: 24823 - DNA, 3003 bp, Unknown
  misc_feature (1)..( 3003): 2750-1469P.txt file - cDNA_ID_2187047; gDNA_ID_2096300; Annot_ID_195680
gaatacaatcgtcacaaattttatttgtaagaaaaacatcataaaaattgaatcaaatatatctattaaccattttcgttacaaatagttaaaacaaaaaaaaaagtttaaaaaaaactctcaataacagactaacatcgtcataatttgtgactaacatatcgacttaattttagtaactcattattacataactacagtctcaaatggtcacaagtgatgactaaaaatttgttgcatattcgtaacaatattactcaaaactaatggtattttgtgactatcataatgctccaattccatcacccactataatatattagtttcaaatagtcccaaactattactaaaaaaaatcatcggatatggttaaaattataaactaaaaacataacctcaaaacactattctttattaaattattgtcataaacatacatatttcttataataatatatatcttagttataaattataattcatctccattcttacaacacaatcacaaatttgacgataactagcagagaatgtaaggatttgacgattactctcatatgataacctctatacagatgatttcaggctctctggaaaggtaagattcaattattatttttctgtaaacgtgattataaaagggtaaagccctgttcttttcattgtcgctgcatcagcgatcggcgaccaagaattataactgagttgagacacgtgtctatggtgagtaacaccggcaacaccattaaaacagtcgcagcgactccttttcaccattccaactgtcgctcatttttccagcgacaacggcgatacccgtggaagtgatcgcatcgactcttttttaattattctccatttatgtggaaattctggtcgcttaaagctatcgcagcgattttaaaccgaacagggcctaagccgtttttctagaaaacggttcaaatagcttgacaaaatgctaattgtgtatcacacctatactcgtgataatttatataaaaataatttcattcatatgttaatataaatgacatgtttacttagtctatatcaaaattatagaacaaatttcgagaaacagaagaagagaagaagccatgaagctaactagtacagtcacaaaaggacgacaccgtttcgaaattgggccagagacaaaactaaactggatcttaaatcagcccaagccgttaactataaatttgttacattagtcacggactcacgtgtcacgtccttcgaaaacaacgtatccgcacgtgacatcgccaccggcctttttttttttttttcacaccgcacgaggaagtttaggtttcttcaaaatcacaaaaccaaacaacaacaaccaaaaaaaaaaaactcaaaccattttctctctaacttctctgtcatttctctctctagtggcaaagtatggcggattggggacctgttgtagtcgctgtgatactgttcgtgcttttgactccgggacttctctttcagattccggcgagaggtcgtgttgttgaatttggtaatatgcagactagtggagcgtcgattctcgtccacaccatcattttcttcggtcttataaccatcttcaccatcgccattcgtctccatatctataccggttaatttcaccgtaccggattcgtaacttcccccggttgtctagttttatggtttgttttggattttgtttcttctctgtgtcttgtcaaaacgttatgaatttgtgaatctgaatatgcattaagttaatttcaaaattcgctatgtttgattctcggtttggtttaaatctggttatggcgttgatttgaatttgatggtaggcactaggcagttagccttagtttggtttattggtattcgagttcaaattggaattgagtactaaaatgctctgttactcatttctgcatcttgagttcttatggatttgcttacgaaatgttcaattttgtttggtctggttcggttcgttctgaaacgaatgtcgagagtcttttgcttgactcgaaacttgccttgtgtcagcgtgtaggggtttgtaagaataaaatgggctttaaaattaagttattaatgggccaacacatgatccaccaagaagaagtgatccggttgcatcttagattctcatgtgatgtgattgaacgttgaaagtgcacagaagtagacctgtttaaagatgtttcacactttcactgcgtactatgtaactagtggagtcagtcccgtcatgcgtatgagtaaagcgcgtcgataccacgggaacacacaaaaacatgtcaccctagtaaaaactgtgttcgttagctcattgtaaattgcagtatatggcataaacaattgtttctacaaattccaagaatgtaagaatcaagacaataaaatgtgactatatcaagaacttaactaaagtttcatccacttaaatgaaaaagttgatttggatagaacaaaagacgtaatattcgatgtgttctctctctctcccatctttacttttattgactttttattttcactttaatgtgtgatgtaaaaataaaaagtaattatttgttcaaccctaggtgaaataaaggacgacccaaaacaagtgacgagagagcagagagagcttcttcttccggacactgaacagtgagagcacccatctccaacctcttcctgtaagtttccccaactactctgtttcttaaatgttctgcgttctttaaaacaaagtatagaagatttaggttgtaagatcgatctcgtttgatttcaaactcactatctgaaactctttgattacaaacccatcttcataatctctgtaaaaatcaaacatgcaattcacttaatggtgcaaaaaccccagaagagggaaaaaggaatcaaatttagtttataaaagcagtggaattgagttgcattgttgaaatattcaaaagcaagatcagatttttgataaagaatttcacttttgattgcaacttataatcaaggaacaagatg

SEQ ID NO: 24824 - DNA, 3003 bp, Unknown
  misc_feature (1)..( 3003): 2750-1469P.txt file - cDNA_ID_2187067; gDNA_ID_2096300; Annot_ID_195686
caatcccgaaagaaaggtaaaaaagaacccacaagaaaagaactgcatgtagtggtgaccaaaattctgaaggaagtagacttcaatacggtgagacttcaaaagtttgagaatttacagattataaagcgtatacaaaacctttgaactcaaagacattttgaattttgtttccaaacaggcaactctatctgatattctacggaagcttggtatgtttctgtaaagcttttctcttattctcaatccataatagttatcgtcttccaaatcttcaggaaacgtttatcattgaaacattcttttcctgcttgtgataatactagggagccattttggaattgatcttatgcatagaaaagcagaggtgaaggatatcattacagatgccattaacgaaatgagtgatgatgatgatgagaaagaggaagacacagaggatgaaggtgagaaagagggaaaggactagttttgtctttcttctctttcctacaataagaaaaagaaaacataaccgaagagacggtttaacttaaccttccatgtgtgaatcataggattgtttgtatgtttggtgtaatgtgtaatctgttaggctcatgtagtatcaggtaatgtggttggatactttctggattagaattaatttgagatgtatttgtaaggacttgcaatctttcttcactttagcagcacacaagtgacatggataaatattgttgtgtttcaaaagaggaaaagaagggtcgtccaagagatcagctccaagtcgatcagagagccaataattcctctcaagacacgcccacgaatgaattcacaagtaatctctcgtgttatgggatctattgcacttatttttgattttaagagtcatgttaacttttgtgtcatgtttattttaccaccctataattagcatgttcgtttcgtcaccactggcggttgcggcagcacaccattgacggttcagcaaaacgtttatcataaacattttatttagctcctcaagaagttaaaacgtttatcatgaacatttcagtccctgatcttcttctccatctccaacccatgtttggaaaccatgtgtgcggttctctcaagcttagttctgcactcttctcacgcatttaaaaagttaaaacttcttgaggagctaaataacacaataaaaccacacaatcgacggttcagcagcacaaacaaatagttgaagcgtatgtgacaacaaatatgcttcatatagtgtgcatggtttggttttattgtgttacttattattatacccttattgaacacccgtattttttttttattaataattttgaattgtaacgcttatatctttaagattcttatttttatcatttatacagttttatattatcactttaaataaatctaaataatttttatgtaagttttgaattgatttgagttggagtcgaacaaaaaatcatttgtattaattaaacaaactttattaagtcaattctgaacatttacaaataagccccagttttatagtttgtcatattacctgatgcaattttggtgatgaactaaatgcacgataataagcttttcaccatgaatttttatttttattttagtactttaattgtgtttttaatttattaatcatgtttaaattttatattttatcagatgattattgtgttacttgatttacaagatatttattagtttagaatgccaaagttttttaaattgttttaataattattaatttatgattcataattaatcttatggtcatcattcaataatttgtcttgaaccacatgttttttttacaccgatcaacattatcttgaaccgtttgtaagtttagcgtcttcctatttgtgtagctgttaagtttccaacttttcttaatatatactaattgtacgactggatactttttggatttgagttcatttttgtagatgtctttgtaaggatttttgagcttgcttcttttttggggtctctctatactagtttacaattccacttaaaagagacacaatgatagaaagtaaacagagaagacagtttatcctgcatggaaagtaaacaatgacaacaaacaaaattggatgaaaccactgatttatattatgagatcatctaaaaataaagaaactattttgacccaaaaaaaagttctactaaaattgtaattcatacttataagtgagatcacctgatgtcattgtttccagctatgcttacccgtgtttcaccttcattgtttctagctttgatttccaagtgaatcacctgatgtcatttacagatcccgagtctttctttatactctaccctgcaagtgcaaatctcacacatataatatattaccaattgaaacttcatactccgacgtccgaatatgtgatcaaattattagaggaatgatcaaaaaatgatttttgaacctaatattaaaatttctcttacatatagaaaacatccaactttgacaaatccatgtaatggacccgtaggccgtaacatcaaatatggttagatatcactcttatcgatcaaccaaccaattaccccataaatatatgtatttattcaatcagccgtccataccggtcttaaagtattgaagtagccagttctttagtggtccttattatgttttcgatcacctccttatctctgtagctacataatcttcccttgttaaatacctaaaccctattctccacttaacctccctaaagaacctatatttcacgttatattcttggctctttcacttttcccataaattctgtgcaaaaactcgagtgggccttaagctttatctaccttatctctccagctatacacttgctactcaagataccgctaaccctaatctctactagacccccttaggacttaaaaccctatatatcaaggtctactctctgttttctcgctttctttattcgagccattccatacgtttttcgatttctttcattgaaaaccattgaaatg

SEQ ID NO: 24825 - DNA, 292 bp, Unknown; identical to SEQ ID NO: 565
  misc_feature (1)..( 292): 2750-1469P.txt file - cDNA_ID_2187093; gDNA_ID_1591980; Annot_ID_151792

SEQ ID NO: 24826 - DNA, 211 bp, Unknown; identical to SEQ ID NO: 540
  misc_feature (1)..( 211): 2750-1469P.txt file - cDNA_ID_2187151; gDNA_ID_1591768; Annot_ID_151485

SEQ ID NO: 24827 - DNA, 3000 bp, Unknown; identical to SEQ ID NO: 3866
  misc_feature (1)..( 3000): 2750-1469P.txt file - cDNA_ID_2187191; gDNA_ID_1620671; Annot_ID_48150

SEQ ID NO: 24828 - DNA, 3003 bp, Unknown; identical to SEQ ID NO: 22612
  misc_feature (1)..( 3003): 2750-1469P.txt file - cDNA_ID_2187191; gDNA_ID_2926200; Annot_ID_141489

SEQ ID NO: 24829 - DNA, 820 bp, Unknown; identical to SEQ ID NO: 7714
  misc_feature (1)..( 820): 2750-1469P.txt file - cDNA_ID_2187203; gDNA_ID_1621158; Annot_ID_57065

SEQ ID NO: 24830 - DNA, 2819 bp, Unknown; identical to SEQ ID NO: 607
  misc_feature (1)..( 2819): 2750-1469P.txt file - cDNA_ID_2187237; gDNA_ID_1592299; Annot_ID_152217
  misc_feature (103)..(103): n is a, c, g, or t
  misc_feature (113)..(113): n is a, c, g, or t
  misc_feature (130)..(130): n is a, c, g, or t
  misc_feature (416)..(416): n is a, c, g, or t
  misc_feature (562)..(562): n is a, c, g, or t

SEQ ID NO: 24831 - DNA, 2677 bp, Unknown
  misc_feature (1)..( 2677): 2750-1469P.txt file - cDNA_ID_2187241; gDNA_ID_1592023; Annot_ID_151861
  misc_feature (25)..(25): n is a, c, g, or t
  misc_feature (682)..(682): n is a, c, g, or t
cgcgagagagagagagaggatgtgncggtttgtattatgtaaatgcttgtcttataatgagagagaccttattgatgataccaatctttgaggtccaagtaacacaacttctttgtgattgatatgtatgagataattaatttgtctattttcatggcatgatgtatcatgtatgtgatttgtctgagatttgcaacattcttctataaagttgagaaataagggtagtttagtctttttaaccaaagatttttatttatttgatcttttccctgttttaaaaagaagaatcgagtaatcgcgtggttttgaagacgaagaaggaataagacatcacgaggaacacgatgggtgaagcggtcaaggtatgtttttatctttgtctcctctgcttctgatctgttaatgccaatcgataattcctagttttgcgatgcaagcatgaatcgccgattgttatctgtgtgatttgattcattttcgacgattttcgaatcatcataactacttctttcgctcaaatctcgcactcagtttaatgcctattcgtattcaatttagttatgcaattgaagatttctcgaattctctgaagttttacagctaaaatcagattaatatctgaacattgcctcccaaggaatctaatcccctcttgatgtgcttttgcttaggatggganagaagaagtgattcaagcttggtatatggatgatagtgaagaggatcagagacttcctcaccacaaggatcctaaagagtttgtatcgttgggcaaacttgcaggtctgtttgtgttttcaattcaatgttgttctctctgcttctctatttgttttcacatgtaatgtttttgtgcagagctgggagtacttagctggagacttgatgctgataactacgaaaccgatgaggatttgaaaaagatccgtgaatctcgtggttactcttacatggtttgtggtctttatttatttactatcccactagacttgaatgctagatgtttacttttgtccaagtcttattttaactctctagggttttgctcaatcttggtttgataatagaaaaatgttcaaattcaggacttttgtgaggtatgcccggaaaagcttccaaactatgaagtgaaagtaaagagctttttcgaagaacatttgcatactgatgaagagatccgttactgcgttgcaggaagtggtaagtacttcttttattggctgccttacttgaaaacttaaaatttcgatatagtagtgtcatgttttattttcttggaaaaaaggttactttgatgtgagagatcgcaatgaagcttggattagggtatgggtaaagaagggagctatgatagtcttacctgctgggatctatcatcgcttcaccgtggactctgacaactatatcaaggttcaatgtcagcttcttctagccatttattatatattttcggcttgcttagaaaattgaaatatcttgttgaacaggcaatgcggcttttcgtgggtgaaccggtatggacaccatacaatcgcccacacgaccatcttcctgcaaggtacaatgtcctgatttctccccttttgttttgttctcttatgcaaacaatgggatataatcaagcaagaaattttgttattttacgagaaagaaattctgatatattgcaggaaagaatatgtcgataacttcatggtcaatgcctctgcttagagagcttcctctctctatatctggctttctgaaaccaggatctataaacaaggcctacaataaagaaagctttcctgtcaagtattggatatttatatatattcctgtgtagaatgatggcttttggtatgcttgagttgttgtaaacttagttacactctctgatatgtctctctttaccatctttgtcgtatcccatatacgaaaagattacattgggattcatattgtcttacgttcgttcctatgtgcaatatgttgagtttttacacaaatctctattcttttttatttgcttttcaaaaaccaacaaattagaagaaactaataagaagtaatacgtccaaccgcgtcaacttctttggtttaatctaaaccatggttcgtttggttgttgttgtgtatcttaacatgctgacggttctaaggatggttcgtttggtggttgttgttatcgaacatgttcacggttctaaggaagaaaagtgtggttttgtgtatttgtggttggacataagattttcgttttcgtttacatttgtggctttcttttgtaatttccttttagagtttggaatctccttaaatccgacctacattaactctatagtctatagaattggagtaatcattttattctcctatcttaatggattacaataaacagtagttgaatggaagaaaaaggggatataaaagtaaacttagcaagtttagcagccatgattaggcttataataatttatgtagacgtggagcttacgtggcagtctagggagtttccctgctccgggaacaattcccccaaattgactcccccatagcaaaaactattcgacctcactctctctcgccactgttccgctctctctcattcttcctaattttacccccaaaacctccgattattactcaaacgccactgctctctcgccgggattccggtgaagaggaggagatg

SEQ ID NO: 24832 - DNA, 3000 bp, Unknown; identical to SEQ ID NO: 4588
  misc_feature (1)..( 3000): 2750-1469P.txt file - cDNA_ID_2217803; gDNA_ID_1620716; Annot_ID_49115

SEQ ID NO: 24833 - DNA, 3000 bp, Unknown; identical to SEQ ID NO: 4588
  misc_feature (1)..( 3000): 2750-1469P.txt file - cDNA_ID_2217803; gDNA_ID_1620716; Annot_ID_165642

SEQ ID NO: 24834 - DNA, 3000 bp, Unknown; identical to SEQ ID NO: 4588
  misc_feature (1)..( 3000): 2750-1469P.txt file - cDNA_ID_2217803; gDNA_ID_2926190; Annot_ID_140994

SEQ ID NO: 24835 - DNA, 3000 bp, Unknown; identical to SEQ ID NO: 4588
  misc_feature (1)..( 3000): 2750-1469P.txt file - cDNA_ID_2217803; gDNA_ID_2926190; Annot_ID_200966

SEQ ID NO: 24836 - DNA, 3003 bp, Unknown
  misc_feature (1)..( 3003): 2750-1469P.txt file - cDNA_ID_2218247; gDNA_ID_2214632; Annot_ID_136073
ctgtttacacttatggactcaaacaagccttcatcatctgcaccaagagttgttgttgtagcatccacaaataggttcttgtctaccttaagcataatataagttgattatcaacattggttttgaatgcaatgatccaatggttttccccgatcttgtcaaaagggtggatgcgattgacccagcgctaagaagagcgggacgatttgatgctttagttgaagtgagcacaccaaatgaggaggatcgtttaaaaatcctgcaggtaattatcgagttcttaaatgggattttcgtatatagtaagtttgtttgtgatcttcatgttttctatttttttcagctgtacacaaagaaagtcaatttagatcctagtgtcgatcttcaagccattgcaatatcttgcaacggttatgttggagcagatttggaagctttatgtcgtgaagcgacaatatctgcaagtaaaagatcttcagattctcttattctaacatctcaagacttcaagattgcaaaatctgtggttggtccaagtataaacagaggcatcacagttgaaatccctaaagtgacatgggacgatgttggtggtcttaaagacttaaaggtcaatactttttaaaaatattcattttgcactttgttgtcctgttttctccattgcgattaatggtttttttttccttgtgacagaaaaagctccagcaagctgttgaatggccaatcaaacattcagctgcatttgtaaaaatgggcatatcgccaatgcgtgggatacttctacatggtcctccaggttgctcaaagacaactcttgctaaagccgctgcaaatgctgctcaagcctccttcttttccttaaggtatagattttgatagatcacatttaacaaaatccccctttggttgtgaaacttgtttaaagaaacttattttttcttgtgtctttgtgtgggtgtgcgatgcagctgtgcggagctattttctatgtatgttggagaaggtgaagcattattgcggaatacatttcaaagagctcgacttgcttctccaagtataatattctttgatgaagctgatgtcgttgcctgtaaaaggtttgtctctatctctcccaactcttgcttcgtgttatagactcttcttaacatgtttatttccttgggtcttcgtagaggtgatgagagctcaagcaatagttctacagttggagaaaggcttctatctacactgttaaccgaaatggacggtcttgaagaagcaaaggtaaacaaaagctcataggcttttaaagattttatctttgttattgggttgcaatgatattgatcgggttttggtttaagggaatcctcgtcttggctgccacaaaccgcccgtatgcaattgatgctgctctaatgcgacctggtcgatttgatctcgtaagtcctcatattggatcttttgatcacacgagttctgaaatagcaaacctcattgctaccctcttcttgatttaggtgctatacgtgccaccgcctgatctagaagcccggtttgaaatactgcaagtgcatacacgcaacatgacactaggagacgacgttgatctcagaaaaatcgctgaagaaaccgatctcttcacaggtgccgagctcgagggtctatgcagagaaagcggaactgtctcacttagagaaaacatcgcagcaaccgctgtcttcaatcgccatttccaaaccgcaaaaagctcgcttaaaccagcgttaacaatcgaagaagtcgaaacttattcatcattcaggaaggcggcgaaaagatctgattcgaaaccgattccgattaacaaaaagaaggcgacttccaccgtcttcggattctcatggcaattaggtgttttgagcttattgttgcttgctactggaaactattacttcaaccacactaaacatgaattactagtagcttctgctacatgagacttgaaacagctcaaagttaaaaaaagttgctaattttgttttattcataaataccaaaatatcttttgtttcaaagttcaaatttttaaataataaaacggctaatgattattagattcgaacaatgacaaagattggccattacacatgaatggcccacgaacctcaccaccgtcgtgaaatttctttaagcaccaataatttcactggttatctcttactaattaattactttttacgtgttctaatccaaatcaacaataattatctgatatttcttcataaaccggttttggaatttagctgaaagatgtgaattttattttgtcttattaatcaaaaaatttgaaatcgttttgatttcaattaaaccggaaccctgacactaacaaaaaccggtctgagcttataaatagagtggctcgctgatgactcagttagtcagctccgagtctgcgttttacttcttctccttgagtttcttcttctagatctgatcgcgaatcaccaaaaggtttgtttcttaacccctaaaattcctccagatcgctttgatttcgtttctctgatgtcttagacgaagttagatcgtagattcctatgttttgattcctcgatcatgcttcgaattatggtgtttttatcctcaatttttggagatttggtttctacggattttgtagattcaggaatttagaaatggtgattcgatttcaatggttttagatctgattcagtcttcactcttgttccactattttgaaaattggctaaaaactaggtttcgtcgtctaattctcccgacgttcttcgagaaatgtgaactttgaggtgaagattttgcgttagcatatgtggttttgtataattgacgttgctactattctgattgtgaattttaagcagcattcacaattgaattgagtcttcactttgttcagctctgaatctatcatctctgaatgttggcaagttatagtttcttattatatttcggtgttttggtttgttgtgctaggttttattttatacaatg

SEQ ID NO: 24837 - DNA, 3003 bp, Unknown; identical to SEQ ID NO: 24836
  misc_feature (1)..( 3003): 2750-1469P.txt file - cDNA_ID_2218247; gDNA_ID_2214632; Annot_ID_187991

SEQ ID NO: 24838 - DNA, 3003 bp, Unknown
  misc_feature (1)..( 3003): 2750-1469P.txt file - cDNA_ID_2685595; gDNA_ID_2213636; Annot_ID_132173
agctttacgataatagatatcctgcaaccaattggtggaggaacagttaagaactcacgagtataattctgagaaatgcgcaccttttacataaagctctaagaacctcattcaaggcatacatacccttttgtctcgagaagcttttcccatggcctctaaagtagaatacggagttggttcactgcgatgaacactaaaagtcagcgaaaactgaagggacagagataagttaagccactagtgtgtctcagaggcattctatcaaacacattaagtgcacaacaaaaatatctgcaaggtagaaaatttcgagattaaatcgatatacaagaagaagacccgccaaattaccgtatagtatacagcagctaggtatgtgaagaagagtagcaccaaagtagaaattcaaggtagagccaagtgaagaagactgtgtgagagaacaaaaaccgattcttcttatttttcttttgatctgtgccctaacaatttggaagatgacgaaatagagttattgggcttgagaccaagttcttttgggtcacatattaggcccaagtatttattaatggaattttcgagaccaataagtaaaacatgtccgtatccaaataaaacaaacattcggccatgtaaattctgacgaacatttagtgtaattattgtatcgaaatttttattaaaaatataattgattttttgtctttttacaaaaaaagcagtcgattcctaacacaataattacacatcccaagggcattgggttcgaatcttgttaaggaaaatcaaatcaactgattgatttcatatatggattgtcacctgtacgttatgattataaacagtcattaaaccactctaatggcaaatattctccattgaaaaacaagaactggattatctttttctgttaatttacaaaacggaaaacaaaaaaatgattatgaaatacaataaccattataaaaactaggttaaatattgtaaggtttggagtgaaactgagcatgcataaaatctttgaaagtaataatgaagaaatagattgctttcaatgaattgataaggcaacaatatgaatggtcggtcgatctaatgtaatggtctcacttcacagttcacacaactatctgtatatcccttagacgtttgtcttgtctcccacccacttttttttttttttttttaaatcataatcttcttctcaagatttccctactcatggatctcttgttttgttttcatcccttaaataatttccaaaaatggtgaccactatcaatgtgtaatttccccactaatgtactgaataattgatagagaaaaaatcgctaaactatagtacaagtatgaaaagcaaaacatttttaatacgatcaaactgttataatttgtactatatctcaatagtaaatattaaattctaatagaaatgagtgagtttaaaatattcatatcatatgctactcccgataataaagtagtaaattccaagtgaaacataaaaaataaaatctagttgaatcgaagaatcaaattcagagggatcagaactggaaagctgctgattcaacaagtctcggtccatttgaaaagacccaaaggcatcaaagtccattacttattctgtgtttgttaaaacgcactaaaagcccattaataaagtatgttctttttcctaatgtaattatgcaaaaaaatggttcatacataatacattcgtaaccatgacgacactgaataaaaatgttctttttgtatccaattcagtttttgacactaaaaagaactacaatagtattctctttgacgaatcaaagactgcaaaagtcgtgaacaaatatttaacaaaaattttattataaattagaccaagtgatgatgataggaaagatgattgtggattgtaggacaatccgacggtgcagagatggcgagtgcacggagaatcaatggatgcacgcgtagaagaacattggcgcgtagggtcaagggcttgatgacgcgcgtggggggtttgctttaaacgcgtgaagaaggtttaattcccacaaaatggctcggctcaaggctcaagccgacggtatattacactgtcactctcactcccatctcttccgtttaactgttctttcttttcttttagggaataagaaaatctttataaatgataaaatatgttatcgaaagaaagaacaatgtgcactgagatatttaccaacaaaacaaaacaatataaatacactaaaaactctaagaaaagttacttattattagctatgtgttttgtgtattaatgtataatcaaaatattataatgctagaaagtttggtatagtgaccactgtgaaggtaacaaatagtaatataatttgtgttcaaaatcaaaactggatacccaaaatttatgtgtgtcatcataagttacaaatcaaaatggtaaacccacaaaagaaaacacactaagtttaattagagaggtctaaatgatgtgggaatcatagagaaggcaggtaaaaagaaatgaagaaaaagcttcctgcttttatgctctctctctctctctttcattgaacatgtataattataacaaaggcggccgcattaaaagtaaaaaacagaacatttttttaagtagacttcgttattacagtactctcctactcacttgccattgttattacataaccagagagctcttcttcactcttttcctctctctccctccctccctcttccattaaatctttgtggttctcttttattgttttgatactgtgctctgcttcggagagtgtagaaagagacagagctaaagtctctgtgtttcttctcagcaggactaaaaggaaaaaagggtaagagcttggagacaatttttcttccttcataagattctctctttttaaaccataaaaaatcaaaagattgtaacttttcaattatttgtttgctttatataattatctttgtgtaccgtacagaaatcgattgctaatg

SEQ ID NO: 24839 - DNA, 3003 bp, Unknown
  misc_feature (1)..( 3003): 2750-1469P.txt file - cDNA_ID_2685632; gDNA_ID_2213641; Annot_ID_132273
aactttcatgtttatagtataatgggcctccttggcccaatattctcgaaacattggactattggagtttctcgtcatcctcaaagcaagttattgggaggtgactcaaaatcacgttcttgaaaaattttccgagttaaaaagttaaacctttatttaattctccaatttgattttcgtttatatttctggctttcgtcctaatgaatatacactagatctcacttgtttttcttcatgtacgtaatcatttttgggggtggcacgactaatcattgcttgagttgatcttgatccaaatcttaggaagataatgcgcaattaattgaattttcaaccaaaaaatggacaaaaagactatcgccttgtaatgattgcaattatgatgcttctagtcttctagatactgtatcaagtatcaactggataataaactatttatcattttcttacaactaacaaccaattaaaagccactcaacatactaacatttccatagtccactccaatgattattgattattatgattaagatcagatgatgttctctatggattaaaaaaaaaaaactagcaataaaataacaagaaaaatggtcatgttgggactgggtgggagtggaacgagaggccacggcacacaaagtcacaaagaaagtgtcattatccggtgcaccgtcccacatgcgattgctggtaaccacgcgtcaatcagacgaatggcatgatccttttttagattgtgctcgctaacatggaccctacaaggaccgaactaatcaatgtggttctcacgtgcctcttttgccaattttaacttttctaacgaaaaaaatattactctgaaacctccacattcaattgtgatatgaccggcgtctggccctcaaaccgaaaggctctcctctgaatcctttgttgctctgtcccacgtgccagaaatatcatcttaaatatggtggtctttcgcaaccctgaatggcatttgtggtaattagttctaaattacgtgagacaatgcaaagattttgttttgcaccatcgttgccgaccacatcaaacaggtcatcgctctgggtccactcaccgctagtccgctatacacttgtgggaaaaggcttcttgtagtacagtttcgtcacggcgtcttattaattgcaaatctgtgacgttacggttttcgattcgggttactattttaatggaaatcttttgataatagctagagcctagagtatgtaaccctaaggttagatggtaataccgaatctacctaaatttttgttattttcggtttttcatgagatatatagactgcgtaatttaaaatctcaaaatttggtttcactttatttttatttttttttagtttcgaggtaggtatacaagcatggaccttttgacattatttaaaattttcataatttagaatcttcatgttaaacgtgtatggctacgatcttcggaactttattcggtttgtatgctcaaaggccaacgccatttattttctaattgattttttcccgttacggaaacaatctttttgcattattgaacttaattaccaaagtttatgaaaagaaacaataaagtctaaattggcctattttgatatactgatcacttacgcgaaaacatctacattgttatctactagactagtcattaactcgaagatagaatttcatttcttgaccaaaaaaaaactcaaaagatagttataatcacagattcattattgacttttgcttttaacactgtagccatttatgtactatttatacaaatacctaacttttcaaatttgtgatatttttcaccctacattttagcctataggttggatcattttgtcatattgcatcactgtttactagtaccaaacttaaatatcacacgagcagtaaatttgctatcaattttttcgttttcacaaacatatatctagtttccctaaccaataattaagttaaattgcattaggaatttaggatttataataaatagatatataacccactaacgacaaaagactatgtcttgctacgtctctgcctttattatcatgccacaagaaaataagaggggaacagagggagaaccccataaataaataaatttagagaaatatctaagtttggttcttccctgtgtctacccaccgtgatcatcataaaatggattgtgatttctgatttgtgagtctatctttctctactccattagcttcctctcccttggatggttacgtcactttctccgagcttacgtcatctatatccggtcttcacttctttttccttccattcctcagcagcattgcgtaatctatctggtgtgtgtgtatcacgtcacttcctcctagtccctctctctgtacgttcttgttgtgaaattgatttactttttgaaaacatttttggtgcaattcaacaatatttgtttcacagttcttattttatttttgtagattaaaaagcttaaatttcaaaaacaagaaaatcttgttttcacaaaaattaggcaaagggtttccaatttccagattgtttaacttgattttcaatttccaatttccgaatcttgcaacttgatttctataatgataagttatctccaaatatgttttcttaaaagagaaaactcgatttgacttcaagttgagatcatatccattattattctctatattacgtacaagttattatatattttataactctagaggaatgttagagcttgtgttaatggaattccaagtcagatatgaatattctcttataatcattattgtccttataactgttttaaatacctcaaatttatattttatcccctgtttttttcccgggaaaacgaatctcaaaaaacgaatttcctactttgacattattttatctccctcttgctctttgatataatgcaactatctgaaactctatgaatttatcatttacagagttcaagatcatatgatattttcactttctggacaaaatg

SEQ ID NO: 24840 - DNA, 3003 bp, Unknown; identical to SEQ ID NO: 24839
  misc_feature (1)..( 3003): 2750-1469P.txt file - cDNA_ID_2685632; gDNA_ID_2213641; Annot_ID_181244

SEQ ID NO: 24841 - DNA, 3003 bp, Unknown
  misc_feature (1)..( 3003): 2750-1469P.txt file - cDNA_ID_2685636; gDNA_ID_2214530; Annot_ID_134257
cttatcctattctgttatcttgcttatattattacactctgttagtctccaatttcgatcatgcgttagctaaaaataatattttacggaattgttaggagatcctacttgtccttgatggaaacactggtttgaacatgcttccacaagctagagaattcaacgaggtaccatacgaaactacctaaacctagtgattctggctccccaaactagaatttcttcgtaaaatcttgaggtttctgggttacatttttttcaggttgttggtatcaccggtttgatattgacgaaactagatggctctgctagaggaggctgtgtggtaaatatctcataaaatttttgatctcattcaaagctcttatttttcattagctctgtcattgaaactggttctccatgtcttgcaggtcagtgtggttgaggaattgggcattcccgtaaagtttatcggtgtaggagaagctgtagaagatctccaaccttttgatccggaggcttttgtgaatgctatattctcttaagccataaaacctcgtcttcttcaaaaagctatcatcttcaacgcaggccagagccaagtggaaaattcacagtgaattcgccggagatgcaaatggaagcattccttattttcttggagatcttaggttgacaagctttttctgcaatggatgcaagtttcgatttttaatgatgtgacaaagctcgtttgcacactgatagtgatcacacaagaatgtaacgagtcataggaactgcttgtgtctcgtctcactactattttgtatattgttaatgttgtatttgaaaggaattacaaagattgataaaagaacaatgaggggaggaaaaccgtaaaaaagaaagaaaaaaaaatgaaacttttttaaaaaatattcataacttgtatataatccacaaaacgatgcaaaggtcaaatgacatgatccataattcgattagttttcatatcattttgtaaaaattaatattcaaatttaaaaataaaaactgtaaaaatgaaagaataaaaaacaaaaatttaaaacttttgaaaatatattaatatgaaacttgtatattaattctacaaaacattgtgaaaacaagttgaattagtggtatcggcatacgacttcaaatgacaagatccaaaatccggttaatttttattttattttgtaaatctaatatccaaattaaaagttaaaaaccataaaaaagaaaaaaaaacaaaaattttaaaatttttcgaaaatgttaataatttgtatattagatctacaaaacgatgcgaaaacaagttaaattagtggaatcggctaacgatcaaaaactgtaagaaagaaaagaacaaaaataaaatttataaaaaacctcttagaaaaatattaataacatgtatattaaatctataaaacgatgtgaaaaacaagttgaattagtggaatcggctaacgatcaaatgactaggtcaaatgacaggatccaaaatccggttagtttccatatcattttgtaaatttaatatccaaattaaaatttgaaaaccgtaagaaagaaaagaacaaaaatcacctttaaaaaaaatatattaataacttgtatattaaatctactaaacgatgcgaaaacaagttgaatttgtggaatcggctaacgatcaaatgattaggtcaaatgacaggattcaaaatccggtcagctttcatatcattttataaatttaatatccaaattaaatttgaaaacccttagatgggaaaaaatcaaaattttaaaaccttataaaaaaatattcataacttctatctcagtttgtaaatctaagtaatttaagggctaaaaagaaaatagggctaagaattgacttttatggcgggctgaaattgatattgttgggctttgaagaattgcaccttagtcctgagcccaaacgacaccatctctaatcttacggcaaagcagtcctccaccagaccaccaccgttatcggaaacgaattccccagtctctccgtcgcgatctccgtcgctgattgtcacgaattacgattcacgaagccgaatatttttattgaaataaccattagaacttagaaccgccaaaacagatcctagagcgagtatcttcaccgccatagcgttcatgcaagtcttcgtcaccggatcttcactagcgccgacgatataattagaaaaaaccataaccgtttctctgaaccgctgatcgattaggttatatacaaagaagacttttgaagatcctcaacgtaaagaggattcgattctagggtttttttcttctccttagtgcgagattttcttatctcttaatgatgaagtaagtccgtatttatagattggtgtgagttaattaatttcctttttttataaaacaaaatattaccgttacattacatattctccggtttaccgttgcatacaaccgtttaatataaacgttgcatacaaccgtttaatataaacgttgctgtgtgaagtgcacgctcttgttcctcttatcatttgtgtgaaaatacatcaaatatcaccttgtttttttgtcaagtgctctcgtttgaatttttttttggttataaagtcatatttcccaatttgcataatgatatacaaatataaaccggatggcccaaaaaggcgaaaaccattagtagtactggcccaaattgcttcttcataaaattaattgttttcggcctcaatactatttcatgttttttgggtcaacaacgtccaagtaccctttatataacataaataaggattgttagaaaagaataattttgatgtgtcacgattattttatcaaccaatcactgatctctaggagaaaaagtgaggacccatagtttaagcgacactctttggttaaagaataaagattagatcggtccaatttatatatttacatgttccgccattatcatcttctaatttgaaaactcttcatcattccctaccaccggattcaatg

SEQ ID NO: 24842 - DNA, 3003 bp, Unknown; identical to SEQ ID NO: 24841
  misc_feature (1)..( 3003): 2750-1469P.txt file - cDNA_ID_2685636; gDNA_ID_2214530; Annot_ID_184899

SEQ ID NO: 24843 - DNA, 532 bp, Unknown; identical to SEQ ID NO: 13533
  misc_feature (1)..( 532): 2750-1469P.txt file - cDNA_ID_2685649; gDNA_ID_2214635; Annot_ID_136105

SEQ ID NO: 24844 - DNA, 532 bp, Unknown; identical to SEQ ID NO: 13533
  misc_feature (1)..( 532): 2750-1469P.txt file - cDNA_ID_2685649; gDNA_ID_2214635; Annot_ID_188075

SEQ ID NO: 24845 - DNA, 3003 bp, Unknown
  misc_feature (1)..( 3003): 2750-1469P.txt file - cDNA_ID_2685667; gDNA_ID_2684225; Annot_ID_191946
aaattgaaacacacatattagatgtccccaaaaagctgaaaggtgtttatttaatctttacacaactctttttaatagtttacaaacacttaaaaagaaaaaaaacagtaataataatgtgtcgaccagaaaaaaaaaaattataatgttacaacaattattattaaaagtaatttagtgtactaatagttttgttgccagacagaacaacatcgacgaaaccacaacatagaaagaagataaagagtgagcatcaatcaaacacaccattacaagcaaagttgtgacaaaagacgaagtcgttattgaaccatctaacacttttattccaaactctccgactttggttctgctacgtactcttcaagtagtcttttgatcaaacaagacgtctacagagcgtgataccatctccaatggaaatctgagagacctcgactcggggatccaaagccaatttcttattgaattctataagagctgctctatattctctcatatgctccggaactccatcttcatcctccgccacaaaaccaaaccacaaggtgttgtcgaacgcaatgattcccccaaccttcaccaattttagaagcctctcatggaagttgacgtagcttgatttgtcagcatccgcaaatgcaaaatcaaactcacatttctgcaatgttttttaatgtatgaccattagctaaaaaaatatagttaattaagcttaaagttaataataatataagaacacatattttcacgtacgtcgttcaccaattggtctaaggccttaagaccatcggaatggataaaattaatcttgtgatcaacaccagccttcttaataaactctagtccaacttcgtaagcttctttatcaatgtctatcgcggtaatctacatccaaagagcatccattttgataactatgtttcttagttaaaacaaacaaataattttgtaaccccaacaatatgattatatataacaagaagcattacacggccatcttcaggtaaagcaagagctgtagtgagaagcgagtaaccggtgaaaacaccgatctcgatagtgtttttcgcattcatgatctttacaagcatcgataggaaatgaccctcatcaaccggaacctccatctcgcttctgcgtttttatttttaaattctacaaaattaagcaactatatagctatctctaaaataatcacaaactattggcaaaattttgtttattccacttcttaaactatataaagataaaatttcttaatttaaaaaagttgttatatagtcctatagattttgttgcacctaaaaaagaaagtcatatattaagacttacaaatttccgtatttttggacagtagcttttcgaagttccttgagcaattcatgctctcttggatacgctgacgtttccatgatgtactgtgacgaacacgaccaaaacaaaacacagatttatacatcaaagttcctttttaaaactagacaaaaccaaagttttaaagatcagcaaactttataacagagaaaattttacctgttttagagcttcgctcttgagaatccctttggtaggaatttcattggccatgtctcttgagtctcgtggttgtgtgcaaattgttcgttgttataaacgagagatgtatgtcaatatatatattggcttctggtcaaactaattgagctactaataagacccaaattaaggactaacacaccaattgatcttatccatgacttttcaaccatgggactagaaaatcaattatctagacagtacttgatgcgaatatattaacgtttatgtttcttaaggattttttttctctcttaaggttgcatacaaatgttgaaatatgcaagcaggcgaacagtttgcaatgtagttttattgactaatataaatttggtatgtgagatttaaaatgcaaaaaaagtatatagtatagaattatttaaagaatatatcaaattgaaggtactaaaaaaacggatttgaattcgaatgctaacataacgaataccagcataaatctccaaagatgattcaaattttgcagtttcaatccctcaatccgcttcaacggatgaaacaataataatattcaacatgttctaacaatttttcaagtatgcatgaagaaatcacttaaaaaattccaagatatgtatttaaagtttagtgaatcatcaaagcgcaaaaattcacaactaagtaagaaggttgtcgataaaaagcaaaaacaaaagttacagaatgtcttgaggagaggattcctcaaacctcctaagaaaagatcttttgggtttttgtaatctgtcattgtaagttaagcaaagtttgttgaataagtgttccagagatatgataagttgaccttttggattgtctaatctggaatcttttagtttatggtgaactctcaccccaagctcaatgtgatgtccatgtaactaatcttaggcaacatgatgtggcataggagattgggcatcctcatcatcaagatccctaaatgacgaaatgattttaaaataataattcctaagatttcacatccttaaacccttattaagtcctaacattcgaaaatacacaacattcatttgatttaatttaaatttttatattaacttctctattttcattaaaaattgtaaaatatttttttattgtcgtaaaatgttttacttttctatttccattaaagttgtaaatatgttttattaacgtcgtaaaatgttatttttttaaataaaaatatctgttgggccaaagacttaaaaatatctaaaaccgtgacttcttcttcctctcttccttgaaatttcctttgatgtgaacgacgatcccttgcccaacgcacaagtttcatctccttcccacataaaccccaatcccaaattctcttcatttttccttattcttgcgactaatcgattcaatcccaaatttcagaattcaaaatttcatctaaagtttagagatttctcgattatg

SEQ ID NO: 24846 - DNA, 3003 bp, Unknown; identical to SEQ ID NO: 24845
  misc_feature (1)..( 3003): 2750-1469P.txt file - cDNA_ID_2685667; gDNA_ID_2684225; Annot_ID_137559

SEQ ID NO: 24847 - DNA, 3003 bp, Unknown
  misc_feature (1)..( 3003): 2750-1469P.txt file - cDNA_ID_2685688; gDNA_ID_2936584; Annot_ID_195032
atagtaaagagttggtatgcattacgtaaaccatgtttttctagatagaagcttctaatcctaattaattttagtttatttcatacaatttattttatgaatatattgacccacgtttagttaaaatttaaagagaagatggaatgttaatgcatgtagatgtgaaagcaattatgtgaagttatattttatgaaagaaaaccaagctaatagggaacataaagtaatatttaagattttaagaaccttcaaaatcatattataagcaatttggtttcctccaaagtggagaacacaagtgcttcgttgattattagtattactttctttctcatcttttctctatgtgcttcgcaaaagaaacatgctgtttgtttaaagacaaacatttctgtcgttaaacccattttgttgtcattttaaattgctttagttcttttcgctttcttgttacataattttgtcccattcatagagcctgtatatgcaagatggctttttaaacaatgatgatgatcaatacaatatgtgatttgttatctgtagaggaatatactatataataagccatcaagtagtaaataacaattagcgtattgtccattcatgcttgaccacttacggtacatacacatctaattcggtataaaaatttgtataattagtttgaatttagaatcagaaacttcaagctcagaattaaacggaattagtaaatatcaaatcatttttccttattaagtacccatatatatatagttgaactttcataccgagactaatattatctctgtttactatacatatagacgctcatgtgggagataactgaggatcgacaatacccatccggtttgaacctatttaggcatgttgtttatccatatcagatctaaaagattgtttgatagattttgacttgtaactcgatttgattaacattgtccattttatgagtaaagtattattaatttgacgtgtccaccggtcaagaagtcaaagagctatacgagttaaccacaatccactcgtgcgttttgtagtctcttctcattctttattgacaagtcaacaacggaagctttggtccaaattaagcccataaaaataaacatactttaacattaattaattgttcataagtcagtggctagtctaactaaatctctttaactctatttcacgatgattataataagttatggacatgatggttgaatagaagttttctacaagtttctaggtcatagttacttggtagttaattttctattgtttgatgtgaagtcaaatactccatttctttgattaatataaatattaatgtacgttttccatcaagtagttatagagccatcaaggtatttgtcaaacaagagtatttaacgcagaaatgtaaaactgcagtgagaacccacttttattctgaaaatacatatcataaaataattgtgagatgagatggtaaacattttgtagtcgaagtcgaaaccaaatttacagaaatgactaagttggtcctaagcactgcccatatttaataccgtaaggacaacgaaattgtgtttgtatatatatgtgttcattaatcgtaactaaatataactaagcaccaaattatatagtgtagtttaatttagtggttttttatttaaggaccgaatttatgtagaacattgttcgttaatgtggaactcagatgatgtattagataccaaacttaatttgaatatcggccaacaaaacctcgtaccgaggaggaaaaacaacagaaaatagagtgaacaagtcgaagataaactcatgatgcagaaggagaagtaacaaaatatgaataaaataaattaaggtcaatgacatattagatgtcgtcgcttcagaaaaagcaagccattgagattcggggaagtcggtaagatattgaagtcaaacacaatctctttatgttgttccaaaatatacaaaacatatgtcgaaacttcaaattgcgactcctctacaatctacatcgaggcatgcttataagtttggcccaagactttgttgcctacaaaactgcggattacatgggatgaactaattatattttcatatattaatataacgaaaaatgttacaacataatttttacaaattaaaaaataaaattacaaatcataatttatttttccttctaaatttctgcaaataaaattagttttttttttattactagtcattaacaattcggagaagaataaacattcctctaactcttaacaattttaactttagctaggtacacaaaatattagactatacaatttacgattttggttttgtgcatttttttttaaaataataaaagcttatgttatggcttattgggctttagggccaaatatcaaaagaacgggtcgatagccttttggacatttatctatgtatatggatcgaactatatactgtttttatatgttggatttagaacttcagccatgtggaaattgtggataaggaagagatcttgtttaaagttttagatattttgatgcacatctttttctcaatcatatcgtttgaatttagaattctaagcaaattaatgagattgtggaaaaaaaagaagcaaactagtgagatgtttatttgaacagtttaacattattttgatttttacatattattattttttcttacataaaataaaataaatatacggttattctttaacacaacaaaaagaaactttttaccaaatcaggtaaatactaaaaaaatattcatccagaaagagtaaaaatcctaatccaagaaaattagcggccaaaacaaaaaaaacaacgatattagcagcacatgttgattgccataagccaaagccaatcctcttcttctctgtttctggatgtccaccaatcatcttcgcacttctttcgtccagtcgatgataataacggtggagaacgacggaggcgggcgacgttagggtttctaatcatttctctctcttagacgcttatg

SEQ ID NO: 24848 - DNA, 3000 bp, Unknown; identical to SEQ ID NO: 10580
  misc_feature (1)..( 3000): 2750-1469P.txt file - cDNA_ID_2685704; gDNA_ID_2213664; Annot_ID_132625

SEQ ID NO: 24849 - DNA, 3000 bp, Unknown; identical to SEQ ID NO: 10580
  misc_feature (1)..( 3000): 2750-1469P.txt file - cDNA_ID_2685704; gDNA_ID_2213664; Annot_ID_182006

SEQ ID NO: 24850 - DNA, 3003 bp, Unknown
  misc_feature (1)..( 3003): 2750-1469P.txt file - cDNA_ID_2685712; gDNA_ID_2684233; Annot_ID_192344
acacaaacctgaagattacgcgaatgtgctctcgcaactaaatctgttggtgtcatgagacggttattgttcacaggaacaattgtgtctttccatggaccaatcccaattacatatggtttaatgtaatccaaatatgcgtctgatgtgatctctgcgtaagtctgcattcacattcattaccttatgtataagcaattttgacataatgagaaaggaagaaagtgaatatgtaaataccttattagtgtcttcggtaagaatagtgacatcgtcgatcaaaaacaattttggtgagtctgtcatgtttgaaatgtaaactagcgaagttgctgcaaaagactgaataaatattggctgttttaaccaatcttcagacagatatgagcctttgtatccatatttcttcaaagtttccacaaatttatcttcaaattttttaccatccgcccacttcacctgcacaagtttccaaatacaatttaacatcctctccatttgttatcatcaatgactaaaagttgaagctaagatttgatggtttgcttacttgctgattcatgaaaaccggattcttgatctctggatatatcccaaccactctaggtgcatccagtgctatcgaaatatactcgtcgaaggtaataatcgggaatttaccattgtattgttgatccctgaaaggatacctctgctttgcaccaagtgttttcagctctttgagagtaaaatcaactgttcttggaatgttcaatctcatcgtcaaaatttgaaaaaaatgaaactatatcaaaacaaatgataatggaatgtttttagttaccagtgaagaagccggtcatgttcattccttggacttcataagtcctcttacggtctgcaaactccttatggtctgcaacatcggttgtatcatcgagattaacatcgtggtgacatataagaacaccgtctttggaagacaaaatatcggtttctataaaatctgcaccctcctctatggccctctgcaatcaaaaaaaccttgtgaaaccagacaaaattagtgtaaaggtaagagacttttgtatagatccaataccatatatgcaggagcagtttcttcagggagctctccgtttgatcctctgtgtgcaaggttgtaaggacgggaagtctgaagtggtttcttggttgcatgttttgcttcgcttgggagacgatacaaaggccttgaggcacaattagcaaccaacaatgacagtaaaagcaatggtagaagatctgcaaaaattataacaaaaattgctttaaacgaagaatcaacttagacatagaaacaatggagatttgacacttacacttgaaggccatgactgaatttgagctagaaaaattcctccaacgaccacactgcatgaatccaacattatatagatagacctgcaacttatctttagaagatttagccaaaaaatcgtaacaacccaatcagcattaagaatattcctctgagaaatctagtatgccaatagaagataaactccgtgttgtttgaaagtatattcttcttctattcactaggttttagttttacattttaaatgatcgcagatatcataaggcagtgtagttttagaacgaagtgaagttgcagatccagattgtattgctatgttctagtcttttgatcctttgttaattacaaaatgtacttgcttgtcgatcatgacaagccaagtttgtaaaacaatctctggttgaatgaaattgtcgatgataaaatgcaatcacgaagcggttgtgaatggaaaattaactcttttatagcatcccaagacacaaatcagaaacgagttcacaccaattctagagaagaaaatacaagagtttgagagagtgaaaactaaagagaggctcctccattcttctcaaactcccatgatcctccattcttcttctcaaactcccatgagatccccatagctacgcatgaggacgactcctcctgcaaacataccaagtgctcgcagaagtttctgcaaccaaaaggaattcgtatgagacagatttcgatccaaatacttcaaaggcatgaactataataaaccctaaatctctaagagacccaacatccccaaattcccattcgaacatccaaatacttcaaaggcatgaacttaacttgtgattgataaaccctaaacctctaagagacccaacattcccattcgaacacacaatttcataagaagaagacacagagataagataaggtcatctgatttggcctatcgaagcataggagagaaaatcaatcctacgttaaattctgaaacccaaaacgaactcattaaattcaattcccattcgaacacacaatttcataagaaagacaaaagaatcacattgtacgctcaattgaatcaatttgtaaatcctaaaccgtaattcaaaatcgctgtacaactcattaaattcagccgaaagcccagaatctaatcatgaaacatacaagagaatcgagacttcgatattcaatagacaatcaagtcggaattaaacgaaagagagaatgtatgaaggttaccatgttcaccgcccatttttgttcatcatgaacctcggagtgccagagtgctttcatcttttcgatagagacaacgttgttcaccatcttgctgctgaaaaatcgaaacttttgatcgtcgaaaaaagaagaagctagggcttttaaaacgacgaattgggatcgggaaattttagtcggttaacttattaagggtttacgttttgtttaattaccaaactaacctttactaatatactaataaccggtaaaaagtgatgtgatttggattgatttcaaccggagaagagttaaccactcgccgaacgacacgtgttcaacacaatcctattcctcctagcaatctcaaagcttgtgtgatctacaagctcttggtttctccattgaagaaaaagctttgacaaaaccagggaaagagacagagagagataatg

SEQ ID NO: 24851 - DNA, 3003 bp, Unknown; identical to SEQ ID NO: 24850
  misc_feature (1)..( 3003): 2750-1469P.txt file - cDNA_ID_2685712; gDNA_ID_2684233; Annot_ID_137670

SEQ ID NO: 24852 - DNA, 3003 bp, Unknown
  misc_feature (1)..( 3003): 2750-1469P.txt file - cDNA_ID_2685717; gDNA_ID_2214494; Annot_ID_133534
aattaaaaatcattgctgttgcatttttaatgaaactcttagcacgaacattattacagttagaatactaatcgttagttgagtaatatgagggagcatccaggatcaaaagcatcttgattgagtccaaaaaagttgactcgaaaaaacacaaactggatgatgtcattaacaaaatccctcataaagtactactagaaaacttagcaactttttcagactaacgggcgagtaaagtgataaactctgactggccacaaccgtaagcggctagcttgtaatcaagacagactatgaggactcgcatatatgcatcactctagaacgcatccttctttggttgatatgaaatgattcaagcagtggagataacattaaatgtgcatcaacactctcattcaatgctatcgagaagcatcattgcgcttttccattgattctagtaaaatagtacccatgcctcttttttggtaactcttctcacttacggtcagagagatcacattatcaagtctcaccaatcccgtctaattaaagttgtaaataatactcattccgttcctttaatttagagggcagaagcaagagaaaattttagggcctttacttaaactatttttcctatgagaataaattttagaatcttgcaaaaatatggacttatttgtataatgatgtttaatttgtaggagctaaaattagcaaacactacgtaaagacaattgaaatcgatatcataaacgtttaaggaaagacaagagaggagtcgagctgatgaactctttctttaaccctttgaatcactcgtagtgtgacggtttttgtgtgattcaaggatcccatgatacaacctctataaactgatgtcgcaccactcgaaaacagctctaacgaaccaagtttctacgatcctctcaaatacttactttcttaacaaagagagattgttggatatatgtgtttctatatgaacggtgaaattctcaatatgttaagaagaagacatcaaacatgcatatatagaggtttgagattggtttgattcttaagatcaatcaaccacaaccatcgcaaatccaggagaggtggatgataggatgaggcaactatctcacagtgaaaccgagtctcaaagagacgtgaaacaaaaaagactgattctcatggaagtattcaactcgacccaacacacttttggaggtccaatgatagtaaagccaaatcattgtgacccacttctcattcgcacaatttaattttataaagcccacttaactttaaaataaaatttggtccaacataattgagccttacaaaattgtggtctaaaaccatgtttcatctagctagtggctaggcttagaggcaaccctgataatacttgatctaagatccactaacacgatattccaactttgaaatgtatgcacatcattagatgctatatgaccaagaaagatatatttgacagagaaatttgcttagatttgtctaattaattatcttcgctcgagactaaggcaaaacagtccaccaacggtaagcctaataagtcaatgcatttgtttttttctaagacgtcaatgcatttcgttctttttttccattgtcccaaaatactcatccttttatattagaagaatttgtagccaaattttcgtttttaagtgatgttataaattttacattctacaaggttaattgttattctttattgttactgtaaatattgatgcattttattgttattttaatattatgataactttctaaaattttgtatgcataattatgtataaacatcatctaagcgacataagaaaataattttttcgatcttgttatttacagaaaaataaagaaaacaaattgtacaaaactcaaggcacgagtcctaatcttatatttggagatactataggtcacttcgtaggtggtgtttcgagatcaagttagccattgaagaagtcataattgtcatcaaagcagtaaacaaacgtaaaatgaggataaacaattgatgaaatcatagaaaaatcacacataatacggatattgtattattcaaacgtagttggattgtactgattttgagtataataacatcgaatatagattcaattattgagatgcgtattgctttattatcataaattaataaggttctgccattctggtcagttctagttggtggctttaacttgaatgtacaacagcctaagatttaatacggtaacaaaaagaagtgtacttgtacctgacccaaattagcaagaaaagatttgtagtatgatttattttgatggaaccttgaaccttcgaataagtaattaaagtgaaaagctctattacgtatgggtcaattcatgttaacatctcaaataaaattttaattagtgatttttttcctaatatcttgcggattgatgtcaaaatggctttcgagtttattttttaaaatatatttattcctaattccaaatttaagaacatgaaatcaattcaaatgaggttgtacacttcaaaattcgtaataacatcactagacggaaaaagagtgataactgataagaaaacaacatataataagggatgataaaggacaacaacacgatgacaaaaataaacttcattattccaattaataatgaagtacatttccaaataaacaattactaaaacttatacctaacggagaattaatactttattcttgaagtttgaacaaaaataaatatactttatttactcaaatagtagataaataaaaatcctctgttccttccttctcccacaaatcaaacaagtgactttttatatttatcttattaattctgtagtctcgagattcgctttttctcctgcttacttctttttatcatcttctctttgtcggtttgatttggaaaaactttctgcaaaaaaaagagagattcttaaactttttatctcaagatcctttcaaaaaatctgaaaagagaagatttttaataaaaaagaatg

SEQ ID NO: 24853 - DNA, 2080 bp, Unknown; identical to SEQ ID NO: 11255
  misc_feature (1)..( 2080): 2750-1469P.txt file - cDNA_ID_2685736; gDNA_ID_2214486; Annot_ID_133357

SEQ ID NO: 24854 - DNA, 2080 bp, Unknown; identical to SEQ ID NO: 11255
  misc_feature (1)..( 2080): 2750-1469P.txt file - cDNA_ID_2685736; gDNA_ID_2214486; Annot_ID_183500

SEQ ID NO: 24855 - DNA, 3000 bp, Unknown; identical to SEQ ID NO: 13557
  misc_feature (1)..( 3000): 2750-1469P.txt file - cDNA_ID_2685740; gDNA_ID_2214636; Annot_ID_188115

SEQ ID NO: 24856 - DNA, 593 bp, Unknown; identical to SEQ ID NO: 12168
  misc_feature (1)..( 593): 2750-1469P.txt file - cDNA_ID_2685754; gDNA_ID_2214535; Annot_ID_185070

SEQ ID NO: 24857 - DNA, 3000 bp, Unknown; identical to SEQ ID NO: 13448
  misc_feature (1)..( 3000): 2750-1469P.txt file - cDNA_ID_2685770; gDNA_ID_2214627; Annot_ID_135977

SEQ ID NO: 24858 - DNA, 3000 bp, Unknown; identical to SEQ ID NO: 13442
  misc_feature (1)..( 3000): 2750-1469P.txt file - cDNA_ID_2685770; gDNA_ID_2214627; Annot_ID_187826

SEQ ID NO: 24859 - DNA, 3000 bp, Unknown; identical to SEQ ID NO: 14428
  misc_feature (1)..( 3000): 2750-1469P.txt file - cDNA_ID_2685791; gDNA_ID_2684118; Annot_ID_137162

SEQ ID NO: 24860 - DNA, 3000 bp, Unknown; identical to SEQ ID NO: 10289
  misc_feature (1)..( 3000): 2750-1469P.txt file - cDNA_ID_2685795; gDNA_ID_2213641; Annot_ID_132278

SEQ ID NO: 24861 - DNA, 3000 bp, Unknown; identical to SEQ ID NO: 10289
  misc_feature (1)..( 3000): 2750-1469P.txt file - cDNA_ID_2685795; gDNA_ID_2213641; Annot_ID_181251

SEQ ID NO: 24862 - DNA, 3000 bp, Unknown; identical to SEQ ID NO: 13224
  misc_feature (1)..( 3000): 2750-1469P.txt file - cDNA_ID_2685803; gDNA_ID_2214606; Annot_ID_135670

SEQ ID NO: 24863 - DNA, 3003 bp, Unknown
  misc_feature (1)..( 3003): 2750-1469P.txt file - cDNA_ID_2685819; gDNA_ID_2214546; Annot_ID_134599
tttaattcttttaatcaaagcatgatttaatgtaaaattatactactgtatgactacttttcttaaaaatataacctaggcaacttgttcatgtgggtctactcgttaggtgcttcattttgaatgatcatgtttaattgcgtaacgagataagtaaactggttaattgcttgtgtgacaaaagatacatatcaaatttaattaatcattaactttgattaaagaagtaggcggcatccccaaagtcaacaaataaaatcaaaggtttctggtttaatccacgcgttgccccatccatattccctttatttctaaacgaaagcgaccgccatttccgtattttgtctccctagcaccaaaattacatgaccatttatttacttacgtggttctttttttctttgcagcagaattatataaatatgcaacactggttagtctaacgctatagatatggatgatattttagatatctatatatacatttttgcagccattttgtaaaataaatcctagagttagaatttatttacagtggctgccactgacatttaataattgtttttgataattaaaaagaaaatctttgaattaaatatttgacaatcttcccaaaatctctccacattaattacacgattagttactaaaataaaacttcccaaaatatttaatcttatttaattactacaaaattatcatttttgatattgtttttctacatgactataataattcgattataatcatcaaaccgcagagatatttgatagcatttaattattacaaaattaaaaaatatttagacaatgattcataaacatatcataaataaaatcagtgagttttttttacaggacggattgacgggacgagtttgacaggacgttacttaataacaatcgtaaactataaaataaaaatattttatagataaatataatttgcaaacttttatatatagtaactttaaaaaataaattgtcttcgcggtataccgcgggttaaaatctagtaagacctaatagagtaccaaggctagaacaattaatacgagtatcgcgtatgaaaaagaatatacatgtattctgataactatataaagtagtagatgaaatgattttgattcatgaatctctatgttgagtgagaaaatgaatagcctgagacaacacaagtgtaatagctttcacgcttggacttgtgtctgaattttggaactgatgatgtttgctgctctttctagaagacctgttgaaaaaagcataaatacgctctgttttcaaatttggcaattgatatttgtttttgtacgtgtctatttaatttttggtaaagaacgcacgttgtttatacttacacaccgcccttctagaagaacaggctctcacgtcatttgcatacaacttccatcttctggaaccaatggatccctgttacaaaagttgctcttaaaacataaacaaaaacaaaagaaaagaaaacatttttatatttgtcgtcaataataatggccactttctgcttacatgtatatgaatgtatatattactataatacgtagctgctcgtgtttcttgtctaagttctctgttatagttaggagacaaataaagagaattagagaacagaagaccagaaaaataaagatgaacacaaccaacaacgtgtttgatgtgtcaccgttcttgcttttagaagcatctgcagattccgaagctggccacgacagcgttgacgatgataaatgcgttaaggattacgatcttggtcatgagtcttctagtgccagttcttgcgagacgtcttgcgtgagtcagagaacgagtttgttaggttttgacctgcaggacgatacggtgaatcatgaagaaagagacgccggagatgaagaagacgaagacggagaaggagaagtgaatagctacataagatgtgggagaagccaacgtgaaaatctggctgtggattctgctgcggtggtgagtgagatggatcaaaatcgaatgttctgggaagcttgtctcgcatcttgatctgtctttattaattaatgtcatctcatcatcaacagagaaaacaaaatagtatatatctagcttagcgtagtgttcttgtctgtgtttcccctttggcttttaatgcacaactaatcgatatgatatctacccattaaccttaattagtcccctttagcgtagtgtaaatttgttttgattcgtcaagagaaaaaaagtggtctaagggactgactagttggagaagaatccgtataaaatctgttaaaaggagaaacaatatactatactagtcttttctcgtagaggaggatgttatactaacattactaatttatgctcacccagtttaaataaaataaaatcaatacttttttggtttgtactaattaacatatatatatatatatattcccaaaattaaagattccatggctaacagacctaaagaagaagaagaacaaacacaataagagattggtgtagttttacttttactatattcatctttgtctttattgaccaataaagtaatttctcccctttatctatttgatagtggtatactttaagttgctttttaattgctggtgtacaattatattggactcaccaacaagaatctgtgtgcagtcagtgtgcttgttactattgttttatctcattaattgatgatcactttttcaccttcatacatgagagctgaattcatcactttgttagttatataagttgggctattctattattaacagtttgatttttgacagtaaatttgtctgccagaataacttatacacattaccacccaaaaaaaaaaaaaagaagaaccatttttggacattacgtggttttgggtttgtctagcgaccttttatgggccaatgatatgaggcccagtaaggaaacaaagaacggcccattataatgtaaacatatttagtacaaggaaaaggggtaaaaaaggaacaaggggaaagaaatg

SEQ ID NO: 24864 - DNA, 3000 bp, Unknown; identical to SEQ ID NO: 10928
  misc_feature (1)..( 3000): 2750-1469P.txt file - cDNA_ID_2685834; gDNA_ID_2214466; Annot_ID_133015

SEQ ID NO: 24865 - DNA, 3000 bp, Unknown; identical to SEQ ID NO: 10928
  misc_feature (1)..( 3000): 2750-1469P.txt file - cDNA_ID_2685834; gDNA_ID_2214466; Annot_ID_182828

SEQ ID NO: 24866 - DNA, 3003 bp, Unknown
  misc_feature (1)..( 3003): 2750-1469P.txt file - cDNA_ID_2685858; gDNA_ID_2213637; Annot_ID_132186
aagatctccacttttacttgctcttctccactttttaacctcattccaactaggaagtaagatccatgtatctctttttaacccttaaaacattggaaacaagaattctcttacacatgtatcggtagttggaaatgccgacccaaaaggaccaaaactcaccattatctcaagtgatagagcttctcaagaaactactccaccatttccacaatctccttttgtatttcttcatcctctggatcggcgtgatagttggaatcattgtttatccctctctacaaggattatcttcgccttcttcgttaaccatccaaagtgtctcccaactcttctttgtaacccctcctcctcctattctttctccttcatttcaggacaatgggcttgacatgtttctgataccactgaagaacatcatgcacgatatggaagataatgaacttctgtggagagcttcaatggatcctaagatcagggattacccttatcctagaatcccgaaggttgctttcatgttcttgacttggggacctttacctttggctcctctatgggaaaggttctttcgaggtcatgaaggtcttttcactatctacgttcacaccaattcgtcttacgacgagttcatgccgcaagactctgtgttttatggccgccgtattccaagcaaggtcagcttcccaaattattaagaaatttatttcgatacattaataggtttggaattaacgtgataaataaaatttataaatatattataaataatatatatatatatatatatatatatataacggatcgaagtacatgaatacgatatttttcctatcttttttagtaaattacataaaaatataagaatatttggtatcttaaaagaaaacatattaattattacactataatacataaaataaaatcaatccaatgtcattaactataaacgtatgcagagagtggattggggaaacgcaaacatggtagaagcagaacgaaggttattagcaaacgctttattagacatcaacaacgaacgtttcattcttctctccgaatcatgcatccctctcttcaacttctccacagtttactctttcctcatcgactccactctaacccacgtcgactcctacgacctcacaatcggtcgcgtccgctatgaccgccgcatgtatcctcacatccgcatgcaccaatggcgaaaaggctctcagtggttcgagctagaccgagccatggccctcgaggtagtctctgatacgttctactggccaatctttaaagcttactctcgctgccccgacgagcactatatcccgacgctactcaacatgaggccgagccttgggttgcgtaacgcgaataggacgcttacttggactgactggagcaagcgtagggctcacccgagattgtttggtgagtgggaggttaatgtggagttcttggagtggctaaggatgaagagtgttggtgattgtaagaaaaatggagaaaataagatgagactttgctttctctttgctcgcaagttttcgtcgactgctttggatgagttactccggttagcatctatcgtcatgtatttctgatcactctcttcccccttcgtccaaaaacaaagatgcaatcggtttaactaccaaatcttctttaagtaagtgaaatatacagtgtgtgcttaacaagttactttcagtactagggatgtgagattaatcaaagtccttgataaagttaggaactagcctgtcatcaagttataaacagaagataacttgagaaacattgagaaaacacaaaagcctgaccccccaatctcatttggtttagtcctccattagcatttatgagaaggtatccattcatattagcacctaactctgcagacaatgtatactcatatggtaagaacttatagaagagaaaaataggaaaagaaaaaaaagaacaaattgctactaataggactaaaagttttgcctagacacctgaatactcaaagaagaataaagtcatgtcagatatttaatctccttctcccatcttcttaagcgagatagaaactaagccacaaatgtttaaccaaagaaacacttgaaaacactactaccaccaagaaatgtgaagaagatcttaattaagcagctcaatacacatccatttttgggcaacactcaaaacgcaatttatcaagttgtagaaacagaaacaaaggctaaaccacatataaacaagaccttctcaagccaaaagtcgtaaatgttcgacaagagaaacactattagtaacagaaatgtgaagattttatcttaatcaagcatgttctagtatgagaaacacctaaaaagatagcacaaaaagcaagaacctaatgagaagcaccaccaccaatggcaaaattttctatacaattgttgattttttccccatttacatattgattattccattttgctatatttagtttttttttttttttttttttattcattcaaattcaattttacatatatttatgtgacccaaaacataattccaattcattttctacaaaaattcaatttttgacttaccatatcacaaatgatattattaaaataatatcaataataatataatcactcttataataaaacttcgtaatggccacaaaaaaatcagtaattttcgatttccttaaaaagtcatcgaattaaatatgaaaaatcaacgagttagtttgtccaaaacgaataaaataaatttaatagtaccttttattttttcggaaacccttgtttcgttttttttcctcgatcttcttcttccccaatctctcttattttgtgagctttttagatcctcctttcttcatcgtttcttttccgaggtttcaaattcgttcaatttctcgattgaagatacctgaaatcgcgttattctaggtccgccgctgttggatctgcaaattccccttcgaatttgaacatttgtgatttcaaattcttcgagaagatg

SEQ ID NO: 24867 - DNA, 3003 bp, Unknown; identical to SEQ ID NO: 24866
  misc_feature (1)..( 3003): 2750-1469P.txt file - cDNA_ID_2685858; gDNA_ID_2213659; Annot_ID_181791

SEQ ID NO: 24868 - DNA, 3003 bp, Unknown; identical to SEQ ID NO: 24866
  misc_feature (1)..( 3003): 2750-1469P.txt file - cDNA_ID_2685858; gDNA_ID_2213637; Annot_ID_181086

SEQ ID NO: 24869 - DNA, 3000 bp, Unknown; identical to SEQ ID NO: 13156
  misc_feature (1)..( 3000): 2750-1469P.txt file - cDNA_ID_2685906; gDNA_ID_2214602; Annot_ID_135580

SEQ ID NO: 24870 - DNA, 3000 bp, Unknown; identical to SEQ ID NO: 15003
  misc_feature (1)..( 3000): 2750-1469P.txt file - cDNA_ID_2685913; gDNA_ID_2684240; Annot_ID_192566

SEQ ID NO: 24871 - DNA, 3000 bp, Unknown; identical to SEQ ID NO: 15003
  misc_feature (1)..( 3000): 2750-1469P.txt file - cDNA_ID_2685913; gDNA_ID_2684240; Annot_ID_137766

SEQ ID NO: 24872 - DNA, 3000 bp, Unknown; identical to SEQ ID NO: 14937
  misc_feature (1)..( 3000): 2750-1469P.txt file - cDNA_ID_2685931; gDNA_ID_2684234; Annot_ID_192378

SEQ ID NO: 24873 - DNA, 3000 bp, Unknown; identical to SEQ ID NO: 14937
  misc_feature (1)..( 3000): 2750-1469P.txt file - cDNA_ID_2685931; gDNA_ID_2684234; Annot_ID_137689

SEQ ID NO: 24874 - DNA, 3003 bp, Unknown
  misc_feature (1)..( 3003): 2750-1469P.txt file - cDNA_ID_2685940; gDNA_ID_2684130; Annot_ID_191200
ttgttcacttcaggaagtctccggcagtatgtattttgctcatttttatactatcttgttatgtcgccgcgaaaatagcggttttggagttgtgtttaaagcagcgaaatcttggttttcttgaaggtaccgtaagaaacatagaaaggtgaatatgaaggctgtcaagtgttgggcgagacagattttaacgggattgaaatatctacatagtcaagatccgccgataatacaccgagatatcaaatgtgacaacatttttatcaacggtaatcatggagaagtgaaaataggagatcttggtttagctactgtcatggaacaagctaatgccaaaagtgtgattggtatgagcaatgctttttcttttatatagtttacaaattcgtttttctttgttttttttaggatctaaattgatagtgttatgttataaccaacaggaacaccggagtttatggcgcctgagctttacgatgagaactacaacgagctcgctgatatatattcgttcgggatgtgtatgttggaaatggtgacttttgaatatccttattgtgagtgtagaaactctgctcaaatctacaagaaagtttcatcggtaagttcgatattttcaaattgtttctaccattggttttatgatatcgaacaatatatgataatatgaatggataacttacttggtgagtcttttttttgtattctttacttaggggatcaaaccagcttcactatcaaaggttaaagatccagaggtaatgaaatttatcgagaaatgtttattgccagcttccgaaaggttatcggcagaggagcttttattggattcttttctcaatgtgaacggtttagttatgaacaatccattaccgcttcccgacattgtaatgccgaaagaaggatcattcggtgaacgttgtcttatgtctgaaggaccacctaatgctcggaatagaacgatgtcaatgaatcttgacgaagacaataaccttcctattgttatttcaagcaacaattcaggaacaaactgtattgaggttagacgggcaaagcgaggaaacttttttgtccttaaaggtgaagagaatgatgagaactctgtctcattaattcttcgtatagtcgatgaaaatggtaagagtcttttgcgtttatattttacaaaacatttcaccgaaaatgttagatgcatatacaatcagccaaaaattgcgtttggaaaattgcatattataccaaacttgattagttttgtcttctttttggcgtgtagggcgtgtgaggaacattcattttctattctttcaagaaggtgacactgcttctaatgtatctagtgagatggttgaacagcttgaattgacggataaaaacgtaaagtttatagcggaattgattgacgtgttactcgtcaatttgataccgaattggaaaaccgatgtagctgtcgatcatctaattcatccgcaacagaaccagagctccaaggataatcatcaaaacggtgcaagttctcaagctggtgaatccattagccactctttgtcctctgattattgcccacgatccgatgatgaggcaaacccgaccgtagctgcaacaacagaagatcaagaagcagagaaaccaggaagcttggaggaagaagaagaagatgagaggttaaaagaggagttagaaaagatagaagaacggttcagagaagagatgaaagagataacgaggaaaagagaagaagcaacaatggagaccaaaaatagatttttcgagaagaagatgcaacaagttgagtaaagtaaacaacagagcaacactctggttttggattcctctgttttgcttttctgtttttccatgttttattattttagttttggtcaaagagaaaaaagcttttgttgtttacttgtttcattgcaagtgtagaaagtttcctccataaaaaaaatagaaagtattttctaatggtaattgggatttacattatataaagcactaattgctgagataaaaccattcatcaggtatatatgtaaaactattctcgagataaaacaagaaagtgaatacacaattttcttgcctctattcataagaaataaacctgttttcattgtgtttatttaacaccaaaagcactcaaaattgaggcttaacattcagacaaaccgtaactatagaacataagaaaaacctaactattgaagaggttgcattatatcacaagtttaaaacaccaaagctcaagctgagtagcaaaaataggtctcttcttccgccaccaaaacctcaacaggaacgtctacaaaagccttgaccgccacaacgaccaccggaaaaacgaccaccgacgaaaagaccacgaccaccaccaggaccaaagacaggagtaccaaaacggctataaggttcctcatcagaagatgatccatccacagacatgctctctgcctgggctttacagagccaattttaacttcattatttgacctaaacaatgagatcaacagatccatcttctcttccattttatgaagacgaataccaaatccttccaacatctccatcgcatcagatattttcatctcagtcgtcatgtctttcttatctttctccaaattgtctgtaggcgtcgtgtccttaatcacagaaggagatgcttcagctttggttgcggatttattgtccatggagaagatgattagtagaacaacgcactagagctaggttaaaagagagaaattggagatcggcaaaaacccctaatcagctgcttaggaagaaaggtatttataagagtcttttatattctggcttggggcacaagagtcctttccttttattttatttacttttcccgttgttcattttttcaactaagcaagctttatctgggccgaggtgaggcccattaattgaattaaaagcccaaaataacaacaaaacattacctgattgtcggaaaatcagacggaaacaaaagaaatcaaaaatccgatg

SEQ ID NO: 24875 - DNA, 3003 bp, Unknown
  misc_feature (1)..( 3003): 2750-1469P.txt file - cDNA_ID_2685948; gDNA_ID_2214530; Annot_ID_134249
aaaacttgagctttctttatgctacaaagtattgatggatgacgaacctgggggttacagtatgtagtatcaagaataagagagctgatatgcgatccaatcaaccaatttgacatctcttcactatagcggaaatcccccgtatgtagaacagcctatacaaatcaacagagtccatggacaattcctttgtgaatggaaagttaaacataggcttacgactacacactgaaagtttctaatttaagaacgcaccttaccgttggctggttcaaagagtatcatgatggatcccggacagtggtttgcatcaaagcatgtcacatcaatgcctgaaatattaaccttctggccaaggtccaggacttgcagtctctcccaaggtatcccaatcttcatatttaccaactttgcggtaactaaggaacagtatatcttcccatgactaaatgactttgtcaaaccttgataatctgtgaatgagaatacagagactttaagcattgattccacgatatgcaggcttcttctgtgtagtaatttataattagacatacagctgactacttacgatcgagatgaaagtgtgtaagaaaccagtggcaacaatcgcgtgtgaggtacttgaatgcgtcctgcatacatatattaaaccagaaaagtcaccaaacataaagattacttaaaagataaatattcagcatcagcatgacgttttaaatctaatttcatgagcatatttgacttgaatgagaaggatgcatatgtaataaggttgttgcattcatgcggagaagttaaaccatgacctagcttgttatgtaacattaccactcgaaaaggtgtccccggaatgcaattccaatgtggaataactttagattttccgttgttgccatttcttctcacagcacgtctagagctagaatctgatggactcttttctgcgacaggtttaggggctgtccggatcttagtgccctcggtagcctgaccagggaaaaactctgtaatcaacttgtttgcagttggttttttgggctcacttgccttacgagtggttgacttatctctctgtctctctgtaacatggccacttgtacaatgagactgtgcctgcacttcagcagaagatgcaaagggatctctaactccgctaagtgcattcacaatcttctttctgggaccaagtgacgtgatacctatgcttagaagatcctgtggaagtataaccttgtcaatactcaattctgtttctctgtgtaaataaataaataagtaaactttagttccattacctcctcagtgagtgactgaagggtatcccagtcgatctcttcacgaataaaaacatcttcatatttagctaaacctagactcctaagccatttcagcactggagacaagtcggtaactagctgaggaagctgaactggatcatcaatcgattcttttataagagaagacaaattttcgcatttcctcaaggagtcctacaataatcatatttacaaatcagcagtcaatcaatggcgtaacgatgtaacaattgaacacagtatacttcattgtattaacctaaattgaaggttgatatcaattccagttatgagataacaaagaagcttacttgctcagaaggctgattatatgacttatcaagacaagtattgctatgaacttgcctctgctcttcactcaaagatgaaatatccatggaacacaatgggcattgaattgaatcatccttgcctaaactaaactctccactcctaccctcagactcagagcaaaggtttatcaacacatcaagctcagagttagactcaacaaaaccttcatcatcctcatggattccactatcaaacccgagacaaattctcgatttcaataacctagcctccatcgaattacacaaataaccttcacgattcacctttatacagtcgtccttatcctctttatcttcttcaccaagagaagaaattggaccattgaaatctcctagagagcaatcaacactagatgggatacaatctaagatacagtgaggagtagaagaggagcagaagagatccggatccggagaaggaggcggagtcacattttctttacccgggtaacggcagagtctgggctttttgttaggagggcggtgagagatgttgttagcgttggttgggtgaagaggttttcgaatcgaaagctgtgaggaaggagggatctggaagtcgtcgtcgtcatcttcgacggtgttcgacatttagataccggcgaggcaaaagtgatagaagctccgtgttcgtttgagtgttaagtgttaaaacgacgaaagcgaaagaaagaaacgacgacgtttcggtttcaaaagtaggataagtcgcatttttatcatttgttttaaatggagcaaaattaatttttaaaaaaattgcggcaaaaacttgtgaccattttaataaacaagagggaaaaggaaaataaattgtgaagaggataagagcaaaaatggtcacaagttttacaatatttttttaaaatttcttactattaatatactagttttttcatcaccaatactcgaagtcagaccattaattatttttcgaaaaaaaaatcattatttattgtacattttttatgtgttgatttttttcctttagttttaatttcttgctttaaattagacaaaggtttttcaaaattaataatgtgggattgtgaaatactaaaattttaggtgggagaagaaaattggtccattatttagcccaatagagtaaatctatgatggaccggatctaatatttttttcagcccaaaacgttaatgttgacaaagttgaaaagaagaaatattgacagtgggctttcggaccagaacctataagtcggcattgttgtgcgaattagggttttacatctcccaagatcatttgtcggttgattccatacgatctccaagtcttgtcgttgcagaatctctaagaagctaacgaaaatg

SEQ ID NO: 24876 - DNA, 3000 bp, Unknown; identical to SEQ ID NO: 14343
  misc_feature (1)..( 3000): 2750-1469P.txt file - cDNA_ID_2685955; gDNA_ID_2684110; Annot_ID_190603

SEQ ID NO: 24877 - DNA, 3000 bp, Unknown; identical to SEQ ID NO: 14343
  misc_feature (1)..( 3000): 2750-1469P.txt file - cDNA_ID_2685955; gDNA_ID_2684110; Annot_ID_137152

SEQ ID NO: 24878 - DNA, 3003 bp, Unknown
  misc_feature (1)..( 3003): 2750-1469P.txt file - cDNA_ID_2685961; gDNA_ID_2214694; Annot_ID_136779
caatatatcaggtatgacaaaagttcatcatgtaatgaaaaatgcgaggtataagaatcctaaatataattaatcacaccttttctggaatctaagacagtgccggtcaccatcatgcctgtcgaagtcatgtgtcaagtcctctttaaggacatcatacgtagttaaaacaatgtccgcattgagaagttcagtaatgtcaatcataggttcttcagaaagtgaggcgttcctcacaccttcatagatacatgttatgagagatcccaagcgtgtatggctacaacatgacagatgaaagaaggaaagaggactcacattacatgatgtggagatacacaaaaaattacgtctagtgaaagccatcttgttaagtgttcctctagtcaaaacataacagaagggagagaagaatctcataccgtgtaatctcggaatgccattgcggtaatataggagctggacagacaataagagtggcacccgtagagatgggagaggcagtgacttgtagaagttcagagcacatttggcaaatatattcaccttctctgacaataatttccgttgcatcctttttgctcttcttttgagatgctttttcatcaatatgttgactatccttcttacctttccctttaggtgaataacctacacagtcggcatgctgccaagcatcacaaaggtcacactgtacccaaactcctttgtatttgtgactttcactgacagctccacatatgcactcaacacgttctcttttcaatcttctcaagccagcgttcaaaacatcagtaactgatgaaccattagacacagaaatttcatcctccgctggttttcgatgagaaaagatacaagcaagtagttccaccgtttttcccaatcccatttcatctgcagcattcgtactttaccacattaagaacgaaacgcatgagaaatattagaggtagacaaagccatatacaccatctagcatttaagacgacttaaaacatatatttctgaaaatattctttgtgaaagcaagtcaaaacaaaattatccttgtaaataattttctgattatatagtacatggaggcaaaatgaagccgcaaattgttcataccagcaaggataccgccctgaattcgaggtgaaaaatactctggtgtcaatgagatattcccactaaaaacaaccaaaacatgacaaattgaccagaacaaattagttcttctgtaaatggcggaacttcactgagcagaacatacactatttgttgacgatgagaggagcttatagttcaaaataaaattaaaaaggactacttagattcttttctactaacctgaatgggttcaagaacatttttgtagcagagtcaaggaatcccacggagatagacaaaggtgaaatgaattggttgtcttccttgtctcccaacgttattggatcgcctctctctcgctgaaccatccaataagctgcccgtcgttggtacggcctaagttctgggagcaaatcagctatgtcatctccaagcattgcatccgtcctgaatcgatattgtgctaataagttggaaagataaaatcagatattaaggcacataaagagagaaaaaaagttgttcactcactttgatggctttatggcttcataaaaagcagcagcatcaaaactagactgcttactagagtccaaagtttcatcttccgtcacaactgatgactcaatatccttgacgttgaatcttgtcccatacctagcctctgatgtcattacctctggcctcaaccaagacatgacatgaatcatactctttttccaaatctgccttgtattctcaagaagagaatcacatgcatcaaaagcctgctgaagcatctcaactctaactctaggagacaacaatccctcattaccaggcatgagccttaaagtcaaaaactttatacttgccaaatgagcaagacccgaaaccccttcacctggaccatcaaaacttgcagaccaaatcactgacccaacctcatcatcagacaccttattatcaaccaattccaaagttatatcactcgaagacaaaaccggccagtgaccaagcttaatccgatcaacaaaattagtcacattgcaaagccgaaaccgtaacgagcaatccagatcatgatcaacctcaataggttttgtgaatgtactactacttcctacacgttctcttacactaaaattcgttagaacaacttcagctaaatcaaagttctgctgctgctccgaaactcgactacttaaacatatgttcacataatacggcttatcgatatcttcaacattcttgtcccctgaaccctcagcttcgtcgccgggtaattgatttctatcggattcagaaccagttggagtgatcaaacccactgcacgctggggcttggattgctttctcctacccatcactaagctaaaatagaaacttcagtactgcgaattcataaacaagataaaaaaattcaaaaacacacaaacaagctatgacctttatgcaatttcatagctcaaacccaaaaactttatgcaatttcaaaatagttattgaaccagttatataattcatacgaaaacaaactcagttacgatatgaaaacatgattccgaacctgtgaagtgaaagagaattcgttcaaaattcagaaattgcgaatcgacggagactatggaggagtggaatttcaagcgccggagaagattaatagaccgccgcgtgatataataacgtattgccggtttatctgccaattcgtttgcaccgacgtggcttgagaatgacaatagtaccctcagcttttaaataaaataacgaaactacctcctcttctctattggaactattccgattccagtaaaacggcacacaactgcaaaaccctaatctcaagttttctgtcgattttgatcttttggttgtaattttgtttgtgaaagtttcggacttttggaatttgaggtagaagagatg

SEQ ID NO: 24879 - DNA, 3003 bp, Unknown; identical to SEQ ID NO: 24878
  misc_feature (1)..( 3003): 2750-1469P.txt file - cDNA_ID_2685961; gDNA_ID_2214694; Annot_ID_189479

SEQ ID NO: 24880 - DNA, 3003 bp, Unknown
  misc_feature (1)..( 3003): 2750-1469P.txt file - cDNA_ID_2685968; gDNA_ID_2214520; Annot_ID_134041
gtgagatccaaccctatccgaccgtatatacgccatgttcagaaggttgtaaagacttgtttaccaattctataaattatcgtatgatatttttatatgttttcacacggttttgacaattattttttggaagatcacctattctgaaattgctgcagtccaaacacgtttaaatgtataatttgtttcaaaatagttgaccaaaaaataaatgtgatttggcgatataagtgacaaaatcaattcttttaaaacgggtaaatgtaattttggttttcttatcgttttattcaaacaaaattcattgtataactcgtgaaaaaggtatatgtaagtttatgttgtatgacgagaaaaatcacacgacgtcaatatgtgaatgcaagatctgcactttaaattttgttataagatctagggatatggtctagattctcatcgtatgagcctaatgattttaggattgaagtaatcgacgatttggatttgtattaacgaactgaaaaatgagagtacaaaagagatctctttagacatgacaaattttttttgttgagtatttttctgactaaacattacacccaaaaaacataagtattctttctggctgtaaccatacgtttttcttcatgtctccccttctccttttaaacgtactagttcgcagttcaaacaccacctcgatcttcgattacattttaattgagaaggacaaatattttattttattttttgggttttaaattttaaagataggactggctagatggttaaggttgtgacaaaattttcttaatgttgaggagaacattttcgttacaaattaagataatcagataaatatgtggtgatttgcaacttccgtaccttatcattattcatggtgttggtggactattcccgaagttttagcgacaaacgcaactcccgtaccttatcatcactaatataatatgattttgaatttatggataagtctagtgacatatatagtgcaaatggttgtctcaaataaagaagctgaaagaattgaaacaatattcaactagtcttttatcatttgagatgaaaaagttgaaaaacattattcaacttaaaaattgaaaaaatagcaagttataaagaaaagttgttcaacttgttcactacaatttgaatgatattgaatgatattcaatcctaaatgatttttattccattcaattttaggcaaccattcgtacccatacagaaagcaacatatatgatactgattgacaaaaccacttcgaaatggttgctccacacaaacaagaatatgagaagggcctacacaacgatattaattactgttaatttttgtttttgtctgcctgcatttagaatatggacaatatctcttcccggaatttgccatacaatcacaacaattaaagcagcgtaccataccatctaaataacagcattaatggctaccaatctcttattttttaggttagagtttagatctactttttaaaacctgattagcttgttccctctacaactataattaggggtggacgaaattttcgtcagggaaataaaaccaaattgaatcaaacagaaataaaacctatatacgttttaaaaattggtttaattatttgatcgcttgtctgtttgttctctgaagtttagtttatacaaccaacattgatatgtgtattttaagggatgatcattttcagttctgtttggttaatccggttttagtaaagctgttattaccaaactcttacaaaagtaattccgtttttttttttgttttttttttattctcggtttaaaattcgtgagcaagttatacataggttgatgacacaaaacatgatatggtgctgatggaactaaagtttccatgctagttagatcagcaaaacgcatcaaccataaactataaatggccaagattatgtcacaaacatccaggtacataattcagaataaactttttattacaaattttacgtcctaacaagtaacaagtaacagagagctcaaaaaaaaaatatgcatacagttatcgacatggctattttgtatcacttttaaggatttcacgtaaacaacgtccaggtacatgattcagaattctacactaccctttgtttgaggaagcgacacatgcttaatgcttttggccttttgccaagtgtatcaagaatggtataaactacaagttgacaatatattttaggcgaatgatttcaatggtggtagtactgggacgatacacttgtaacatttcaaacaatgcagtgacaacacaacagaacacaacacaacacaacatattttcctttgatcttgagaccatgcatcaattgcagctatcatcttttccacatactcagatctagacaaccaagataagtaatctctatttaaataaacaagcataatgtagaaaaagttatccagaaacaacaactctagtcacatataaaatttggcatggcctctgtagaagatagcaagaatgcttcatttcactattgcatcaaggacacaaaagttagtttaaaaaaaaaaaaggagaagataatgtcaaacatatacgtgtgcagatagacaccatgcttcatgtcattattgcatttttcttccctcacagcccatcaccaaagaccaagaacacacacaaaaaacttgttttaatgcgattttaatgtatttctctttacacaatcttactattttttttttatataaaacagaacaaattagtaagtttattatttgtgagggtgtttgattttaattacataccatattaataatttttgcttgggcctggaccacccaagtgtaaaggattatgaacaaaatcaagagcattaaaagcaacgtccctaccttatccgtgtttggtgatattatcaaatttttgcaaaagcaacgtacccatcttatcattattttataaagatcctatgtctatccgtaaatggactaatctttagacacacagagaatataatg

SEQ ID NO: 24881 - DNA, 3000 bp, Unknown
  misc_feature (1)..( 3000): 2750-1469P.txt file - cDNA_ID_2685972; gDNA_ID_2684203; Annot_ID_137253
cccttaaaagctttctttaagaaacgctcgtcgcttgcatctccagtcgtcaacttcacaattataattccactcaatgtttgccaacgtaaagagaaacaacagatagaaccaagagtatatattcaatgaaccaacctcaacataagatccaaaagcttccaaagcctttcttttgtccttcacaagtgctttaacccgagttcctttcacaatcagttgcagtataatcatctacatcagctaagaattaacagttctcagtttcacttttaaactttcatcttgttgcatccaatggatgatgcttctgtgaaaagcaaacacacctgacccaaatcactgtctccatcagttacaaaaacaacgtctttctctccatcaagatcatcttctttttcctctgcttcattggtttcaaatgagataccaaaatgcagataagagttatgtgcaagtcctgagattccatttcaaccattttaagtatcttgcattttgtttttaatgataccttcaaattcatcgtcgtctccacttaaagatccatcctttggccgaagttcaggagctccataccatttcctaagcttgggaccgccttaaaacaagaacacacaaagaccaaactcaagacagttaaaaagtctcaatttttcttctcataaaaaattcaaattcaaatttccatggcaatgagaataccttcgatataatcgagaatctgatccacaaaactgattttcttcttagcgaaacaacgaacaagacaacgttttccagatgttatcccaattcgacatttattagcttctgagtcctgattcgaagaagagaagagtaacgaaggtccttgactgaggagacacgaaggtagagaagtacccgccatgtctgcaaccacaaagataaggtttcgtcctcaccttgcttctactgtaaatctctcaacagttcacagtaaccctctagatgagaaagaggtttctctaaaccgggataactacaaaaatacctgctattggatcggataagattgttatgcaaggtgtccagagcaagtcctttcattttgcaaccttatctcaacgttcttctgctgataaagtttgggactttcttcataaaaatgtgtgcatgctagtttctagttttgttctctctttttttgtgttatcttctatgagtctctttattcatagatgttttcgtttgattatatataccttagtcatgttatctatttatgatgtagctcgttcttacttgagattgcactagtagtcttgcttaatgacatataaatcttgatttaaactccctctggatattctttcatagagaaaaaaaattcttatgatgattttattgttgttgttacttgttttctcagcattgatccatctctgctcaatccttacaccaaattttgatggtataagaggattcagtgacaatgcttatattaaaaatggagtttatagtctctctgaactatctatgtccaagttcttgggagttcggaagcaccttacatcgttgacatttgttctaagttttcctatgacaattcttttcgtttgcacattcagagatcagtttgagatccactaaagttgatgtggtctgatactcacttcttatcccaacctaatcaccatgataacttagtgcttttgcttaccgtcctaatggttttgtgtttagtttttttctttttcctttcaagtttccattgttgcaggagaaacaggtctactcagacatgcaacttccattcatgatgcagcaaaatgatcattgttgcaagagaagagaagtccacaatgatgtctcaaggatcaaggacattatttagcaacaaagaaatgttgatttatgttttcaactatcatgtactaagtaataattcaaactttgtgaaacatctaacaatttgagagcaaaaaaattacaaattaacatatgagtgtcaaattcacagacggcgtgcaatcctgatctagatagagcagacgacacggcgtgtcttgcacacgtgacctaaaacggaacgtagtttactctgttttggcatattaagctatttactgacgtggcaatgcttcgatatcggaccaaagctgaataggtatatacggattccaaatcacaaaataaagttatttttgagttaataaaacgctttggagtccgggacctgttaattttgctctaagcactggaaaaaaaaaaagcctaaagggagccaaacataaaagcagtaccaaaaatttccacttttctttaaccttttttgcttgtctaagaaacttctcctctgaaatcatcgtagattaatctgttttcttagacatgattaagtctccgacgctttgaggtaaccggaaagtgtaatcaatcgcttgttgctgtatttgtcactctccggcgacaaaacttgatttccggtggtaagcaataaaaattcaacctttttttaattcgtttctacatttcaagctttgattttgttctttcttaatatgttgttgttgtatttctgtgttgtattcgtaattcgatctaaaattgtcaaattgattgtgagaatgcaaggtcttagtttgtcaattgcgaaacttgtgaattctttggaatttcaattttttaatctttcttaattttgtatacttagtgttatacttaatattcaaagggctttacttttgtttgataatagatacttctcactttggggctgctttgttttcgtctgatggtgttatttgtatgagaatttgctttgtgttcaggtttttggtgtgaaattgtacagagatgctgtcaaatagtaaaagaattgtttttttctttggtaaagttatatgtagtactgaaacatgctttggtagattggtttttttagtacttgaagaatatattgagcatatatcaatttgtttgctttttctctgtttgggattgcagatagtgtgttcctaagttagatttgcgatg

SEQ ID NO: 24882 - DNA, 3003 bp, Unknown
  misc_feature (1)..( 3003): 2750-1469P.txt file - cDNA_ID_2685976; gDNA_ID_2214523; Annot_ID_134110
tcatagatcttgcaacaaagaagatgcatgcggctgtgactgtttccgatacaggtactttggctaatcggatggtaacgataaagaaagatccttcttttgatctattgaagaccttttgggttaatctggatgacaagaccaaaagagaacttttggtggtagattctagaaagcttatagactatgtagagaataagtatgttgacaaagtgaaagaagattttgggaaatgtgtatccgttgccaataatcttcgatggagatactggaagtgccacatttgttctcaggtatactactgttttacagattgccagaggcacatcttagataaccatgtgcaaaaatttgtacccgatcccagtgctcgtcctaagtgtgtggataaggtattagctgacatgatatgttgtgggaaatgggagcctgtgaatacagtagcggcagcaaatctgatcaaggatagagctaagcgcggggaagagtttgtttatgttaatggatggtgtagtgattggcctgaagctaaggatgaagagcggagtaaaatactcaaacagtttgctcaggttcttaaatcttcttgtaatgaaaatgatactctttcatgtaccctttgggactcgttgatatattacacagaaaggaatctgcaactacttgaagttcctgggagctatcttgataaatgtagcttctttaagaaccctcagtgcatctgcttcttagatcttaagcaccttgaacacatcctcaactattttagacagctcaccacagatgtccgcgcgagtttagttccaaaagtagtgaataggttctgggaaaattcccgggtcaaggaaacaatcggtattgagcgacttacatctaatctgcttcttgatgggagactgctgtgtgaagaagagcatcattttgatgacacagggagtgtagagacttttaagtccagtggaatttatgagcatgtgatacctgagggggacaagatggtctcctgggttctcgactgcccagaaatggatgagaaacttgtgtctcaaatgggagagggcgtacacaattttgagatatgttagcagctctgagaatagtaaggggcatggttaggaaaaaggaaagctactatgataagagacatagaatggtaacctatgataagatgttgggtgaggctgaaaccatttgtaacagagaagacaataggaagaatgttaatcagcggagcacatatgcgtcagcgctgcgaatgaagtgtgaggagcttgtagtgatacaagatgatgataccaaatgtttcttgaatgttgtaagagatgttcttgaaagagcaccttctccaaaatatgaagtattaaccgacaaagagtatatggagagtatatctgggctatctactgctgttcaaaatgacattgttataaaaagtctgtggaagctacgaaaatttctgacaaagaaggtatgtattcttcgtcttcgtttctttctactcattataacatgttttgacctgtggctactgataaaaataagaaatcttgggtattttttgcagttccatttgattgattcaaagatattgctgaacgaatttacacaaggagagctacatgaattcccaaagctatcagcaattgagtatcgcatggtggtccttccgtttgtgaaaaagtttttacaggtttatcaacttacggaaattatcaatcacagggaactcacttggtgtttgttacttaattccaacacaacataatttgttcttctcgcagggtaaactgaagaaaatgatcatgaaaactaaagaagatgacttcagttactgaactagaagctaagaagagagctctgtaaaagaggtaaaaatctaatgaatcctatcaacagttgttgttttggtgttgttctttgggttaaatttagttgtgttttttatgcagggctacaatttttgaggatcattcttgcagatgaagaagataaacttcgagtaggagttgtttagaaaacagtcttttatgttctcgggaaaactttgtacccgagagaaaactagtctgaaaagttctagtttgttttaggatctgatgcatatacgtttgtgtgtctcaagagagattgagaaacacattgagaagtggtgagaacacatttttatcaaagtgaaaattgtaaaatgcctcttaaaattgttgccgtccaaaaaacagacgttaggtggtcgtttagatttgactaattgtttatgtcgacaccaaatccaaagcccatttgacccgccttacaaaacaaaacatcggcccaatctgtgtccccaaaaaaaaaaaacttaaagcagacgtggcagaccctgattcgttacactatcgtgtcgagcatatttttctcgcgtcgccacgatttggcaataccctgagaaataaataaaaatcgaaaatggattataaggtgaccttcgtctttggttgaccatcaaaaactacaacgctctttctccgtaggaaaggggaagcaaataaattatcgaagcccactggtttcggagctgatcggtctctatttctctcttcatacatatctcgtaagcttctcctccctcttttatcttcttccaatctcctcaattgctttctcctttaatgttttcgtttctccaatcgttatttgtgagtcttttctattcagatctgtgtgattgttgatctctgttcttagatctgtttcgcgttttctagatatcgaatttctatgtatgtaatacgatgtagatcggatgcgttattgtagatctggtttttttggatcgactgagtcaaaaatgattgactcagtttacgaaattgttcagttacttagctgcgaaaactgtgattcgtgaattttgtagctagattatgaatgtggttgcatgcgtttggatttattgagcttacttggaagtgatttgtgatttattattacagaagcagataaagttgatcggatactagaatg

SEQ ID NO: 24883 - DNA, 3003 bp, Unknown; identical to SEQ ID NO: 24882
  misc_feature (1)..( 3003): 2750-1469P.txt file - cDNA_ID_2685976; gDNA_ID_2214523; Annot_ID_184677

SEQ ID NO: 24884 - DNA, 3000 bp, Unknown; identical to SEQ ID NO: 11729
  misc_feature (1)..( 3000): 2750-1469P.txt file - cDNA_ID_2685989; gDNA_ID_2214513; Annot_ID_133888

SEQ ID NO: 24885 - DNA, 3003 bp, Unknown
  misc_feature (1)..( 3003): 2750-1469P.txt file - cDNA_ID_2686029; gDNA_ID_2214492; Annot_ID_133487
ttgctagtaaagcctaaaaagatatcattctgcttccaaataccttgcattaatttagaattagtattgctaaattgtaacaacatgccatcatatttccatcattgagttttgttatggatttggcaaacaacccaatctaagtcaaattcattgcatgcaagatcatactaaatgttgtactggagaaagcacgatattctatagcatttttttttgtttaaatgttaattccattgtagtaagaacaataatatatagtttagaatctgttattacaattcaataatcactacaatataagtagaattcaaatgaaagtgcataaatatttgtatacgtcatgtatataaaaaacatataaggcctagatatcttcataaaagtgtttcttgaaggcctccatgtgagccacctgtagacacgtcgcgagaatcaccgagccatcttcgttttgatccggcaagatcagcgagtcgccgtcaaagtcatgcgtgcctggtcccgtgtagaactctttgccccatccgaaatcaaggccgtacattggcaaagttaaccagctcaccactccaagatttgggtttccgtagaatggaccttccgtgcttcccaaggcatgtagatcttgaaacttcttcagatctttttggttcttaagatactctatcccaatcatcacgtattcgtttgttacattctttatggctttactgattaaactcgccgcgaaacccaattcattcgatatcagttcacctatatgcataacaaaattatcgaaacagactttgcattgtagaatcagtacgtactaacctacatttacgtggatgaaaagcaaccaagaaaagtttcatatatccaagttcttcagataattttaattgttcagcaatagtagaaattaatgataatccatcagtttcataaaagagtcgttttgacggtcttttgacacgaattctaagataaacaaattacaatattttgtaatatttttgaattgaaaaaaattaataaataaataatatatataattggaatataaaagtaatgaacaaaatcataatttttgtttagaggactaaattaaattttgaagaagtgtattcaaattcacaaaacaaacaaaatttctatggatagtaatagaaaagaaagaaaaaacacgtacctgaggtgcttgctgcgaccacgtcaagagtagcattgccgaagtagccgcgtggcagaggtggctccatccgactacgagtatctatacagattcctagagccgttggttgctccggagagtggccacgtgctttacacgcgcacctccacacgtgtccggtgacggtctcgtaccttgtaaaccctttcgccgggtcagagtgtttgcttccgttggctttacttcgtagcttctgcagctgagatgtgctcagtggtagcatcaccacaatcgttttcttctttctctcttctacattgtccgtttctccgatcaaaaacggtggctgatcaaactctttgtggtcgaactttgggggcgacacaaacggtgggagcggttcaccagcccagaggattttccggtctagaaatggaacggtttctaacggttcaccgcgcgcgagtcttccccattccgatattaagtgaagcgcgctttggccatctacgatcgcgtgggaaacgttgacgctaaggcttattccaccgcatttgaatttggttacctgagctaaaaatagaggaatcgtttcgatagggtttttatagtttacttgcggcataagattctcgaattccggcgtaggagagaagtctttgaaatccgaaagcttcccctcagattccgcttcaatgaattccactccctcggcgttacaattgagctcgaaccgtccccgagggagccatctgagacggccagccatagggtaaaaatggactagcacacggctcaacgaggtttttaggatttcgactacattgccttggaaagattcagatggcttgtcgtaaaagtaaagggtgggaatgtgagtaattgtaccaacttgatcccactcggctaagggaaacctaccgctccacgttggttcggccggtactatagtgtaagattttctaaaagttatgggagccataacacaaaccccctttctttttctcttctctttttgaagttcgtgctaaagtaatgtttatatagtacacagaatcatatggattcaacgaatttttcttgctgttagtcaaaattcaaaaatgtttttctcgtggtttagtttgtttccttcgaagcagcttaattagtggaagtgagaataaggtttagttttgttggttgtatatgatcacgcgtattacccttcttctctattttgttcacattgtggatgaatatatatttccacgaaaaaatgaaaaaaaacgaggtaagaacatataacataaaattcatatcactattagggaatgtgttatacttttttatgcaagtatattccaaagtataaattctaaactaaatccttaagtatatatcataaactctaaaaagaaatggtaaatccaaaatactaacttcatagcattaaattcaaaagcccacatcgccagttttgattatatcttctgaatttaagttgagtttatttttataaagtcatcttgaagaaaaaaaatgtggatgatgtattttacactgttacacagtaattttagtttttacaaactaacaaaaaggagaaaacaattccactttctccgagtctcctcctccagtagttttgtcttaatgggtaatttgtgggccttttaaagcccaaaatgagttatcgtattaataaaccctagttttaaacccgaccgactaaaccttaacccagacccggactcgactggatcttctcttctcgccccatctctctctatcgacgatcgaacttacttgagtacttcttcttcttttgaccagagctctcacacatacgagtcactataatg

SEQ ID NO: 24886 - DNA, 3003 bp, Unknown; identical to SEQ ID NO: 24885
  misc_feature (1)..( 3003): 2750-1469P.txt file - cDNA_ID_2686029; gDNA_ID_2214492; Annot_ID_183707

SEQ ID NO: 24887 - DNA, 3000 bp, Unknown; identical to SEQ ID NO: 15037
  misc_feature (1)..( 3000): 2750-1469P.txt file - cDNA_ID_2686032; gDNA_ID_2684256; Annot_ID_193130

SEQ ID NO: 24888 - DNA, 3000 bp, Unknown; identical to SEQ ID NO: 15037
  misc_feature (1)..( 3000): 2750-1469P.txt file - cDNA_ID_2686032; gDNA_ID_2684256; Annot_ID_138104

SEQ ID NO: 24889 - DNA, 3000 bp, Unknown; identical to SEQ ID NO: 7523
  misc_feature (1)..( 3000): 2750-1469P.txt file - cDNA_ID_2686130; gDNA_ID_1621150; Annot_ID_56845

SEQ ID NO: 24890 - DNA, 1671 bp, Unknown
  misc_feature (1)..( 1671): 2750-1469P.txt file - cDNA_ID_2686217; gDNA_ID_2653; Annot_ID_145840
aggaattttggcaaacaattatgcatcacctacataattgtttgtgtaagtggtgatgtatatattttattctttcgaacaattatgcgaatattgtcaccaaaatatgaaaatatcgatgttatctattcatcattaaattacccgatccagagatttataagtatttaactatttatcaaattctaaatcgatgttataagttgtagataatttttagcaaaaaaaagttgtagataattgatattataggggagcccattccaattctctcccgaggatggatcccgtttaaattcgtaagtgggcttataagttgaaagcccatacttatgttagaagttaaaagcccagctaaataataatctctgtagtgtttatagtcgatgttgggctattgaccactattttcatcatgcgtgacgtaggcgtgggaagtattatttgtgtgatccgagatctgatccgaatttgaatgtagctgtatgggagaaaagccgaacgtgtatattatccttttgacggcgcttaaggttatcttatactagtatatctcatatttttcttacgtaaaaagtcggtgatatgttattgaaacgtgtcaccacaaacgtaaacctatgatctgggacatgtttgaaaccaatgaacttttcaattaaactcggacatctatttgtatctttctgtaaacttaaatattagatatatctattgatgtattatgttgattttcttattcttagacgactagcaatatacgtaatatggtcaattagaaatttagaaatctcaccaagtcaagcactaatctatacagaacggcaaatccttctaagttctacttctaaccaaaccgtatgatccacatgaccatatgagagtaatttccaagagactatcatgatgcaagaacgaacataaaaccatctaactaaaaatttagctcacttacatgcatgaacaaaccaaattgcctcattgaaactgcctacttaaaacatgttataaaatcaagatttttccttgtctttttcttgattcgaacaaagaaagagttaaacatgttgacatacaaatcaacaaaagaaccggcgatggttaaggaacttcgacaagggaacccattcgtcaaaagtagtttgttattcgtttaccggtttttgatattagtaccagatttgtttttgacatcttaaagaacgttaagattgtttcgtactatttaatagtttcacacttattttatactgtatttagaagcttgtttctccaattatctcatttggtaaagacgtttcattagcgatatcgtgttaacgtcgaaagtcctcctctcgttacggtccggtccgacacagaaatttttatttaatatttactttattttttgtccatttattagaaagaaagtcattgattggtgcaatttattaatataaatttattaaacaactatataaactcctcattactgcccattaacgagcttcccttttcctctgttcttcactttaagaaaattacaaacttttatcttctattggacgaatctttgatctggttttaattaatcactcgcttactttaggatttttttacctgaattcgaatatatacttttgattttcatcttccgtagtcggtaccatagaattgaggagcttcatg

SEQ ID NO: 24891 - DNA, 357 bp, Unknown; identical to SEQ ID NO: 132
  misc_feature (1)..( 357): 2750-1469P.txt file - cDNA_ID_2686240; gDNA_ID_2986; Annot_ID_146081
  misc_feature (25)..(25): n is a, c, g, or t

SEQ ID NO: 24892 - DNA, 520 bp, Unknown; identical to SEQ ID NO: 217
  misc_feature (1)..( 520): 2750-1469P.txt file - cDNA_ID_2686284; gDNA_ID_30662; Annot_ID_146827

SEQ ID NO: 24893 - DNA, 511 bp, Unknown; identical to SEQ ID NO: 226
  misc_feature (1)..( 511): 2750-1469P.txt file - cDNA_ID_2686295; gDNA_ID_30985; Annot_ID_146899

SEQ ID NO: 24894 - DNA, 974 bp, Unknown
  misc_feature (1)..( 974): 2750-1469P.txt file - cDNA_ID_2686302; gDNA_ID_77479; Annot_ID_147183
tcatgacttatgatcgtgtaagawttttatttttctgaaaatatttcacacgggacctgaaaacgaaacccatgtcgtcttaaagtcagattctcaaacactttctcttgacaacattaatagccaacaatgagatgtgattagatgaaaattgtaataattcacaaagtataaagaaaatgatgttaaaactgaaagccaaaacaatatatggaaaactgaaaattgtaataattcagaaattttacaaatttgataccttaattgaaattacactcgttgtggttgacctcttcttcagccataactgacctcgaatgagaagggagagtgaagatgaattttggtttgagaatggcaagcagcaaaaaaaatgtaaggattgttaatctgccatggcgtcatggtgtaaagcaggcggaaaagaaaataactgatccgaatgtgaaaaatttgagattcgtaattagaaaattgcatagaagatgaaacaacataaattagcaataactgttgcaagatatggggaatggggaagatagtgatgaagatggcaagaaagaaggaaataaattatggattaaatctctttaataatttatgttaatgagaaaagaattattgttttacgcttcagaaaaatcaaaactcaataaattgagactttgcttacgtgtaaacaggagaatgttgcagtttgtgataaagtgactgttgatttagtagatatagattatagattaaaagctgacccgggtctaaagtatgtatggaaagccaatatagcatcgtttcgaccattgcaataatattgtgtggtgacaagcaacacatgatatgtccgtttagaaacagacaaaacaagaagaagaaaaaagagtcgtggaggattcttcattcttcctcatcctcttcttcaccgattcattagaaaccaaattactaaaaaacgtctatacacgaaaaaacaaatg

SEQ ID NO: 24895 - DNA, 3000 bp, Unknown; identical to SEQ ID NO: 14931
  misc_feature (1)..( 3000): 2750-1469P.txt file - cDNA_ID_2686404; gDNA_ID_2684234; Annot_ID_192371

SEQ ID NO: 24896 - DNA, 3000 bp, Unknown; identical to SEQ ID NO: 14931
  misc_feature (1)..( 3000): 2750-1469P.txt file - cDNA_ID_2686404; gDNA_ID_2684234; Annot_ID_137683

SEQ ID NO: 24897 - DNA, 1165 bp, Unknown
  misc_feature (1)..( 1165): 2750-1469P.txt file - cDNA_ID_2686424; gDNA_ID_1591787; Annot_ID_151502
aaaactatgcctatatatcaccgtgagtctttctttttttgggattactttgccagtttgcctataaccatgtcattgagtctatgactacaacatggcattgggtttagatgtagtggtcaacatcttatagttattgagatattgagtccattggtaataaaaaaactcggttaaagaaaagaaaaaccggtttaaaaacggtataaaacatgtggttgaatgattatgattagtgaaaacaaaaatttgactaaaaaacttactaaaaaaactttaattagtatacacacaccttgcttccacttaactatcatgaagccatcatcactgggtttacatcggctaagtttatgaaagtgaatgtctctataaatgcttactctctttttaccatacatattagcctagagaagtatgtagagttcaagtttccaacatacattaatttgaactcaatacgtacgtgaaagcaagccttcctacatcaataaagaccgacctactagtttcttcataaatcagatagaggccgtgtttgaacgtagatgcgacttggtgtctcaatgagtgtaaaataaaaacctaaaaaaggaaaaaggtaggaccaaacacgccccatcccttaatctcattattatcacctcttccacacgttacctccctgcaaacctcacgctccttccctcataacacgtgactctcacgctcctccacctctcaaaaaaaccaaattttccttgtaatttacttgaaccaaattcatatattcacctaaacataactaattcttgatctaactttcgaaaattttcaaattaaaacatctcattgattccaaaaacatactttattgttttatatggttagtattttaatctttatgtaaaataaaagacgttggaattggaaattactactagtagattgctttatcagaattttataatctatacaatgtaaaaagccgcgtcatctgttcaaaaattcagaagatcagagtcacgcctatatttctctctctcccgtcactctcactcttcctcttctgcttcttattattacatcgatcctcgttgtccctcctctgtttcttcaatatctctttctctccaacaaaatcaaaatcaagaaaacaaaaaagaaaaactctcaagaaacaatg

SEQ ID NO: 24898 - DNA, 3003 bp, Unknown
  misc_feature (1)..( 3003): 2750-1469P.txt file - cDNA_ID_2686462; gDNA_ID_1974091; Annot_ID_180598
ttggtgtaaggcgcaggagtcatgaatctgtagtagaaaggtttcatttcaggatcatcctccgggccagtcatacaactcccgcttgtactcatggagtcttcttcgcttgtactcattatggacttgttgctgtcatccatcgagtcttctctgccatggaacgaaaggctgcttctcttttccatggtcttttcgggttcgctgttggtcttctctgtttttggttcttcagtttccgtctgcttatgaatgagagagtctggctcaaatcaaatggaaagatgtatttaaagcagacaaagaagacgactcacatggacatgatgatgatgaggtggtgtgtacaatctctgctctaaagacttggcatcccattttatggagtactctctggcgatttcctgcagcagctccactttcatttcctttgacggcggctctgctttgaatctctctacaaactgcaacattcctccgtggagtcagcgaccaagtggcagagcatataaaaaaatatagtcaacaaagaataaatacctcagggttcacaaactgatcaagtgtgtttccgtatctctcagcaaataaagatctgaggtcgcgtagctcagggacttcagagactctagcggctgcatatacaagggaggagatggcctcgcggcactcatcagggcaccggctgctcaagcaaaacccaatatttatttagatgaatggaatccatgcaagtaaattaaacaagtttagggttagtttttacatggatttctgtaatagagagacattggatgcaacacagttgcagaattgctccaaaaactcataacaagccagcctccttttctcctctataagcccttctgcctgtcacacaaacacatgccatcagaaccatctctctatgtacttactcatgtgacttataacttaaaacaggggccaagaatttcttaagcaacaattcactctgttataaccagctggtgacagcatcagaatgaaatatatctatttctttttttttgcattgcttccatctatacccaaaatagaaccaattaacaaagatttaccgaaaccatcgtacgttgaccctctttcagaaaagaaaaacaaaagaaaaaaaaaatcattctgatggaaatgtaattgctttcacgttcggaaaaccaataagatcccgtgattcattaagtcgatagaggacatgaataacgtgtctataactccaaacaaacaaaaaagacgcaatagaggctgccatatgcatgtaataaatgggggtaaaagaaaatgatattaccctgccatatgcattgtaatcgaggctgttcttgagaagatcgacaatgtcgttcttgagatatttgcaaaccgagtttttcttcctcttcaccgtgtctactcttgtcttcgttatcttgaccaacgacttgctgagaaatataattaaaaacaatcaacgaatgaaaccaggaaaacggaaaataagcagagacttaccatttcgtataaaacttgggtttgaacagcccatcaaacattttgcctttcgaaaaaaaaacagacaaggttgtcttcttcttcttcttcttctttttttttttttttttgttgtttttttttggggggttttgttatctctctctctttcttcgtgcaagagaaagagagagacagagagaagaaatgtggtccttttgagaaagatggcgctttaaggtaagggaagggcttttataaggaagagagaggaggtaatgaaaaagaagagaagcgaccttggcttggctcggtcttacatgagatctgaagaaacggacttgtatcgcaagaaaaccatggaaccctgtctccccgcttttttatccacctctctttctctctctctacgtacatgtacatgtattgatttagagctgtaattactaaaacagggtggagttcccgcacgataagggtgttgactagggtttgtttcggtattcaattcttattttttccgttaaaactctttgttatttcgcaagtgagtcagtgatgatgacgaatcaattcaatcattatgttctctcatatatatggtttacttcaattccatcatctcattcattcattcaaaacatgtgaccattttatttgaaattgttaattgttatatataaccatggatggacacaagtgttggagaaccccaattgggcccataataaaagccaagcccatatgacaaggtatgcctgtacatctttagggggtttatatgtctctgatgagtacaacaaaatctgaatatggttgatgagcttgaattatatattgtcttaattccttcgaaaacataagtaaatcatttggtaacttgacgtctctctactcaacctttttttttgttggcgttcttgtctctttgtatagaaaaagatgttcatatgtttgtgtactctacgttacttcttcttcttcttcatgtgacgatgatggggattacgtgcaccccttcttccttaaacaaaatccattagggagttactttttgttttgatagtgtagttgtagtggagcactgagagttatcaaatgaatgaggatctcttgaataataaagaattggagtgtggaattaggatggatctaatttcattaattaaagaggagcatgattatcattttttgttaatttaatttaataatggttaatgtgaaaaacagaggaaactagaagaagagagttttggcaggagatgtaggtggcgggagtgggttgggcgagagagatgatggtgacggtgcagctccaaatcttctctaatcttttgacacttttctataaaactccccaaactgattctctctgactgcctcataagtcattataatagtttcccccggattgttttttctttctttttgctaatcatcatcggtttcttctaatcaaaaaaaaaaacaaaaaaaaaagagggactacgttcgtacaatcccatccttggtatg

SEQ ID NO: 24899 - DNA, 3000 bp, Unknown; identical to SEQ ID NO: 14655
  misc_feature (1)..( 3000): 2750-1469P.txt file - cDNA_ID_2686488; gDNA_ID_2684211; Annot_ID_191505

SEQ ID NO: 24900 - DNA, 3000 bp, Unknown; identical to SEQ ID NO: 14655
  misc_feature (1)..( 3000): 2750-1469P.txt file - cDNA_ID_2686488; gDNA_ID_2684211; Annot_ID_137333

SEQ ID NO: 24901 - DNA, 3000 bp, Unknown; identical to SEQ ID NO: 10266
  misc_feature (1)..( 3000): 2750-1469P.txt file - cDNA_ID_2686506; gDNA_ID_2213640; Annot_ID_132251

SEQ ID NO: 24902 - DNA, 3000 bp, Unknown; identical to SEQ ID NO: 10271
  misc_feature (1)..( 3000): 2750-1469P.txt file - cDNA_ID_2686506; gDNA_ID_2213640; Annot_ID_181197

SEQ ID NO: 24903 - DNA, 21 bp, Unknown
  misc_feature (1)..( 21): 2750-1469P.txt file - cDNA_ID_2686513; gDNA_ID_93827; Annot_ID_147277
atcgtcagtttcataacaatg

SEQ ID NO: 24904 - DNA, 3003 bp, Unknown
  misc_feature (1)..( 3003): 2750-1469P.txt file - cDNA_ID_2686513; gDNA_ID_2684211; Annot_ID_137344
aacaatattacattgagaagggaactctaggtatcaggcgcatttgatgtacttttcgttgttgtgtttatcttaaggcttctctcacatcaaaagtggtgcaatcaaacagtgtatgtttcaccatgtttacgattacagatgtctaaccaaattctaagctcttaaaatgggcaaaatacaatcaagagaaaaagagccaattcatttctgacaattcttaatgtaacaactccagagaccattcacctgagcttccaaccatcaggtagatggcactaagctcttagggtttagatcccaaagcaagaagtatcttcttcctcggaccctgcaacgaaaacatagcttgtgaaaagagagcgtaataatgttgaacgaagagagtggatgtagtttttcgcgttacaacagatcaaacaaaactgagaaattgaaattcattcaaaatctgcaagatatgataagagtgatactagatgttgtgtggcaactcaacatgaagcttaccatcggtatgagcatagccttgaggtcatcatctgtcatatgcatgagagcatccatatcaacctgtgaatgaccgaaaaggataggaacgttatatatgcatcatccataacataacataaatttcaacctaatagaagatattacatacttcttccacttgaaacgctgttgaatatttctcgagacccaatgattcaagaaagctatcaaccgatgaatcagcctgaaccagaagatgacaagcaaagaaacattagtggatggcctgtatacaagggaagagacatcgtaagctatgtgtctaactacattttcgcaccggtcagaagaatggtttctcccaagcaataaagtactgatggaaaaatatagttgaagaaaagtgaatcatattgcctgctgtgatttcttcctggtagcttgactggaagtttttctagtctctgtttcagtcgctacgctcttcatacttggcctagcagcctccgctttggattttggtgggtcactgttttttggttgctgattcattgtcccagagagctgatcccgtaaatcccgcacgcctgaaccagcttctcgcccactttgagacccatgatgtctcttttggagcttcaaacgaagatctctaggatcaaccctgcgatctaaataagccatccgatagagaatcaacaaccaaacagaaatacttttgtcatacttaattttctactgaaagaatagatgagggggaaaaacatacttgaaagttgaggtttgtcactactgaaaagatcatgctcccatttgtcgtcctgcctttgcctgaaagcatgaggaaggagaaacttgagataaactgatatgtaattaacaatgaagactacataacgagaggaatataaaccattccccaacgcaaaagcaaaaaaagttcatcacccaaaagattcaattaaattgccttaaaaccctaatcaaatcaccaaccatcaacaaaaacatcatcagatagatcacatctccagatttaactatgcaggtaggcactcaaactagagaagctcataaagctgatctaattgacaatgcagtgaagttgattgaaattaccaattcaaaatgggcaaatcagagagtcctagtaagctaacaaaaagagcggattccatactctaattcatagagcgaagcaagaatcaaacttggggatgctacaaggaagattatacacaagaggaaaagactctaacaccaagtaccagctaacatactgaagaattttcgaggaaagcaagatatatctcaatagaattatgacggagagagggagatagataagaacctcttcccagtcacttgtcgcacgcgagtagagatgtctccagaaccgccattgatacgatccttaacgaccttcctgcttccagactcagcctccaatttatcagcatacatctttatccccttggatgaaaaatacagaaatttgtcctaaccctaaattaggaaaactcacaaactaaaaagttgtgtggactattagcagctctcaggttagagatgcaaatagaaatcctagaatctacccagaaatcacagagacggaagagaagctctagaacagaaacaatccattaatgtagaaaactgcggattttgctcacgatgcctttggcttcaccaggatctacgttgcgagagagtattcgggaaattaacatccaatcaaagtaacgggtcgggtcgggtcgagaatcaggattatgcgttcagaacaaaaaaaacgataaccggtttgactgttaaccagagttaatccggcgattcaaaagacgtttcggttcgatttttctttgacaacgcggctaagcttttcatttctttttttttgttttgtcaacacgcggttaaatttttgtttgtcagattcattttttttcttgataaaaaacatccagattcctttctttgtaatgttttagattaaaataaacaaaaaatccctaaaaaacgaaaaagttttgaaacttagaaagacggacataagcgagctagcttctaagctttcttcgctaaattcttggctaattctcttctatgactgatccaattctgcttcgactccatatctgaggtttctgacgtctgattaggtaactcccgcttttgttttttttggggggttttatccatttttaatgtctttgttgtctacttgtttcaatcgtatgaacttgagacgcgagaagctcagattcaggatccctaaatttttctctatttttttttttagttttgtttcgttgattacaactagtcctaggttaaagaacaacgtttacaacttattttgcttttttcagttgtgcctaggtcacttgtccgaatctgtataattcacgtgtatcttcctggatttgattacatttcatttacttagtgttgggttttacgttagtttaagctgctgagtactttgatgttttttgtttgtagaaaatg

SEQ ID NO: 24905 - DNA, 3003 bp, Unknown
  misc_feature (1)..( 3003): 2750-1469P.txt file - cDNA_ID_2686520; gDNA_ID_2213668; Annot_ID_132724
agtgtaacccagacctccaacaacgtttacttagctaaaaccaggcgtcaataaaatgccttgctttaaaagttcagtaaattagtggatgagaatcccaaaaggagaaacagcaaaaccaccactacttgcatagatcagtactttataattaactggtgagctaaaggaatgcatcatagtatatttatatcaaccaaagagcccacaatctcctctgtggagaatgtatcaaagttcatagcacctaaactaagtaatcaactaataagagtgggcaaattaaattgaaagtgaataaacaacctccaattgaaacactgactggatcatcatgtccagcaccaaactcttcaagagaatctgcaaaggcactaactccagtagatgcctctcctaaagctcccctataacaaaaaataatgcaattcctaagtttcagaaaagacaactgaagagaaagatacaacaaggagacagaaaaaatgaaggtgagaacgagaatgctaaatctaattcattgaaaaattccttcccattgagtcttaaatggtacaaagtttaaaactttcagctttcaatggtcaaacagttcaagagaatgacttatgaataagacaaagccttatataatagagaaccagagaaagatgattaagatattacgacaaaaaacggaaacaaccaaaaaaagtaggtagagatactcttcttacatgaacttcttaacacctttgtataacttctgacaacgatctttaagctcatcacttgtcccttccaaggagaagacctgatccagtcaataaatcaatcaagtttcaaaactttattggagaaaacttgaatatatcactaatgaggtaaaaaggtagtgtacctgtttttgaaacattggggaatcctcaagattgataaaacccgccattgttaagataaaacacgaagaagcttcagaccaaaagtctacgaatcgagtcaacaagacaagacaagtaaaccctcgaattgctgtcttcttcgatttgaaaatagatctcgcgagtttcagaggcgttttcagctgtctgatgatgttttcatttgcttcgagaagagagacacagaaaaatctgggaactaaagttgtttacaaataaacccctcattttattatttattacagaaacagaggaaaataatatcagataacaaaaccatcctcatgtcacatgtcttacgaaatttaagtaagccactttaataagttcaaaatgttgttgtaacaacactcaaaaagtagaatttatccatcttgctcagcttttaggctctccaaattttccatttgaaacaacaaagttacaaaaaattctttgtctttgttcgtatgctctctaatttctctgttaaagattttgtcctcatagttgcgatcgtcatctctctgttttttttcgataacggtttttgacatgtacacccacacacaccccaaagaaatggatcgaactcattaattttaggatgtaagcaaataccccaaaccattagattgcacggtcttgctcttgttatctctcgtttgatttattctagtttctttcttctgtccaaaaacacttttatatcttcttcacggcttgtttccaaaacctatcattataatttatttccattaaaattttactccattgtgttggtttgaaacctatgtatatgatgacttagaaaaatgtgtatgtatttttagtatgagtttttaagttttacttttgatttattttggagaaaaaaataactaagattataaagtttgaggttctctattaaaaatgataatgaaaattatgttaataatgtttttacttataacaaataaagaatatgttcaaaaaccaaattaaagctagagaaaaaccatatacattcaacatctaaagaaaactaatatggtagtgcaattaaacctgactaatctcgaaagaaaaatcaaaccgaaaaaaataaaaataaaaaaataaacttctgagcttatcctatgagaaagttaactcaaagtaagattttaaaaaaatatcaaaacggaaatctgttgagcaaattaataaatagaagattaaaaatttgtacttgttgttcaagcttctttaatggagaccccagttctttatatttttttgaagaacacatcttgagaagacatctctcatcatccatgtcatacacctcgtacagcatccgatgatttaggttttgtggtgaatatatcttagctagcatcaacatattctatcaaacagttttaagattgaaggaaaaagagataaaaaagaagaggttttcatcgtattctttacatgtacattcaacatcttatcaggatatgcgccatgagcacttgttagcttgtcaagttcgaactttaaacaactagttctttacatgtacattcatcaactagttttttaccatttgagatgaaagagttgaaaaaattattcaacccattcaattttaaaaaattgaaaaaaatgagcaagttataacaacaaaatgttcaacttgttcagctacaattttggagatgaataagttgaatgatattcgatccaaaacttttcgactcaatacttttaatccattcaattttaggcaaccatccgtagccatacatgtaggattaaattccaacgaaaatcctaaagcaaatgacttaattacttttttcataatgcttatttactttcatttttagaaaaaaactaaagtaacggtcttcatagaaaccataggttaaaataaaataaaataaaaggtttttaggttccaactttactttttaccacacaccaatcatttcaacttttgacaattgcgtcaaatacatatccccaacggtaaactttactctctgccttacattattgtcatccacttgttgcaaagttccacattacaagaatcattcgattctcttctatcatcatcttcttcttctccatcaaaattcaccaaaacatg

SEQ ID NO: 24906 - DNA, 3003 bp, Unknown; identical to SEQ ID NO: 24905
  misc_feature (1)..( 3003): 2750-1469P.txt file - cDNA_ID_2686520; gDNA_ID_2213668; Annot_ID_182163

SEQ ID NO: 24907 - DNA, 3003 bp, Unknown
  misc_feature (1)..( 3003): 2750-1469P.txt file - cDNA_ID_2686544; gDNA_ID_2214701; Annot_ID_136867
ccttgcaatcctctctacgcaacttcgctcaatgtcttttgaaccatgagcagcaaactctgcaagatcaatcgtcttgcatatatgtatatatttgttcgtgtgtgtctctgtacatgtcatgtgttattgcttctatattaatggatctggactttggtgtggttgttgatttgtaactgttgaataaaatctttctatggaacactaatttcttcttgttccatagatgataagtattcttgttctatattgtattttggtggctacagtctacaattctacgcattagaaagatttaatacatatcaggtgcataatgagtctccatttatcttatttgaattacagaattgttgctgaatttaatcctagcttatatactttagatagtagatttgagtgactaataaccagggtttgttatatattatccttcaaactaaatcatacttaacatgagtttctttttttcttcatttaaaattttgtcaattggtggttttgcattgaacttcttgctttaggtctgaagcttcatactgttttaatctgcataaattgcgacagatatttcaaattaggagtatgaaaatgtaaaaaaggtcttcaagatttttttttaccatagacttttttattttttcatgataacattaatatgaccttctttttttttaacatcaacataaatataccttgtcaccacaatattcttagtttcttttcaaaaataaaaatcgtaatttttctattattacatcatattttgttaattttttaaaaaacaccacatgcatattactgtagcttcacatattggagatttggttttgtatcacgacaatggttttgttgtttgagtatcagtttagataatgcatgtcaattggttcaccccacaaaaaggcagttgttcattatgtcattttcaagctacacaagtagatcatcagactctcaaccatcagcaaagcagagcaaccatgataattttaactcaatagtcacatttggattgcaagcatgggtggatgtatgttaggagtatgtgggacacgtgccccacattgattataatgttttgcgagtattagagtttacaatggctacttagcatctttggtcgtaatgtagtaaagtattaccattcccatgtttagatccctttgatgttgcaatgttttctttatgtgtttattagttatccaaataacattattctaatttcttttttggttggtctttcttataaaaatgtcaattctaagttttgttatcattattttgtattttactaatcaaaaaaatataatattgaaacaatatatatatatatatatatatatttgaaataaaacatatattttttttgtgccccatacaaaatacatgtttagatttgtcactgattctaagaacttattttgtagaaaagtaattttcttaatattctatgaatctttcgaatatgttatgcatttacgttggaactgttaggtttctcataaaacattgtaaaactaaaatataataaggggtgtgtggaattttggctcaaaaagattgtatactttgccagatttattgattttgagactatgttgtgcagcatgtgcacaaaatttgttgattttggtaatagtgacaatatagatccaaagatgatttttaaaaaaattaagtgaatatatagttcatttttatcgtaaataattggttaaattataaaattaaaatattgtataaagagaaattaaagcgattgtaccattgtagcaaccacaaccagcatatatgtttgctcaagatttttaagttgttttatacacgattcaagcatatgatcttaatatcaaaaaggatatattaagtttaatcggctttccattttagttggtagcaattgtaaaaatttaatattatatccttatttattaaatattattattacctaaccttttttgattaacaataatcataaaaaagctgaccatctcaatttgaagataaacaaatagatttaaagaagtgatcaaatcatgtattggtaatgtctaacatgttcttaccacatcttaattcacagataaacatatacatatacattgaatatgtttttatataacacatggttcaagggaacaaaggtgggataaatcctatcatattttctattcttgacttaccttcataagtatctaggttataagtttaaattttctttataaaaaataacaatataaaaagaaacagttaaatttgaaatttactactttttaacaaaaattattcatccatctgtcattcaagtatcaatatagaaaataaacaaattcatgttgtcagccatactgcatgaacatgaatttcttttatctttttactttttttcgtaaaccctcaaaataacatcagtaaaaatggatagcaacataacagataaataaaaaccaaaaacaaaaacaaatccagggtaagttaatatgaaacaaatgcattagatcaaaaacttatttattagtgtagcaacttaaacagaaataataagtctcaaagttaattttttttttaataccaaaaattatatcttttatattttgaatgaccacgaatatctttttcacttgatcgataaaattacatcatacagtacatcttttctaaattaaaacaaatctaaaacatggttaacaaaacaaacgggttaaatgtgaataaacaaaaagtatcgggtgcaaaacataaaaagacaaaaataaaagactgagtccaaaattccaaaaagtcaaagccaccttcctaacttgtctgcatagacgaagaagacaaagaagaagagattcgatcacacaagaaaaattacaattcttcttaatcctcattattatatatataaataaacttcaatctaagcttcttcgtaatttctctttcgttcaatgttattcttttagatctcgaacaaaacaaaatctccagaagaaaaaaccaaattccatg

SEQ ID NO: 24908 - DNA, 3000 bp, Unknown; identical to SEQ ID NO: 10082
  misc_feature (1)..( 3000): 2750-1469P.txt file - cDNA_ID_2686576; gDNA_ID_2213624; Annot_ID_195776

SEQ ID NO: 24909 - DNA, 3000 bp, Unknown; identical to SEQ ID NO: 10082
  misc_feature (1)..( 3000): 2750-1469P.txt file - cDNA_ID_2686576; gDNA_ID_2213624; Annot_ID_132007

SEQ ID NO: 24910 - DNA, 3003 bp, Unknown
  misc_feature (1)..( 3003): 2750-1469P.txt file - cDNA_ID_2686579; gDNA_ID_2684216; Annot_ID_191679
acttgtacgtgagataagtgatgattcatttttcttagttgagataaactgattttattatgttcatacagtgtgtggaagaggacagtgatacggtctcgtgactctcgtatcgtcttgttcgttcgtgtgagttcgtcggtgccggctttgttggggaccttctgtctcttacggcagcttttcatatctctttgtctgttgttgtatgtttgatttagctttgaccgctttatcttcattttttgtcctctcacctacacacgtatgcctccaaagtccaaacctttttatagatttcactaaaaaatcggactaaagagaagctagagcaaacaaattaaagcttcatctacatagtacttctgcttagaaattggcttagattatctgaatatatgacagtttttacagattatgatctagttcatgatatatttcagcaaattggtatgataagcatagtttttttttttcattcttagaaagtgtacatgtaatgaatgggcttatatcttcctgccgacaacttggcaaactcgtgctagcttaaaattaaagaagacgacgaagaaggccaaaggtatattaatgaatccaaaactagccagattctcttaaatctctctttttccaaaaatattcaacaaaaataccaaaagtagtcaaaaaccaacgatttctattcgaaataatgatttatatacttgtttcaagatttctttcctccaagaacgcaaacataatttcaatatactattcatcataatgtggggctgtatatggaccatatacagtacgactctagtctaacaaataaagcatttttccacataaaaaccactgatttaaaattcggttatgaattaaaaacataacgtaacccattataaaaaatgattgctagtttcagaaataagtaaaacggtggtaattttttctagtatataggctcatagcaattgttttagtagcattaaggtagaagacatgcatatatattgtgatttatttaacacacaaaaaacaatttatgtactaatttcttaggcatggctaattttaactcaaagcatatatgttacagactgattcatatttttgagtatgatgcattaaagaggatcgatatatacacacacacacaaaggaatatatttaataaagtgcttcaaccaaatatatatatacaaggaaagtcattcgataaacctctactatactcaaagtgcataaattcttttatatgcaaccacacgaatttttttttttttttttttttttacatcttgtgcaactaaatgattacaaatttgacataagcaatacatctatgacttctttttccccgttaattatcatagtttctaaaaagacaagatgaaactaaagaggaaataggtgataaaatgattgcggtatattatatacttgaagtcatcatacttgtacatatgtataattcataatacgaatgtaaacatgtatattagacgggtaattaaaaataagggataactaataattatttatatgactcatatcatttatataattatttatataagcatatcatttgatccacttttaaaatttgtaaacttggagaaaaaaatcagcccgcgaaaaacttttcaattggcttaatttaagtttcgtaaacaaaatcagttgccaaaaaagttgtctgtagattatcaactagttttgttttagcgattaaaaacaatagatatcgatttatcttcatagcatggatttgaacactaaattaccacgcataatgtaaaagatggcaaacaatatgattggatatatggcgtgtggactttgtaaagggaaaataataaatgaaaacgaagaacagaataacgaagttggctttgggtcagtttattactcgtacatgcatttcaaagctaataaaaaaacgatgtgaatgtctatttgtgattcattttcaaaattggatacttaattggtatagggatataaggttttattgttagtgaaaaactaaaatattatctaattattcataggttagaagttgctttatcgtcttattgatcaactcgatttttaattgatggtggaagatgttgccaattgatttgaaatatcaaaatataacaatcaaagaaaatgctttatttatttattaataggcacatgatccaaaggcacattgggactaccgttaccatatatacttggcttagaagggaaaaagaataaaagaagaagacttactatttttggatatttcttcacttaggggatttagctccaatccaaactctttactaaacaagggccgttgcttattcatgaatttcaatcgttggaacttggaatatgagacttgttcaaacaacagtaagtggaagaataggcccatgtacggtccttattaaaaaatcaattatacgatttagggtccacataagcccatgcttaatccccaagctaagcatgaagagagattagaacttataatgacactgtaaacaaagtgtttttttttttcttccaaaaaagtgaaaaacctagttccatatctatataaaccaacgaaaacatgtagatccgtatcaatattaagtcttcacgtgaataccttttgtatttctattaccagatcattagcagttaacatttagtcgtatttattatagacttgaaacttaaaaagttgtgatcaaaagtcagaacattaccgtgtttaaaaggaagattggtaagattggtttgtagataaacttatgaaaatatgggcctaagcccataggttgtggaaaacagtaatacgacccagttcggaatcaacgaacctactttgacaattctcacgcgccaccgtcagcgaccacgtactgtgattggcttacactccccaccgtcaactttgatgattcacatcccaaattatttttcagttacgaattagactcaaagaaagaaaaaatcagatttttgttttgtttttaatcgggaaagatg

SEQ ID NO: 24911 - DNA, 3003 bp, Unknown; identical to SEQ ID NO: 24910
  misc_feature (1)..( 3003): 2750-1469P.txt file - cDNA_ID_2686579; gDNA_ID_2684216; Annot_ID_137400

SEQ ID NO: 24912 - DNA, 3003 bp, Unknown
  misc_feature (1)..( 3003): 2750-1469P.txt file - cDNA_ID_2686597; gDNA_ID_1971923; Annot_ID_58545
taattttaaggtttgcaaataatgttataaatatattgatgtatgttaaaaaatttatcacttaattttagacataatttaaaatcttaacacttatttcttttatttaaaaacatttatatatcaatatctaaactgtaaagtttttttttgtttttaacttaaatttagataaacagttttattttcttacataatatttttgtttttaaaaaaaagttgtaagtatttttgtttaaatgtgtaaaaagaattgaatgataacagattctttactcacagaacaagagatattaaattttctttatgtttatagtatttaataaagtttatagtatttatttccatatatacatttgtttctgtaagaactatccatttgatactagaataaatttcttcatttggattagattgttcagtacaaaactctatttctggcatgtcaataaataacaaatgctaattttggctcttaatcttgttgatagaatactaaacttgcaatgctttttacactaatctttatctctttatatatttatttttaaaaactcttctttcctttttttctgatttaaagtacaaaaaaaaaacaatacatctttccattgaactagaagaaaacattttcactgtccttttgaatcagaagaagaaagagaaaaaaaagagatggagagaaacacgccggtgagaaaccctcacacttccaccgccgatctgctttcttggtcggaaactcctcctcctcctcaccactcaaccccttccgccgctcgttctcaccaggtccgtttcttcaacaaatgttctcactttctctttctatagagagaagctgaggttttttcttctttcttctttcattttcagccgtccgatggaatcagcaagattctaggcggtggtcagatcacagatgaagaagcccagtcgcttaataagctgtaaaagattcatttaatctctatctctcattgcattaccagatctaataagtatacctggatttgttttttgtattacaactgaaacttaaagtttaaagctttgatcttgtgattcaccaaaatggtttctttgaatgatgaagtcacttctttttcttagtgataaatttttatgaaagggattggtcaaatgctttttggcttttctgagaagttttagtgttaatagtattttattacattctttgttcatcaaagccccacaccatttacatgtcaaactactactgttcattatctaatgaggagatctttgtcttctttgttatttttgattgtttcattaagtgacttcatcattacatgtaaaggtctttaccggtctctaatatggcgctttttggtacagaaagaattgttcagggtacaagttaaaagagatgactggtagtggcatatttactgataagggaaaagttggatctgaatccgatgctactactgatccaaagactggactccgttactatcaggtagcttacttgtgtcttgtcttatgtttcaacagatttagacaagtgtaaattgaaacgattgttatgtgaattttgcagcagactctgaatggaatgagtcagatatctttcagtgctgacggtaatgtttccccgaagaaaccaaccactttaaccgaggttgcaaagcaaagagagctgagcgggaacttgctaaccgaggcggatttaaagagcaacaagcagatatcaagtgctaagattgaagagatcagcggtcatgacatctttgcacctccatctgagattcagcctcgatctttggttgctgcacagcaagaagctagaggtaacagagacatgggagagcctgcaccaaggaacttacgcacttctgttaaagtttccaacgtaagtcttgccattgcttttgctttgagaggaaactcaaacttagtgcccaaccaaatcagtaaattttctcttctattccaacagcctgcaggaggacaaagcaacatactattcagtgaagaacctgttgtgaagacatcaaagaagatacataaccagaagtttcaggaactcacaggcaacggcattttcaaaggcgatgaatcacctggtagtgcggataagcagttaagctcagctaaactccgtgaaatgagcggaaacaacattttcgcagacggaaagtcagagtcccgagactactttggcggcgtgaggaaacctcccggaggtgaaagcagcatttcattggtctaataagtaagactcggggctgtatggtattatccgcgcatatgctcaactctcacatttcagcttctttagaatttagtttcttagagtctgaagagagctcattgtacggatcctttaaaaccttttggtgttgtctctaatacttgaagtttcttaactgtttctgcatttctcctactcttcacttaaaaaacaagtatggtttcaatacatcatcgttttcgtgttgaaaagagaaacgactccactggggatcgaacccagaatctctggtttcgtagaccagcgccttatccattgggccatggagtcttatttgactaagaatttctacaaaaggtatttatattaaacaactggtttaaaagggtgaagtatacatctctcatcatagctcgtcgccttctcttaccgaatatgatcgtctttttagttaagctgtctcaaaaacactcggcataaaattcagctctttaagaaaaaaattcagaggaaaattaaaaaaagtggatataatagagaaaaaggtaaaggaaaggaatagtgagagagagagagggagagatggtcttcttgtttagaacatgttgtttccaattattctaagaatggcgttttaggtaaatgatcacagcttattacagatggaagagaagctgactcaatttgtggtttagatttgtcaaagaggatcgtgtggaatctgaaagttttcaattttcactaaaaataggattagagttaaaaaggaggaagaagaaatg

SEQ ID NO: 24913 - DNA, 3003 bp, Unknown; identical to SEQ ID NO: 24912
  misc_feature (1)..( 3003): 2750-1469P.txt file - cDNA_ID_2686597; gDNA_ID_2926219; Annot_ID_142357

SEQ ID NO: 24914 - DNA, 3000 bp, Unknown; identical to SEQ ID NO: 11831
  misc_feature (1)..( 3000): 2750-1469P.txt file - cDNA_ID_2686605; gDNA_ID_2214518; Annot_ID_134012

SEQ ID NO: 24915 - DNA, 3003 bp, Unknown
  misc_feature (1)..( 3003): 2750-1469P.txt file - cDNA_ID_2686636; gDNA_ID_1620781; Annot_ID_50355
caaaacaagtgaatattgtaccagcattggtaagggcatgaaggagattagctttctgtttgagcttgagaccagcttcgaagtaatcgtgttggtcaagctcggactcagcgcacgtaccgtgtttctcccactcatgtgtccaaaacttcataccatcattgctcggacacgacaacgttggccattctctttgtaaatcgctcatcagatcagaaacctttataaaagttttcgattctcattagttatttacgattcttttcttgtggttaataatttccgaagtcccaaaatacaaaaactattgtgttataagttaaaaacaaacccgtaaatcatcaaatcgactgtcaggattacaattttgcggccatccaccggttttgtagttaggccaaagaccgtgaattccaaaatctgcagctggtttaccggtttgtggatagcaacaactatgtcttgaatcacaatacgctccaggccactgcattgcaacgcacatacacaaacataaaatttcaaagtacaatgataattcttgtagagacatttatcgactttaattacctgtaaaacgaagtagaagaaatcgaaatcttgggcgaaactttgtacgtagagttgttgtaacgctagaataaaaatgaagaatttcatttcctcaagatatcaaataatttgtgggaatcaaatttgtcgaaaaccaatgaaggatggatgatagataaatagtttagaatatgtttatataagtcatataacgtgaagtgtgatattttgttttgggtagagagacgtgacgtgtgattggtatatgtttgcttaattgtgttaggttagtatttcgtgcaagcattttattttcagctccaatgctttaaaaagtaataacgtaaggcaaacttttcatcatgcttcaactacaaaattatgagtattttgtagctccaattaacgtaacgtaaggcaaactttccagctccaatgttttagagctagccgaatattatgtgtctcagtatttataaaattatgagtattcgattggaaaaataaataaagaaactcttatagtattcacttaaagacctttgtttcttaaattttaaatatttaaatccacttaaagatccttgtttctcataaagtgttaaagacccataaaggcataaatcaaaccattgtcccgtctcggaaacgtacgtcaagtttcttgatgaggcgcatgttggctacttggttctacttctacagttacagactccagtgtgtaccgtattctatcaagttctgcatttatgcaagaaccttaggtatcacaaatatttgggggcaataaaattataaaaattccttacagtgcagcgatttatgtcacattttcagccaagaggttgtgtgttcgagttccctcaactacttctgctaatttttttattaaaaaaaaaaaactttagaccgcccataactttgagccggcaatgatcctacctcacaatcatactaaaatctaccaatgatccttaccatgttttggcgcttgaggtggatacgaataatccactagttgggttaaccttatagggaaggtgaagattgttataaagtttgtagattatacaatgaaaagtaagaagataggtccaagtcaaagtttgtatgattaaaacaagaaagatggtatataccatgcgttgctttccagaaaatggcttcaagaaagcaaagacaaagaatatcatcatgagcttgaccagggataaggaagaagatccattgacgtgtttacaacgacaaaaactagttagaagttagaacatagtgtcgctgaagttgtggaggaaatgcattttttaaacagatgcatagagacgattgaatatggcatcgaaacagtgaatgcaagcaacaaaggttggtaaactggtgaagagaaaggtaacagacgatataactttttttgtgaatgaattaaaagggatttttttttttcgtcaagaagctgaaatttcattaaaccgaaacttaaaccgatacataagttggtacaataagtgcataatttaatgcagattttgcatatgcatatgcacaaccgtttttttctctaaaaatgaagtgaaaagaaatttgatcgaaattaaacgaaagagcaagaacatcttggaaaatcacgtagagattctttgggaaggattctgagttgatagctttgatcagcgtttgcaaatctgaagcgaaggtgacttcctaaaaccgagttctaaggcattttgttgggctagatgaagcgccatggcttctgccaaaagaggagaagcaacattcgccactctaagggattcaaagcctctttatgaaatagaagttgacatatttttagttcaattaaatgaaatgaccgacgtgccaatttgtcatatccacataagtataaaagctaactaaacctccaatgtcaaaaaaaaaaaaataactggcttcgactagggatcgatccttggacttcgatatttcacaattctttgtaaccaatataccaaaggacgagaatgtgacaaccgcgactttaatttaataaatacgttatagtttggaaaccaccagcagagacggagagtccacttttatttcttccgctccgtttggtctgtcctcttcttcttctccaccttcgaaatctatcttctccgatacctctctatctatatctcttcgacgctgcaaattagccttaagcttctttctcctttaaacttttcgattattattccatttcctatctttttgtttcccccaaatcttttcacggaagcaaagaatacaattccaaaccctaatcccgatcatccgtctttcctctccggtcagtcttccgatttcctcgatccacctgattttcattatgattatacatatatactttcttctcgctcgtcaattttttcgttgctgtgtgaatttagattgatttgttttggattcaggtttcaaaatatg

SEQ ID NO: 24916 - DNA, 3003 bp, Unknown; identical to SEQ ID NO: 24915
  misc_feature (1)..( 3003): 2750-1469P.txt file - cDNA_ID_2686636; gDNA_ID_2684095; Annot_ID_190085

SEQ ID NO: 24917 - DNA, 3003 bp, Unknown; identical to SEQ ID NO: 24915
  misc_feature (1)..( 3003): 2750-1469P.txt file - cDNA_ID_2686636; gDNA_ID_1620781; Annot_ID_167938

SEQ ID NO: 24918 - DNA, 3003 bp, Unknown
  misc_feature (1)..( 3003): 2750-1469P.txt file - cDNA_ID_2686679; gDNA_ID_2684220; Annot_ID_137438
tatttattcataaggaagagcatttcgaattctgtagttcaaaattgaagatcatgtcggcgtcaacggtgtcaatcaccgctagtcctaggacaataaggcggacgccggttctctccggtgagaagaaatctaattttgatttcccgccgagcgaatctcatgccaatgcggcaattggagagtcgtctgctggtacgaacaaggatctgattcgcgccgaggctgccggtgagagatccaacacctacgacgtaggtccggtgacaaggaaatcaggatccaccgcgacggggactaatacaaccaccacgcagcgtcggacgcggaagtctcaggggaataagatagatagagggaaatggaagacagtggttagggtattcgcgaagcaatttggggctcttttgttacttgttggattgattcagttgattaggaaattgactttgaaggattcgtctctgtcttcttcgaatttcccaattgaaacggaaatggtgctttcggaattggagagtcggatttctgcagttgatggtttggtgaagactacgacgaagatgatgcaggttcaagttgagtttcttgataagaagatggatagtgaatcaagagcattgaggcagacgatagattccacatcttctgtgttacatagtgagttgaagaaggtagagtctaagacagagaggttacaggtttctgtagatgagttaaatgctaaacctttggtgtctagagaggagttagagagagtttacgaggagttgaagaagggtaaggtcggtgattctgatgttaacattgataaactgagggcttatgctcgtgacatagtggagaaagagatagggaaacatgttgcagatggccttggtcgagtagattatgcgttagcgtctggtggagcttttgtaatggggcattcggatccgtttcttgttggaaatgggcgtaattggtttgggacaagcaggagacgggttcatagcaaagcggttaagatgttaactccgagtttcggggagcctggacagtgttttcctctgaaaggaagcaatggatatgttctagtcaggctaagagcaccaataattccagaagctgttactttggaacatgtctctaaggtagtactaacatctcaatactaaactttcacaaaatgattgatttttatatgttaatttgagccttcaagaagggttctctgttaaatgttgttggtattgagatgccctgtacttcggattggattgctggtgacaataggttatcgaatagagggcaagaaactagttttgtgaatttgagttcttatagtttgaggtttagtttaggcactagctgtgacaatatgcattgaggaggattttacctattgttattttctgcaaatcactagctttagcagttcctttgtctaatatcaatgccactgtgttgttgtgctttgtttgggacatcgttgacagagaaaagaaccgtatgtatgggaagagcttgtaagtttacaattagtggaactgtaatattcactgtttacggatatccttaggaaacagtagctgaagggaaatagtctcaagagtgtgtaatgtgatggtcacacattgctttccatcattgttcatccttgtgatcatttgtctgataaatttcttcttgtctgaccactaaaaggcaatactaatcttacggttatgttatgcaccatttaatcgaacaggctgtagcatatgacagatcgagcgccccaaaggattgccgtgtatcaggatggctaggtgacatagatatggagactgagacaatgccccttcttacagaattcagttacgacttagacaggtccaatgcacagacattcgacattgcagactctgctcactcaggacttgtcaacactgtcaggctagacttcaattccaaccatggaagctcttcacacacttgcatctaccgcttcagggttcatggccgtgaactagactcagtctctgttgctcatgcttgatctgaaagtccacgtcaaacttttcttctctttgtaacattccctctaatagatatctctcttctttttttgtgttagtttatgtggtgggaaagcttctcttagtctgtaatcagaatcatttggttgtattcgtgattattagcttcaaatctgttttggttcggtttatttggtcagggtatgtatcctccgaattgaataatatagatcttagtttgatgtccggttttggttttgtaacagagtttcaatttaagctttcacctaaaacaaatcatacaaattctaatagagtatacatatttcattagttgaaacaaatattgaatttggattattaatggttaccttgggtacttggtattacaacgatatgtgatgaataggaagagtgtgtatatagatggaccataacttgttagtgtgaattgcgtaatcgacaaagtgacgacttcttcttctaggctgcaccgtcttgccttgtctaaaagcttcccaacacatcacatgcaaaatctacggtcaaataatagatatgaaaccctcttccaagtcaacacagcttgtttgattataaattaaattaaatacaaattcatctttgacatgtctgattaatgttaattttttacagtgtcaactggcataacaaattgagctaaacaaaattaagctctaaaaatagccattttttacggttaaatcacatgaagaaacctttcctaaccaagtcaacccatgtttggtcgtcgtgacggtggaccaccggctccaaaaaaactcttcatttgaccaaaacgagtataacccttaattattagaccaacatgcattacataaatgataaattcagtttccctcgagcccatgcattcattaaatagcagaaagctcctcgtatagtctatatatatagcagattttagatccaaaataacaaacaccatcaatacacaaacaaaacaaaaaggatgaaaatg

SEQ ID NO: 24919 - DNA, 3000 bp, Unknown; identical to SEQ ID NO: 3778
  misc_feature (1)..( 3000): 2750-1469P.txt file - cDNA_ID_2686789; gDNA_ID_1620664; Annot_ID_48018

SEQ ID NO: 24920 - DNA, 3000 bp, Unknown; identical to SEQ ID NO: 3778
  misc_feature (1)..( 3000): 2750-1469P.txt file - cDNA_ID_2686789; gDNA_ID_2926203; Annot_ID_141606

SEQ ID NO: 24921 - DNA, 3003 bp, Unknown
  misc_feature (1)..( 3003): 2750-1469P.txt file - cDNA_ID_2686834; gDNA_ID_2213626; Annot_ID_195876
gaatttctcgatggttgaagatggaatttatcgatctgggtttcctcgacctgagaatttcagtttccttaaaaccctaaatcttcgttccatcatgtaagatcctttattaatcttctgggttattcaattatactgtttgataattgattatgattggagtaattaatcgtttttttattcatcaaaacagttatctgtgtcctgaaccatacccagaggagaatctcaagtttcttgaggctaacaacattaagctttaccaatttggaatcgaaggcaaaacggtgcgttttgcttctttcttgttgcttgttgtcaaagaaatgcaattgtccttgatgtcttatctcggatcttttacgatatgcaggatcctccaactcctatgccaaaagatacagttttggatgctctcaaagttttagttggtaaggaatcaacactcaataatgttttttggtctcttcttagctagttcatgagtcttaaagtagatcttttgtttctctgtagatgtgagaaaccatccaattctcatacattgcaaacgcgggaaggtaatttacagtttcttcttcctcttctaggaacttagcctatgttattatttattacaggacactcatggtggtcttggcttgtcttatttagttatgcacagtacacaatctttttgtggtcctttaggaaataggcagttatttacaggacactcatgatttggtgtttttggtgaacttgcagcataggacaggttgtctagtgggatgcttaagaaaagttcagagctggtgtttatcatcggtgctcgaggagtaccagaagaacgcgggtttaaaatggagacaaagggacttgaattttatagaggcatttgatatagtgagcttgagacagtgtctcttgagcatcatgtatcagtatcacggttatggcttcaagaggagaaggttggcatatgaagaagagaatgtcaagacaccaaaaccgcaggctgctagagtttaaaaagagagcaaccaagtggcatatgttccgtgttctgatttgagtttaatcggtgcctggattattctttaagtgggataagttttagtttaccccaaaagccgtaaccagaagttttattgtgttttttagaaatagaaatgtatagaaagtttattcttcattacaatctgatgcaggggaggtcatttttaactcaatgactcattcatgcttatgttgctttattttattttattggtcaaactcctaaagttagcttaatcttgttgtttaaacttcaaagtctctttggaataaccattagcaataatataagtggtacagcaataataccatgttttaaattcttgtaaagagttcttcgataatctaatcatttataaagagttcttaaataatcaaaccagtagaaattagatcaaaattagcaagaacttgcagtacaattttcaaatcaaaagaaaaaaaaaactgatttatgtccagaaaacctctctagccaatcaaactgaattttaaaagataacattcggtagtatactttcggtatgaaatcaattattaaaacagagaaaacagaggaggttaagagtatcgagtcagcttctaatatataccatgtgcactgcagtacaaggtatatgactaatctagcacatgtgttaggaaaaatatgttttcaaagataattaaagaaatacaagttgattagcagcattcttttactaaaacagccatattatattcatctattatatatttagctttttgatttccattctcagaatgaaaaagtgtgcagctataattgacattgtctatgtaactatgtaacacataattgacaaagaataagcaaaaccgggaaaattctatcgtaatttttctgaccagaactaaaccgagaaaaatccataaccgaaccaaatcttacctaagaatcatcattcatcacccacgtatcggataaaaactcacctcctacctagaaatcatcacccaagtatcggataaaaactcaagatcaagaacgcaaatcagattgacaattacgcaatcttctagttatagctaagaaaattccatgtcattttcagaaaacaagatgtccgtgcatacgtactttgcaaatcatccggacctaaggtttccgctgtttatgttcgaacagaaacagagtacttcatttcaaacaataagaactaatcttgatgatctaaaacttgtctgaaaaaagaaatagaggttgttgatttaacatgactacaaagctatttaagattcgctaaaccagatgacatcaacaacatgatagattttggggtaagaagtagcacattacactctttaacatcaaaagataacaaattttataaaattcaaacatagagttacttcttcaagcttcccctgataccaggtttaggtttcgattcagctactggtgctaaaacagcatggagattcacgagctttgattcctcataaatgatattaggatgcttcgattcgtgatggatctgcatcgtcttaagacctggagccgtaattttgcaatgaggacactcgtacttagcgtggcctcctttctcttttccggtccgatcagcgattccagcttttcctccgcctcgattagtcaacgcagcatcgatcttcgcttgaatctccttcgctgtatgcttctttggcttggccttaccagtcatcttcaatggcggctaaaagggatgaatttgccaggaagggagaagccctaaccctaaccctaatttgtgctctactcttctgatttaggacgcgagagccgatatgaatatatatactaattttatttttaaaaatggaaataatcttatctgattttgttttttggggtgttatagtgtgtggagaggtgcatggtaatgactgtggacctaaataaaataaaacgcagtaggcagaaacgcatcagtcatcaccacatgcgacacaccaacaccaatg

SEQ ID NO: 24922 - DNA, 3003 bp, Unknown; identical to SEQ ID NO: 24921
  misc_feature (1)..( 3003): 2750-1469P.txt file - cDNA_ID_2686834; gDNA_ID_2213626; Annot_ID_132061

SEQ ID NO: 24923 - DNA, 3000 bp, Unknown; identical to SEQ ID NO: 14657
  misc_feature (1)..( 3000): 2750-1469P.txt file - cDNA_ID_2686856; gDNA_ID_2684211; Annot_ID_191511

SEQ ID NO: 24924 - DNA, 3000 bp, Unknown; identical to SEQ ID NO: 14657
  misc_feature (1)..( 3000): 2750-1469P.txt file - cDNA_ID_2686856; gDNA_ID_2684211; Annot_ID_137337

SEQ ID NO: 24925 - DNA, 3003 bp, Unknown
  misc_feature (1)..( 3003): 2750-1469P.txt file - cDNA_ID_2686861; gDNA_ID_2684103; Annot_ID_137091
ttcagtgaggagaaaaacgctttctcaattatgaactctgcatctttgtcactgattcttctcacctgatctgttgcagatatttggtcaaagagtttattaaaagataacataatataaagtgaaaaagcaatgctgctttctctcattggttgtgcatagagcaaggacagagaaaaacaggttcgtacgtaagaaacacacattaactgtgttctgcttcctttgtattctctcacttttctcttttttcagaattcaatctctggaaattttcttcctaaagattaaagagaaccgtttggaccagatcagcttgcctcttggtaatggtctctcttctctttgttcccaatttctgtagctttcttctttctccctaactcgtctgctctctttgtctcttcctctcacagttcatacgtcttccatggcttccggtgatgttcttcctagattcttcactgtcttcctctcccattgcagctccgaatccatggtgagatttttctctggaatatttcatggaaaaagctgcttgggttgatatgtttcttggatacagtaacgatgtgaatgagatctgcaacattatcttaattcttaactctatatgtttaaatctcttgacactgacaaaagttttaactttcttcactaatgagctcaggattatctctgtttgtgttacttatgtttgaatatgatagagtatgtcaaactaaacactgaatttcctcaaagagttttctcctttgttgaaaaaattgaacaagaggtcttggtcttgttgtttgtctgtttacctccgcttgcagacagagtctttagcttatattttgctcacttttaacagtttagtttatgctacatctttgtgttgagcaggtgataccaaggtcttactacaatcttttaccacgtccgttgcccaagactgcgattctcatcggaactggtggaagattttggaaagtagcaatgacgagcaagcaagagcaagtgtattttgaacaaggctggggaaatttcgttgctgataaccagttaaaagagggagaattcttaacttttgtgtttgatgggcacaaaagttatgaagtaagtatctatggtcgtggagattgcaaagagactcgagcagtcattcaagttgaagagatctctgatgatacagaagatgacaacgtttctcttcatagccctagcaatgtttcacttgatagccttagcaacgattctcatcatagcactagcaacgtttctcttcgaagccttagcaacgattctcttcatggtgatgctgagatagagagcgacagtgagtattctcccgagaacctaccctcagcctctatatctgttgaatccgttgaggtggtgaatccaacaacaagcaggcagagaagttgtaagtaaacattgttcttttaactgatgcttataaccgaagctgtttagaatttgatctcaaatgggaattttgcagacaagaggaagaccattgagaatccacatctgtatttggatgatccaaacaatgtctgttttgagacgtgtcttaagcttagaaagtttgagctggtaagacttcattagatattattatctcgtctcattaaaaatcctttcacgagttgatgattatttttctaactaaagctctatatacattatgcacagttagttcatgcacagttggtgaaagactacggcttgatattcagcgacaatgttgactatattgacggatatggaaaactaaccgcgaaaacgaccaagtgggcagatcaacgggtttgcataaacaaatggcagaaaatatgcgagagaaaccagttcacagagaatgactccatcctatgtgaaattctccgcaacgaggacaaagtggtttatgcaatcaagattcacatcttccgcgatgcagcagcaagcacttgattctctgatgcagttctgcaattgtgtttcttctctttcgagtctagtcttttgtagtaaactattagaatgtctaatttcaaaacatgtttaagacttttgagttctcttgtagactttgaagtaaacacaatgaggagcaggcttaagcttacccgttaatcactctgtttctcttacaagttacaatcatgtaaaatgggttagaatgatcgttttaatatgttaggtacagatttcgtaatttctcgaaaatgtgatatctcttcttcacaacagaagaacagattattgtgaaagtcaaaacaaaaaaaaatctctgaaacaatggcgtgttgcttagcttcgtgctgtgcgtcggcgacttgtggattatgctcgtcggtagcatcggggatatcgaggaaatcagcgaggatcgcttattgtggtctcttcggtgcctctcttgtcgtctcctggattcttcgtgagactggtgctccgctcctcgagaaactcccttgtacgattctctcatccttttctgaactgggtttgtgaaaaaggaggttccttttagccgagattgatgattggaattgaaagagaccatcaaatttcgaaattgggttttctttgatcttgtcaattggaattgaatccggtggttaacgatagatttgggtgatgtcttgtgcttgaatcttactaagcgtttaagtatgaatcttaatttgtattggttcagtggaaatttggttgctttgtagctgcaacagattgataattgtgtactagaactttagaaatctcaatctgtgttgatttggatgtttttcaactttcaattgcgtttgtttatgctttgtgttaacctgcttgatctaagagagaattttgagtgttgcaaaaggaaacttcatcgcctattgatacaaatctccggttttggatgttgtttgacaaacagggatcaatacttctgattcatataccaaagaatggtatcagcaacaagctgttcttcgtgtgagctttgggaatttcctcttctttgcaatatatgctttgatcatg

SEQ ID NO: 24926 - DNA, 3003 bp, Unknown
  misc_feature (1)..( 3003): 2750-1469P.txt file - cDNA_ID_2686869; gDNA_ID_2214671; Annot_ID_136615
ttttcatctatttttcttaatttttataatattatttaggtttaaaattcgtaatacaaatattaatacatataatttggcacgaaaaattcgtgcagaaccgctacataccacatatgtaaacaatttttttcaagattggttcatctgagtcataaataatatttaatgacaaaaaaaacaatattttaaagtatttgatttgttgttgaattatttagattattaagatttgttttgtattttaaggagaaaattgaaaagatatggaagttgtaaaaatttgcattgaccatttgaccaatctgggtcaacaacaaacgaagaaacaaattaaaaaaacacaccagcttatctattgttagttttttttttttctgttttcaggtgttttcttaaatcacaagctacaaaccctatatttatcttctgcaacaagtcagcatcgaactctcagatcatttatcaattcatcttcttaatttacttgaccctttctctttacacgataatggcgagagataaagaagatcaaaacaatgagaatccttcaattgtccagaacatgtcatttccattcaacaccattttcttgatctcaagcgcaatcttcctcgtcacagccgctttctggttcgtagccgtcatgacattacattacaggaccgatgaatgtaaccggttcgtcacaactcccggaatattcataagcttctcattgcttgctatgtccctcactggattctacgcagcttacttcaaatccgattgtctctttcgaatccacttctttatcttcttcttgtggatgttcgttgtcgtgtctaaagcaatctttgtcatctttctacataaggagaccaatcctagattgtttcctgggaccaagatttatgagtttaggtacgaggattactcaggatgggttagtagattggtcatcaaagacgatgaatggtatcgtacaaggagatgtcttgttaaggacaatgtttgtaacaggctaaaccataagatgccagcttctgagttttatcagatgaatctaactcctatacaggtaatataacctaagctacacattaactaaatcaaaccgaatctagttttgattccggtttaatgtttttttttatttcattctaattttgtttctttttttatgacagtcgggttgttgcaaaccaccactttcatgtggattgaattacgagaaaccaaataattggacagtttcaagatattataacaatttagaagttgattgcaagagatggaacaattctgcagatacattatgcttcgattgtgattcatgtaaagctgtgattattgctgatgtacataatacttcattttccataacagttaacattattcatatcatctttagtctttgtatcggcatgaccggttggtttgcctggttaaggatccttcgagaaagtcagaaatagatttgtacacatatgtaagacacatataaataaattgtttctttttattatttcttataatttatatcccttgctcaaaaatcgctaggcgctagttgggcggtaagggtgagcctaacgcctagtaggaaaatcggagattatacgggattaatcggatattagttttagggttatttcatatttttaaaatatattaatccattataattaagaaaattatataatattgttttttaaattgtattaaacacatgaaaacaagattttctattcaaatttataatttttatacaaattacgaacataagttggatattttaaattttaaattttaaaatgaaaaaaaagaaaaaataaaaataaaaaaattgggctagccatcctctagacagatttaggcgggtctaaaccgacaaaaatcggatcaacgattaattttcccaatttagacaaaatcgttgcagactccatctgatctctatgcggccgattttttgaacaaggcttatatgtatacaatcaatttaaaccgattgaaagagtaaacaaaaggttataattttagtaactgtttgtttacttggttggattggactgtccgtcacctgccatttctgtctttgcacttaggaattagaaagtttatatgtatatttttcctggacggccactgaatttgtggatgtaatatatgagtttgtgtatcactgtattgtggataaaaagatttagggctaagcgttctttagaaacacagactgaaaatgtgaaatgaaagcatgtttgttgatgatttttgtgaattacaaaaagaacttagagaggatataatgtaaaaagacccccttcttcataattgggccttagttataattcccttggaattttatggtatgagttttttttgtttgacgagatccaacgccaacaaatacgaagctaacaaactctctcatctaacaaactatttctaaagttacttttttatttgtttcaatatatcaatcaatgaatataaatataaaaataaagaaaaccaaactattgtgatatcatataacaaccaaaataataaaattttatccaacctcttctactatatatgtatttaatctatatatagtccaattatagaaacacgagaccggcatgtacgcatttctgtttcccttctatctcaaaccccaaacgttccaatttctaaatacagttctctactttagtaatgtttaataatgtttctttcaacatttcagttttctatacccgttgtgacaagacactcaaattttccaggacttatgtttgactattttttaggcaaggtaaaaaattgcataagtctcgaaacttttgggtgttcgggcggattggttagttagaaactaatgcacgtcagcctctgaggttccgtgtaatagattctcatgttgtcctttaaaaatgaaactcttccctttgattctttttgttcccaaaacacatttttctacatcttagagtcttagagaagaaaggcaagataatcaatctcatggcgatg

SEQ ID NO: 24927 - DNA, 3000 bp, Unknown; identical to SEQ ID NO: 12234
  misc_feature (1)..( 3000): 2750-1469P.txt file - cDNA_ID_2686877; gDNA_ID_2214538; Annot_ID_134420

SEQ ID NO: 24928 - DNA, 3000 bp, Unknown; identical to SEQ ID NO: 10233
  misc_feature (1)..( 3000): 2750-1469P.txt file - cDNA_ID_2686883; gDNA_ID_2213638; Annot_ID_132209

SEQ ID NO: 24929 - DNA, 3003 bp, Unknown
  misc_feature (1)..( 3003): 2750-1469P.txt file - cDNA_ID_2686885; gDNA_ID_2684236; Annot_ID_192411
ttggtggtatcaaaactcaattagaaaaataataatgtgcacgagggatgggacttttaccaatgctaggctgacatgtaagagtacggacacaaatcttacaaagttcttattgtaccttccctaactttgctctgttgagataagtttctttggtaattaagaagtgtttgaattatgtagctataatttgctgatttatattaaattcttcactacaagaatctgtatctataactataatatgttttgtgtacaattagagactaactaaactaagagtgtgttgtaagaatgttaagcaaataaactctatattggacaagtgacttgaaaagagaatcaagtgcagtctcaagttcctctgttctttcctctaatctctctaacatcttcttaatttccttggagttatccccatctgaacgtagaactgcatccaagttctgcaactcgctcattatcgacgatgacgatcggtgaccaccactgatcagcctggagacgaatttgagagaacatgtctttgtcttcattgttgatgttgtggacaggaacatgaaaagagagcggaagatggagacagagagctcggttgtctcagagtcatccaacttcttcttgaggccaagaagaagcttgttagtctctttcttgatcttcttcctaaaggaaaagtactctttgatctgaacttccatggatttgtcttttcttctcaatgcagactgaagattaaggagatgctctctgagagtgagaactaggtttctcgctgcgtcgcaagagtctagtaacgtggctgacacgtcaagagaatgttcagcttgagctgtgggaagagagtgattgagttggtgaagggaatggtaaagctcagagaggttgagtaacgaggcgtgaagagattgagaatcagatgagttttggaagagatgaatctgagagagagcagcttgaaacttagcagaaggatggtggattcttgatggaagacttatagatctaactggcatttggagtttggtttctggaaatgccatgtttcttaattctgctgaagaaaaagaaagaagagaggtttggtatatatatgatgaagccaaggcatgtgcaggaaacatgggatattatatttgttaaaaataaacagtgattgtttagtcaagccacgatgcacatggaggtggtgaaggaagctttgaatgctctgttttatgctctgtttttgaacgtgaaaccaattttagaggaccaaagatagatagagccattactagatgttgcctttgtgattcccatttagttagccggagagagtgggcttgtcagagtaaggagacatggaaacatttgtcgcagaccattttcagatttcaactctttcttgtttcatccaattgtcaattttttttttcttcctattaacttattcaccattggttcccaagacggtcgtgaagagaaaaaagatgtcacaacactacaaagttgttgtaaaacaaaaaaaataaatactatatacacgaaagatgttacaaaaaaagtattattttgcattttcaatgcaataattaaaatgaattccaagtttattctttttttttttttttttttttttggtgcaccttccaagtttattcttataaactgattcttattatgtaaaaagtagagaaaatgcagagagttacatggaaaaaaattcaatgtagtcttaatttgtgagattttttttttatagaatgacacttagtataaaatcgggaaatattatattaagaataatcctaatcaggattatacaactgtacctactttaaataatgttgattagaatttaggagggcggttcaatgttttgtgccctaataatagaacgttgtattataagtttttgattgagtgcttcaaggctgtcattggattcatgatcaattggaaacattgttaagtgagagggacaaacttatgaattaagatattggccctttgtctccgttacaagagctatgcttatatgataaaatttgtttattaaagaaagaagggatcattgtagatcgcatataaatgatatgatgcaaaattacgggacgatgtaatgtacggggaatcttaaaagtggtacgtttcagacagaagatcttcatggaatttgatacattgaacctcttctcaaagtgttaatcaactcatctttatctgtcagaacccaaacttaaaactcagtcgaaatgtattctcaaaatatagttaataggcaacaaacttcgactatcaataataaccacataatttggtcggaaactagaagacgtcgcaacattatcaaacttaaactatgtagaaaatttccaaaactataagctactttaatgttgattaaaatgtaggagctagggctagtagctgttcaatgggttgtcccctgattcaccatatccattttagtataagtttttctttaatttgattgagtgattcaagactgccattggattcatattgatcattatcaattggacgcattgttgaattagagagacaagattatgaatcaagatcatggcttgtccccgtttaaaaatggtttaaactatatgataagtttatttagaaagaaaaaaagatcatgtacggggaatcttagagaagtggtacgttacagacaaaagatcttcacaaaatttgatacattgaacctcatctcaacgtcaatctacaactacgccttcaatagtaacagaaacaaaacacaaaaagtccataagttaaacactgggcctgacaatttaggcccatatactgaaggaaaacgagtctataaataattgggcctaatgaaatataaaagcccacgatactagattatcgaatggtggtccctattagttacgtaacgtacgaagatttatctacaagtttgaatcactccaaaaatttaaaattcagtgttcaccattttttatttttctccacaaacccaatctttctacaatg

SEQ ID NO: 24930 - DNA, 3003 bp, Unknown; identical to SEQ ID NO: 24929
  misc_feature (1)..( 3003): 2750-1469P.txt file - cDNA_ID_2686885; gDNA_ID_2684236; Annot_ID_137701

SEQ ID NO: 24931 - DNA, 3000 bp, Unknown; identical to SEQ ID NO: 10079
  misc_feature (1)..( 3000): 2750-1469P.txt file - cDNA_ID_2686953; gDNA_ID_2213624; Annot_ID_195771

SEQ ID NO: 24932 - DNA, 3000 bp, Unknown; identical to SEQ ID NO: 10079
  misc_feature (1)..( 3000): 2750-1469P.txt file - cDNA_ID_2686953; gDNA_ID_2213624; Annot_ID_132001

SEQ ID NO: 24933 - DNA, 378 bp, Unknown
  misc_feature (1)..( 378): 2750-1469P.txt file - cDNA_ID_2687044; gDNA_ID_1972138; Annot_ID_179174
aagcttgaaagcggcggaatccttacatattccgacgtacttaaccggagcttccggcgccgccatcttctcttctaattttccggcgattgaatggagacaatgcgtcgccgtttttcaaaagcggtgcggaagagaagagtgggcgaggaagtttagagaaactggaacagaaaacctaaagcgaagaagtgatgagtaaaactcctctacacgtggtctttagtaaacttcagtggatatgtaacatgatcgacggtcgagagtttatcatattttaaatgggctttaggaaggaaaggcccaataaagaaatgaatatttccaccacagaattatgaattgagtaaaccagaaaatcgaagaagaacggcaatg

SEQ ID NO: 24934 - DNA, 3000 bp, Unknown; identical to SEQ ID NO: 9041
  misc_feature (1)..( 3000): 2750-1469P.txt file - cDNA_ID_2687055; gDNA_ID_1971974; Annot_ID_58702

SEQ ID NO: 24935 - DNA, 3000 bp, Unknown; identical to SEQ ID NO: 9041
  misc_feature (1)..( 3000): 2750-1469P.txt file - cDNA_ID_2687055; gDNA_ID_1971974; Annot_ID_177556

SEQ ID NO: 24936 - DNA, 3003 bp, Unknown
  misc_feature (1)..( 3003): 2750-1469P.txt file - cDNA_ID_2687136; gDNA_ID_1971893; Annot_ID_176868
gcgtacctcagaaattaaagcgcacgataaggtcaccttctcggctttgccaaagatgcatctctctcttgcgttttgtttgtcgttaaacgtttcgttcctttaaattgattgtgattatttcttaataaacttgattactattattaattctttaacttaaatattactctaatggtgatgccgtgatggtcacaaataaatgaaatagaaaaagaccaaaacaaaaaaaaaaaatccttttttcctctcttttacatgatgggaactcttgacctttaagttttttttttttgtgacaggaagtgttcaaaggaacgaaatacacttcttcttccatttgatgtctgtggtccgaatgaaaaatatctctgtattaaccagaaacgtgtttcataagcatctttaactcttcagctctcaaattcttcatgaatatctctgcttatcgatcaaggtttgttaaattttccctccctctctgtttttcacttgaaacgtttggatcttggagaatttggagtttctcgtgtgttttttttagttccaaactttatattagttttaaaaatgattaagagtttattctgtttatggtttgtatcagtgagagcaaatgcaatttttaagagccagctattggatctataactgaaggtgaggcaacacaaaactttcttttttctttctgctttgatctattcttgtgcatgtttttgaaagattctaaattaccaactatgattggtttgatatgtagaggatatatatagagatgatgagttcttcttctccaacacaacttgcatctttaagagacatgggaatctatgagccatttcaacaaattgtcggttggggaaatgttttcaaatctgatatcaatgatcatagtcccaatactgctacttcctctattattcaggttgatcctagaattgatgatcacaacaacaacatcaaggttaactagttttcttctttcaagattcattgatttttgaaagttgttgttacttgtttttttactaatgggtttttaaatcacgtgcagataaattatgattcttctcataaccagatcgaagcagaacaaccttctagtaatgataatcaagatgatgatggcaggattcatgataaggtttagatcaaaacaaagctaattatgttttcttttttatacatgcataatagaaaatggtggtttttgtgatattgattgatattcttttgtcatatgccaatagatgaaacggcgtttagcgcagaaccgagaagcggctcgcaaaagtcgtttgagaaagaaggtagaagcaagtccctttattgaatctcatatagtttagttagttgctactaagtcctctttttttttgtatctttaggcttatgttcagcagttagaggaaagccggttaaagttatcgcagttagagcaagaactcgaaaaggttaagcagcaggtgagctaggtcaaaagatatgtttaaaatgttctgttttgagtctctatcaagaaaatcagttttggtttcgtaattgactcagtactaaatgttttctttcaagggccatttaggaccatctgggagtattaacacagggattgcatcatttgagatggaatattcacactggctacaagaacaaagcagaagagttagcgaactacgaacagcgcttcaatctcatataagcgacatagaactcaagatgctagtagagagttgcttgaaccattacgctaatcttttccaaatgaaatccgatgcagcaaaagccgatgttttctacttgatatcgggaatgtggcgaacttcaaccgaaagattcttccaatggattggagggtttcgtccatccgaacttttaaacgtaaaaatacccaaaatgttacaatctctaacaaaaacattttcaaaatgtaatattttctccttcccttttcttgtaggttgtgatgccttatcttcaaccattaacggatcaacaaatcttggaagtgagaaacctccaacaatcatcacaacaagcagaggatgctctgtctcaagggattgataaacttcaacagagtttagctgaaagcattgtgattgatgcggttatcgagtccacgcattatcccactcacatggctgcagctatagagaatcttcaagcattagaaggatttgtgaatcaagtaagtagtaaacattaactcaaaacaaattaagtaaagtttgtgtcattctatttcaaacatctctatcctgattataacaggcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaaaagaggaacttattaaaactttaaaaacaagaaacagcagaatcaaaagtcttgaagaagcatactcatcacaaagcttggaaggatgttttaaaaaagatctttgttaattaagtagagtgagattctcttgattagaactttatggtttttgctttatgaagtatctctccagagaagattgtaaatttgggttgaaactttgtaatatatttagatacaacaaataagtttgaaatctgagcaatttgataatatgtgtactgaatgtatatttaatgtattattaagggactaatgtgaaactcaataaatcaaagggtactattgtaattttcccatcgttgcgcttcagtcgtccacaaaaaaacttccgttggaattttctgaggaaaatgagaaaattcaattgaagaaaagagtaaagaagaagtctcttgttcggttggatttttcaggaatttcattttcgtgagcttacttgttcgttcatataaagaggtggaatttgatttatatgaattttgatttctgggtttacgaaattgatcggtttctgggttggaacttgaagttatg

SEQ ID NO: 24937 - DNA, 2202 bp, Unknown; identical to SEQ ID NO: 3674
  misc_feature (1)..( 2202): 2750-1469P.txt file - cDNA_ID_2687174; gDNA_ID_1620656; Annot_ID_47851

SEQ ID NO: 24938 - DNA, 3003 bp, Unknown
  misc_feature (1)..( 3003): 2750-1469P.txt file - cDNA_ID_2687174; gDNA_ID_1620708; Annot_ID_48950
ttcaaaaagatgacttgacattcgtttggttgatgatccttgcatctcttggatcgaaaatcttgcggcttcaacgattttgtcaatgctaatgccctcttgagattcaaatatcctgttgattcttgagcggagaaccattagcagctgatcaagtgttgttgtatcctcatctggctcactggacttactagaggactgtttttccacagatcttctactgcaaacactgttggaagattttgaagctgagttagctccatctggatcactacctactaacttttcaatctccaagaagtcatccatcaactccagtctactagaactcctaggctttgaggaaccattaacacttacttttctcactttatgagaatctagtgaggttgctgggccacactcagaagaacttccttcttcatcaaatccatcttcggacaccgaggtgacactaggcggatagtgatgatcatgaccactggatagactttcagagagatttctgctatttgattttggagcattcttgtcattgttaaacatatgcatctgcccttcaagaatcttaagcttcccaagagtcttagcgcatacatttctcgaaacctgcagttcattgttacgagcagagagatgttctttaagcgtctgaatctcctcctccatttccaatgtacgtcttgtgagatatacattctctcttttgcactcttccaacttatgatcagtagaaatctctgcctttgcgatgtgtgcattgtgattttgagacatgtttctctgtgctcgagggtctgtgaattcatgccctaagccttcaacttctagcttcatttgagccatagcagcaggaccaggaagctttttccgcagaagtcctctaagcctatgacactctgcttcaagttttgcaatctttttcacaccttccagatgctgcttatttgcgatatccgccgacttcaaactcatgtttttctcttcattgcggatctcaacttctttggaagcaacgtgaagatcgtacttcagataactaatctccttctcagccaactgaagattagtcttcaacttttccacatcagcttcagctttagacctctcctcactaatccttactatcatctcagatcgttcttgcaacgatctagtgagtgctgcattgtcagaagctgcccggtgtagtccttcactcaattcatcgatctttccttcaagctcggctttgatcttatcccattgactggtcttagcaagaatcacatcctgcagcttcttatcactctcttctttcacaatccttatctgccttgtacactctttcaacgcatcatccaaatgcgatgctcgatcctctgcagtgagctttaagagtgtaacagattcgagttgacgtttaagtgccaaagtttctgcatcagccttctcccatcctaaaaaaagaacaaaagactataatcagcaacaaaaaaaacatctcaaaacaaacaaaaatgctgaaataacattttacctgaaacagcttcttcagcgactttggcatgttgaagaatcaaagattctttagtgttgatctcagagtgagcaagagtgagtttttctttaagatctttaacttgaacttcaaacaatttgacctgatcctccattctactcatatgtgtgtatgaatccatagttatctgaacatagtttgtgtttttacacttctcctgacacacaaatcaaacacacaaaaaaagacttcaaatgaaaatttctatctcacagaaactgacagattatcacaaaactatataaaacagaggtttggtgtaaaattaaagcacctgattctcaagagaagccaagtaggacaaagaacaaacaggagttgactcgattccaacaactggtttctcagtcgtggctttgtccgaagactttctcttccatggccaacctctaccctccattttttttgctccaaaataatagtactctgcagaatccgtagaagaaggaagaaaataagctttaataaaaaaacagacaaagaactgatagaagttttgaaatttgaactaacgtacaaaaaaaggaaacaaaatcttccgtaaatgttactttcaatttcatccgacaaaatcccgctatatatttattatactgtatcacctcaacaatgaccgttttgttgtttctttctttttttccgcagtgattcacatttaatgatttctttccaaaactatgtaaccaaatttattgaaaagtctactaaaaaaataattcaaatcccatcgcaatgggcgcgagcgagtccttcacattaaacctgatcataatcatcatcagctaccacagtatcgcacttagaacacacacaatcaaattcaaacaaactttcgcttgacaatttcaatcgaaaccatatcttttcaagtttagctaactatcggaaagaaattacataccgagactaatgattccacagacttgagagagcgcaaagatcgaagaacattcgtcgagagaaagaagaagaaagtgggaggagcgtgtatgtgccagagaagaaggagcagtggatgatttatgcgcttgggctgtcgctttttttcaactttgacgctccacaaagacacaacaacgacatctctctatttcaaaaaagttttatttttttattcattttaaatacattttaaaaaaattaacaaataaatcgccatttgttgttcttttttcaaaaacggaatacgagggtgcagttatcctctacgagcaggtgcatgtaataccatctgatggatttgacttatcgtttatccacaaaagattcaaaatcttcccggtttttaagtttgggcttcataaggcccaattagtggcaaatccatcacagtccactagggtttttgagagactggatataaaatttgattttgttcattgttgtcattcgccgtaatctgaagaagacgaagcaaatcctcccacaaagaatcatccatg

SEQ ID NO: 24939 - DNA, 3003 bp, Unknown; identical to SEQ ID NO: 24938
  misc_feature (1)..( 3003): 2750-1469P.txt file - cDNA_ID_2687174; gDNA_ID_1620708; Annot_ID_165394

SEQ ID NO: 24940 - DNA, 2202 bp, Unknown; identical to SEQ ID NO: 3674
  misc_feature (1)..( 2202): 2750-1469P.txt file - cDNA_ID_2687174; gDNA_ID_1620656; Annot_ID_163657

SEQ ID NO: 24941 - DNA, 3003 bp, Unknown
  misc_feature (1)..( 3003): 2750-1469P.txt file - cDNA_ID_2687174; gDNA_ID_2926210; Annot_ID_141959
tcaaaaagatgacttgacattcgtttggttgatgatccttgcatctcttggatcgaaaatcttgcggcttcaacgattttgtcaatgctaatgccctcttgagattcaaatatcctgttgattcttgagcggagaaccattagcagctgatcaagtgttgttgtatcctcatctggctcactggacttactagaggactgtttttccacagatcttctactgcaaacactgttggaagattttgaagctgagttagctccatctggatcactacctactaacttttcaatctccaagaagtcatccatcaactccagtctactagaactcctaggctttgaggaaccattaacacttacttttctcactttatgagaatctagtgaggttgctgggccacactcagaagaacttccttcttcatcaaatccatcttcggacaccgaggtgacactaggcggatagtgatgatcatgaccactggatagactttcagagagatttctgctatttgattttggagcattcttgtcattgttaaacatatgcatctgcccttcaagaatcttaagcttcccaagagtcttagcgcatacatttctcgaaacctgcagttcattgttacgagcagagagatgttctttaagcgtctgaatctcctcctccatttccaatgtacgtcttgtgagatatacattctctcttttgcactcttccaacttatgatcagtagaaatctctgcctttgcgatgtgtgcattgtgattttgagacatgtttctctgtgctcgagggtctgtgaattcatgccctaagccttcaacttctagcttcatttgagccatagcagcaggaccaggaagctttttccgcagaagtcctctaagcctatgacactctgcttcaagttttgcaatctttttcacaccttccagatgctgcttatttgcgatatccgccgacttcaaactcatgtttttctcttcattgcggatctcaacttctttggaagcaacgtgaagatcgtacttcagataactaatctccttctcagccaactgaagattagtcttcaacttttccacatcagcttcagctttagacctctcctcactaatccttactatcatctcagatcgttcttgcaacgatctagtgagtgctgcattgtcagaagctgcccggtgtagtccttcactcaattcatcgatctttccttcaagctcggctttgatcttatcccattgactggtcttagcaagaatcacatcctgcagcttcttatcactctcttctttcacaatccttatctgccttgtacactctttcaacgcatcatccaaatgcgatgctcgatcctctgcagtgagctttaagagtgtaacagattcgagttgacgtttaagtgccaaagtttctgcatcagccttctcccatcctaaaaaaagaacaaaagactataatcagcaacaaaaaaaacatctcaaaacaaacaaaaatgctgaaataacattttacctgaaacagcttcttcagcgactttggcatgttgaagaatcaaagattctttagtgttgatctcagagtgagcaagagtgagtttttctttaagatctttaacttgaacttcaaacaatttgacctgatcctccattctactcatatgtgtgtatgaatccatagttatctgaacatagtttgtgtttttacacttctcctgacacacaaatcaaacacacaaaaaaagacttcaaatgaaaatttctatctcacagaaactgacagattatcacaaaactatataaaacagaggtttggtgtaaaattaaagcacctgattctcaagagaagccaagtaggacaaagaacaaacaggagttgactcgattccaacaactggtttctcagtcgtggctttgtccgaagactttctcttccatggccaacctctaccctccatttttttttgctccaaaataatagtactctgcagaatccgtagaagaaggaagaaaataagctttaataaaaaaacagacaaagaactgatagaagttttgaaatttgaactaacgtacaaaaaaaggaaacaaaatcttccgtaaatgttactttcaatttcatccgacaaaatcccgctatatatttattatactgtatcacctcaacaatgaccgttttgttgtttctttctttttttccgcagtgattcacatttaatgatttctttccaaaactatgtaaccaaatttattgaaaagtctactaaaaaaataattcaaatcccatcgcaatgggcgcgagcgagtccttcacattaaacctgatcataatcatcatcagctaccacagtatcgcacttagaacacacacaatcaaattcaaacaaactttcgcttgacaatttcaatcgaaaccatatcttttcaagtttagctaactatcggaaagaaattacataccgagactaatgattccacagacttgagagagcgcaaagatcgaagaacattcgtcgagagaaagaagaagaaagtgggaggagcgtgtatgtgccagagaagaaggagcagtggatgatttatgcgcttgggctgtcgctttttttcaactttgacgctccacaaagacacaacaacgacatctctctatttcaaaaaagttttatttttttattcattttaaatacattttaaaaaaattaacaaataaatcgccatttgttgttcttttttcaaaaacggaatacgagggtgcagttatcctctacgagcaggtgcatgtaataccatctgatggatttgacttatcgtttatccacaaaagattcaaaatcttcccggtttttaagtttgggcttcataaggcccaattagtggcaaatccatcacagtccactagggtttttgagagactggatataaaatttgattttgttcattgttgtcattcgccgtaatctgaagaagacgaagcaaatcctcccacaaagaatcatccatg

SEQ ID NO: 24942 - DNA, 3003 bp, Unknown; identical to SEQ ID NO: 24941
  misc_feature (1)..( 3003): 2750-1469P.txt file - cDNA_ID_2687174; gDNA_ID_2926210; Annot_ID_202576

SEQ ID NO: 24943 - DNA, 3000 bp, Unknown; identical to SEQ ID NO: 5911
  misc_feature (1)..( 3000): 2750-1469P.txt file - cDNA_ID_2687185; gDNA_ID_1620831; Annot_ID_169655

SEQ ID NO: 24944 - DNA, 3000 bp, Unknown; identical to SEQ ID NO: 9780
  misc_feature (1)..( 3000): 2750-1469P.txt file - cDNA_ID_2687287; gDNA_ID_1972187; Annot_ID_180166

SEQ ID NO: 24945 - DNA, 3003 bp, Unknown
  misc_feature (1)..( 3003): 2750-1469P.txt file - cDNA_ID_2687331; gDNA_ID_1620815; Annot_ID_169228
aacgcttcccggcgcgtgctcgtcagacgccgtctattcagaaactcagcctcatcgtgatcgattattggtttctctttcttcgctagatgtctttcgagaagctcctccacggtatctggaccttcgtgcaggaaccgcctcgtcgacacagcgccgctccgattcatcagatctagacgacctgccagatttcgccatttctgaagcttcgcagccatcatctctctcaaacaacaacattgaaaattttcgatcctggtgacaacaacaacaatgcttgataacataatgggcttcgatttctgaaactgtataagcccagttaaagcccaatataatcattaagttcgcaaatgttatacgtctctaataagacgacgacggatttagataaaatttgagcccaaaacgcaccaccactcagcgttttagacctgtcttctccagaggcagagaaggagaagcttcctcatatggcgttcatagccgaagaagccgtttgtctattccttcctctgaatgcaaatcatcatgactcatcccaaagatgagaatttgaaagatgctataaaggttttactatgcttatacgaaaagggttcaaatagacaattttttacgtgcattgagaagaaaaggatgtgattgttccacacactgaaacacgtgatacgaagtgtaagtctatatacagcagatgggtatggatacagaacgactaaagatgatgtattattgtcattgaataactatatgagaaaccaaatgttcttttaccttctgcagaattgaatgtcatgcactgttaaactcttcaaataaaaagtctgatcagctttgtgtttacaactctttcttgcgtatcttctccatctttatagatagttattttcaacgatcagcatcctattctctaatacctggatttgtgacgtttttccccaacaatgttacttctattttagtgatgttctcttgcaacccatcgagaaagggtttaatcttgcatgataagctttgtggatgggttgcagcagaagatgactacaacagaagttatattgttgggtaaaacgtcaaaaagaacagagttcttaaaaccatcaaacaaatccaggtagaagagaaaagtatgttgctcattgaacaatatcaatcaatagagataaagaacatatgcaagaaaaagcctaaacacaaagatgaccagaatttctatctgaagaatcgagcattgcatcacattcaattaaagcagaagaagtacaaaaaaaaaatgttaatggccctgcatatccaacatctcatcaagtcctttgattctctctaaaccttcactaatcagataccgaatcttttgtttgtcattgcagtctctgttcttttccatctcttgcctaacagtctgtttcagttcccctacaaaacatcaacacataaaatcaaacaaagtttatcctccgaaatctactaaacccctagatttcgagatttttaatcaaatggatgtacggtgaacgcaaatttattgtctatgtgacgaatctcatagatagaaaaataagagacatgaaagacacgaacctctaacatgaacaggagctctgtgagctatcttcaatgcttgtcggtaaagtttaagcactcgagcccggagaataaagctctgcagatctaattgaaccataatttatcaaccaaccgttgaattaagaatttacggccagagaaggatcgattcagaaagaactgaaatcaaaatcgaaatctagggtaagagagaagttcctgactctgagtcctgagttaaaagaaaaaagatcggagaaggaaagagtcacgtgagaaggacatgatgaagaattaatgaaaatatgtggtttaagtgtaaaccggtaatcggtgttaattgaaatcaaattatagtttaccaaccatctttaataacagttctgttttagatggtcctaattacggaagcccatccgaaccatcgtggtttaacttacagcaaacagataccaaaattaattaggtagctttgaataaatattaggtggtttagcatcgtgtttccataatatgattttctcagtgtacagcttcgcaatttctcaattgtttttggtccattttcgtttatttaaaatcgtttactagagttgttcgtcccttggttgactaatattctaccttttttttttaatttctttgaagcacgaaattgtaaacacaagatatcaataatttagacaaggtctcagtaatttaatatagactacgtaggatttaaaatatagtttcgataattaaaagacaatcatttaccaaaacgtgttactgaatgatttgtgttaatattattatcagaattcaaacatgcaagtatatgaagaagaagtatgtttatcgattgaaatacattgtattttttttctctctcttaggtgtttcaattacagaactttaaatgctaattaacaaaaaagtaaaatttcataaagctccaactagttcaatgcatcgttgataagttctaacttctaccttccttccgatatggctgaattttgcttgcatgtaggtcccaaatatcaccaccgtttcttaaagaaatgttatactattttgatttttggactattgaggcacaaactaaagtcaaattagtaattaactaatcatcatctttggaaaataaaaaaatgtgccgtttagcttttaggtagtagtaacaaaaagaagaaacttgaaacaaaaacaaacatgtcttccgcattttgattttataaagtcggccgtataaacacaaaggtctttcttcttcctttttagctctcacatttgaccaaaactcctccaatccaggcatcatcgttgactttttcaaactcatttcctctctttttccttcttctcacatcatattagacccaaacataaaaagaacgaagaatcctctgttcttgtctgcgaattttgctgttgtgatcagcgatg

SEQ ID NO: 24946 - DNA, 3000 bp, Unknown; identical to SEQ ID NO: 8775
  misc_feature (1)..( 3000): 2750-1469P.txt file - cDNA_ID_2687347; gDNA_ID_1971889; Annot_ID_58460

SEQ ID NO: 24947 - DNA, 3000 bp, Unknown; identical to SEQ ID NO: 8793
  misc_feature (1)..( 3000): 2750-1469P.txt file - cDNA_ID_2687347; gDNA_ID_2684202; Annot_ID_191250

SEQ ID NO: 24948 - DNA, 3000 bp, Unknown; identical to SEQ ID NO: 8793
  misc_feature (1)..( 3000): 2750-1469P.txt file - cDNA_ID_2687347; gDNA_ID_1971889; Annot_ID_176810

SEQ ID NO: 24949 - DNA, 3000 bp, Unknown; identical to SEQ ID NO: 8775
  misc_feature (1)..( 3000): 2750-1469P.txt file - cDNA_ID_2687347; gDNA_ID_2684202; Annot_ID_137225

SEQ ID NO: 24950 - DNA, 3000 bp, Unknown; identical to SEQ ID NO: 9500
  misc_feature (1)..( 3000): 2750-1469P.txt file - cDNA_ID_2687357; gDNA_ID_1972138; Annot_ID_179179

SEQ ID NO: 24951 - DNA, 10 bp, Unknown
  misc_feature (1)..( 10): 2750-1469P.txt file - cDNA_ID_2687382; gDNA_ID_1591309; Annot_ID_150822
cacaaagatg

SEQ ID NO: 24952 - DNA, 3000 bp, Unknown
  misc_feature (1)..( 3000): 2750-1469P.txt file - cDNA_ID_2687416; gDNA_ID_2926144; Annot_ID_139052
tgtaagattaatctcgaaacgttttggattgtggttagacatgtttgaattcaagctgaatcatcttgcgtcatttgctttgaggagcaatgcatctcaactctttcaaaccttactaaagaacacgcctccaatctctcaaaccttaccgaagaacaagcctcaacgctctctaactttattgaagaacacgcctaggtactttcaacctcacactttctcaagcctttttgaatcattgatttgtggctgcgatttgattgaacgacaccaatctagtctcccaatgttcctttggttatggccttgtgattatctttggcgatttcgacaaatcttatccggcatttggaatatctttccaccggcagtctcctcgatggagcattctaccaaaagctcatttgcgtcaatcgcgcaagccgtctatcaccaccagttggtcgggattttctcgaagcttgtcttcgaatttgaatctcctatggcatcaaaagatttttcaaacattgcaagcttctccaagttgagcatctttttaaaaacacattgagcctttagctttcttttccatgcattatcttaatttcagtttgtatgaattttcctctttttgaggttttaagtgaatgaaagttcttttgtccaaaaaaaacccgacatattatgtttctttcctataattgtttcaaataaatttaaaatatatattttctaaaggttatgaatcaagataaacacaacaactaatcaatctccacaataactagtatatagtttgacaaaaaaataaataaagataaaagtactttttacggggctttatagatttgggtacatttaagttaaaaaagtcagaataaatcactttttgtttggtttatagagataagcattttctgttagacaaaattaccattttgccctcaatctccttcttctttctttattctttctttattctttctttctttcttcatcgcttatttctcttcttaatatttccagaaaatctcaattttttttttggtttttttttgtttttgatcacaaaaatccaataataatgaaatctataccctaagggatagtaaaaagtgaacccaaacaaaataattaaaccgatttgataagaatataagaacgctaaaacaatttccaaatttgataaaagtttaagattttgagattttggttttgcaattttgttggttcgttgtctaggtttagagatttatttgggttttgtctaatctatttatttttgaaatttatttcaatttaatttgtttgtatgttgttgatgaattttgttggaaatttccggattttcttctatatagaaaattcttcaacatgaattagctagagaatccaaaatcataacaaaaatatcaattttcagttccttaatccaaaacaaaagaactgctattaaaaatcagcttgaattttgatctggttcgggaagggaaagagatagtgatataatttgtaggtggaaaagatttgggggagactaagattaaaacggtaaaacagaaagtagaaaagtacatgaagctgtaaggcacaaaaaaaatgccgatacttacaaagggacaaggttttaagtgtttttctcataattgatcctactttatacaactataaacaaggagaatcacaagtatctttaatttgaaagatgatatatgaaatattttagatctacaactatgtatctatatatttatttagttattgatgttaagaaaatactttatttagttttattttaggtttaaaatttaatattttattggatatcatctaagttacaatttacactttgaatatatcatttaatattaatataatctaatttaataaaattaattaatatatttatctatatatatatattacgcttatatatatatatatttttaataattatatattttatttttaaagcctgcaaataacccgtaaacacacgggtttgaccctcaccaacctcacggtagagcagtcagggtgggattagaaagctttagttctgacaaacctaacaattaccactaaaattggaaaaaatgtcaaaacaaatcacaaattttaaaatttgggacgaaaaaaccatgaagttttgacatgtcatttaaatctcaaagtttaatttgactttacaataaaatggttaagttgtgttgattgagtcattttaggcatgccgtttttttgttatttaaaagataacaaagttaattttctataacatctaacaaaaagtaacgacaatgcctaaaatgaccgaatcaacaaaacgtaaccattttattgtaaaatcaacctaaattttgagatttcaataacatttcgaaaattaatatttttttcgtctcaaatttcaaagttcatgaatttttttcgttacttttaccactaaaaattgtaaacattggtaataaaataacaaaagttgaatactccatattttgtcacctacccattagatcagatctcaatgacaaacagtatcatttatttataaaatagtccaacagattttcgtcatttctctagctttacatagtcaccattttttttgtttgtttgacctcaaaaactcctacgtttctaagctcttctctttgcttcgattcccaaaacgactatttccaaaaggttagtttttaatcttcaaatccttcttcaatgtccatcttcgtgatttaatagtcatctcctttggctttttttttttttttgagtccgtactttttggattgtagacaaagatcctcccgaccaaacattttgcttccgtgaaaaacgattgtggtctctgtaagattaagatcgacattacacaaccactgatttgtcttagctttaatgattagattcttaattaattagtcattactcttgtctctgtaatagttgacttgggtttttgaaactaatgttaaatttaccaaactaaaatttttgtagggtttaaagaagttaatg

SEQ ID NO: 24953 - DNA, 3003 bp, Unknown
  misc_feature (1)..( 3003): 2750-1469P.txt file - cDNA_ID_2687416; gDNA_ID_1620757; Annot_ID_49911
tcgatgtaagattaatctcgaaacgttttggattgtggttagacatgtttgaattcaagctgaatcatcttgcgtcatttgctttgaggagcaatgcatctcaactctttcaaaccttactaaagaacacgcctccaatctctcaaaccttaccgaagaacaagcctcaacgctctctaactttattgaagaacacgcctaggtactttcaacctcacactttctcaagcctttttgaatcattgatttgtggctgcgatttgattgaacgacaccaatctagtctcccaatgttcctttggttatggccttgtgattatctttggcgatttcgacaaatcttatccggcatttggaatatctttccaccggcagtctcctcgatggagcattctaccaaaagctcatttgcgtcaatcgcgcaagccgtctatcaccaccagttggtcgggattttctcgaagcttgtcttcgaatttgaatctcctatggcatcaaaagatttttcaaacattgcaagcttctccaagttgagcatctttttaaaaacacattgagcctttagctttcttttccatgcattatcttaatttcagtttgtatgaattttcctctttttgaggttttaagtgaatgaaagttcttttgtccaaaaaaaacccgacatattatgtttctttcctataattgtttcaaataaatttaaaatatatattttctaaaggttatgaatcaagataaacacaacaactaatcaatctccacaataactagtatatagtttgacaaaaaaataaataaagataaaagtactttttacggggctttatagatttgggtacatttaagttaaaaaagtcagaataaatcactttttgtttggtttatagagataagcattttctgttagacaaaattaccattttgccctcaatctccttcttctttctttattctttctttattctttctttctttcttcatcgcttatttctcttcttaatatttccagaaaatctcaattttttttttggtttttttttgtttttgatcacaaaaatccaataataatgaaatctataccctaagggatagtaaaaagtgaacccaaacaaaataattaaaccgatttgataagaatataagaacgctaaaacaatttccaaatttgataaaagtttaagattttgagattttggttttgcaattttgttggttcgttgtctaggtttagagatttatttgggttttgtctaatctatttatttttgaaatttatttcaatttaatttgtttgtatgttgttgatgaattttgttggaaatttccggattttcttctatatagaaaattcttcaacatgaattagctagagaatccaaaatcataacaaaaatatcaattttcagttccttaatccaaaacaaaagaactgctattaaaaatcagcttgaattttgatctggttcgggaagggaaagagatagtgatataatttgtaggtggaaaagatttgggggagactaagattaaaacggtaaaacagaaagtagaaaagtacatgaagctgtaaggcacaaaaaaaatgccgatacttacaaagggacaaggttttaagtgtttttctcataattgatcctactttatacaactataaacaaggagaatcacaagtatctttaatttgaaagatgatatatgaaatattttagatctacaactatgtatctatatatttatttagttattgatgttaagaaaatactttatttagttttattttaggtttaaaatttaatattttattggatatcatctaagttacaatttacactttgaatatatcatttaatattaatataatctaatttaataaaattaattaatatatttatctatatatatatattacgcttatatatatatatatttttaataattatatattttatttttaaagcctgcaaataacccgtaaacacacgggtttgaccctcaccaacctcacggtagagcagtcagggtgggattagaaagctttagttctgacaaacctaacaattaccactaaaattggaaaaaatgtcaaaacaaatcacaaattttaaaatttgggacgaaaaaaccatgaagttttgacatgtcatttaaatctcaaagtttaatttgactttacaataaaatggttaagttgtgttgattgagtcattttaggcatgccgtttttttgttatttaaaagataacaaagttaattttctataacatctaacaaaaagtaacgacaatgcctaaaatgaccgaatcaacaaaacgtaaccattttattgtaaaatcaacctaaattttgagatttcaataacatttcgaaaattaatatttttttcgtctcaaatttcaaagttcatgaatttttttcgttacttttaccactaaaaattgtaaacattggtaataaaataacaaaagttgaatactccatattttgtcacctacccattagatcagatctcaatgacaaacagtatcatttatttataaaatagtccaacagattttcgtcatttctctagctttacatagtcaccattttttttgtttgtttgacctcaaaaactcctacgtttctaagctcttctctttgcttcgattcccaaaacgactatttccaaaaggttagtttttaatcttcaaatccttcttcaatgtccatcttcgtgatttaatagtcatctcctttggctttttttttttttttgagtccgtactttttggattgtagacaaagatcctcccgaccaaacattttgcttccgtgaaaaacgattgtggtctctgtaagattaagatcgacattacacaaccactgatttgtcttagctttaatgattagattcttaattaattagtcattactcttgtctctgtaatagttgacttgggtttttgaaactaatgttaaatttaccaaactaaaatttttgtagggtttaaagaagttatg

SEQ ID NO: 24954 - DNA, 3003 bp, Unknown
  misc_feature (1)..( 3003): 2750-1469P.txt file - cDNA_ID_2687424; gDNA_ID_1971898; Annot_ID_58495
tatatcactagtcacaaaattttaaaacttatattacatgtacctttaaataatggaaaatcaaactcaattttgcaggagattagaatacaatatgaataatactaattttgggaccgcaaatcgtgctgcagcatcaaaaatcttaattctgcatggaacgtgtatgtgcaagaatatatattatcatctatatatctaatttgttatctagatatataagaatcacgagatcatatatgctaaaattttgtttttgtttttgcaataaagatccttgctaattaattattgaatttttttgtgtcacagctgatgatgtagttccctcttcattcggatacagatgtgctgactcccttcgcatggctggatttccaaccttgttcaaacaatgtggagggtctaaacatcgattacttcactcttttttttttttttttgattactattttcttaacatacatcactgaatttgagttatataccatgtgtgcagggatcatgtaattaatgagatccgtgtctggctcacaaaccttgggctttgaggatatggttaatttctgcataaagaaaacaaatggggagcaaaactattatcgtacaatataataaagtgtttagttttgagctttcgttttttgtctttgttattcataatcaatagttaatgtattattcttcgttcgaaaccgttaaaaaggtgaattatatttctccattatatatcttagtaaaacaatttccttatctgaccagcaaattctcaaggaatcaaaattgcttcggaaatcctaatactggtatgcataaatcaaattaactttcaaacaaaactttgtgaaatttcctgaagtaacagtattgaaaaccgttacccccatacgaacgttacagagaaaactattttttaaagaaatgattgaataaataattgagaagtaacaggaatatgttttagtcaagtgaatagtgattaaatttgactccgtcttccagagtttgactctgttaaaacgtaatagagatggactaataaattaggtcgaaagatgtaaaataaaataaaaataaaaaaaagtaacgaaaacaagtgcatgttgcgaaaatttatgatgtaaatgtcttcgtattaggcaaagtttaaaacgaaaactttataaaataccaattatgtaatttccgtactaatcacccgaaataactagtgtccaatttataaaagaaaaccattacatgataatacgtagaagtacattcaaacccaataaacaacaacaaggatcggcataacctcacgaacgcaacaaacactaatcaaagcaaacaaacatgaaaaccacgaacacgaaacaaatatttatcctcttcacttcctctgtgtctcacgagtagtggtcgtagtagtagtacttggagctgaagaaacatgttctttgtttccttcatcagtgcgaagccctaaagtgtgcttcaccgcatcagtagctcccatagccatctgtttcacctgctcaccggtctggcccaagatcccactggtcttctccttacctgcttctgcagtctctttggtatattcagctgcatcgtgtgccttgttcttgattgcttctccagtttccgacatgtagcttcctgtcttgtctttggactcttgagctctctcttgagtcgtttgtgcagcttgagacgtcttgtctttagctgactgagctgtttcatgagccttttgttgggctgactgggctgtctcttgagttttgtccttagctgcttgtgttttgtcccccatcgttcccatagcttccccagttttctcctacagttcaagattggatttacattataaaaaatactaatcagctttttttttttttttctaaaatcaaataacacgaaacatcacaaaattgaaaataataactttcaaactcatttttgttttttcacatacaaacaatagttactttttaggttttgtttaagtttctaaaattaaatcatttaatgctgctatccaaaatgtattatagttatgcatataaatcgtttagtacctgagccttgcctctggtttcaccagctttgtaactctgttcttgatgagacgccattttcactcttcgaagaaattcgaaaccaaatttttctaaatgataaaagcttttttttttagatcttgtgttttttgtgtgtttggaactgtgagttgtctccgactcgttagtcagagttatttatagcaagtcttggtcggcgagagaacaagataggtgttgcagtttcgcgacaggtgtgtaggtacgtgccccgattaggttgatgtgacgaagtttcgaaacttggagttatgtgcgagtgttaaagttaggtttctcgttttcatgatgacctatatctatgtgacacgtcatggtaaaaacggagctacggaagatgttagacacgtggtgactcacgttatcttgatattggatattcatctactcaaggcatatattatgcaaccgccattactgcatagatatttacttttttctaaaaagaaccaatacacaattcttacatggattcgaagtaattttaatatagctataaattcttgaaaatcgatcggatgagtttttattgtattcgttattgatatattactgataatatattttttgacaacaataaaaagtcataaataattgtcaccggaaaaaaaggtttaagatcttcctattgcctgtcatcctacttcacttcttgaccaagcaacgttagggtaataaatcctcaaactattcacctccacaaaaaattagccatgtcaatcgtcaatggtatgttattttccacgtgttagtgtaatgcttagatttaggattttactaaaatatacactttctaattatataaataccattataatgcatatcaaatcccttcaagtattctacaagcttacaatcttaattaattaagacatttcacagaacaaccaagaagatg

SEQ ID NO: 24955 - DNA, 3003 bp, Unknown; identical to SEQ ID NO: 24954
  misc_feature (1)..( 3003): 2750-1469P.txt file - cDNA_ID_2687424; gDNA_ID_1971898; Annot_ID_176908

SEQ ID NO: 24956 - DNA, 2516 bp, Unknown; identical to SEQ ID NO: 9985
  misc_feature (1)..( 2516): 2750-1469P.txt file - cDNA_ID_2687434; gDNA_ID_2096299; Annot_ID_195648

SEQ ID NO: 24957 - DNA, 3003 bp, Unknown
  misc_feature (1)..( 3003): 2750-1469P.txt file - cDNA_ID_2687434; gDNA_ID_1621109; Annot_ID_56073
aacaagccaattgctttaaaatgacagcatatgaaaaagaagaaccccatgatttgagagttattggtgattcatgtgttaaaaacttctctcccacgaaaatgatgtgtcaacctcatatttcctgctgatattcatgtgatttctcacgcaacacaacgtattaatcatagccgtgactagttggcatttaagaattatatcctttggaagatcttcgaatctacacgaaatgggattttaataattctacatatggatcacattcacctatatatatatagatatgctatgcattgagataaaacatgagatagggagagagtgtagtagagagaggggttaagaaatggagaaaagagtagagaagagaaggatagtgttggttccacttccattactaggacatttcactccgatgatgcaactcggccaagcccttatcttgaagggattctcaattatagttcctcagggagaattcaatcgagtaaactcttcgcagaagttccctggttttcaatttatcaccataccagattctgaactcgaggcaaatggaccagtcgggtctctaacacagctcaacaaaattatggaggcaagcttcaaggactgtataaggcagttgttgaaacaacaaggcaatgatattgcatgtatcatctacgacgagttcatgtatttttgtggagccgtagctgaggagttgaagcttcccaatttcatcttcagtactcaaactgctacacataaagtttgctgcaatgttttaagcaaacttaatgccaagaagtacttgatcgacatggaaggtatacaaaaactagcttattacccattatgcttactctccttatgttcaacataattttgttttgactttgcagagcatgacgtgcaaaacaaggtagtggaaaatatgcatccattaagatacaaagacttaccaactgcaacatttggagaactagaaccttttttggagctctgtagagatgtagtcaacaaaagaacagcctctgctgttatcatcaacaccgtgacctgtctagagagctcgtctctcacaaggctgcaacaagaactccaaattccggtgtatccattaggccctcttcacattacagattcatcgacaggatttactgtgctgcaagaggataggagctgcgttgaatggctgaacaagcagaaaccaaggtctgtcatatacataagtttaggaagcatggttctcatggaaaccaaggagatgttagagatggcttggggaatgttgaatagcaaccaacctttcttatgggtcatccgacctggatctgtctcaggctccgaggggatagagtcattgccagaggaagtcagtaagatggttttagagaaaggatacattgtgaaatgggcaccacaaatagaagtactaggacatccctcagtgggaggcttttggagccactgtggatggaactcaacactcgagagcattgtggaaggagttccaatgatttgcaggccttatcaaggcgagcagatgttaaatgcaatatatctagagagtgtatggagaatagggattcaggtaggaggtgaactggaaagaggagccgtcgagagagctgtgaagaggttgattgtggataaagaaggtgcaagcatgagggagagaacccttgttttaaaagagaagctcaaagcctctattagaggtggaggctcctcatgcaatgcattagatgagcttgtcaagcacttgaagacagagtgaagaattagaatgcaatgatttttttgttaaatggtttttttaaagagttaatgatgcatatttttcaaagtagatgattttctatgcgcaaataaaaaagttattggaaccagaggaaagatccaagcttttcaaattcaaggaacgtcattgttctaattcgtatttaacattcccaattatgtatagatcatcacaaaaattctatattgaccaaaatatgcgtttactctttcgaaaatgttagcttcttccttcgttgaaagttattgctttcaaaagatatatgaagaatacttaaaatggtatagcaaccctttgatgcaataattgaaaccaagattggagaaccatgcatttagccacttttgagaaaattttattatatttggagactagaaagtaaaacctcttagcatttttgttattattatctaaatctcaagacaaaacctacccaatggtgctcaaaaccaccaactcctatatctatctatatgagacaaaacaaaataaaacaagtttttcttggaattaatgtcatactctcagtaaatataaatgggattttaaccaaaaaaatactttttagtcaacagatttttaataataatttagatcacttatttagagttgttcagcaatgatgttatactaaccaataatcatggatgatgaagatgcaggtatgacttatgagtgataggtaaattttgtcaaagagaaattgaaagcctccgtaagaagtggagtctgagtgaaaacacggtgctaaactttgctaaagacagaataaatcaaatgaacttcatgtaacatataaaaacataagtaatagaccagctttgatttttatagatcaagcttgttcttgcaaaaattacaaaagtagatgctttgctatgcaaataaaaagctttcactttaattctcatacaaagagaaaatacgtaatggtttgagagttgttgatgtagcttgtgactttatcttcattaccacgtaattgatgtgtcaacctttatcttaacagctaaagtagttgacttgttggcatttaaaatctcttttagaagattatgttgaatagtcattggcgtgcgattattcttgctttgaaaaatgaacagttgactatagaaaatggtctcatttggaagattgtgggattttagttattacttggatcacgtataggattcagagacaagagaagagaaaagaggagagaaatg

SEQ ID NO: 24958 - DNA, 3003 bp, Unknown; identical to SEQ ID NO: 24957
  misc_feature (1)..( 3003): 2750-1469P.txt file - cDNA_ID_2687434; gDNA_ID_1621109; Annot_ID_171758

SEQ ID NO: 24959 - DNA, 3003 bp, Unknown; identical to SEQ ID NO: 21114
  misc_feature (1)..( 3003): 2750-1469P.txt file - cDNA_ID_2687499; gDNA_ID_1620745; Annot_ID_166639

SEQ ID NO: 24960 - DNA, 3003 bp, Unknown
  misc_feature (1)..( 3003): 2750-1469P.txt file - cDNA_ID_2687599; gDNA_ID_2214507; Annot_ID_133783
aaattgtttttaacagacctctgtaaaaatttaattagcgaccttttctatgctaaaatatttttcaagtgtttatatataatcaattgatatatcaaacagaatcaaaagcaagggttaatttgcaaaatggctaattttttttatagttgctaaaaatataattttaaataactaactaaaagcaaatgaaaaagtactttaatagttgaccttcaaaaatatttcatttaatattcacgtagagctactcgttttattcattggtaaaatttaagaaaacgtggtaacaaatgattttcttttttggaggctaatataataatgaatactattaagtacgagagaaaaaaaagattaggctaagaactaataataatggaatgatggaatataaaaattctattttgtttggatgatctaacctttcatttaacctaaatgggtgattttcttttctgtaatatatcacttttatattatatgattttaatgttaacagattttattaaatagagttgaagctatatgatttcaggatgccatatcatactaatattctacgtacaaaacaatttagcacagaaatagttttaccgaaaactaattgatggcaagaaatcacatgattattattttttgtaatttgttttgtatattttccattaatattttgctaattaactcagctaaaaatgtttcaaaaaatagatctgattatttggatgttggttttatatttccttgttataaaaacaaagaatatgacgaataaatttaactttttgaaatcctaaaaaaaaaagcatacacatttaaataaatacttttatgtatttacctatgaaagttaaattgattttgtctatcagatacataaatgatcaaataataaatgagaaaaacctgcccatatgtgccgatatatatccagttgaattaaaccatcatcttcttgtttctttgtttttaaaattctcttatgaaatcgatcttttagataaaatacaatcgaatttatggaagcaagaaaaaaaaattacgtaggggaggtgtattattgggggacccagcacgatcaaaaagtcaatattcatcagccaatttgctgaataaataaataaataaccttgaaaacaatttttggttaaattacaaaaataatgatatccacaaacatgtgaattgttccagcaattgctgaccttgccatgaggcaccttggaagagccattgcttcattacaatcctttaaagccataaatatgagattaggattaccaaaatttcacatataacaaattgttttatatcattactagcttaatatgtgttttattatagttttagatcgacgtcatctgaatattttcccccaaactcctaaattttataatctgtgtctaaacctaattttatatttcaaaacatccctttttctggaagaaacttgtcttttaattttttttttttttttcacacttgtcttttaatttccttaagagaccaaatcaagttaatttagtgtactcaccacctttaaaacaggtcaagttaatttatttgaacatcagtaataaatttatgaacatctcttttcaacatcggtattcttaaatagtgttttagaatcgtcattttaactttatgtttcactaaacttagaaaatatttagttttttttatctcaattagtaattatcatttaaatttttattttctcggtttctacttcgccactattatttaacatattattaaacaaattagtattatacgggttgattttaattttccaattacaaattaattaaaattcaactttttgattggttgtataatccgaaggaaaaatgtttacatacgaattgttttaaaaacactttgatttaaaagtccgacctaaacaatcaacatgaaaattaaacttatgagcaaattaggttgatctagaaaataacttttgcatttgtctcatagggaattataaagttagtatctacacacatatatcaaatatacatgttatatctatattactctctctctctctctctctctctctctatatatatatatatatatatatatgtatattcacaaatccatgtatgtattttaaattttgtttgttttttttttccttcaaaatgagtaacttatatagaagtcattaagattagctttgcacaactctttgggaacaaaaaagaacccaaattttaagcattattcaatgttcatataattattatgtatattatttttccttattgattatcaattttatatacacaaaaagatatcagtgaagaacttatgattgtgcatattttctgtccatacataaccacaatattaatcaaaaatttaaatttatcttagatatttttcttatgataattcaatactgtataattttttaaaatctatacattacagttttgtcttttaaatcatattctaatatgcataaatatctagaaaaatactaactccatagaattaaatttcttatgtaagtttagtatattatcctaaatttgtgttaatgttaagatttctactaaatttgatactcaaaagtaaaaagtttctcttaatagaaaaaaataaatatagattctcttacattacaggatcagagtataaaaccagtttaagtaaacaatgtttcaaaaaacagtatgatatctgaaattttaattataaaaccaaaaatccaaagtcaaatatacgttttccaagtgagaaaggacccataaacaattaacaaccattgatgatcaccaaatcataatcaacggtcgaaatgaatgaaaaataaaagtctgaaacggtggagagtttcgtcgttttgagtggttataaaaagagaaggcgtatatctcctctgcaacagaagctcgctttctctctctctctctcgtgtgtgtgtgtgtgatcgagtggtgaaacgacagagaggggcgtcgttttgttgatttcttctgggtgaagatg

SEQ ID NO: 24961 - DNA, 3003 bp, Unknown; identical to SEQ ID NO: 24960
  misc_feature (1)..( 3003): 2750-1469P.txt file - cDNA_ID_2687599; gDNA_ID_2214507; Annot_ID_184164

SEQ ID NO: 24962 - DNA, 3003 bp, Unknown
  misc_feature (1)..( 3003): 2750-1469P.txt file - cDNA_ID_2687670; gDNA_ID_1620518; Annot_ID_159366
ggctatcgccttgtagaaaagattttgagcattagtaagccaattaaagtaccaaataccaatgacagtaaatgctctaattcagtaatcttattcactttcacattgttttcatgatcatctggatgctaacagctagcacattcccttgtgtaggtttctttggtttgatataagtaaatcaaatgaaacagagaaacaaatgaaagattgattcgcaaagcaccacagcttcttctaatttcattcaaatcacaggggcttgttctccaaaggggtgaaggagaaattgccggagaatatggactctttatctgtgtatgacaaaaaagaaccatataagaaaaggcatgtctattcgaaatgcaaatgcgagtaacataatgaggcattccaactatagcgtcataggtacctgttaaagaaagagaaccaagttctctccggacatatcttgccattgcctgaaacacacaagcaatgtcttaacaagtttggtacacaatgcctaaactagtatgtcaatgtgtgtgtgtttgcgagagagatagagaggagaaaatcatgcctgtgctgtttttaaatctgtgttatcaggtgttgttgttccatcatcagaaaatacgttcctacaatccaattgcatataaggttctgagacaaatccgttatctatggctgccatattgtatataaattcaagccgagctacttagctgtgtaatctctaccgaactcattgcataaagcatgacgttatagaagctttacctccataatttgatttgtaggtcatttggtttagcttccggaagtagcgcagcatcataggcaacaacatttccataaaatattctctccaactccttcatccacttggctagcagcaagttaacctgtaatttcaagaaagattaagaccatcttattttaaggaatctaagaaactaagatatctcttcgaaactatattaaagcaaaaccaagtctagcacgtaccccggctttagataccctgagttcaacatcatgattgtagatctcatagacgtattgaccaaggtcaacaccttcctgtccatcttccttcaagcggcgtaaaacaagccacatatgaaggacaagcagcgaatacgttattttgaatgttttctccaagttgaatactgcagcagagacagagcacccgatatataaacaaagcacaaaatgtaaatacataactctgtttgcaaaagttgtgttggaaaccaaataaagtaccatcatatattgcaggtttatcaacttgtgcaatgatccgcttgtagatcacgttagccccacggatagacatgctctgtttgctatagaacatcatcatctttagtatgaaacgacgaatccctacatagtctggttcatcaattctgagaggagagtctttaggcagagccaatgaacatggctttgaccaaaacatcttatccaagtttatctgtcaaacatagaacaaatccttttcatcaaagaagacacgattgtccagaagcagttgactaaaagagcatgaatctaaatcacaaacatactaatgaaactccaacagaaaaaaagggatgaatcctaaatgaggtacaatggggaggcagaagtcactttagtcccgcattcgatgaaactagaaacagagagaatcaaattgagcttaggttcgaatactatagtgagacctaaacattcacaacaactacgcattaacagctacttctgaaaacgagatctttaatctgagtaaacaaaatgttaccactttaagatcataccggagatttactggggaaatccttctgcgacggaggatcagctgccgccggcgcaacagtcgcgtacccatatcgggagaaaaaggagagatttttcatcgatccattagtggtcaaagatcgaagctttgaggtttgagtgacgactcgagctaatctgggcaacattagagagaaacccttgtggttttactcaacagatgaataaatctgaagggagaaatttgaatgagtaagatcgaattctaaaaccctaggcgaaaaaccctctccgactccttttctgtgtgattgatgatggggctaggtagtcgtccacgttagcgtctatttggccagatattcaattacagtgctaacttacgccgttattaggaacggaaaaccttggttatgcaaaaacaaacacattttaccgatattggtgacacgaaactgatggtcgattttagatagtaagagttgatgataccataaaatatgtttgtttataccattatcattttagggggataaggaactatgactactttgtcatccatttttttggtggatctctaatttgaactcaagtggcttatattgaatagttaagaaattatgctttctcatggccattggggaatttagtttcaattagtgaaaagagttttaattagattttattgtgcaccgaattttactgatttaggacatggtttacgcttattttctcaagagcaaaaatatttacggtctcctcaacaatatcatcaatttacactttttattactcttcgaaacgcttcatctctctctttctctctctcaagctgtcaaagtcacctctgtattcgcgtgaagataatttctcacaattagggttttttttttcttctgagttaactgttccatctccatcctaatcttcaccttctccttgatttcgagatctctgtcaatttgttgaatctgttctttatctaattagctcaactccgagtctttgctggattttgaaggtcaccactgttcaagtttacattttttttcctgctaatcgcttgatacccgtttctgctgttgtgggatttattgggtttttcttctttacgatttttgttgcagcttttgtagctgaagcaaatttgtaatctgtgatggtgtatgcactgattctgggtatggtattgtactctaggatctcgtagcgagaatg

SEQ ID NO: 24963 - DNA, 3000 bp, Unknown
  misc_feature (1)..( 3000): 2750-1469P.txt file - cDNA_ID_2698044; gDNA_ID_2926150; Annot_ID_198024
taacaaacctgaaatatgatcaaaccaatgagaacaggctgtgtatcaaatccgaaactcctgaagagatcagtggagtttctgacaagagtgtatcctccaaattgtaagaaggcaaggatctgcaagcaaaacattgagagagggtcataagacatgatttcttaagtgaaatgtagatgtgagtaagtttttgaactgtcggttgagcctcacttgaactgcaatgaacgagtatgtagtgtgattcagtttccaatgtccaagctcgtgtgcaataaccgccacaatttcatcctcattcttgcactgcacaatagaagattatgttatgtttcagaaccagaaacagaaatgtgagtatagctcgtttgaagcatcaagagtcacagtacctgctgaatcaacgtatcataaagaacaatccttttgttcttaaagaaaccatacatgtaagcctgtatgatgtaacaagatacgtaagcttctaatggtaaactagagtaaagtaggtaggaagagatctcaagcttctcacattgctatggcttgaccttgtagatccatcgacaacaaacagcttcttcaaaggaaactttagagaagaagcaagtttctcaatcttctcccggaggtctccatctggaagctatagccataaaaaagcgggagattatattgtctggtaacaacatatgcaaacaagcagtgaattgtaaaatggccatgacagaaatacacacaggagtgaacttgttgaagagcggtgctatcaagaccgggtatatagtcatcatcactagagacaggataaacatgaatgcccacagatagatggcaagataaggacctcctttctggaaaaagatagaaacttcatgctcagagaagcaaattttaaatttttaacacgaaaactaaaaactttgaagctcacactcaatggagaatagtcatccatgtgaaaaactcagaaataagatgaatccagaatcatcaaacctggactatgaaaattatcgcagcaacaatgggtgggcctagtatgacagagaggaatgttcctttgatcatgtccctaatgaacatccatattgtttgctgtcaacagaatttagaagcaaatttaatccacatctctgataaaaaaacgtaagtcacaaggtagtgttggaaatacgacatactttgttgaacccatgccgagactcgatcacgaaagttgagtacaaagaaaatggcaaatcagtgatctgcatcagaatataaaagaaatattattatcttaagaaaatagatattttgatgctaaacgtataggactatatgaaggggtttatttggaacacctgtgaccatgtcataacaccagccaagaatgaaagagtatgcagtatttcattctctggatcaaggcccaacctcggtaaaacagctccagacatctaaggtaaaaatgaaaactttacaattgtaatgtaacaactctatattcaaaatgagatactgtataccgaaaccagatatgtaccttccaaaaccaaggcaagatcccaaagaacaaaattgcagagtccataagtatagttacaaactcatgaacaaagtgaaaatagctgcatatattaaagttctcagtgatgatatcccctggcaattataaaaaactaaaatgatataaatatgatcaagacgaaaccttttgtcaagactgtatgctcgtgatttctcaaacttctcttggctaattacaccaaccaaggttttcgggagagttggaagcttgagagcagtgagttgcctcagatccaaatacgtctcaaaaatgtacatcactatcataaaacctgtaagaaaaagaataaaacagaagatgaaatacgaatctactctaaatgccacaacaacagatactccatcactgaaaattcaataacatcatctacttttttgatcaaccagatataaaaagatctcttgtgctgactactgatggaaacattggagcactgaaagagttttgatgcaacattcacatacggttccacaacacaaaacccatttcaaaaaactccagaaaactctagttgcagtcacgaacataataataccctgacaagaaaacccaaaacctcaagctgtatgacttgaacaaagaaaaatttcaagattctcaatttccaatcgggaatgaggaaaaaaaagactccgacttttcttcccaaatcctagattttggttaacagagaagctccgtacattctaaaaccgaggaagagatgatgaaatcacataagctcaaatcaaatcaaacgcacgagtaagacaagaaactagtaggagtaataaaacctcagatcaaggtacgcactattagaaaagaacaaaatttagaaacgagaagcagagacgatggtatatgaaacaaacgagtcatggaatctcaacacacacaacacagaaagcaaaacccaaacaaaaacgaaatacgatgagtgaaacaggatagtaaaatgtctcagaaaaaggttttgaagcttacccacgacggtttccatgaaaggaatcgccatggctgagaaaagagtgacctgaaccgcgatgaaagcagaagcaaatcgaagaaagcagaagcaaatcgaagaaagcagaggaacgacaaaagagaggtttttcgtttttgactcttctcaggtcggtgtggatatgtaaaacaacaaaaacacgggtacgggttataccttagaagcccaaatagtaaacgggctgagatttaggcccatatgaaacaacccctatattttatctaaaatctctaagtataatagtatattatcaaatattggggccttagttgaaatattatgttttaaaggggctaaacggaaaactccttatcctcaaactgtcaacaaattacgaaggtgccattgggtttaatcaacaacgaacgccgagagctctcacttcacactttatccacttggagcttcgacaatg

SEQ ID NO: 24964 - DNA, 3003 bp, Unknown
  misc_feature (1)..( 3003): 2750-1469P.txt file - cDNA_ID_2698044; gDNA_ID_1621155; Annot_ID_56996
aaataacaaacctgaaatatgatcaaaccaatgagaacaggctgtgtatcaaatccgaaactcctgaagagatcagtggagtttctgacaagagtgtatcctccaaattgtaagaaggcaaggatctgcaagcaaaacattgagagagggtcataagacatgatttcttaagtgaaatgtagatgtgagtaagtttttgaactgtcggttgagcctcacttgaactgcaatgaacgagtatgtagtgtgattcagtttccaatgtccaagctcgtgtgcaataaccgccacaatttcatcctcattcttgcactgcacaatagaagattatgttatgtttcagaaccagaaacagaaatgtgagtatagctcgtttgaagcatcaagagtcacagtacctgctgaatcaacgtatcataaagaacaatccttttgttcttaaagaaaccatacatgtaagcctgtatgatgtaacaagatacgtaagcttctaatggtaaactagagtaaagtaggtaggaagagatctcaagcttctcacattgctatggcttgaccttgtagatccatcgacaacaaacagcttcttcaaaggaaactttagagaagaagcaagtttctcaatcttctcccggaggtctccatctggaagctatagccataaaaaagcgggagattatattgtctggtaacaacatatgcaaacaagcagtgaattgtaaaatggccatgacagaaatacacacaggagtgaacttgttgaagagcggtgctatcaagaccgggtatatagtcatcatcactagagacaggataaacatgaatgcccacagatagatggcaagataaggacctcctttctggaaaaagatagaaacttcatgctcagagaagcaaattttaaatttttaacacgaaaactaaaaactttgaagctcacactcaatggagaatagtcatccatgtgaaaaactcagaaataagatgaatccagaatcatcaaacctggactatgaaaattatcgcagcaacaatgggtgggcctagtatgacagagaggaatgttcctttgatcatgtccctaatgaacatccatattgtttgctgtcaacagaatttagaagcaaatttaatccacatctctgataaaaaaacgtaagtcacaaggtagtgttggaaatacgacatactttgttgaacccatgccgagactcgatcacgaaagttgagtacaaagaaaatggcaaatcagtgatctgcatcagaatataaaagaaatattattatcttaagaaaatagatattttgatgctaaacgtataggactatatgaaggggtttatttggaacacctgtgaccatgtcataacaccagccaagaatgaaagagtatgcagtatttcattctctggatcaaggcccaacctcggtaaaacagctccagacatctaaggtaaaaatgaaaactttacaattgtaatgtaacaactctatattcaaaatgagatactgtataccgaaaccagatatgtaccttccaaaaccaaggcaagatcccaaagaacaaaattgcagagtccataagtatagttacaaactcatgaacaaagtgaaaatagctgcatatattaaagttctcagtgatgatatcccctggcaattataaaaaactaaaatgatataaatatgatcaagacgaaaccttttgtcaagactgtatgctcgtgatttctcaaacttctcttggctaattacaccaaccaaggttttcgggagagttggaagcttgagagcagtgagttgcctcagatccaaatacgtctcaaaaatgtacatcactatcataaaacctgtaagaaaaagaataaaacagaagatgaaatacgaatctactctaaatgccacaacaacagatactccatcactgaaaattcaataacatcatctacttttttgatcaaccagatataaaaagatctcttgtgctgactactgatggaaacattggagcactgaaagagttttgatgcaacattcacatacggttccacaacacaaaacccatttcaaaaaactccagaaaactctagttgcagtcacgaacataataataccctgacaagaaaacccaaaacctcaagctgtatgacttgaacaaagaaaaatttcaagattctcaatttccaatcgggaatgaggaaaaaaaagactccgacttttcttcccaaatcctagattttggttaacagagaagctccgtacattctaaaaccgaggaagagatgatgaaatcacataagctcaaatcaaatcaaacgcacgagtaagacaagaaactagtaggagtaataaaacctcagatcaaggtacgcactattagaaaagaacaaaatttagaaacgagaagcagagacgatggtatatgaaacaaacgagtcatggaatctcaacacacacaacacagaaagcaaaacccaaacaaaaacgaaatacgatgagtgaaacaggatagtaaaatgtctcagaaaaaggttttgaagcttacccacgacggtttccatgaaaggaatcgccatggctgagaaaagagtgacctgaaccgcgatgaaagcagaagcaaatcgaagaaagcagaagcaaatcgaagaaagcagaggaacgacaaaagagaggtttttcgtttttgactcttctcaggtcggtgtggatatgtaaaacaacaaaaacacgggtacgggttataccttagaagcccaaatagtaaacgggctgagatttaggcccatatgaaacaacccctatattttatctaaaatctctaagtataatagtatattatcaaatattggggccttagttgaaatattatgttttaaaggggctaaacggaaaactccttatcctcaaactgtcaacaaattacgaaggtgccattgggtttaatcaacaacgaacgccgagagctctcacttcacactttatccacttggagcttcgacaatg

SEQ ID NO: 24965 - DNA, 3003 bp, Unknown; identical to SEQ ID NO: 24964
  misc_feature (1)..( 3003): 2750-1469P.txt file - cDNA_ID_2698044; gDNA_ID_1621155; Annot_ID_173456

SEQ ID NO: 24966 - DNA, 3000 bp, Unknown; identical to SEQ ID NO: 24963
  misc_feature (1)..( 3000): 2750-1469P.txt file - cDNA_ID_2698044; gDNA_ID_2926150; Annot_ID_139283

SEQ ID NO: 24967 - DNA, 3000 bp, Unknown; identical to SEQ ID NO: 6657
  misc_feature (1)..( 3000): 2750-1469P.txt file - cDNA_ID_2698142; gDNA_ID_1621100; Annot_ID_55831

SEQ ID NO: 24968 - DNA, 3000 bp, Unknown; identical to SEQ ID NO: 6657
  misc_feature (1)..( 3000): 2750-1469P.txt file - cDNA_ID_2698142; gDNA_ID_2926167; Annot_ID_139970

SEQ ID NO: 24969 - DNA, 3000 bp, Unknown
  misc_feature (1)..( 3000): 2750-1469P.txt file - cDNA_ID_2698142; gDNA_ID_2926168; Annot_ID_199251
tatacgtgagattcagtttctttctcatgcgtatgaggatcattttctgcataagatttgtatctagttttgaagcaggatcagcatgtttactggactgaataaattttcaatgtttcaggagaactatggtaaagccgaaccatcaaacgttgctaaggtgaaagctctctacaaagagcttgatctcgaggtttgccactaagcattaactcaaaccctttcgttagttagaccaagtagaataagagaacgtaattattgcttatgaaagtagagaacatgagagatgtgatatatatgtaacaaaatctgcgtttgatcttgattattccatagggagcgttcatggaatatgagaaggaaagctatgagaagctgacaaagttgatcgaagctcaccagagtaaagcaattcaagcagtgctaaaatctttcttggctaagatctacaagaggcagaagtagagacatactcgggcctctctccgttttattcttctgacatttatgtattggtgcatgacttcttttgccttagatcttatgttcccttccgaaaatagaatttgagattcttgttcatgcttatagtatagagacttagaaaatgtctatgtttcttttaatttctgaataaaaaatgtgcaatcagtgataaattgatacttgttaatgtggcaaaaattttgtgtcacatgagggtgcaacagaaatttggaaggacctgaggctgtttgagcttacatcaccttgcaaaatcgaaacagggtttggggaatctggtcctatgtcaaattagggaccattgttggagaagaagaattttcaaggacatgtgtaacagatagctccaggaagcacttaagaagttacaatagataaagacgagaagattagtggaaatgaatctatagtgatgatcacaatctaattgatgataaccgatttgagtctcatcttagacagtacattgacaacaaaggtaccatagttttagtggttctgattttctaatatagaccccaagaagatattacagagataacactggttcagcttttcagcttaacaataaaatacatctgaccctatatttatgcaatttctccgtcctatatctactatatcgctaaataatgtaacactgaaaaatttccctaatctacattgtgagagtccagatcaatagtccaatgcaaatgtggtagatagaccaccttgccattggctcagtacttgacgataagcctatatcagtaacacccacaagaaatcgacagtcaccaactgaaggatctaggaaggtgaccatgccaagtccatcaaagtcacagctcttttcatgttgcatctgcatctgatagtaactgttgaaagcgtatgagatattatctttttcaccaagctggctgcacgagcccccgtcgttgagcgttgtgcaatctgcttcactgcaagcaagcctgaggtggtcaccaacttgggtcatgtctcttgatgggtgagccacacaccaccttgaaggaaggtactgcacattttttgcattcttgagtcctctgttgcctagtcctaagttgagacgatacttggcctgtccatcgaaagagaagattccccaatgcctctcaaagttaccaggcagtgtgcttttcgctccttcgtcaagcaaaccgaaaagatatacatccgcaggaggagatccaggcctgagcggtgttcctttgttgctcaacacatggctaatgagcccttgattaaaaacccgggctgctgtgagattagcaccaactgctccatctgtaggccaaccaatctcaccaataactataggcatttgaccatatccaagcttggtgagagcagcaacaagagtgtcaaagttcccatcaaatgcattatagtaagtgttaggcccatccggaaccggatgactactcccctcaaaaaaggcatagtcttgtggaaaatccgagttcccatagagactaaggaaaggatagatattaaccacaaaaggagagccattggagttgagaaacgaaaccaattgagtcataatctgtgtaagctcaggccggaacatcccctgagagggaacattagactgatacgcatctgcgttgcaaggaaccaccaacttcacatagctagctagatttgctctaaccaaagattgttgcaggttaaccatagttgggactacatagttctgaaactgaccaccgtaaccagtcagaaacggctcattccctactgcaacatacctattcaacagatatattggtaaaatcctctgcttaatcatagcttaaagacacatatactctgagagaaaagatacctaatatcagcaccgtttttgcctatgaagcgagagagattttgctggacaaacaaatcagaattgaaagttgagagcatctcgttaggaatgccgatcattacttggattccagtacccattaacgctcgaagcgcatctggattcgcatcgaaaagcttcaccttggtgatcttgtttgctttgaggagatccaccactgtggaaggtctcatcttgtgaaatgacaacgttccccagttcacgccgattgcagattccacctcatgggagacgagaagaagggagagggcaaagagagctacacctacaccgcttcccatctttttcactgagctctctctcgggtgcaaagatagcaactttttaaaggttacagctttatttttataaacagactgcatgtcgttttctatttaaataaacgtcaagcagtgcggttactaaataggaaacgacatagagattgaaatttggcgacaatacaggttgatgcatcgctggatttgctggaaaacaaaccgtcaatctccgtctttatagagaaaaaaagattctcttctcttctcgttctcatcatcgtcttaaagaaggaattcgatttttcgcctgaacctgcggatttttcgattcttcaaattcaatgtcttatg

SEQ ID NO: 24970 - DNA, 3000 bp, Unknown; identical to SEQ ID NO: 14311
  misc_feature (1)..( 3000): 2750-1469P.txt file - cDNA_ID_2701811; gDNA_ID_2684104; Annot_ID_190359

SEQ ID NO: 24971 - DNA, 3000 bp, Unknown; identical to SEQ ID NO: 14311
  misc_feature (1)..( 3000): 2750-1469P.txt file - cDNA_ID_2701811; gDNA_ID_2684104; Annot_ID_137117

SEQ ID NO: 24972 - DNA, 3000 bp, Unknown; identical to SEQ ID NO: 10475
  misc_feature (1)..( 3000): 2750-1469P.txt file - cDNA_ID_2701832; gDNA_ID_2213653; Annot_ID_132486

SEQ ID NO: 24973 - DNA, 3000 bp, Unknown; identical to SEQ ID NO: 10475
  misc_feature (1)..( 3000): 2750-1469P.txt file - cDNA_ID_2701832; gDNA_ID_2213653; Annot_ID_181652

SEQ ID NO: 24974 - DNA, 3000 bp, Unknown; identical to SEQ ID NO: 14338
  misc_feature (1)..( 3000): 2750-1469P.txt file - cDNA_ID_2701843; gDNA_ID_2684110; Annot_ID_190588

SEQ ID NO: 24975 - DNA, 3000 bp, Unknown; identical to SEQ ID NO: 14338
  misc_feature (1)..( 3000): 2750-1469P.txt file - cDNA_ID_2701843; gDNA_ID_2684110; Annot_ID_137139

SEQ ID NO: 24976 - DNA, 926 bp, Unknown; identical to SEQ ID NO: 11177
  misc_feature (1)..( 926): 2750-1469P.txt file - cDNA_ID_2701871; gDNA_ID_2214482; Annot_ID_133298

SEQ ID NO: 24977 - DNA, 926 bp, Unknown; identical to SEQ ID NO: 11177
  misc_feature (1)..( 926): 2750-1469P.txt file - cDNA_ID_2701871; gDNA_ID_2214482; Annot_ID_183402

SEQ ID NO: 24978 - DNA, 3000 bp, Unknown; identical to SEQ ID NO: 11174
  misc_feature (1)..( 3000): 2750-1469P.txt file - cDNA_ID_2701875; gDNA_ID_2214482; Annot_ID_133280

SEQ ID NO: 24979 - DNA, 3003 bp, Unknown
  misc_feature (1)..( 3003): 2750-1469P.txt file - cDNA_ID_2701887; gDNA_ID_2214482; Annot_ID_133293
tcgagactatttggatattgtaattttcactaagttatctgagtaagaagaaccatatcgtttcatttcctatctatttattaaggttcaacttttgagctattgactggtaatggaaaatgtttgagaaagaagaaaacttggagacttcaaacccattccggttaattttcatcgttgatctgacatggtaaatactgaataaagcacatgcacactgtgacacctctactttaaaaagtaccaaatagataaactgactagaagattattttcttgtgatgcaagtaagaaacaaactcaaccaatcgaccttactaaagtatactcttctataaaataaagaaatttcttctcccccgtatgtaaattgaaatcaccagatggaagtcttggtatagagatatatcgatctgataatcttatcacggaagaagactttggtctcgattgcatatctctcacgtacgactctcgtttgtatgaatagaaagaacaaagacacacacaatttaacgagttcccaaggtcaaaccgatccttggtacatctcggctaggctttgccatagcaaattcactatccagttttttttttcttttttttatacatatgtacacaagagagatagagagaggattaggtcaaaagaagcttcgagaaacttggaatcaacgacctagatatctccttgttgtcttctgttgttggcgatggaagtccttgtgtaataaaaggatgtttcaagagctcagtcgcggtgggcctgcgtgaacgcatgtcatcgcatcgccttaagaaatcttgagcctgcggagagataacgtcacgcaaatgccatacgtaaaattcgtcaaagtactcctggataggtatagctccaaacatctcattaaccacacaccctagagaatatatatcaagggctggatcgatatgtcccggatcgatcagtccgtttggtacaaaagagtccgggggcatgtactcaacagtaccaagggacgtaggatcatgatcggtgtcaggctctttggatgaaccgaaatcagcaagcttgagatcccacggctctccaggagttgtggaagggaagaggagaacgttggatggcttgaggtcgcagtaaacgtaaccatgggagtgaagagcctcgagtccttctaggatcatacgagccgtgcgactgaccaaagactcaggtatcggctcttctttccgacggaaaccatatataaacctatggagattacctttggaggcgtactccatatagatgtagcaatattcgtagggttggatttgtaagtgaagcttgtttgaggcttggacgatgcgaggatgatcacggaaacgatgcatgatcctgagctccttctcgagaatctttttgagatgcatcggcgatgacttctttgcgtaaagtcgggagttggagtccttctcgagagagacgtaaccgaagttccctcggccaagagaagagagcttcgtcaacgaagactcgtccacaatccaatcatcatctctgcaaatttgttccatcatcatagtgaagcttttacgtattcgattgtctttaggttttcatcagtctctctatacctatatatatatattttctgtaggtcggtgcgtggttcgttttttcagttggagctaggacagattttccttttccaattaagaatctgaaatatcgtatacacgctttagttaaactatatcctcaacttatttaatatttatattatttaatgctaaaaatgaaaatttattataaattacaaattctaaatgttaaaagatttacactattatttattcaaaatgtgtatacaagaaatataaccaaccaataaatatagacaaattaaaagtaacataatttgttagcacaataatatatgaatattaaaaagcacatattgatcttaaatattcctaaatataaaaagaaactgaaataaataaacaaaactttctattaattttaatattttttcattttatgattagtgatttttcgtattattttaaattttacttttagaaagaaaagtaattgtaatcctagattcattggaatcgagtagatttttttagtaaatacatcatcaattattgttgatatatgatatattttctattcgaatatattttgagtcaataatattagttgttaaaacaattatgcaaaagtgaagtaaaaagatatatgtgtttatatatatatggggtaggaaaataaaaactttcaacaattaaattcgatatatatgttatttttttcacttgatattacttttttcccataagactaaaggaagactgataaattgatttcttaaaattttatttaaatgaaaccaaataaccaataatccaatattcaccaaattaagtttcctttttcgtattattttaattatgatagcttaatgatatcaattgttaatttttatttaaatttcctatcaaacggataaaagattacgaagtaggattatgttaaaagacaaattgaagattataatggatttttaaaggttataagattactttgttaatatttaagatttggggacaatttggaatatttagtatttgttttaagaaaataaaagattttggccaatttttcctaatgtcaatttagtatttttgtaccggctaaataatctttcgtgtagacaaaaatcaactctgaataaaataataataaacccaccagccgttaaaaaagggtgaaaaacatagtggagccctatccttctctctctctctcgtagccctcctctgttccatcttcttgctccgccgatctccctctgctctttcttcttcttcttcttcttcaattctgtttttatttatttctttataaaccttctctcttaaaacccaaattcaaaaaaatcaaacgaagaaaaatctccgagttagaatcgtccataatcttgagactaagtgagaaatagtatccaaggtgatcaaacaatg

SEQ ID NO: 24980 - DNA, 3000 bp, Unknown; identical to SEQ ID NO: 11190
  misc_feature (1)..( 3000): 2750-1469P.txt file - cDNA_ID_2701895; gDNA_ID_2214482; Annot_ID_133296

SEQ ID NO: 24981 - DNA, 3000 bp, Unknown
  misc_feature (1)..( 3000): 2750-1469P.txt file - cDNA_ID_2701898; gDNA_ID_2214694; Annot_ID_136765
tttgagatgtcatcttcttcaatacttacaggatccaaagagaagtgtttgcagagagctgaaagaatcatctgcttcgcctttgaatccatcgtcaacttcttctctttctctattttcgaaattttgttcttctctttggggctcttcgctgtaagaaaacacactgcaatttcttcgatagggtttttgcttgatgtaactaacggtcctaacggacttccaactaacggcgttatctccatctataatgggcctagatatattagcagcccattaatatgttcttactatgggctttaccaccgaaagcaatcattaataaaataaaataaatgaattaacttctcagattcttcaaagacctagagtgtcttcgtcttcgacgacggcaaattcgtggaagctgtttcatcgattccggcttcactgaagcggcgtcgctcgacgtttattattccgacgactaggcctttgaggcagtttctgattaacttcaggcgataatggcaaacagaacagatccgttggcaaagaatataagaggaacgaatccgcagaatctggtagagaagattgtgcgaacgaagatttatcagcacaccttttggaaggagcagtgctttggtctcacggcggagacattggtggacaaagctatggagctcgaccatctaggtggtacctttggtggtagccgcaagcctactccgttcctttgcctcatattgaagatgcttcaaatccagcctgagaaggaaattgtcgtggagttcataaaaaatgatgactacaagtaagatttctaaccaaaagcttatttctgcgtaatctagattggatactgctattagccttgtcgtagttgtttctcaagtatacaggtatggaatgtctctcaaatctattggtcttagataatctactctcttagtttctgcagatatttgttcttgaattactgaaatatttactcttttggtttctgcagatatgttcgtattcttggtgcgttctatctgcgtctcactgggactgatgttgatgtctatcgctacctcgaacctctctacaatgactaccggaaagtgagacaaaagttatctgatgggagtaagtttcattttctttcgatggatccgttgtgtttaacttttgattgatttgttcactaactagatttatttctttggtttggaatagagttttcgctgacacatgtggacgaagtcattgaggaacttctaaccaaggattattcttgtgatattgcaatgccacgtttgaagaaaaggtttcttcttttgcatttgtctgaagctgaataattagtttttggtttctgcagtattttaagatggttaatttttcactctgatgataggtggacgcttgaacagaatggtttattagagccaaggaaaagtgttttggaagacgactttgaagaagaggaagaaaaggaggagaatgaagggattgctgatggatctgaagatgagatggtcagtgctttcattctgcaatagtttttatgtgatctgttttctgtttctatctagcagctctaagatgataccatcttcctcctcttttacaggatcagcgccgtaagagtcctgaaagagaaagagaaagagacagagacaggagacgcgacagtcatagacacaggtatctgaatccgtgacctttactagatacatttctatgctagttaacatttttcaaaaaaaaattctttgtgattgtggaagctgtttgatctagctaatgctcttgcatcatgtctagtactctgtcttttgagtgtctgtttccactatggcatctcaagccatcagcggttggatacagcttccgaaattaaatttgtagagatccttccaggtttctctgtactgacagtgttcagagagaagtattatggatcagacattattacaatccttaccctgatacagtatatggtagttgtcattgtgttactttgaaaaagatcagttaatcatgagagcacttcccatctagtttttagctcaatcaatgttttctttttgttacagattttcattatgattgatgttgagacttgagctcattgtttcatgaattataatttgaccatggttctgtgattggcagggatcgtgattatgacagagactatgatatggatcgagatcatgacagagactatgaaagagaacgtgggcatggtcgagaccgggatagggagagagacagggatcactatagagagcgagatagggacagggaaagaggcagagatagagaacgagacagaagagacagggcaaggcgcagaagtagaagcaggagtagggatcgtaagagacatgaaactgatgatgtgcgggatcgggaagaacctaagaaaaagaaagaaaagaaggagaagatgaaggaagatggaaccgatcatccaaatcctgaaattgcagagatgaatagactgagagcatcactgggaatgaaacccctcagggactgaactgtgaaatgaggacatctttatcaaaccgaaacttggttcatttgcccagctaaaccggttactacactgtgatcctactcactatagttttggtttttttgagtttacctgatccctctttaatgtagaacaaaatggagaatctgtaatggcattgtactgtatgttctctaaaccgtaaacgaattgtggtcgagaaattctgaatgtaacccggttcttgatattagttgtttttaaggtaattcagataaatataaaaacctatatgttatgtctacgtggcgatatcactttatgagtccatgtaaatcggacccaccaaaagcttataggtaaatgatacggtttcataatcattaaccatcacgacgcgcgtgctactcatgtcccacttacgacgacgtcgttttaaactctctctctgtgctcttccagtctctatcgatcgccttctgaattttccggcggaaaagcaaatg

SEQ ID NO: 24982 - DNA, 3003 bp, Unknown
  misc_feature (1)..( 3003): 2750-1469P.txt file - cDNA_ID_2701901; gDNA_ID_2214483; Annot_ID_133305
aaattccattcggaaatagagaggtaatttcttcataaagctgtacccttttgatttcattggttgtttcatctggtcaaatttgaattcggagatgattggtaggatttgagacctttcgctctatagtagagaagcaaagctcgctgctttagatgtatgtgttgaacttgttttagcttcttcttaagtttttcatctttttctttctttttgtctactgtgtagattttagttgagactggtctcatggggagacaagcaagttctgcagtcacggtgacagatggagaaactgtaagtgtgctgtttcattcaatttccaaaactttcaactttttttcttagttcctcgagtttgtattcttcagtttagcttctgttacatgcttatctcttaatcggctttgtttcattatctaatctgtctacttgtcattgtagattgtcttcacatccgtttgtctagctgatgttccgagtgagccatcagattttcttcccctttatgttcactatcaggagcgattctcagctgtaggtcgaactaggtaagcgtttttcaattttggagtctcttgctgtaagaagaccatgtcattgcctaaatgatgatctaaatggaccttcttgtggtacagtggtggattttttaagcgagaagggagaaccaaagatcacgaggtatgtactaatgctgtttttggtttcgtctatttcgccatccttcttaacatgttgatttttatgcaggttctgatttgtaggttacttttctttgccttcctgcagcctcctacatcaccggacaggaagagctaaaagcatgcttaaatgattggaaatccaatggtttagtggtgtctggtttggttagagatcagagggagaagttgattcaggaagtgtcttccacgttcagtggcaagctcaacattcttgtaagttcccttctcctgcaaaatgcttgttaaaactgactctagttttttctcagcattgtgatcagaatcgtcattgatcttgaaatagtttattgcattagctctgcatccttataagtttattcagagagacgggagtcgccattagctcaaggatcagggaataatatgggtggttctgtgatgaatggtaatactcctccatcactagactgtcttttatctccaaaatccaaatggatcctcttaattaatgatgagtttctacatcatgaaaattgatcatgtcatggtgtttccagctaatgaatctgtttcacctgtaacctcttccccggttataacttcaacaccgttggaacatacagaggctggaactaaaggaaagacggtccccaagaagacacttcagccaatggaaatgaatcaactcgagagaaggtatcactttaacataattgtcattatttttatttaactctgagatggttcttctttgtgtttaacactaatatgcacagatgcgtgagaagcattatagtgaagataacagtcgtaagaggaaaagaggagaactggagcataattcggacctcaacgagactggtatgtcttaactctcattcgaccttctgaaattcatgatcagcttgcaatgttacaaaggctgagttccattatacgagtaataaatattactatactaaagcaatttcattaattatcttgttaatttgtgcatgcgttgatctccagtgctaccctctgattggactcccgatcctgtgaagaattttgctgctgatgatgatgatgaggaaaccaaagcaaaggatgcaacaatggttctgccttttgtgaagaagtcaccggtttggaagatatatgaatcaatggaggtcttcaaaagagtaccacaaagtcctcatttcagcccattgtttgaagcaaaagaagatttccgtgaaggttttgctttgggtatgatggtgactttttctggggtattagaaaaagtagaagatctgaaaaccgacgttcccatacgccaactaaatagccttaaagactcatttaccgagctagagaagcatggattcacggtcacagcgcctttatctcggatcgccaagctgttagctctcaaagatagacaactaaaaatattggaggaactaaaagttttcgacaaagagatgaaagatgaatctagcaaaaagcataaagctgagcaagagtttggtgagatggaacgcaagattcttgaagtgaaaaacaaggttctggagctgcagaagcaagaagcggctctggaaaaacagaaggatgcaacctatgaaaagatatgtaaaatggagtcacgtgcaagagatcttggtgtagagcttgaagatgtggagtgagttggagacaattctgtcagctccctggtaagttaagaaaaaaaacaaaactataatgatctattctgactcaaaagatttatctgagttcgttgttcgttataggttatgatgtttagcttttaatcttgaagccattagcttaacttcattttcctttttgtggatttcaggtgaaaaaacaaaacaaagaaggaacaaaagcgtaaagggtttataggatcaagatcagagtcaaggagagaagctgacgtggcaaagacttgtgagtgattaagtcaaagagagaagctgacgtggcaaagaaaaatgaagactgaataattaattaattaatatcagtgagagcagataaaaacaattaattaagatgggctcgttaatttaggcccaatagatttctttgtaactttcatcgcgccaaaaaaatgaagaattattcattaatataaagtaattaattaaggagtatgatatgacgacttctcagattcctatgtaaagctaatccattttcagaaacagagtttgggtttctctccgctttagggttttctgtggaagaagaaaaaggcgggggttttctctctctttgttctgaggtttttttttttttaatgtaatcagagtaacgacattggtagtatctggggatg

SEQ ID NO: 24983 - DNA, 3003 bp, Unknown
  misc_feature (1)..( 3003): 2750-1469P.txt file - cDNA_ID_2701901; gDNA_ID_2214483; Annot_ID_183421
ttggtttcgtctatttcgccatccttcttaacatgttgatttttatgcaggttctgatttgtaggttacttttctttgccttcctgcagcctcctacatcaccggacaggaagagctaaaagcatgcttaaatgattggaaatccaatggtttagtggtgtctggtttggttagagatcagagggagaagttgattcaggaagtgtcttccacgttcagtggcaagctcaacattcttgtaagttcccttctcctgcaaaatgcttgttaaaactgactctagttttttctcagcattgtgatcagaatcgtcattgatcttgaaatagtttattgcattagctctgcatccttataagtttattcagagagacgggagtcgccattagctcaaggatcagggaataatatgggtggttctgtgatgaatggtaatactcctccatcactagactgtcttttatctccaaaatccaaatggatcctcttaattaatgatgagtttctacatcatgaaaattgatcatgtcatggtgtttccagctaatgaatctgtttcacctgtaacctcttccccggttataacttcaacaccgttggaacatacagaggctggaactaaaggaaagacggtccccaagaagacacttcagccaatggaaatgaatcaactcgagagaaggtatcactttaacataattgtcattatttttatttaactctgagatggttcttctttgtgtttaacactaatatgcacagatgcgtgagaagcattatagtgaagataacagtcgtaagaggaaaagaggagaactggagcataattcggacctcaacgagactggtatgtcttaactctcattcgaccttctgaaattcatgatcagcttgcaatgttacaaaggctgagttccattatacgagtaataaatattactatactaaagcaatttcattaattatcttgttaatttgtgcatgcgttgatctccagtgctaccctctgattggactcccgatcctgtgaagaattttgctgctgatgatgatgatgaggaaaccaaagcaaaggatgcaacaatggttctgccttttgtgaagaagtcaccggtttggaagatatatgaatcaatggaggtcttcaaaagagtaccacaaagtcctcatttcagcccattgtttgaagcaaaagaagatttccgtgaaggttttgctttgggtatgatggtgactttttctggggtattagaaaaagtagaagatctgaaaaccgacgttcccatacgccaactaaatagccttaaagactcatttaccgagctagagaagcatggattcacggtcacagcgcctttatctcggatcgccaagctgttagctctcaaagatagacaactaaaaatattggaggaactaaaagttttcgacaaagagatgaaagatgaatctagcaaaaagcataaagctgagcaagagtttggtgagatggaacgcaagattcttgaagtgaaaaacaaggttctggagctgcagaagcaagaagcggctctggaaaaacagaaggatgcaacctatgaaaagatatgtaaaatggagtcacgtgcaagagatcttggtgtagagcttgaagatgtggagtgagttggagacaattctgtcagctccctggtaagttaagaaaaaaaacaaaactataatgatctattctgactcaaaagatttatctgagttcgttgttcgttataggttatgatgtttagcttttaatcttgaagccattagcttaacttcattttcctttttgtggatttcaggtgaaaaaacaaaacaaagaaggaacaaaagcgtaaagggtttataggatcaagatcagagtcaaggagagaagctgacgtggcaaagacttgtgagtgattaagtcaaagagagaagctgacgtggcaaagaaaaatgaagactgaataattaattaattaatatcagtgagagcagataaaaacaattaattaagatgggctcgttaatttaggcccaatagatttctttgtaactttcatcgcgccaaaaaaatgaagaattattcattaatataaagtaattaattaaggagtatgatatgacgacttctcagattcctatgtaaagctaatccattttcagaaacagagtttgggtttctctccgctttagggttttctgtggaagaagaaaaaggcgggggttttctctctctttgttctgaggtttttttttttttaatgtaatcagagtaacgacattggtagtatctggggatggaggaaacgattaggaaaggttctgaagtggaagtgtcttctacagaagaaggttttgcagatgcatggttcagaggtatcctccaagaaaatcctaccaaatcaggtcgcaaaaagctccgtgttcgttacttgactctgttaaacgacgacgctttgtctcctcttatcgagaacattgaaccgaggtttattcgaccggttccgccggagaatgaatacaacggtatcgttttggaggaaggaacggtggttgatgctgaccacaaagacggatggtggaccggtgtcattattaagaaattggagaatggcaagttttgggtttattatgattctccacctgacattattgagttcgagagaaaccaattgagacctcatttgcgctggtccggttggaaatggctccgaccagatattcaggtacgaggttgatgtaatccaagttgggttttttttttccttaattttgttgctttgttactaaagattgaaacttttatctgttgcatgttgtgatccattattaaatccgtttttttttcatgcttggagctgtctctgttttgttgcatgctatgttttgattgaaatggttaaaggcttgatctttgactttgattcttagtgtagactttgatgtttctgattgttttccttgaaggaattggataagtccatgtttagctccgggacaatg

SEQ ID NO: 24984 - DNA, 3003 bp, Unknown
  misc_feature (1)..( 3003): 2750-1469P.txt file - cDNA_ID_2701905; gDNA_ID_2214483; Annot_ID_133304
cttcttctctttcccttttctacttggttatccagtttatctgattatttctggtgaatctgtcaaattttcagcttcatgtatacttgagaacctatggacttgaacaaatggtccaagctgcaagctctgctgttggtcttcgaacgatcaagcgggttgagcagactctgcaagatctcggggtttgtctttgcttcttgttctgtttaactctttctatttgtctatctcatttgcttatctttccccattgattgatgatgagacttaactaatgttataaaaggcacccgtactgaagctagctttgaatgtgttctatgtaattagttgggattttggttcgggtagaggctagtaggttcttgtcagtttatttgattgtagccactcttaagatttactaaatggattttttgagtatatagagttttctgtttacaggttaatttaaagccaaaggttcctaccaaaactgtatgcgatgagcatcttgagctaagaaaagaaatattaacactactgaatcttcagaagcaggtaaaccatacaatacaagtcttatctcacatagattcacaaatatacagctatttgtttatttaacttgttgccaaaacatggtggggtcgtaacttcagctgcaatataaggaatcagaaggttcatcacatcgtgaagggtcgtatgccgcaatgccagacactccaaaggtgagcaacaaactttgtttattggttctcgctacagtttcatcttcctgttgatctctttaatttctatatatatttgatcaggatcgtgttttcgcaccggacccattcagttttggaggtacattatttccttatcttgttggtttcagcattgtatgcactacttaaccatctctaagttcattttgtgtgtttatttcagctgaaagaccaatcaagaaggaacaaaaacgcaaggtggtgcacatcagagtttgctcttctttatttttcgtaccaattcctccgaaaatcctttgcatctacatgtaaaacttgaatcttaattaaaatatgtttgggaatcctgcagggtcctggaagacaagcagatactccttcaccagctcataagcgtccgagaaagttgaaagcctctgatctctaaaatctctctactcggtgcatactgactcgcaatttcatgtgtatgtatttgcctttttccggtgatttccgcaatgttttcagttcttaaattatttctgatctctaaaatctctctacttgtactcagacaccgcactatcttgtcaagccaattagagaaattgagaaaatgttgcacattatatttatgactagtaagaattattacatctaaagacattttcgaaaatgttaaattacaaatggttgattggtatgataaagaaaagaataaaaattaattagatagaagagagagtaaactatcgaaataagaaacacaatatcaggaggtggaaggcgaggagacacattcataagaatgtagataacagggagcttgaggtgggtagagacagagaagaagacagttgacaacaattgttgagtcttgaaggagtctcgctacatacatgtaaagaaaaacaaggattactactttatttcttcaaacttatagattcttctattgataggcaaaaatcttagcttcaatgtgtttatatgtatgccaaaactccaaccaaagaaagaatgtccatactttttctctcaacttagcaataagtcccattatacagtgggatttaagattactgaaattttcaacacttagaaatcttgagtttttagtatactaccaattagaccaaaaaataactaaatttgttccacatgtgacagaggtatactagttattataatcaatatcattatcaatattaagcacaactacattcgaatgactaacagagattcctacgaaaaaacaataatctgaagcaatagaagtaagagaagcaactatacatttggaatcgaatagccgatatgggaatccgccacagattctggagaagaatttgcagtttgtcggagagagcttttgattgaagaaatcagacaaaagttttggaggagagatctcgaaccggaacaaaaagtttacattagtattgaaattagaactaatttgcggttcggtttacactgggctaaagaggaaaaaaaaaaattcacgcgatggtgattttgaagacaactgcgttgataaaaaaaggcatgatttcaaaaggtgaacccctacagaattgctctcacgctctcaacgcgcactttgtgcgagtagatctgaaatacagccttgtgattggctaaaaaactctaaaaaaatagaaatagtagacatgttgctagcttatgttattatttagcttttctacaaaacgccgtcgttttttatttcgatcgtttcagcttttggcattgatccgaaccaatcggttcaactggctaagtctatccacaggtttgtataaaaaatctcatttggtcatgaaattaagcactaaatttatattaattaatcatttaatgcttatagacaaattctatttcatatttctaacgaatcagacctaattgtacgaaataaattattggttctgaaaatatcaattgggaaattaaaacccggttcaatttgaaaccggaaacaagactagctacgcctggaaactctcacacagagtcacaggagaagctcccgcgtctgcaaggaacggataaagtctctctctttctcactctctctcaatgaagaagaagatgctgacgagtcccagtaacgcacttcacagtagtactccacagttctggccagttcgccggagcagactttgccgttcccggaatttccctcgttttcactccggcgaacgcagcagcggcggaggaggaaaattgtgctcgctctctcttctctccggaagtggcgccagtaaattcagtgtcagagctctagttaggcctgatg

SEQ ID NO: 24985 - DNA, 3003 bp, Unknown
  misc_feature (1)..( 3003): 2750-1469P.txt file - cDNA_ID_2701913; gDNA_ID_2214483; Annot_ID_133301
gatcggtcaataagggatataaatacaagatgatttaatattcattagccatcttcctttttagagagtcttatctattgccctataatatttgatttaaactgtttactaagattttgcgattgaccttatagagattttttgttggaggctttatgtgttatgtcgcatcaaatcggaattagacataaccagatgacaaaaaagagagcctttgcgtatgaatatgacagaattttgagcgtgtaagttaaaaagacgagattgtgggttctacttttggtagttctgctgattttgatagatcgcaaacgtctttttatgttgatttttcatctttttgttgattatttatctctttctttttgtgctttcctttttaaaactatagatctacttgtccggtgagacgatcgtatatataggatagtacacgttttggcatcaaacttgatttcctattctcgccaagcagttttaatttcttgtcttatcaaacaggctttaagattgttcttgagtaatatgcaatttagcagtagaaaaaaacagtgaaatattccttcaactcataaatcaatataattgacacaaaagaccggtcttatttcatgtcaatagaaaatggtattttctctcgtggtttgttacttttctgttcttataaggctaacctctagtggggatgcaaagttctagatttagacttgttcgttagatgactaggtggttagaatttagattcgcgtcgttgtttactgtgttcgggataatcgtttttagttgggatttgtcttcgcgggttcatctatcctttgctctactctgtttgtggttaaagattctctagtccgcgatcttcgagctcttatttccgcgagttttgctctcctccgactttcatgttgatctcatgagcttatcttcttgattttagtatattttcttgtggtcccatgtatcgggcttttgttttcggggatttctttattttctgccggctatgttgtacgaaaacgcattccaaaactgtatttcacccatgtattatataatgaaaatctttcagttaaaaaaaaaaaaaaaaaaaaaaaaaactagcttatttgggttgtcgtctatatcacatatctaatcgatgtaacaattcactgaatcgggtgttacaaataacatttgttttcttcactaaaagtataagatactggtacaacgcgaaatctaacctatattcgaatcaaatgacacgtcatcacttgggtgtctatttgtccacagttgaaagttataagaagcagacaagtgtctcataaagacatcgagatctgattcggttctcaggtacatacagttaatcgggagtgttgctttcccctagaactatggaggctactatttaagtgtcgttgtgtaacaaaaatcctgtgtttacttgcattacttaaactcctttactttaatagttttatatatgttttcgacctccctttttcgacggagtggatcgctatgacatgtaggcatctgattgtatttgctaatctgtttttgttagtatgttaaatttttaacccaatatatgtttatagtgcttatatattcttactttagttacatatgaatatatgatcattgatgaattaaacaatataatgtaataattaaatttgatttccctgatcgaattataatttatatgttttgtaatacgaatcaattaaaatattttcttgttacacattttgataaaatgtcgtagaacgttacttaaaagtaatgatgcattaacaaaatgtacaacatatattataaaagttatcatcaatattataggcattcgactttcagaatgtgtatcaataatcgaagtagtaatggaacgattattgaaagtatactacggtctctctttacttcatcgtggattctcattaaaaacaaaagtactttctctaccggcaactattgaaagtatattattgtttttaataactttgatagtgtttcttaattattattcccaacgtacgataaaattttgtttgataaaactcacaaaagtttagtatatttctgtaaatatatgcatagaagtcatagtgattgacagaggaaagacgtctctttgactactcttcaatcgaaaacaaaatgtgctaaaatttcaaaagcaaagtccctaaactcgcctaactccatttctcatttgactttgccttaaatgtcaatagtcctatgttatttagctacattcaaaattgggaattaagaattattttagactccatatacttagaaacgaatccgtattggaaactaatttccatttagtaatagtatttaagtattattatgcttaccgagtagcatgtagtagtttcttaatgttagctaatttcaaagcaaacgacgaatattaaatcgtgattgcacacaacaagaagtgattaataaatcattaatttcgcccatagtaatcactaaccagagtaattttgaacaagactaaggatgtacaataacttacgtctgcgatactgtgtggtaataaatatagaaactttatgaaatagaactctcttaccaaagaaagaaaaagcaagagtgcgtgttactatacatctgaacaagtcaaagggtcaaaccttagtattttaaaattacacaaacaattgaccaaatggagagctaattatgtttagcataatttactatatagttgcaaaattccactttagaaacagaataaaaaaataaaaattgaacataacacttatgccgtgttccagtcactcttcaacattctactcattttcaaatatcctttttataaaatactacttttaaaattatttgattcttatgttccttcactatatatatataaatatcgcacattgcttaatcacttcaaatctaatccacaaaaccattcacaccatctcatcttctttctctctatctcttttcctttcctcatttaaagtttctttataagaaatg

SEQ ID NO: 24986 - DNA, 3003 bp, Unknown; identical to SEQ ID NO: 24985
  misc_feature (1)..( 3003): 2750-1469P.txt file - cDNA_ID_2701913; gDNA_ID_2214483; Annot_ID_183417

SEQ ID NO: 24987 - DNA, 2063 bp, Unknown; identical to SEQ ID NO: 11201
  misc_feature (1)..( 2063): 2750-1469P.txt file - cDNA_ID_2701916; gDNA_ID_2214483; Annot_ID_133321

SEQ ID NO: 24988 - DNA, 3000 bp, Unknown; identical to SEQ ID NO: 11203
  misc_feature (1)..( 3000): 2750-1469P.txt file - cDNA_ID_2701929; gDNA_ID_2214483; Annot_ID_133315

SEQ ID NO: 24989 - DNA, 3000 bp, Unknown; identical to SEQ ID NO: 11205
  misc_feature (1)..( 3000): 2750-1469P.txt file - cDNA_ID_2701945; gDNA_ID_2214483; Annot_ID_133308

SEQ ID NO: 24990 - DNA, 3000 bp, Unknown; identical to SEQ ID NO: 11205
  misc_feature (1)..( 3000): 2750-1469P.txt file - cDNA_ID_2701945; gDNA_ID_2214483; Annot_ID_183426

SEQ ID NO: 24991 - DNA, 3000 bp, Unknown; identical to SEQ ID NO: 11195
  misc_feature (1)..( 3000): 2750-1469P.txt file - cDNA_ID_2701949; gDNA_ID_2214483; Annot_ID_133300

SEQ ID NO: 24992 - DNA, 3000 bp, Unknown; identical to SEQ ID NO: 11195
  misc_feature (1)..( 3000): 2750-1469P.txt file - cDNA_ID_2701949; gDNA_ID_2214483; Annot_ID_183416

SEQ ID NO: 24993 - DNA, 3003 bp, Unknown
  misc_feature (1)..( 3003): 2750-1469P.txt file - cDNA_ID_2701953; gDNA_ID_2214483; Annot_ID_133310
atatcagcagaatctattatatgttgaatgttctgtcttccaataaatgatacaaaaataaatcttaaactaggatttaatccgtggtacaccacgggacaaatattttttatatatatatatataataatatgaattttacggttttagtttagtattaaagttatataattttatattaatattgtaactaaaaaaattggtgatgataaaataataaaataaatatttaacatgtgttatatcaatccaaacccgtcctgctattcatatcaatctaaatccgtcccgctatattttttgtctcatgattttttaattttttataagtttaaatattagttgttgaattagttatgattgtgattttataccgaaaaagttatggacttttaatttcatggaatattcaaaccaagataaggaatgtttttaggtgcacatataattgggtttgctcattttacgggattgtaaatgtattttggtttgtttcacaatgtttgttttaattgattgccgatatttaatagaaataatttaaatagttcaaattttggttgttttaagatttagtgaatattgtaggtgagataaggagaagataatttatcgtgttttgcgtgacatatgggattaccatatatttcgaatatttttggtttgttacacaattaattgccttaaaaaaatacaaactattaattaaaaaaaattaaataattaaaatccagtgacaaccattgtaaataaatcccaactccatgatttatttcacaaaatggatgcaaaaatgtatatatagatttagaaataaaaaaatggatcaaataaaaaactcaaaattttatgataaaaaaaactaaaagatcaaccaatattaagaaaatatatttagtaataatactatactataatatatagctatgatagtttagtttaattaacggcactgtattttaactattattgatttggcccataattaaaatacttattgggctagaggcaggaattacagttggggctaagcccattaatactagtgggtttaatttggccctttaacttaaatactgtgatccataaactgatatatggttaaactgtacgacgatacagatgatttaggtctctcttcttcttcttctttttcttcttgagcgccggcgaaaaaagtctctgtgagaaaaagatacgacgattgtcattagaagagtcgtattacatgttttgtgcttgaatctaattcaacaggctttatgtaagagattctttaacaattcctataatctttgttgttggattagattcacgcacaaactcgtaatctgtcttttcgatttttaccagatctgtcttcgatttcgaatcgatctcttttgattttggtgattttaagatttagatgttgctttaatttgggaatcgtaaacaagatctacatgtctacttttggaatcattcccttgcgttgatgatttctatcgttttctatttccaaatttggtattacctatgtttggtatgaatctcgattcgagagcccgacaaaaagttatcactctgtttatttatgcatattaaagttttcaagcactcatttcctaattgtcttgcttaattatgctttcttaagactttcaaagactttacttgagttactggatttgattgatgcaaacgacttgtccttaatccatttatgtctgtgtattaatgtctggaatcatatgacagttgttgttattgctttagcattttcttacgatccactggtaaagagaatctctttctcatagtcctgttctacgttctttgttggtttgtttgtccgagaaagcagatcaaaatcttttgtaaaaatattgtgaccaaattaaacttaaacatctttaagtcactctgattgtggggtgtgtctactattaacatttactaggtcaagatatttacttgtataattcaaagattttatatctgatttcaattaattttcttataacaaataccaaggaactcttacttattcagccaggtggtttgggaatactcaatggtagatcagaattttttcatgtctttatggatttactacactacatgaacaataatgttactagcgagaaacgtaagtttttcttgtaacaaaagtataaccaaatatatgaacaagtaaatagttcgttaataatagcattaataaacataaattcatattttagtgtggcacaatctgtagttaattaagagtcttaaaattaccctgccaataaaacggtcaaattacaatagaataaagtggtaattaagaaaaacaaagtacgtagcatcgaatcttcctctctctggctaaactaattcaaagtttcaactagagaggaattaatacgtacaaagtaatgtattaatttggttttaaaaaaataagagtgctgtgtagctttaaaagattttaaagccaaaactaataggtgactttaaaaaaaaataaaaaacaaagagtaaaaaaaaaaagagtgctgtgaaagctttaaaagattttaaaggcaaaaaaatcttgattggcaaaaaaaaactttgaagacttttaaaatctttctaaagtcttaaatgcttctgtcaatcacccccgaaatcgttaaaatatatgttatttagtttaggaaggtagaatatcagaccaaatatattttgtttggtatttttttatagtcaaataaaaaaactccaaatgtttaaacttatttttgttaaaaaattacatttaaattatatatatggaaatatttaatgtgaaatatttaaatatttataagatgatatcataccacatatgtacatatggatcagtgaatgcaaggtaaacacgctcgctctgtgaacagtttaatatataaacacctaattacatttacttagatgtgaattataaaaaatcaattctatacgatgaagagggtagcatcttacaattacaaaattgtgtgtatggtcgtaatg

SEQ ID NO: 24994 - DNA, 3000 bp, Unknown; identical to SEQ ID NO: 11228
  misc_feature (1)..( 3000): 2750-1469P.txt file - cDNA_ID_2701983; gDNA_ID_2214484; Annot_ID_133332

SEQ ID NO: 24995 - DNA, 3000 bp, Unknown
  misc_feature (1)..( 3000): 2750-1469P.txt file - cDNA_ID_2701999; gDNA_ID_2214485; Annot_ID_133342
tcaattccatgagggagaagagagctgagtgcagacctgatgttgtgacatttacgagcatcatgcatttatactctgtcaagggagagatagaaaactgcagagccgtgttcgaagcaatggttgcagaaggtctaaagcctaatattgtttcctataatgccttaatgggtgcctatgctgttcatggaatgagtggaactgctctctcagtgttaggagatatcaagcagaatggtattatcccagatgtggtctcttatacatgcttgctcaattcttatggaagatcacgtcaacctgggaaggcaaaggaggtattcctcatgatgaggaaggaaaggagaaagccaaatgttgttacttacaatgcattgattgatgcttatgggtctaatgggtttctagctgaagctgtggaaatctttcggcagatggaacaagatggcattaagccaaatgttgtttcagtatgcactcttttggctgcttgtagtaggtctaaaaaaaaggtgaatgttgatactgtactttccgcagcacagtcgagaggcattaatctcaatacggcagcctataactcagccattggaagctatataaatgctgcagaacttgagaaggccattgcattgtatcagagtatgagaaaaaagaaagtcaaagctgattctgttactttcactatccttataagcggttcatgtaggatgtcaaaataccctgaagcaattagttacttgaaggagatggaagatctcagtattccattgacaaaggaggtgtactcttcggttctatgtgcttacagcaaacaggcaagtgcttagagtttgagctcagaagaagacgtgtgtattcaatagaattctgattttcatatggtttgactgtcactttctttgtgataatttccagggtcaagttacagaagcagaatccatattcaaccagatgaaaatggctgggtgcgaacctgatgtgattgcatacacttcaatgctccatgcttacaatgcttcaggtaaataccatgagtgtaagactgttaaaaatggtaacaaaatgttttcagtggatctgagttggcttggaatggttttgtgttgccagaaaagtggggaaaggcttgtgaactcttcctggaaatggaggcaaatggaatagagccagattcgattgcttgttcagctttgatgagagctttcaacaagggaggtcaaccgtcaaatgtctttgtcctgatggatttaatgcgggaaaaagaaatccccttcactggtgcggtcttctttgagatattttcggcttgtaacacgtaagttcttgtatgtctatttaaaacattacagtaaaatacttgctcgaattacagaaagagcaatatatcacccttcttctttcaacattgcagcttgcaggaatggaaaagagcaatagacctcatccaaatgatggatccgtacctgccatcgctttctatcgggttaactaatcagatgctgcatcttttcgggaagagtggtaaagttgaagcaatgatgaaggtacaacgaacttttagttgatcagctaattagacttccacattatctttcttttctgccaacctgtttacaaaagaatgttaacgaaaccatgttgtaccactaaacacacgcagctgttctataagattattgcctctggtgttggaatcaacctcaagacttatgcaatactgttggaacatcttttagctgttggaaactggagaaaatacattgaggtaatacttttttgtttgtctcttgccaaatgaatttcaattagcaatgaccaagcaagttttgcggttgagaaataaaatttgacttttgtgtgaatgatttgcaggttttagaatggatgagtggtgctggtattcaaccctcgaaccaaatgtatcgtgacataatctcctttggtgaaagaagtgcagggatcgagttcgagcctctaatacgccaaaaattgggtgagatgagagaggaatgcaaaataaatgattctgtcacatgattttcgatctttttggtgtctcacatttcattttttgttggttattccatagaatcactgagaaacaaaggagaaggtctgattccaacttttagacacgaaggcacattgttgtaatttccactatatgcttgtatttttggcccagtgattatgcatatgatgtttgtaacttgtaatctcctctatcgataatatgataattcaattcagaaaacgaaatcattttagtattgaaaataaacgtagattgttggctagagttacatattgaattgctataggatccagcttgtatgtgcagataatagataaactgatacaagacattcaattcaaccaatcatttcaaaaagtttgaattatgatttttaaatggaatgattcgatgtgtaagtcattacaacggtagcaatatgaagaatcaaatggtaggaaagaaaatccgaatttaaaatattccgaaaattattaagcttagtttgataaacaaaacaacaacatcgtgagtgtaccataggaagaatattccttggaacgaggcgagagttgggaaacacttcacattaaaatgtcagaatccagaaacagatcacgtacacgtggacataattagtacacgtcagcatataaacctattctactaatgacgaaagcaccctcgtctccgtacatagccgttgcagttattatctttcgcttcgttgaaaaaggaaaaacaaaattgggacgtaatggtaaattaagtccgtaattttattttgccgttgtttagattactagaaaagactcaaaaatcaaaatcattgtattcggtgaaaaaggaaagagtcaaagttgaattttctcagctctcactctctttttctctctctttacttctactgtatcaagaagctccgttttgcttagccatagtgcgtctagggtttggttggtgggaagaaggttccgatcatg

SEQ ID NO: 24996 - DNA, 3000 bp, Unknown; identical to SEQ ID NO: 11239
  misc_feature (1)..( 3000): 2750-1469P.txt file - cDNA_ID_2702003; gDNA_ID_2214485; Annot_ID_133343

SEQ ID NO: 24997 - DNA, 3000 bp, Unknown; identical to SEQ ID NO: 11246
  misc_feature (1)..( 3000): 2750-1469P.txt file - cDNA_ID_2702007; gDNA_ID_2214485; Annot_ID_133345

SEQ ID NO: 24998 - DNA, 3003 bp, Unknown
  misc_feature (1)..( 3003): 2750-1469P.txt file - cDNA_ID_2702013; gDNA_ID_2214485; Annot_ID_133347
aattatttgatttggagagattggtctcatcattcgctatttcagcatgacacgatgtcctttttagcatgtgaatttgcacgattcaactcctttttgaaggatatgcacttttcgtatattaaaagaatacactatagtatttcttcgtaataatatactctttaacatgaaaaacaacaatcatgaatgaaatacaataaccagataaatagagaacagccttcttttctacttttaggcttttggcagatgtcatggatggataatactccttttttctctactctcgttttcaactcaaaaaaaaagaaggaaaaaaaaaagttatgtcatgtatataatcgtattcgtaaatacatagaagaagaaatttcagaatcagctaccatcattccatcaatgctttgccaactagagtttgttcaaactcttacaaacttctctacttgactaatataattatgcatttaaaagttcaccgtaccgttttccatttatatctctcctttttgatagtctcattcgcatatgatacacttgacttgaaacctcccaaaaaaaaagggtacaaagtgtagcttctatatgaccgatggtacataacagactttcgactaccatgcacttaactaggatccaaatccctctcccgtagcctatttcacaatatatcagtgaatgtttttttaaggtgttcaaaacaaagttgctatacttgataaatcgatcattgttttattttgtgtgttgccaggtcaacttcacgtaaacaaacaataaatatcgaaaacagataaaagttattaacttgtactataccatcaagaaatgaataaaaattataattgaaggtcactccatcgtaaattaaggaaaacgtaaaaatgaataaagagagtgcaatgtccacaccgaatgaaatgaaagaaattatatgttttaaaatttcgagaaatatactatgtatggttgatatatatataatcggtatcaaaaatatatatattttttaagtaaactctataaagagatgataggagtttcgatcagatatttccgattgcatagaatgaacaggctcggtttattctttgagcagggccaaaactaatgtaattaagtaagattcaacctaaacaaattaaagttgaaatcgtaacttagcagtttcatctcttttttcttgactaacaagtttcgagctttcaattcagaatttatctaattctgaaattagtatttgtgccgtacgtattacgtagcatagatcatgtttgttttgaagttattcggacaacgaccaacgatatcgattagcaaccaacaatacatttcttcattcaaaatagtaagtcagacttattttgatctccaattcgaatatggaccgtaaaaaggaatatgaatttacaggaaacggttttaatgattgaacttgtgtgctttaggaattaggcatctatatattataacatcggtactaaaaggcctaaaaacatatcatgtgattcagtgagtgtctagttttttaaaaaaagtgtcaccttcatttataaatctcgaaagttagttatatgatcgcaaaacaatccacgaccccctcacctctatttctcacttcacgtggaacaaggtcccatgtcccattatttcttcttttctagttcataaagttcatcataatctatctgttccacacacacaaatatattgattgatttgtctactccaaattcgcaagaaaacgtgaataaatttgagaaatcacagaattatttgatattttgtaaattaactaattattgatatagaagaacaaattaatacaatggactaatgtcatagagcaatttttttttgctaaacttcaggatttaactcattcttcttcttgttcaagtggttgctgattctgaaatctcttcttcaataacttaggtcttggtttcataggcttcaagtacttagattgaaatctaaccatctctttcaaaacactaatcagcttcctctctatttcttcaccgtcaggttcaatagctcctaagcaccgtgccacagcctccgccgtagttacacatcctccgaatggttccttccttagcacaagctctgaatcgtagatggttcctccactcactgatgcgtctatttccgtatccaaacacactctaaccgctcctgcttctcttaacaccacctcgctagctttgaccatctccttcgcgtgtttccacgtcgcgtcgaatacgattagtctcagcggcgggggatttgagatctcacgatggtttaagaggtttagggatttgaattcggatatagtgacggcgggagaggaaggagaagaagggaagaggtagattgttggcggtgctgggagtgcggttcctccggcggtggagatgtgacggcggaggagacggcgggcggggattctggtgacgtttagtaaggatttggtaaggagaggagtggtgttgagcttgtggcgtgactcgtgtggatggtggaggatgatgatttctgtattcgtcggaattagatccgctggtaagacgtggcagagacaaatcgcatttgggcgatcgcagttgtcgcagatctgccggcgatgatgcgcgtcttgctcgtcctccatcgtcactgctctgtcacgcgagcattccaacattaatgggaaattagaaaaaataaaataatacgctgtcgtttttggtctattagaaacacggcatcgtttaaactaagtttctgaacgacggcgtttgacccattcacgaatacgaatacgattacgattgtattcactacgtcgtcgtttggtctgttcacgatacatcgtcgttgggcattaacttatttaactctctgtctcttctccggtcaccatttacccaattgtacacgaccactttttagttttgacgattagatgatcaacgttgctggaagtaggaaaattagataagagtactgatcaaatcctaagagagaatg

SEQ ID NO: 24999 - DNA, 3003 bp, Unknown
  misc_feature (1)..( 3003): 2750-1469P.txt file - cDNA_ID_2702019; gDNA_ID_2214485; Annot_ID_133353
taacaactttacgttttggtaattgtggaatcaaccatgataatcttatattattcgatattaatcaaaatatggcttaaatagttaaaactcacacataagtccataagttccaattgtataatattatacttttaataaattatattatatttatacatatgaataaaaaggaaggtttcaggaattcatggttacaaaatgagtttaaaaagatgaacatttcccccaaaacactaattagatcgtacggttggtgagcctaaagaagtagtgctactaataaatgagaataatagtttttggtacgacatcccacaaatccttaatgatgagagcataaatctcggcataatcttcgtttcaagagttcgaaagcatattcatgaatattcacaaatgattacgcagaaagtcagtttgataggtaaagcatccataagctaatgactaagttttcattgtaatcattggttaacattttctctaacaatgttaattattgaaaatttaaaacaattaactacacttcttatctccccttcttcacgagtttaaagcgacgaggtgcttccatcattatgtcttctctttttcttgttgctcttcttatgattcgtctttaactcattcgcctatttgtgaaaaaaatagattgcttgaaaagcataaaactaatcaactgaaaaaatgtatatgcataattaaaaatcaattcatagaaaaattcagtcgtactttcgtcaattcatggatttattttttgttgtagctaaaacttcagttgtactaccaaaacaagaagaagttcaacgtcttgttgatagtatcatgagttgtgaaaactcacgtgaaaagaaatgtaactatgtaataaagttttttatagtattaatagaataaaacttgcttaattggtggtgttatttatatatacttaattaggcaattaggtttcaagaagaggaaaaaaacgatgggacggaggtggtgagtggtggtggtcggagcagacaaagaagggtcctacaatttgcctaaccgtaaagagccacattcctttttcttttaccccatcccgtgagtgaaccccactcttcctcattctattattctcaatctatattttcaaaaataaacataaatatacaaactctttgcagcataaaggaatatgttgataaaacggagctttgtttatgattttgtttcattatgatatattttttttaaaacatttaccaacaatttcttagaaacataaattaagagctaactagtatatctagtatttctcgaaacccaaactcatgttcttaattttttatttttttctggaatgttaatgactatcggatatttgagtataattgtatgaatttgcttgactgttgcatactttgaatctttctttctagtttacaattgtgcaaattaaatcaaactcgttttcagtattttaccttttagtactatacttaattatgtcatctgtatcaggtaatagttagaggaaagaggaaaatggtgtaatataaacaacaattatttgtatgtgagtttacgaccatcatctagcttaaagtacacaccaatgagaatatgaacacagtttagctcaactcatatatgatctatccgacatcttttcaatgttttgggtcgcgtaggagtatcggaagcagcttaagacatagctatttaataaattgttggtatgttttatttataacaattatcacaaaatcaaaagatactaatctcgctgtttgaggcagacatctgagaaaacatgtcttctaccaacattcaagatttgacaaatcgttgtttacgtattgttatattgagcatcttacaacaaaaatttacgtgtattttgaaactcggaaatcaatcatatctattgatattaacacacagtgtttcctgactatcgtcgcagacgaataataatagtaataatcttccacctcgtgtgattctataatcttatattcttgacataaatgtcgtcaaaatttggtatacatcaaacatggatcgtgtttaaagtaatcatcaaaaatcaccacacgagagtagattccctattgtcaaatatagatcaaagagaaaacatgtaggctacaaatataacctagtccctacgaataagaaaaatgtcattataccacaaatgataactgcaaagtgtgtgtaaattttgattttaaaagaaggtaaaaaaataaaaaagatagatttggaaacaatcttttacctctttggtattgaacattgtgacagtatcaatcagtatggtacagaaaaaacgtcagaggaaaagaattatcaaaaaacgtacactcttcattttcattaaaatcttttttttttcttccaaaaaacaaaagcagaaaaaatgtgtcagaaagatttatgcagctttcattcattcatcacttgcactgtctcgtgaagaaaattaaacttttttgtatcagaaattaattacattaaaagaaaagaaaaaaaaaattccctcctttccaagtgcgtttgctttgtggagtctctctcttctctctctctgtctgtgtgtgaagtgagaggatctttgtttggttctgcaatcataatttcgtgatatactaaaaaaaatgcaatttcctcttctctcttataagcagagaccctactactctttgatcgaattttccttgctctcttctctttgttctctcatgtttttttctccctaaatttatgggctttgctctctctctaagccacactcacactctaaagcactcgtctttcttcttctttttcttcagaaacagttattttgacttgaaaaaccagagctttaatcctggattcatggcaaaaagagcattacttttcttttcctctctcactttcttgtttcatttggcttaaaaattcaatgataattttgtatttgggggaaagaagaagaagaacaagagtgtgtgattgattcaattcttaaaaatg

SEQ ID NO: 25000 - DNA, 3003 bp, Unknown; identical to SEQ ID NO: 24999
  misc_feature (1)..( 3003): 2750-1469P.txt file - cDNA_ID_2702019; gDNA_ID_2214485; Annot_ID_183490

SEQ ID NO: 25001 - DNA, 3000 bp, Unknown; identical to SEQ ID NO: 11252
  misc_feature (1)..( 3000): 2750-1469P.txt file - cDNA_ID_2702023; gDNA_ID_2214485; Annot_ID_133354

SEQ ID NO: 25002 - DNA, 1893 bp, Unknown; identical to SEQ ID NO: 11242
  misc_feature (1)..( 1893): 2750-1469P.txt file - cDNA_ID_2702027; gDNA_ID_2214485; Annot_ID_133356

SEQ ID NO: 25003 - DNA, 3003 bp, Unknown
  misc_feature (1)..( 3003): 2750-1469P.txt file - cDNA_ID_2702038; gDNA_ID_2214486; Annot_ID_133369
aaacaccgagtttttaagccaggttatagatcttgtttcaatctcttttcccttcctttgtcttaaggaaacttgtatttacattctcttgcttctttctccttaggtttccatggtttcaagactaaagcatgagaatctcattcaactggtcggttattgtgttgatgaaaaccttcgtgttcttgcttatgagtttgcaacaatgggatcattgcacgatattctgcatggtataatgagtttctccgcccttcttattttaaaacttttttctgttttaaataactaagaggttctcggcctaggattgttttctccatgattgtgtcatgtgatgttattacaggtaggaagggagttcaagatgcactaccaggtccaacacttgactggataacaagggtgaagatagccgttgaggcagctagaggtttagaataccttcatgagaaggttcagcctcaagtaatacatagagacataagatctagcaatatacttctttttgacgactatcaagcaaaaattgctgattttaatctttcaaatcaatctcctgataatgctgctcgtttacaatctacaagagttttgggcagctttggctattactctccagagtaatcctccatagtttgtaaacttttaaattttgttgcatcgttataaaagtatgtacgagctagctaaatgtgacttgccatttgtagatatgctatgactggagagttgacacataagagtgatgtatatggttttggggttgtacttctagagctcttgacagggaggaaaccagttgaccatacaatgccgcgaggccaacaaagtcttgtaacttgggtatgttttagctactctttttccatctcaatatatatgtatcatactgtgttttaatctcatatcttataactgtgtattattcaggctacaccgaaacttagtgaagatacagtagaggagtgtgttgatccaaagctaaagggagaatattctcctaaatcagtagctaaggtacactactttcatcccagagagtatataaatatctaaaaaagggttaggatggtaacttaatagacaagaattacatgtctttggtcgttttaatcgccaaaaaatgatctaatatttatgtaatttggtaacgcagctagcagcggtggcagcattgtgtgtgcaatatgaatctaattgtagaccaaaaatgagtacagttgtgaaagctttgcaacaacttcttatagcgacaggctcaataccgcaattctaaattcgtgcgcttttaaaatactatcttatattgtttttggacaacagagttagaatcttcattcatacaaaagagacattttactttgatttggaatatatatatatatatatatatatattaaaactactaagtcttgtgcatgattaggtatataatcattgatggataaataagagatgaggttacatattcaggcttcaaattttttatatttggtgatcaaaatttaaaaaaaaattaggtgagtttggtctttttaaagctaaaaaatattgaaacacaacaaagcaaaaaaatgagtgattgatttcaattataaggtgaaaatagaaagaaaataatacaaaaatattacttttaaaaacattattaatttaagaagaaaaagggcaaatgagaaaagtggactttccttttaggctgttttaataatcgtcttccccgcggtttgcccatctgtctccgtcttcatcatcaagcaaaaaaaaaactcatctttctccactctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctctggttcatctacagagttaataatcattaagcgaagaagatccctagaaagattgatcagagaaagtctcagctgaagcacgtttttggaaaacccagatttgacgggtatatatctaatattttctttcaatttggatcaattctcttgattttctacctttatagagcttattgattcgtttccctttgacccaattttgctttctttatttagatttcaaatttcttactcgatttcgttttgtgccccatttgaggatcttcgttgtagacgcgattctcagtggttctgagtgttaattcgagtagaatctcttctgggtaacgtttctcatttgaaattcacagtaaagttttgatctttcattcttttcgtttttttcaatatccagtttatccatagtagttgactattgccaaccttatctgacggcagaattttgtccctttctgatttgtaattttgcagttcgactaatggaatgtggagttgttgattgagaattgcattttttattatgattagagaattaccaactcattgttccaaaagcttgtgcttatcatcattgctatcttgatgcaaatctgaatccagtttctggttttgactttactttgaagcttttttttttcagttatgtgaaaatgttgctgtgatttgttagatggtttcaatatgcctaaacaaatttgtacttgctagttacaatatttgaatcatgtctaggggacagttgctttacttgtttgcattttggaggtagtgatctgaagcattaacttaaattgaagtagcaggttgtgacattgtaacattagatgttaagtaatgccgctgccatggcagtgactatttcatttgttaaaattttgttctacttactttggcattgacatgtagtgtaacgagctaatagaggattgttacttttttctgcatctataatcagttgctttgaatggtttcaggtactaagaagctgtggaggatctatatttgaaagaagagaacaaggatg

SEQ ID NO: 25004 - DNA, 3003 bp, Unknown; identical to SEQ ID NO: 25003
  misc_feature (1)..( 3003): 2750-1469P.txt file - cDNA_ID_2702038; gDNA_ID_2214486; Annot_ID_183515

SEQ ID NO: 25005 - DNA, 3000 bp, Unknown; identical to SEQ ID NO: 11258
  misc_feature (1)..( 3000): 2750-1469P.txt file - cDNA_ID_2702050; gDNA_ID_2214486; Annot_ID_133362

SEQ ID NO: 25006 - DNA, 3000 bp, Unknown; identical to SEQ ID NO: 11258
  misc_feature (1)..( 3000): 2750-1469P.txt file - cDNA_ID_2702050; gDNA_ID_2214486; Annot_ID_183506

SEQ ID NO: 25007 - DNA, 3000 bp, Unknown; identical to SEQ ID NO: 11263
  misc_feature (1)..( 3000): 2750-1469P.txt file - cDNA_ID_2702058; gDNA_ID_2214486; Annot_ID_133370

SEQ ID NO: 25008 - DNA, 3000 bp, Unknown; identical to SEQ ID NO: 11263
  misc_feature (1)..( 3000): 2750-1469P.txt file - cDNA_ID_2702058; gDNA_ID_2214486; Annot_ID_183516

SEQ ID NO: 25009 - DNA, 3000 bp, Unknown; identical to SEQ ID NO: 11261
  misc_feature (1)..( 3000): 2750-1469P.txt file - cDNA_ID_2702066; gDNA_ID_2214486; Annot_ID_133367

SEQ ID NO: 25010 - DNA, 3000 bp, Unknown; identical to SEQ ID NO: 11261
  misc_feature (1)..( 3000): 2750-1469P.txt file - cDNA_ID_2702066; gDNA_ID_2214486; Annot_ID_183512

SEQ ID NO: 25011 - DNA, 3000 bp, Unknown; identical to SEQ ID NO: 11259
  misc_feature (1)..( 3000): 2750-1469P.txt file - cDNA_ID_2702070; gDNA_ID_2214486; Annot_ID_133365

SEQ ID NO: 25012 - DNA, 3000 bp, Unknown; identical to SEQ ID NO: 11257
  misc_feature (1)..( 3000): 2750-1469P.txt file - cDNA_ID_2702082; gDNA_ID_2214486; Annot_ID_133360

SEQ ID NO: 25013 - DNA, 630 bp, Unknown; identical to SEQ ID NO: 11933
  misc_feature (1)..( 630): 2750-1469P.txt file - cDNA_ID_2702086; gDNA_ID_2214523; Annot_ID_134102

SEQ ID NO: 25014 - DNA, 630 bp, Unknown; identical to SEQ ID NO: 11933
  misc_feature (1)..( 630): 2750-1469P.txt file - cDNA_ID_2702086; gDNA_ID_2214523; Annot_ID_184670

SEQ ID NO: 25015 - DNA, 3000 bp, Unknown; identical to SEQ ID NO: 11275
  misc_feature (1)..( 3000): 2750-1469P.txt file - cDNA_ID_2702124; gDNA_ID_2214487; Annot_ID_133381

SEQ ID NO: 25016 - DNA, 3000 bp, Unknown; identical to SEQ ID NO: 11274
  misc_feature (1)..( 3000): 2750-1469P.txt file - cDNA_ID_2702132; gDNA_ID_2214487; Annot_ID_133379

SEQ ID NO: 25017 - DNA, 3000 bp, Unknown; identical to SEQ ID NO: 13847
  misc_feature (1)..( 3000): 2750-1469P.txt file - cDNA_ID_2702152; gDNA_ID_2214658; Annot_ID_136504

SEQ ID NO: 25018 - DNA, 3003 bp, Unknown
  misc_feature (1)..( 3003): 2750-1469P.txt file - cDNA_ID_2702160; gDNA_ID_2214488; Annot_ID_133400
attgtcaaggtttgggataacatatatgtatctcgtaagatgacccttctcaaaccgttgagttcttcaagaaactactttcctcagcatttacctcgtattttcgatatgtctaagtttacggttcgtgaattgtgtcgggaagtcaagctctatcatcctgattactactgtgtccctggacacacagctttagagttggagttggggaaaactgttgtcaagtacctaaatgatgacaaattcgtgttgcttacaattcttgaatatggaaagttagctgtgtttaggtcttgggatcgagaatggactgtgatcaatgattacataccttctcgttgtcaagatttgattatgttcgatggacgtttctttgctatcgactacaatgggaggactgtagttgttgactactcttctttcaaattgacattggccgctaatcctttgattggcggcggtgacaagaagtttctgattgaatcttgtggtgaaatgtttctggtggatatagagttttgcctgaatgaaaaaccggaattcacagggggtttctattcgtattttaatgagaccacggtcagttacaaatttaaattctttaaattagtggaaagagagaagagatgggttgaggttgaggatcttggggataagatgtttttccttggtgatgactccaccttttccgcttcaactgctgatattatacctcgctgcgtgggaactggaagcttcgtgttcttctacacgcatgaggaatccttggtggtgatggatgatcgaaacttgggagtgtttgatttcaggagtgggaaaacagagctggtaaacaaactccctgaatatgccaagttgttttggcctccacctccatggattactacttctcatgaggtcagtggtttccaatctctcaaccacccgaatagagtgtatttacatttgcatcttactacttcttttttaccgcttgtctcactaacttatgctcaaatatcttttgtctcagagtgttgaaaattatactggagaaacatcatcacaatcccaatcttgagtttaagaccttggagatgacacttcaacttgaatgacaatgtttatatgtatttttccaactcttgttttttcctaaacaatttgtatattcatctttcaaaagttttcttatgtctaaaccgaagtccgctatacaaagattttgaggaaaactggaaaagtgattttgtgttaaaatcgaattagttacgagaaataagtcccaactaaaacaagaactttatttcgatgaagcctgctttactttaagatggtgttgattggtgaaaaactgtaaagattggctatgcaaatgaagttgtaactgtgaatttaatcacttgaattcacaagttctcagtgaaacagagaagagtgcattaaaattttgtatgatatgacacaaccagtgaaatacagtcaccttgcagtaaaaaaaagctttatcatgtatgtggtgattttttttttaataaccaatcactttaatggttaaaaagttcattttacaatttacaagtttggttataaagtgtatattagatgcttcttattttgggaagtttcgttaatattgctgtgttctgtttactgaataatgttcggcatttgaagacaaaaaaactaaaagaaagtagctttttctgaagtttccgagaaattttcatatgtttgtcatatatattcttcctagccccactagtcgaactcacttgtttttattggtgaattgtttggtcttttggtaacaaagaaaacgatttaaaatctataaattttatatctacatatatctactttacatttattgaaaatacaagaaatattagagtttttttttcttagttgtaccatgaaattgaggtttgagtcgtgttgagttctttaaatggaggtgctccaaattaagaaaatatatattgggagtctctcacttagaaagtagtatgggaaaacatatctattattgaactgcagaatgttgattcaatgattaaagattccaacattaaaaccaccttaaagaaaaataagaagccggtgagataacaacacaaactattggtactacaagatttggctaaaataaaaaacacgttagtacataaccttataaaactaatgtaagaggctaagagttcatgcttttcttttagattacacataatatttaaaagctaaaatgaaatcattttaaagcctgaataattgtttttgtccattcatattattgataaaaaatgatgttacattttatttaattatatatatccacatcagtttttttcttagttttgactacaacaaaaaaaatagttaattttatagaaattttttaaaatatttgttttatgttttaggttgtgtccaacaaagacaaataacttcaagtctttggaggagacttcccaagtcaatctgagattaaacaaaatggtggaagtcccacaatcaaaaaagttatattcatttttcacactaaaatatgatcaaactaattaattacaaaaaaaaaagaagaagaaaaaaagtggagtaaacagaagaaccaagctctggtccaatcctcatatgaccatttctaattctcttaagataaaaccgtgtgggttccatccactttgatcaagacctttcttcttctttcaagtaaacatcacaaacctttaagaaatatgaaagaaaataaaacacattataaaaaatctcacaagacttcaaatttcaatatgttaaatcattcatgcctccacatacagtatttttatttttctctcttgacttagtcttctccatcaaagtattgccccacaaagaaaatctttcacaacatattcggtcctagttgtatataaatgtgtattgattcacctaagtgataaccaccaacaactttttcacttacacagctttaaaaagaaccaaacctttataagtgttttttagacattgggagagatg

SEQ ID NO: 25019 - DNA, 3003 bp, Unknown; identical to SEQ ID NO: 25018
  misc_feature (1)..( 3003): 2750-1469P.txt file - cDNA_ID_2702160; gDNA_ID_2214488; Annot_ID_183564

SEQ ID NO: 25020 - DNA, 3003 bp, Unknown
  misc_feature (1)..( 3003): 2750-1469P.txt file - cDNA_ID_2702164; gDNA_ID_2214488; Annot_ID_133395
atctagagtaatataaaaaggatatgatcaatccactcttggcttgattttgaaattggaaatccaccaaacttaacaattaaattgtacggcttttaagatatgtattctgtcttgcctaacaattaacatattaaagaagaacaagattaactacttagattcactttttaaaatgtgccgaaaacaccttatatttaaacacgatatttatgcctttatttttgattaccatctcgttccaggggaaggtccaaggatgtatatccggggtaagggcttttgctcaagttgtggctccatttgtatatagtccattgacaggtaagtgaacacagtatcactaagtgaccaatgaacaccattcattaataactatcattaataaaacgttattcatcactaataagttttatagcgttcattggtcaatatcgagaaaataaagttttatttcctttaacaaatatttattttggtttgatatagctctatttctctccgaaaatgcaccattctatttccctggattcagcattctatgcatcgccatctctttggtattctttacatctacaaccatatcatcagttatcacaattatatgtttattattaataatgcatgacataatgacattgctttacatgcacagatgatcggattccttcagagtcttctgataaaagatcatccttctttgcccttagtgaacataacaatcaacaacccttcaaaagcggaagcttgacaagaaatatatcaagaagcaaatgtaactgtaatattgtacaaatttgcttcaaattaaaagttcatttaaaacgaatacatagctagaagctgtaaaaataacttagttttcttacaaagattgtcattgcaaatgaataaaatcacttgtatagtagttgttggcaactaagtacaaccggtcacatcaacatacatcaactaagtaaccaaacaaatataaccgtaaaaacaaacaaccgtaaatattttagagaagagatgcgataaaaagacaaccgtagaaaaataaacgaaaatatttcaacaaaagaattagatgaaaagacacaactgaaaaattaaccgtaaatattttaacaaaatgttgcattgacacaaccgttcataaatgcaaaaaggattgggataaaaagacaaagctttttatatttcaatgaaaagatgtaataaaaaagacaaaacaaaaaaaaacgtaaatattttagtaagaaattgcgataaaaagacacatccgttcgtaagtaaaaagacattacgataaaaagacacaaccgtaataaaaaaacaataaatatattaacaaaaaattgcaacaaaaaaacacaaccgtttagaaatgcaaatgacattacgataaaaagatgcaagtttcggggagaattcgcaaaacttcatgaaaatacgcgataaaaagatataacaaaaaagatcgtaaatatttcaacgaaaatttttcgttaaaaagatacaaccatttagaagtgcttacgaaagaaacgacacaaccgtaaatattgcaacaaaaagttgcgagattaaaagaaacaaccttataatctctttgatcatatgaatggaaaactaaatctttgcacacaaaaaaattcaggattttcatattattttcatgggatttttgtttaaatgggcacatttcagccaaaaaaataatgagagggtacattcttgtgggcttataagaatgagtacttatttggctaagaaaagacaatcttgtcaatactctttcttctttctttttttttttttttttttcttttttttccaaatgcttcatagatctttttctcccttattaattcaatagatccaattaaataggtttgtatataaataaatctatatcctaagggaataatgcttagggaacccaaagatttcaagacgcagattaaattaattttacatttgatcgataaatatattggtcggtggattttgattcggactgaaacttgtcaccagtttaggagtcgaggaaagagatgaaggcagtgtcactggtttttgattagcaaagactgaagatggaaggcgttaacggcggaaatgaggatcgacggtaggatatgttttcgatttgatagaacgatgtctaataatcgctaagtaattcaaaaacagatgttcgatggtgtatgtgtcatgttgtgatcagtttacgaattacgattagggtgaattgagagacaaatcggaactggagattgagggtgaattgtagagacaaattagacggttaaatgcgaataataaaaaagataaaaacgtcaatactgtgagaaaaatacctaattgcagtagcacatgattttgtgcctatttctacaacggcatacacttttgaagtgctttatttgtaactgatccttattttcatgcatgtgagtgatatcaagttgtactttgttgttttgaaatgcctagaaatgacaaaagcgtgtgggaatggacataatcgtttttacaaaattgtgggaatggacatgatccttatttatggtttgtacgcgacggataaatttttatttaattacgtaatcgtctggatttatatatctttaatgcagattgaaatatggcagtaccaaattttttgcatagtcttaacttcaaatcgatcgtagttattacaaaatgtcacataattcgtaatgtgtaattaaaaggtactccctacacaagagatggtgactaatgatcgagtcggccagaaaataccaaaaaagtcctcaaaagtctgatgtgatctcccatgcttcaaccgaatttttggaataaagaatagattggaaaaatatctgccacattgtagtattttcaagtaagctttctttgtttgttcaataatcaaaagcaaaaacaaaaacaaaactctcaacactttttgtgtttattttctgttattttgaatcgaagtcggcaagcataggctaaaaggtgatg

SEQ ID NO: 25021 - DNA, 3000 bp, Unknown; identical to SEQ ID NO: 13158
  misc_feature (1)..( 3000): 2750-1469P.txt file - cDNA_ID_2702176; gDNA_ID_2214602; Annot_ID_135576

SEQ ID NO: 25022 - DNA, 3000 bp, Unknown; identical to SEQ ID NO: 13158
  misc_feature (1)..( 3000): 2750-1469P.txt file - cDNA_ID_2702176; gDNA_ID_2214602; Annot_ID_187088

SEQ ID NO: 25023 - DNA, 3003 bp, Unknown
  misc_feature (1)..( 3003): 2750-1469P.txt file - cDNA_ID_2702192; gDNA_ID_2214602; Annot_ID_135583
cagaaaaaaaaaaaatctataatttccaaccaacatagtttactttcagtctgatagccaaatttcccaagtaaatatataagaaatcagtccatagtttcaagctctagtaccattacctttgtaacatgtacctaccatattatatacctcagatctcatgatatcataagcaaacaagtttttgtggacttaggctctgtgctgcaggaaagttcatgatgcttatacatgaaaaataaaccttaatagtacagatcttttagttcataagaaaaacttacatagaagagtttgtcaataacaacagacatacttcttttaaaccaaaagaaaagagaggcagaaaacaagcacggttgggaaactaagaagcctttgcatttaaagtatcactaaggttctcgactctccaaaccagagccatcaaaagtgaagagtaatacaaggagttcatcaaattacacactttcaaaaagtctatagaatttacagaaaagtctataggaaactgattaggaaatagaagaggatgaaagaataaggcacgatggcaaattatcatatactgtatccgcataaaagagcatcagagcaagttcatgcaaaataggtaacacttgatatcatcttttcagtttctatcaatgtactacttcttcgtttatattcaagtaaaggccttgtacatgtatttcactaaacttacaaccatagatgacatgagcaagaaaattacatggaaaatccaatagcaggacttaagcttaaaatatttttctgaaccgaaaccctcaaaagtgcacctgcaggcaaataatcctagaaggatataggtttagaaagtcctaaccacgaatacactacactacccaagtgataaagccgtcgtgcttgattgatcactgattcatcatttctgcacacctttaaagtagaccaacaggaagcaattaggcccttgacttcactaatacaatgagaacaccaaattctattccttctcctctgatccacaaattgaatacactacagtttccttagataaacggatttagtccacaaaagtactagcctgcaaaggcttactacctcatttactatttctgcgctcttattgtcttcaaacccaccagcacaccttaatagactcctgaattcgggcttgtgtgaaaggatgctttcttaaaattagcattatgtttcacatcattgtgcatccaaatcaaatgcttgtacgtgacagcatgtcactctagaaaccattatatgatagatgtagtttgttaggaagattgaagttccccactcatggataccgtacctcaagcatcttcaactgactaaacacactctggtacacatgtgatggcagagactagttatggttatttccttacccctatggatcagaataacttctagatgacttgagttcaagttcgctttgctttcccaatcaaccaagaaggtccacaacacaatccgcaaatcagaatacatcaaggataggccagccaccaatcctaatgggctaacatgaggaactaacatctgtttgaaatgtgttatcaatgcaatttctttaagaatgatgccataatttcaaagtttctaaaagttctcaaagaggaagatgaattctgacctgaaactatagccgtactagttctcaaatcttccaaacacttgaatcactgattaggcttttctccagtttctcaactaccagaggttcgtggtggagaaaggtatgatagaactagaaaccaccattgccactaaacctgcagcctgcaggatacaaaccagctaagcctaggttatgctaatacactatatcccaaactagcttacccgcatcgctgaagtagcagcctgaacaacattatcaacagctaaccaaaacacaaagcttacaacatctcctctaatcaccgagctggtctcttctcagtatcggaatcttaaaaagctaacaactacgtgaaagagaacaaattcgaagtctgaaattatcagaaccgactccggttaacggacatgatcgcgatcatacccgaagattgtgggaaaagtcaccgatgtagcagcaaaaccgggaataaaccggattaaaccgaaaaaaagaaacaatccatcatcacacaatcacaagagaaaaaaggaaacaacgatcggcttgtttatacataccaacacgaaataatcagctcaacggcgaaacaacaataatgatcggagaaatgagaaacattaccaaagcgttccggcgatgagaaaagaagaccgatcggagaaaagcaaagagacgtatggattcgtatagatgacgcaaccttttatgaaaaagaggttttagagagagaaatatgttttgaagacaaattgctttcttttttggtgatggttgagcgatgaagagtatcggtttatatttaagaaaaatcaaattaaagcggttgagttacgacgttgccgggacattaatcccttctctgaccaacttcaccggctaccggtaaaacccgttcactgtcttattgtcgactaaacaatttattaattaactatggttcttcagtaatgggcctatatttttggactgtacttgggcctcagctgtacgtatcaaaagggttcgagaaactcagagattaaagggatcttgaccgttgatcgagatgactttgattttatccattaatagtcaatttgattgatgagttaagaggatgattaagaaagcaataaaggaagcgaatcggaatccacattgtattaatctttttgatccagtagccattggcgaatccaggagtattaaagttccattttgattttggcgacgatgatgaacagagtttagagaaatttgcattgaagaagagaagatttttggattttgtgtagtgggagaagggtaaaccctagcttgggagggacatgatcggatgctctaagtagcttgtgaattagagaaagagcaagtgagcaaatatg

SEQ ID NO: 25024 - DNA, 3000 bp, Unknown; identical to SEQ ID NO: 13184
  misc_feature (1)..( 3000): 2750-1469P.txt file - cDNA_ID_2702206; gDNA_ID_2214603; Annot_ID_135609

SEQ ID NO: 25025 - DNA, 3000 bp, Unknown; identical to SEQ ID NO: 13184
  misc_feature (1)..( 3000): 2750-1469P.txt file - cDNA_ID_2702206; gDNA_ID_2214603; Annot_ID_187132

SEQ ID NO: 25026 - DNA, 3003 bp, Unknown
  misc_feature (1)..( 3003): 2750-1469P.txt file - cDNA_ID_2702224; gDNA_ID_2214603; Annot_ID_135602
taatgttcgagattgtattattttttccttttcgggaaactaaagggagcgatgggcccgctttgatctggacggttggggatgctttgcaggaggcttctcagccgttagattcaaatctaagagttgaaagttattcaaagcttatcttcttcttctcccgaaaagatctaacagagtgaagggtacaatgggaaaaagacaagtttatatatttaataatttaatattattctggttcagtcaacattaaagttgacggacgtaagcagatattttgactagtcgtcccatatttttgggaacgcaaactgcgtgccgtttctttttttatttttattttattacgctctcgtacaaataaatagtggattttcacagagtagccccaaagtttttttgtatgtatttattttggtcaaaatctcaaaagagtggtcaaaagcgtaacgtccatagtccaaatgacatgacgatgggacctgtcaatgcacatttacactttccaaacaaaaaaaatactacatgtatccaattttgaaatctttagttttacccaaaataattcaatgaaaagatgagtttggttactaatagtagtttggccactaagtttatctgtatcaattatgattctatctacctatatttaaagaagtgattgagctttaaatgtgcctcttttaaatttatgaaggtatgaatgatttgaatcccaagagtttgtaaagatgttttgactctgaataatgacaaaaccgcaaagtgtgatacagtttcgatagtaacgaaaattttgtatatatttatttaatttattattatttgaacctcaacgcaacttatcgaacaacacatttttattcggagttttagttatgggatcttcgagtttttatctaacatgaaggtcatggaatcaacgtttgtttcatgtaagtgtgtgataatgtttaactttttacttgcgaatggaaaaccatattgatattatgacattgtatattaaagatgtctaactcttttagaatcatctaaatgactcacatgtaaaaatttaattggtaggttctaaaggcatctccatcagtgagataccttattggtttttaaaaaaaaatatattagtattttaataaatattagttctataattaaattttaataataaaataatatttgaccaatagatgatatacaagtgttcttatgggtttttcagagtttttcacttgagagactaattttactctctctcttactttttgattatattttatttttatattaaacagtttttcaataaaaaatcattgatggagatggtttaataccttaattatcatctcggaataatagtagatcgcaaaccaaaaactaaaaaagaaaatatagtagaaaaatatctaatttttaacatttgctttcacactaatgatactagctaactcggctactaatttttattttgaaaaacaaccattgaaatatatagactgcaagcgtgggtttttcccatttttctaatttccaactaagaaatatggacaaactaaaacaaaaaaattaacagattttacagtcattgtcgaagaaaaagatggtatctctacacatatactttacacttttacagtcgttgctaaatcttttatgttggtaaattagctatataacttcaataattagaacctttttttttgtcatgagagttctcttcgaatattgattagttttagaaaataatcaataattcgtaaacacgtatactattaaaatacatttgatattgtagttgaagtgtgactttattaacttgaaagtatgtttcatcgagtaagaatgacattcatgctaaagtatacttaagctctggatgattttttttttcttgatacttattggctccatcttaataaaaaaaaacagaatggcagacgtaggattatataatttcgactaagcatcctctctgttctactatgtaaattcgaatacatgtccgaataattaggactttgaaaattctccacaactacatgatcataatgccaattctctttgatttaattaatttttatttttgataaatagactactttgttcaatcgatcatcgggtttggagacacaacttttttacttttttagtaatacattttttataagctcttgttaaaaacaaatacattttcgcttacttatcaaaaatgaataaacttattcctagtaatatttttttttttggatcataattcgtagtaatatatatgatggtgattacatgagacaatgatcttgagtcaacaagtcaataatttgtagactaatagaaaaaggttttaaaatgttttagcatacaaataaaatgataaatgaaaaaactaactgaatatacaaatgtaattggcttttaaaataaggtgctacttaaaataggatgaatctaacgaaaaaacctaactaaatcctttagagtttcagttagtgattcaacacttcaactttttgatgctattataaccaatcttgcgattcttttaggcgagttgggacgaaaaatttaataaaactattgatgagtagaattattttagtctttttaattatttattttggagcatgcacatgatagaagatttatcagtttcggattaaaccccgtttaagatttttccacatatcttataaaatattaatttttattttcacttctcacgaaaatatttatattatttttttattggttaattagttaatatagtgaagataaaaggaaactttaatatgaaaagaagattatcatatttgagccaaaagtaattaaaaataataattttgttgctcgaacgacgtcgctttgctgggagcgcaaataatctccggcttctgatcaaagccgctaactcaggcagaggctttaacatgccttcactccagttcaccgccgttgtcttctctctcaccgacggcttaagttttatctgtcggagtagtttcaatg

SEQ ID NO: 25027 - DNA, 3000 bp, Unknown; identical to SEQ ID NO: 13179
  misc_feature (1)..( 3000): 2750-1469P.txt file - cDNA_ID_2702234; gDNA_ID_2214603; Annot_ID_135607

SEQ ID NO: 25028 - DNA, 3003 bp, Unknown
  misc_feature (1)..( 3003): 2750-1469P.txt file - cDNA_ID_2702281; gDNA_ID_2214604; Annot_ID_135628
tacacacatgaaaactcatatcattatatgcgttagctaattaggtttaattgttgtgacctcgatatccttaccttgaaactaatgttgtaagctgtgaagttagctgcaaacactacaaaggagaagctatcagcagtgtttccggcggattttgctgtgtcgttccattcgatggatgtgttttgatatcctcttccttgaataacaaggtttgtcttgttttcattaaccgtaaccttttccctgcttgcttaaattgaactcaaacattactaaatatatatatcatattacactataaaagaaaattattgagcaatggagataggggaaaaagaacaagagcttggagttgaagataggacctataagaacccgaattaacgatgatgagagtcttggaagagcttaaatcagggacaacatcaatggcgctttgaacattgctgaagttaccacaaccatgcaaatcaacagtcaacacaagagaagtcttgtattggtgtctaagccttgacgtccatttctcacaacattttattggttcatggtggtgataatgatgatggtgatggtggtgatggtgatgatggtggtgtttgtgtccaaaaaatgttgaatattttgctaatgctccgatagttgtagctatagaagagagagatctagaggatggcaattggatcgtgtagagagcaagaatgatggataaaagagctattagggtggttaaaaccggtttgatgggcatgtttaagataatagtagatgggtttagtgtgtctcaactagttaaaagtaaaaagaggccaaatgttgtttggtatttatacatgtgtgaggaagagtggcgtgagagtaaagtgaaggatgggcttcgaagacagtgtggtacctttttcttcgtaaatcagatacgttttatctaaagtcatttctgaacaatttcgtgataattaaacaaaaaaagtatatacgtcgctttagaaacttagaaaaactgtggaataagttttctcataggcatcttcaatcgtttaagttagagacgcaataatggaataagatgatgaagtatttttacaaatatcagacgacaattatgaatatttttgacttactaagtattgtttttttttggttttgggttagaaaaatcgaaatcttgtttttttcttagacataacgtctgttttgcaagacttataacctgaaagtttataattttttttcttttaaagacatttttacatatgaaatattttatgattttgcttaatagatcattccttgttgtattaaccatcttgaaaacgaagtatcacggccagtcggctatcataacaaaaagaaaaagaaaaacttataatgaaatctagccaaaagcatattataaatttttatgtaacaatctataaaatttataagagttcaatttagaaatgggtgacttatatgatgttggaaaaaatagttgttgagattataagagaattttcaaatcaaccgacaggcgagcgagttgggggtggtacacgccaagatggttaatgatgcttaataaaaccatttcaaaagcaacttttactatattttaattttgcgttgtttaataaaattgtgagtgttttatctattttggtaaaaaacactgactcatttatttacagaaaccactgagtttgactcgtcgaaagaaaaataatttcatttacataaacaatgcttttctccataaactttctaactccaaatttggtatcggtatggttttaggagattacataacagtatgaattactttgaaaaatcttgaactattaacatcttaatgagtcggttgacgtactgtatatttattcaagcaatgatgcatggatccagaaactattttgagccgaggcaaaaataaacgtaaattaatagtattgaacaataaattaaacaagaaatgaaccgtgtaaatttggaaaaagaaaacatcatttttctacgtaatttatcaacattgatctattttaaaatttcaaagagtcttgcaaaacaaattcgagttcatcactttctttcaatatatatcgtctcgtgaatccaagtgaaataattgccatgaatcatgcaagatgcaccttataaaacagaataaatttatcattttttccaatgctaataacattaaggcgaaataaattgttttatagacttacgttgtatcatgtatggttaaagtcttaaagagatagagaataacaaatacacaaagtgtataaaacataaagaagagacttgagaaatgagttctcaaccaaatcaaaccgatcacacacgattagtaaaagaaaaatttagatttaactgcaatagttttataaattctaaaactactcataagaggttaaacaaagtttaaattttcaactcataattcctaacaatttaactataacgcacaacataaatgcagttgttaattctaggaaaaaaaacagattagtaagcgcaagttttcgaaatgggcattaggcccaattgatttatcttcaagaaatacccattaaaaaggttaatatttacgaaatctgccactgctctaaagactgtaatttactgcgtttttctctatcttccttcctctccagtggctgcaaaatcctaaatctcaccgaaaaggattttgtattgttacatcctcttcttcttcctccagatccatgtatgaaacctcccctgaaccctaatttagctatcgaatttgagattcgatccgatgtttacttccaaatcttcgtttcgtctctgataatataactccatcgtaatagaactgatttcaagacggttcgtttcgttttcctctatcccagattcggaaagctaccttgttttgaactccatagttttcccgaatctattcatcacttgctactatcagtttgcttcttctgttctgtgtagatttccttggagggggtttgttttgacgcagtttcgttgcaaatg

SEQ ID NO: 25029 - DNA, 3003 bp, Unknown
  misc_feature (1)..( 3003): 2750-1469P.txt file - cDNA_ID_2702287; gDNA_ID_2214604; Annot_ID_135625
aataaacaaattttataatatttttttagaataaagcagaaatttgttttgttaagaattctacttctgtaaattatttttcaaatttaaaagatcatacgttataaatccttacgtatatctacatgtattcaaaggacatgtcacatgtgtattactaaatttatagaaatttgaaaattgtaaaaattatattttattatctgcgggatcgtatatacatgctggtcgatcggtccagacttgatatgtgacgaacacacaaaaataaaacttgaataggatgtaatcgaaagactgttatgaagtaaacatttaaacatatataaatagaatcactatttttaaggaaatttttatatttgcaattttgcaaaagtcaacatatatacaaagtcctattgagttgacccaatcccctcctcaacgggacccaagcaacgaagtttcgcgccaactagttccgtttcagtcaattgcttaaatatcatataacggatcttttatacaccactacgagtaattttatagaaaaattacactgaataaacgaaaaacataggcaacatgagccattttttcttattatgaatatgattttttttttttggggaatccgtttaaaaaaaaaagtagtcttgatcacgaaatttcttcttccacatgtttatgtatatatgatcacaaatgacggaatcaaagatacatcatttagacatttaccattaatttcaaaatatttattttcctcgctacaaaatattctgtattgacatattgtcatcaaatatgcatcatttaccatttcaacatgtttattttcctcactacaaaatattctgtgtcgacaagtagtagcatgattttccttaacaagaataatttctgaactgtcttcaaccacacattcaaatcttcacccgaatgcattccccataaaataatgttacttagatactgttataccgatacacatgatcttaaacttgttgactgttttttctttttcaaataccatacaaagtaaaaataaaataatctttactgatcctagctcttgatggctgctggaattaaacattcacgaaccctttaattccgctgtgaactcgacccgatatatatatatatatatatatatatatatattttacctactttgtagagatatatccatatacttaatcattttgtacatcctatatagcaatttttttcaacaatttgtttttctgccaattagtagtttttgtgatggttaccaacttcttgtgatggcttttaagatattgcgaacgaatttgttgtaacataaattttatgtctacttatcaaattgtcatatttcacattattttactgacttttagcaactactttgaaaattccctctccatatatataataatgcgatagagtatggaagtactggcaatagtcgtagctcagttgcaaacaatttgcgatgaattttttgcaacaatattttcgccagatactaatgaaacattatatttagttgtgaatttgtgactagctaaaaaatgagatgaaaccattgctaattcatgatatactggtattctcgtcccaataatatgcgacgacttcttttacagtcttttccatcacatagatgtttttgtacttgtaaagatgtttctattttcataatacactacagtcttttacagccttttccatcacatagatggttttttgtacttaaatacttttttgttaaagacgcttgagtccgtgactcgtgagtacggataccccacaaggccacaacagccgcaaacgaatccaaaatcagtatattcgaaatgcattacgtacttaccttttcgaacgaatctaaaacgtgtccagtttgagattgcatggctcatatcgttgttgtacatgcatgtacattgtttatgtaaaatacaataacttttaattatatacgtatatataatcatttttaaaatgtctattgtagcttcaattcaaatggttcgggagaaaaaatactctctaaacccatattaaaacttgcaaataattaatttagtatcttctaataataattaaatatatatacatcaaaactatcatttttatctggtaatgtttttcttatctggtaactataattaaaagttatcgaacaaactttcaaaatcattaatttttaatttataaattagaataaataaggataaatattttatatgatattctatcatctccatttagagctatgtgaatagctgttgcgcatttgtgaccaaaaggcgagagagctaaagatctcgttatggccatctattggtttactaaacgctaacattatctatgattttttttttcctttgtaaacaatatatcaaactttttttgttgtgaaaattcaggaggtggctcgtattattatattttaataaatctattctattttttctcataaactaggtagacttttattatttttattattattttctctatcattttcaattatatttaatattattgcgagctagaccctaccatctcgtgtcttatcgttcaaatactatagaataataatattaacaatatgtcaacggttttttggtaaggacgagttaagaagaagaagtcagtctccaagaatttgactcagaacaataccaaaactgctttaattcgtcaaaatatcaattctggactattcatttcaacgtctcctccaaaaacgtatgtatataaatacctacacccaccaacaccacaacttaccaagtctccaaacatagttcctcgcatttacatatatacatataataatatctctagaattttcaagagcatcaagatccatcaagatccaccaggtatatatatacgtgcttcgtacatacatacatctcctgagtttccgttctttgataagttctctatatttgctaattgattattgatgcatatgtacgtgacaatgtctcattaacagtgtaacggagaagaatg

SEQ ID NO: 25030 - DNA, 3003 bp, Unknown; identical to SEQ ID NO: 25029
  misc_feature (1)..( 3003): 2750-1469P.txt file - cDNA_ID_2702287; gDNA_ID_2214604; Annot_ID_187170

SEQ ID NO: 25031 - DNA, 3000 bp, Unknown; identical to SEQ ID NO: 13195
  misc_feature (1)..( 3000): 2750-1469P.txt file - cDNA_ID_2702291; gDNA_ID_2214604; Annot_ID_135624

SEQ ID NO: 25032 - DNA, 3000 bp, Unknown
  misc_feature (1)..( 3000): 2750-1469P.txt file - cDNA_ID_2702293; gDNA_ID_2214604; Annot_ID_135623
ccaaaaaaaaaaaaaggaagtaaatttacgacgatagattaggctgacggcccgaccacccgttatgggtcaataataaaggcccattaacggtataacttagcaagataacaaacgaagaagaaaagtcgttgacaaaaagaaaaaaaaaacacgattttgagacaatttgccgattcctcgatcatttcatctgctgaataacaacagtgattggctcttctgattagcaagcttcttcttttcgaaatcgcatcactttggctgatcggtggattctacgaaccatgttcaatttctggtaacatcaacttcatgaatctgatttttgtgattatgcgattttgttaccctcttttacctcagctcgattatgctgttatctaattttgattatgatcgttttggagaatttcaatttctatgtgtttgggattaaagaactctgctttttgttagttacttactgttttatgcataccattgatggctcttatagttagttgctgctaacatagttaaggtgaacaaaaattttagttgtaatcattaaaagaacctgatctatgctcatgaagttgtgctgggtcttaagattttgcaatgttagtatattgggtattggaacagtttcaggtaagtatttttaagattgttgtgttaaaaatccaggggatcaaaagaacagcaacaaggacaatctcgtccttctccagaagcttctgcaacaccgtggtattcgccgtctcttgtcacctctcctagctcatcccggcctcaaacctcagggcagattccatcacatgtttcaccaggtgaagccgccggcattattgccattttaaaagacaaaaggttagtcttcaatttccttataccttcttgtttgcctcttttgtacatgatgtataacagttttcttgtgtcacacagtcacacatttcttgtcatctttaatatgaatttatggtcttttaggcttggaatagtttagattaacgctagaccaaacactagatttactggttctgtggttttgatagtttggttgctgatagtctcttgtgattttgcgttgtgttactaatttgcagagatatataaagggaattgatttctgtacttgtcggtatgttatcttgtatgcttactcttattactcatttatgatgttcttcaaatgttttgctcttagtgtggatgagcttaggaagcttctctctgacaaggatgcgtatcaacagtttctgcactcgcttgaccaggtcactattcaaaacaatgtaagtgggaaacatgatgtaaaaatcatctattgtcttaagaaatgtagcttcttcattatttacgtttttgagatgattcagttttgtgctttttctttatatgttcattagatcagagaagagcttcgcaaagaaacgttacatctagctagtgagttcttgtatgactttttttgacgatgacaattatattcatattgcgagatctaaaacattcatgctaatataacaggagaaaacttggagaaggaaccacagatagtggagctcagaaaccaagtgaataatatcattcaatctctgagtgagttaattaagtatatgaaacttctctccatttgtataatctttttaaaaacagtgcagaataatccgtacatccgagcttgcgactgctcaagagaagctcaatgagcttgagaatcaaagagaagagatcctcaaattctactctccaggttctcttcttcatagacttcaaggtaagtaaaaccattagctgcttcactcaatatccttcatgtgtaacaacaaaatgatacatgtcggtttctaatacacaatcccgggtttgtttatcgcagatgctatgaaccaggtggatgaagaatcagaggagctgcaacagaagtttatggagaaggatattgacacagctgcatttgtgcagaaatacaaaaagctaagaagcaagtatcatcgacgggctttgattcatctcgctgctaaaacttcatctattggctgaaaacaaacttacacgttttgttttttttgcttccgaccttaattcgatgtgtaagtaaacaaaactggttaaaagtcgagatctatatacgagatcaatatatatcattgtattacataatcatgttatgctctatgaatctgaatcttctatagttctttctgattttgaatcttttgttattggttcgtcctggtttgggtgtggaaatgcacaattatgttcagatgacgtggaatgtgtccaatttttgtctttgtttaggaaactcacaccacaatttaccaaagcctcattcattctttgacgtgtccttatggatcatgaagactagcacgactcacctacaagtcaattttaaataatataagtaaaccatatcttaacttactcattcatataattttgtagttaattcgaaggtggtcttacgagtggtgactaataatattaagcctcactgaccctaaaaactgctcagaaaatttgtctaaagatttgcgtataagaaactttgagttctcacaataaataatagcggaaatatacaatttggttgatcccttgtttaagaaaatttcccggtttgcatgctcaattttatcatttcataatcttctgcatctataattgaggaaatttagtaaaacagagaaagcagatagaggaatcaatataccaatcgttaatttaaaatagtaaacaactagatttgaacataaaatcgaaactaaaccgaaccaaaccaaactaaaccgaaatcaataattttggaatatataaatttcattagtccccactatctccgctaaaacatttgagaacgtctctctctctctctctctctctgacagttctttctgtctctctctctgctcgatgcgaagaatcgagcatttgtgtcgctctctggaacgtgtgtcttcatcgggaatataaccataatctccacgagctgcttgaatg

SEQ ID NO: 25033 - DNA, 3000 bp, Unknown; identical to SEQ ID NO: 13221
  misc_feature (1)..( 3000): 2750-1469P.txt file - cDNA_ID_2702318; gDNA_ID_2214606; Annot_ID_135663

SEQ ID NO: 25034 - DNA, 3000 bp, Unknown; identical to SEQ ID NO: 13221
  misc_feature (1)..( 3000): 2750-1469P.txt file - cDNA_ID_2702318; gDNA_ID_2214606; Annot_ID_187233

SEQ ID NO: 25035 - DNA, 3003 bp, Unknown
  misc_feature (1)..( 3003): 2750-1469P.txt file - cDNA_ID_2702330; gDNA_ID_2214606; Annot_ID_135657
ccacaagtctcttccggtctagcaagattgttttcttaaacccaaggtacctgcaaaaagatgttcatttcaagaatcttgctgggaattagcttgaatcagattttcataatacctccgatgaccttcgacaacttttgccatgtttccataataggtaggaataaaagtgttgctggctacagatactatgaaatctagagctgccatttgagatgaatggttctgaaactgttgcaattctgttggatctaatagcatttcctttttcacctgaaaaaccaacaagtcaccatcatcaccaaatcgtttccaaagtgcgtaatgttgaaagtgataaaacttacaattcgtggaaatgattcctttagaagggctaatctctttgcaccaccaaaaatctcaccagctgcaatgtatatctgtgtatccttttgaaaccccaatgctttaagaaccaaaaccgcctcctccggtgtcaaaggacacagtccttgcactctcctttcttctgaaactatctctttctctctccaccatggatatgcatacctagaacacagaagtgaaccatgaaatcaaaattttataaaagatgagagcatccagctaaaataatagtttcacctcatctttttgagttcttcagcttcttcatcggtacaaccatgagtgcaaccagagaaagccaacatgtccatctcatatctcaaatgcaaagccacaaaagaccctctttgttgaagaatccgaactaactttgatcccaaagcctcaatccgtggagtgaatctcagtccttggaaattcactcggcatctcagcctttgaaggtcaagagaaagaccattgttcgccaatcgcgtatcactccgaacgaaatgtataactttacgtttactaaaccgcggcaatacctgaaacaaacaaaaaaatccgatcaatcataagcatttcagattcatcacatagaggcaaaacagaacaccaaagaaacttgcaaataaacctgttgcaagtaatatttgtcgttggaccagctcacaggcggcatttcgaacaatttgaatccatacttcttactataccgtttaggaagtctccttatgatcctaacttcatctcttaacgaatcaatgaaatgctttatatcaaaaatgtcctcaaagtcactgtaaaaggaagaaacaaaagaatgctttaaactacaaacaaatcttgtaggatcattgacatgagacacaaacatataccttgtatcagcccagaatgattttttatcaagctcaggaacaacaagagtcaaattcaatagcctagcaacagtcaccatatcacaaatctgaaacaaaacaagcatcaagatattgcaaaaccctaaattcagcaaatgagagagagttacacgaaccgctgcacgcatttgattcaaaccgccattacaggacactagtaaaattccattacttgtgtaattccctgcaaaaaaaaaaattcaaactttccttcaatctctcaaattctcaataaccaaaacaaaacccaatgaagaaaacaacaaaactaacttggaggaagaggaggaggtaatggaactgactgaaccgggagagagaatctagaaatgtgattggttaaaccagtgaagatttgggaatgccaaaagagctgaatcaaacaagtccaaaccaaaatgcaagaacaaactctaaagaaccaaacttgtaatcgagctttgggaatagcttgactcggaggagctttatagtcactccgcatcagagtactctccgatctatctccgacgacgacactcatcgccgcttcatcatcggaaaaaataattaaaacctaacaaaaaccgcttaatttgccaaaagtttgaaacttttgtggatttttttctccgaaattatgaaattagtgaccgaaacaagtgcggacaaaaaatacagatacgaccgtacgaagttttgttttttttctatatgtttatgtttcttttcccgtgagaaaattgaatttttcttaagaaatacacctacttttatataagattattcgaaaacaatcgaaatttttgcaaagatggtatttttcaaaattagaaaaacttgaaaatcccaacagattgatctcatctttatctctcttttggatcatcatcatcatcatctctgtagcttataaaaaaatatatatatggctgggcataaaatccgaaatctaaaaaccgatccaaaaaatccggttccgaaaccgaaccgaatagtcacaaaacccaaacagatgatgaattcttctacccaaattccccgaactgaattcaatccgaaccgaaaaccgaatggatatctgtaatccgaaataaaattatatatcttaaaatattagtgatatttagttataatttatacccaaaaaatactaaataacaaaaatattcgctataaccttaatatccaaatttcttttagttctatttgttataattttactttgttttgcaaaattaaaccaaattttagtaaaattaaacgatttttgattaaaattaaacaattttttagtttttttttctcaaaaactgatttgaaatccatacaaatccgaatagtcatataatccgaatggttaataaactttttcatccgaattatccaaatacaaaaaaattctaacctaatccgatatgaaatatgaatgttcggacctatattgaaaatttaaaatttaaatttcggatatattaatctatgtaagcccaaatattgtgccaagtgaaagttcattacaaaactaagcccagttccatatacaaagcccataatatgctcatgacaaagaagacttgtcaacgtgtcttcaccaattaaataattacacgtgtgcaaagaacgtctttgactctcttttgtcttaccctaaacggcaaaaaaacattgactactgcaagattttatctctttctctctctctcttctcttttctggtgacgccatg

SEQ ID NO: 25036 - DNA, 3003 bp, Unknown; identical to SEQ ID NO: 25035
  misc_feature (1)..( 3003): 2750-1469P.txt file - cDNA_ID_2702330; gDNA_ID_2214606; Annot_ID_187226

SEQ ID NO: 25037 - DNA, 3003 bp, Unknown
  misc_feature (1)..( 3003): 2750-1469P.txt file - cDNA_ID_2702339; gDNA_ID_2214606; Annot_ID_135661
catgtttttgttgttttctaacattttgcatcatccaaagtgaagtcttgctttctttgttttcacatactttaacgtaatgtatggcgaaacttccttaagaggataggctgcaagattgaatgaaactacacacttagaatttttgttttccttcctaagaatgtaagtattcataaaatgaaaatgtttatgttttacacgcgatacctaaggatttggtcccatgaccaaaaaaaaaaaaaattagaaatatgctggtcacaactctctttagtggcatttgctaaattgcattgtcatatcacggtgcaaagtagagatctccaaatctataactaattaataacctctggttttttaggccaaaaggatcgtctcctaaacaacaacttgtgaatccaagctacccaaagagcatatgcatatcagcatataaagaccgcattccttcttgcggtgcctcttagacccaatactcctttttctgcctcccctctgacaatcaactttaatcttgcatgcgactattggaaatgactctactttaaaggtaacagaagcttcaaggtctctcagagagcgtttaggtagtgtcaaaacagaacatcataacttaatggtgttgtgtatgaccaaaaaatcatttttaatctcccttcaaaagataatgtcttattgccaaatgcaatatcttatgcattttgacactcaaaaaaccttcatgtatttctccatcgactcggaattcgagcttgtgacctgattgttccaaatgcaatatcttatgcattttgacactcaaaaaacttcataacattttagtttttttaatcaaacatgaagcaacatatataaaacagaacaatacatcaagcataaactgtatcccactctatttctctttgatatttgtatatcttcttacatacacgtgaaactatatatgtctgtataataatcacacaacacatagcaaatgctcttctaatacatacatatatacactcgtctcgttacacgattcgaaccactcgaactctgcgtcgtgatgataacaactcgttcaatctcccaatttcaaccataagttcctttattctctacaaaatcacataatttccaataaaaaaaactttcttaagattactatagctctataagctcagaattagttaacacaaacctgatctttctctctgaggagaagaagcagaaatctcagtttctcttcatgtagccgtctccaccatctcacgagcttcacataaacaaggctcaagaccaacgagaagcctccaatgattgttaatgaccaaaatacccttttacgagttaggtaactacaacgcaccctttcgacggcctgaaagatgcacactgagttcttgattaatcgcttcttggtagtctcaatcactcgccacggaagccaaagattcacggtggaggggacaacagaatcttcatcatcgtcgttgatcgttggattttcacggcggtggcttggttgtaatatcggtgagtttggaggggtagatgcgtcagtacgtggggatttgggtgaggtttgtataacaactacccattcactgaattcttcttcttgctctgcctctgctctgttcataatttggataatgttctgttttttttttgttgttgttgtgttcaaaatattttcatttgctagttgagaacaaaatatctaatagaatgataatgacactattggtttctacactctcgtatttttatattcaaaattaatgattttcttatttataaattttaaaataaatctataaatattttagtagtaatataaacttcaaagtactttcagctgatatatatatatatatatatatattcatatttaataaacagattaattgtaaatgaaattttaaacaatcaacatgttaattaatttaattaaaattaatacttatacgcatgtttattatttcgtgctgtgcatgggtatgatcagaattaaattccatgcatgattatattattatatcattaacttatgttccaaacttttcttatacaacgtcttctctacattcataatttagataaaaacttaaaggtgaaaatggttccaagaatattgcatgaatggttaacatatatcggtaccttctctttgtgttttattttattatatatcacattacatatatataatcctttgtatagttctgctcttaatttatcttttatccttttcagcttcaaaagtttctgaaaaacttagcttccgaaaagcagcagaggaaccaaaccttcctattgctgctgctactactctgatatcacctcaaggtcgagtagactttgtctttatggacaatgaagcacaagagataagaaatgtttcgccgacatcacaagaacttccatcttcttctactacttctatttcacatagtaatgaacgatctaattctctacgatctatcgttattcagtaaatgtatatagattttctatcttatactacaatatttaaaattacaagataatatataaaaaagggtgatccttaaaacaatattttgtttgaactcaacggattttcctacatttttactcaatcatatacgtggaaatgatgataaaattatatcatatgataataaaattgatgggcttaaatatattatttggactttatattcaggacattgttttgcgtggtaaaaaggtgtgacccttgcaggatttagggtttgtaattcgtagtttgacagagacaaatccatcatatatattgagatgatactcatcaataacattgtgttagaagaaataatggtgagacttcccgtgaaaaccctaattggatttcaaagcgtgtctaaacactggaggtgtacgatagagtcgaagtctttcaaggagagattttgactttattaggaaacccaagaacccaaatttctcttaatctatgaaagcgagtgtgagagtcttgatatgaagactatg

SEQ ID NO: 25038 - DNA, 3000 bp, Unknown; identical to SEQ ID NO: 13220
  misc_feature (1)..( 3000): 2750-1469P.txt file - cDNA_ID_2702343; gDNA_ID_2214606; Annot_ID_135662

SEQ ID NO: 25039 - DNA, 3000 bp, Unknown; identical to SEQ ID NO: 13220
  misc_feature (1)..( 3000): 2750-1469P.txt file - cDNA_ID_2702343; gDNA_ID_2214606; Annot_ID_187232

SEQ ID NO: 25040 - DNA, 3000 bp, Unknown; identical to SEQ ID NO: 13235
  misc_feature (1)..( 3000): 2750-1469P.txt file - cDNA_ID_2702364; gDNA_ID_2214606; Annot_ID_135671

SEQ ID NO: 25041 - DNA, 3003 bp, Unknown
  misc_feature (1)..( 3003): 2750-1469P.txt file - cDNA_ID_2702371; gDNA_ID_2214606; Annot_ID_135673
aagcaaagatttagaagatttaaatcgttaattaaatatttttctttctaaataattaatttcagtagcatgacattgtaaataagttcaaatacatgatttatttatttaaacaaaaaacgtttagtaagaataatatttatttaaacaaaaaactttgttttaaaatattgttaacaaatacgtttatgctaattttaagggattgatgtgaagtttgtttggattaaatttgattgataatgtggttgacaatttaaattaagaatttaaagtaaaattaattatttcggaaaaaaaaaattaatgctaatggcattgagttgtaaataagtccaactctaagatttatttgttaaaatggctgcaaaaatgtatttatagatttcggatatttttgattatccaaaatattttggttccgtagtaattcaagtttcgattcttttgattataatgtttagtaattatttttaaatttttgtttcgattgactttattttgctttcctatttcagttcgatacattaggtttaatttatttgccaaaacctaaaaattatcattttcttgtgtttttcctccttcttctcaggataataattagtttatttatttttagacggtccatttaaattcgatattaattagtattacttcccataacttaaagttcggttctaattatacaaatatttgattaacgcaatctcgagtggtcaacaacatgatacatgatctttaacatcataatttcctccatcatacacaaatgacaaatccaacagttaataataattcagaaaaaacaacagcttactaaaacagtaattatagaagataattactaacataattatttttagaaactaaaacattactcacttcataaaaccttgagccatcttagcataatctccaaacccatgaccacctccggacttctcatcttctttcttagccgccggtgctccagctccaccaccgtgtcctccaacattaccgtggcttccagttccaccggtggaggagtgagagtgggaagtttcgtacttgtgaagatattgttcagccttttcaaggtactgaccaacaccgctcttttcatcgagcttaccgtatctagaagcggcgtctaagatatcagcggtggctccggcgactttggctttgtcaagcttgtctgactcgtgacgagcagcggcttgagcagcttcggctacgatcttggcactagccatgagctcagcgttcgtagccggtctgtgtgttgttggatcggtgttggagaccggtttatgtgttgttggctcgccgtgaccgggtttatgtgttgttggctccgtgtgaccgggtttgtttttgttgtggtttggctccggatcagagctctccggtttcttgtcggagaatttcttctttacttgatcggtgaagaaatccatgtttctttgtttcaaaggaaaagttttttcttgttcttgaatttggtaaacgtacaataacaacttatccggaggatgatatttattgaatttcttgaaattaggtttttgttctttttctttgtccactagtttttggtcttctttttctttatccactagttaatgggatatttatagtcacgattcttacgccttagatctacttttcgactttagtgagtgaattttattctcttcctacgtaaaaaagatgcttgattacatttgaccatttcgcaaaagtcgaccctcataaccggtcttgataaattctttcttattatctttgattcttgatcatagagttacttttattggtggatgggtacttttagttttgggtatttgtttacctatgtaaatgctagtataatcttggattcttcatcataaatgtagagtttatactttatagggaagtaatatttggtgtattttactacacttaaaagttttagtattggttgaggttttgatgagtggcacggaaaaatgggtcctcatgccacgttcgtccgactatccaactctttgaccatttatgattttgtcggcagaataattaaactatttgaagattggtagcagagtttagatgagttttggatgggcctatgagaagagagctcatatgggctcattaatagcccattattagatatatattctgagcccaactttgtttgatacattccattgaacgttgtcgtatgtgaagaaaaggatgtggtcatttccatcacacttactaattttttgtcaacaagatgaccacattattatgacagaacagaagtgaacaaaaatctaagtaagaccaagaagagtaaactgtatttatatatgtagaaacttgtgtagtatagtatatataagaagcagtgaaagcaaagtatggagaagaagagaagaacaacaggaggtgaaatttcaaaggagtggcatgtgaacacatatcctatggtttcttcaaatttccattgaaaccattgagttttgtgttctcaggtcacccctttgaatctcccctgttccattttttcaccttactaattttttttattcatactctaaatttgtgagcttttgtgctttctttttttttggtcataagtgagattttatgcttttttgattacacatttattataatggaacctctattttgtatctgaaacagagacaaagcattaaccatatcctacatatataccttaacaaattaatgacaactctggtttccaaaacaataaattatgtatgatttgacaattaaactggttgataaaatgtaaatttggaataaataattagttccataatatatgttttttatatctaaaatagcatagtcttttgaaggtgaaaagtcataaatcaggtttggtttcaaacaatgacttcataatcactcaaaaaactcttcttaattatcaccaaaaccccaaaaccaactaaaactgaaaaaacaaacgttgactttttgactaaccaccatcctccgccgtaaatcatg

SEQ ID NO: 25042 - DNA, 3003 bp, Unknown
  misc_feature (1)..( 3003): 2750-1469P.txt file - cDNA_ID_2702375; gDNA_ID_2214606; Annot_ID_135676
caattatacttttttcatgtataaatcttcttatctatatatccaagattctattcttttttaactatcataaaatattacaacaacaatatataatacaatgttatgcaattatattacttatgtggtttgaaacttatctaacttgattataagcaaactattctttgttccatgtattttcctaatctagtactctagtcacatcatgataagctcatgactaaatattgaattgtaataatttgaataacaaatgtataactatctactcatttatttcaaaagttctatctactcatttatttcaaaagttttataccaaaagagaaaacaaaaagcaaaaaattaaagagtcatttaagtcaacacttttaggtatctctctttgcatttacatatacccatattggagaaagtgtcttgtattgaatgttttggtatatctaagatcccaaaaaaacttacttgaaaaatgtgtatgtcattattaatattaccaatttatcataaggtacaaaaaaatcatatatcatgtagaccaaaaaatgtaataataagagaagattaagttaaaatactaaactaaaaaaggttaaatagcaaacagctaagttacaaatatcagataatgactataaaaaatagcaaaatagaaaaagtagaataaaagtagtgtttgatacattaacatgatttgtatttttttcttttattttgaaaatagttaattaagagtgggattgatggatggtttaatgcaatatgagaactttaatttttcgtcactaacttttgttaattgttaaatgatattaatttagaatgacatgtggcactctccagtgtgatgatgtgtcattcatatggagagagttgaccaactttcatatatatgatttgtgtccaagcaagatgtttatcatgatcattaaaaacggttaatatgattttccacaaacggtctatcacattttaatgatccatataagcaggagtgatccgtcttattgtgataattcctaagaagttgtattttaatcatgccttcatttcatggaagtctactagaaaaaagcgaagcttcgtaattacatatttggagattcaatgagaagatttgtgagaacttgagtgggaaaaactaatagaatttcttctctttatgagctatacccatcttcatagaatcctatattatgatcacaaactcttgcaaaatatctaatcaaaacggattattccaaaactcgagacatcatccatgagacgttgtgcaaatggatttagattactcgaatggagagattgaaggtagtaaacgcttatatttgatcatgcatgttgttctaatgatcttatctcatcaagacatcaacccaagttcgatcgttgtcctgagattttgatatctttgttggttttttaaaaatattatttacgactaaaatatcagtgttgtgtttagatttgttttctttcaaagttgttaatgcgacataataagaaaacgattgctttgacgttttgttgcctgatttctttcttttttttcctcttcttccataaatcgtaacaaggacaatttatttcttttaaaaataggactcttttctaagtacatataataataataggaccatgtacataggtgatatttttagagtatcacaagtcctaaaattatttttatattaataaagcaattataatatgtttgatcagtatcagtccactgatatttatgataccagtatcatctgacgtggcttcttctgattggtcacatttgacaaaaacaaaaaaaattatatatatttattaaacaaacattataaataatactaaaaaaattcttaatgatactttgtgagtatcacctatgaacatgctcttataattgagttacataattctatgtagtactcaaaattttataaatatacttaacctaacacgtataaaataaattatttaacccataaacatgaaaattaggttttcttttatagtagtggattgttattgctcaccaccaacaacataatcatacaaattaataataataattaacaaaaacctttttgatatagagaattttagaaaaataataaaataaagagaccaagagacaaagagaccaatttaataaatgcacaaaaagcaaaagtgcaccacgaattttgcaattattctcctcatgactgtttttttgctggaaccaaaactaaacaattctttgttttaaaaagtttacttacacatactttcttaattagatctaagtttaggattataatcttcatcatcattatttgttattattaatctccatattcagaaaattcgattaataaaaaaagaagcttacaagagagtgcccatataattggaatatctctctctctatctttcttctgaatctctcaaaaatttcgccattgttgttgctctgaaatctgttaactttggtacgcatctcaaaaaccctaatttgattatcgtcattttgtctgcatttaatttatttgatctgatcttcttcgccattctcgagatctcaatcatgggtttatccatcagaattattatcaagcttttctttttcttgaattttcgccgacaaaaaagcaaaattcgcttaatgtatagattcactagaaatggtaatgtttcttttttgggaaaatttcgatttttgatctgtgagatttgattgcaggtgatttgattgcatttgcctttgagagttttaatcttcaatttttggctacatcgagatttggttctgaattttggcatctctattagtagtgaggccatttcctgatttggatcataaagagtggagaaaaatcttgcctttgtctccttaggattgtggcttgatcaggtaatgagactatgtgcttcaaaattgagacttgtttggtgaaagaagcggatgaaaaagtttctgtgtacagcgagaggaattagtggtttctgcttacgaatgatatg

SEQ ID NO: 25043 - DNA, 3003 bp, Unknown
  misc_feature (1)..( 3003): 2750-1469P.txt file - cDNA_ID_2702383; gDNA_ID_2214606; Annot_ID_135678
tgaattaactgatacaaatagaaagtttttaattaccaaacttcgaatgtatcgtgcaccaaccacaaaggactagaggaccaggtcagcattaactcataggttatgcaaaaatttctataatttgtcaattcccaactttcattttccttcgtacattatcagatgaacactaaaacatattgatttgcttttattgagtctactaccattatggtctcacgatgaaatcacgactattaattggttctgcttttattttgactaagaataattaaattgtaccaaacgataaatgaaataattacaatttttagcaacaaaaaagaaaaagaaaaaaacaaatgttgagaccatatacatttttggagtttggacactgagattttcagattcttgtctgtggttaaacctcggaaccagagagagatggtatggtctttatcactctcttttattaataaactcatatctctctcatctaaaatctcatctcttcttcttcttcttcttcttcttcttcttcttcttcttctcctctgtctttgaagctatcttcttggattgtgtttaggagttaaaaacttgctttggtccatcatgagattgcttcttagtctcttgtttctcttggctttaaccacctactcaagtaagctttttgttcaaaatgattctctgttcttgaggtttcaaacaaaaccaactctctctcactttctctgtttctaggtgcaacttattgtctatgtagagatggtgttggagagaaagatcttcaaacatcgatagattatgcatgtggagttttaaaagattgtaatcctattcatgagaaaggtccttgttatcaaccaaacaccatcaagagtcattgtgattgggcggttaatacttatttccaaagatttggtcaaatctctggaagctgtaatttctcaggaactgctactaccagccaaaatcttccttcaagtaaaaaccaaaatctctgaaacctaaatttgttggtgttatgatgcaatctttttgatgttttcctctgttcttttgcagctgtggttactggttgcttatatccttcaagtccagggtatgtttgtttcaagatttggtaaagagattgtttggttaaaacttgtctttctttatgtaacgtgacttagaagtttggtgttcttttacctgttttgtcttccacagaagtgcagggacaactcccacgacaggtactccttcaggaacacagacgtttccgggacctcctgcgtttggtccggccggagattttgatccttcaggcaataatggtgctccgagtttgttcatttcaatcgctctctcacttggtttctccgtcgtcattgcgtttctataaaaggctagtgagtgattaagaaagtgaggctgacgttttggatgtatggatgagattttgtcacgtgtgaatgcaagttctttgaggcagacatccatttagtggttggctttgttgtttaggctattttaattttatttcatgtatgtaagaaatgatctaatggaatctttctataagtgtttacatgcagagtaaatagaacatgtaaacataagtagaatgcaaacaatatataggaagtggtagagttatgtctaagagatgttgtggtgactggtgaggcaaaagttttatttcgatatgaacctgacttgatattttttttgtatctattccagctttgaatcattagagacaaacttattattcatgttgttctatatcttaagtttgaaaaaacatataaacctcaaatcaaatttaaatattagattagcggttttaaaacaagaccaaagatttcatacatatacgtgctaactattagggctattctctcatattggaagttaagtatgattttaatcttcattcattgccaattattttgagttggaagcccacaatctaatatgatatcaaagcccgaacatatcgagatcagtggttagaaaaaccatcatttcggagagacgttttaggataatgtcccacattagaagttgagtaaaatataaagtgatatatatataagatatgagtctctccacttattaacaattgattttgagttggaagcccacattctaatactaacgtacacctaaatactttctatatcaaaaaatcaaggttactaaaacttattaacacacaatttagtaatttactcataataagcccacatataaatcaaacctatagagtgaaaaaatttacgggtcggatttgcaatatttgcatcaagatttaagatcatcagcgttgttttcaccgtatgttagttatctcgaagatttagagaattatcactgtttttatcttcgatattcaaatcgttgttttcattgttattattccttaaataattgtttccaccaacaaaaatctatataaaaacaaaacatattataattatatactttttcatgataaactattgtataatataacttattttatgatttctatcaaaaaataaaccttttgtcccaccatgtacctttagttcaatcctaatttacatatatatatatatatatatgtatgtaataaattggtactaacttgtctaagatatatttttttcttttttttttcaagacttaactagtaatctctattgtatttttttcatatttataacaagctaatacaaattatttagtttgatactggaaaaatatagtatttgtttaatatttgaagatttgttttaaaaaaaaagttataatgaaatataaattttggaagattactcccacatctaaaaaaatacgatccattgattctcctctattcaacggttcgatatcaattacacacacgaagttaaactcttccctcccacaccttataaaaccctatacatgaaaaaaaccttcatcttgaaaaaacccctttccaagttttgcaatttccactgaacagaaaactttcccggttaagcaaaattcgccatg

SEQ ID NO: 25044 - DNA, 3003 bp, Unknown
  misc_feature (1)..( 3003): 2750-1469P.txt file - cDNA_ID_2702425; gDNA_ID_2214607; Annot_ID_135692
taaagttaacgtctcgcaacaattaaacgacatgattaaataggtgacttcggtcaaaataaaactttgaacaaagttaaataaatcagtctttggaataatttgtaatctcgtgcacgttttcaatggaaactaagattatacattatatttgtattatattagagctcttgccacaaatggttttggaaaaacctcaacacgattagattaatttattttaacatttaaaaaaaaaaaaaacttatgctaatattaaatatgattatagattaataaataggtgacttcggtcaaagtaaaacgttgaacaaagttaaataaactagtctttaaaataatttgtaatctcttgtacgtgtctactggaaaccaagattataaattgtatttctactattttaaagctttcgccacaaattttgttttggaagagatcgattccatcattatattttttttggagtgaatctctagttcgacaaaaattgtttttgttattattgaccacgagttgatttttcgaaagtttcgtgcaaccctatcagataattttccaaacctttatctttattttgatgtattttctaaggcctcactggtttaaacgcaatgggtacggttgcggttgcgggagtttgcggaaatgggcggttgcagtttcaagcgttatcaagcgttttgaacgattggttgagcgtttgataatgggtacgtttgcgggagttttatgactggtaaaccagtgggtacgatagtaattaaataaaaaataaccaaaataaatataatatattactattaaaagaaataaatatacagtatattatgataaattgataatattagaaaacttgattttctgaccaaataaaaatacaatatatcaccttgtccgaccaaatgatttttaatcaaaaaaacaaatcgaaacatgtattcaatcaaaaaactaaaaagaatacaaaataaaataaaaacaacgatgctatgaaatagttaaaaaattacactagctaatgaatgaataaaatgatagatgatacttatgtttgattcttgattttgattttcatcggatgccataattgagacaatagggttacaatatattgattaaggttttctaataaaaataagatatatcacagattagattattttaattatagtgattagagtttgggtggaagccacaattatttaatttaattaaaaaagatttatttttaacctaaccgctatcgcccgcaaccgcaaacgcttgcgggaaggagcttttgaaaacggacaattttgagcggtccaaagcgatgtctagcggtttttatgattggtgtcaatcgctaacaaccgctaacaatcgctaccaaccgtaaacgctgtgtttgcgggtggtagagggagaaccaatcaagccttaagttctggttttctaccttttttgtgtcaaaggttttcatatttatgatattttaaaaattatgtgtaaaacaataaattgtgctaagcccaaaagagaataattgcagaaacacgatattaaaaatacaaaaaaaaaaaaagagaaagaccacccatgcctattagaggaacaaccaacccataggaaaagatccatcggagccaaaaaagtcaaacgcgaagatgaaaaccacaaaatctgatgtccacactcatgacggatccaggtctaaatccgtcgtgtgtggcagatctacagtaaaaagaggtgaggcatttaaatccgttggcatatctacaatgaaaggaggtgggacatgtgtcccacacttattcttaataagtatttgattgatcaaattttcatataaattttttttaattcatttgaaaagattactccatataaagatctaaaatttaatttttctccattttttgagcttaattgccggctgatcccttgtttctcaaggaacaatgctgagtcgaatcccatatctgtctacggtggtgtggtgtctcctccaatgatgtagcggtagctcttatttgtcggtagaggtctctttgagcatgatgctagttgaggacgttggtggttgtttggagatccccttggctcaactgatgagttagaatatgcggttacaacgaagattgtcggagaaacggtgagttttgtagttctatttggtggtcaacgactaatcctgtcatgagggactatgagccaataagcctctggatccaccgtaatggtttctatcagaccggattgatgagattttgactcgaaagtttcttagattttctggtggtggcttgagacgttaaatcccagtttatcaggttgcttaaaataagattccaaagtatgatcaactctccaacaaccggctctacattgttagatcccattttaagaaacctgataaactgggatctaacaatgcagagccggttgttggagagttggtcataccttgaaaagtgtggcgggtctagtgcatcggtggcgtgatcgaccgaggaaatttgaatctcctatcgtagatcgcatgcctgagatgcacaaagctgttctctttgaatccgccaaaaactatgtctgactcttttgccttcagtcatcaccgaattccgattctcgagccgtcgtcgtcatgaattttttcttttaccttatttggtaactgttgtcttgaatattgacccgaaaatccaaatctgattagattttaataaaaattaaaaatatatattattctaaagtttttactaaattgatattaataagtcagagataataatggtagaatctgattgtgaagttttaaagtcatcatggtcgaataaaaaacactttcgtgtagttgtaatcattcattaactaaactcgtaagaaatataacacttataaacttacaaatccacgataagaattttctgttttggggcctaaaaaatccacgagaagacaaaaaagggtaatttgaaaattttcagatagaaacagtcccgtcaccggcgacgatg

SEQ ID NO: 25045 - DNA, 536 bp, Unknown; identical to SEQ ID NO: 13245
  misc_feature (1)..( 536): 2750-1469P.txt file - cDNA_ID_2702429; gDNA_ID_2214607; Annot_ID_135693

SEQ ID NO: 25046 - DNA, 3003 bp, Unknown
  misc_feature (1)..( 3003): 2750-1469P.txt file - cDNA_ID_2702449; gDNA_ID_2214608; Annot_ID_135711
cgaaagacaagattttgacaggtatttgtacaagtactgagtcggtcaacaaaccccgtctggactctggacccgaagtaacccaacaaacgttgcgacaactacattagcaccaccaccaaggcaccaataatgcaacgtaagagggacgcagcaaaactgtcgcgatgtgagattcacgcgctctaatttaaacgttgactctttgtttcatcgttactctctcccatttatttacttcgcatactctcttcgttacaagtttccatttaattactcttaagtctctaactaatagctttagggattcgtcattaatttaaggcaacgtaaacttaaagagtttcgactaaaagccgtttcaggaaacatacatcatcacatactttatctaaataactggcttattaattttataacaaaaatgacgttatttagtgttaagatatacaaatatttaatttttactaaattagttaaggtaaaattgtgttcctttctgtgagttttccgcaatattaaaaaaccctagagaaattaacaaaacgtaattgactaaaaaaagagttcaaaacaaaacatttgttacatttatttcataatttaaagactaagtataaatccactagaaaacagatgattaaaaatgcgggtcccacaatacgccaatcgtcaaataatcgcgcaccttttcgccacgtagcataacaaagtcacgtaagcccttcctctacattacaagaccaaactcaaagtctctttctcccccaaacccaaaaacattgacccaaagagagagagacttctatcgtgcgcacctctctctcttaatcctttatcctgcgcaccaccaccaccatcttcttctccggcgaaaacaaacccaccgccatggggaaaggtcgtgcactttccgacggagtgatcaaaaagatcatcctttcatacacctatgtcgcaatctggatcttcctcagcttcacagtcatcgtctacaacaaatacatcctcgacaagaagatgtataattggccattcccaataactctcaccatgatccacatgggtttttgctcttccttagctgtgattctcatcaaagtcttcaaagtcgtcgagcctgtttcaatgtcacgcgagacttatctcagatccgtcgtaccaatcggcgcgttgtactcactttctctctggttatcaaactctgcttacatctacctctctgtttccttcattcaaatgctcaaagccctaatgcctgtagcagtttactcaatcggggttttgttgaagaaagagactttcaaatctcagactatgactaacatgctttcgatctcgtttggtgttgctattgctgcttatggtgaagctaagtttgatggttggggtgtttttcttcagcttggtgctgttgcttttgaagccactaggttggttttgattcagatcttgcttacttctaaaggaatcaatctaaatccaatcacttctctctattacgttgctccttgttgtttggttttcctctctgttccttggatctttgtggagtttccagttcttagagatacttcgagtttccatttcgatttcgtgatctttggaaccaattctgtttgtgcgtttgctttgaatcttgctgtgttcttgctcgttgggaaaacctctgctttgactatgaatgtggctggtgtggttaaggattggctcttgattgcattctcgtggtcggtgattaaggacacggtcacacctatcaatctgtttggttatggacttgcctttttgggtgttggatattacaatcactgcaagttacaggcgttgaaggctaaagatgcacagaagaaggttcaggcaagtgatgacgaagctgggaagcttttggaagagagggaaagtgaagctaaacgcaacgaaacccaagattgatctgttctgattcaagaatgcaatttcaggaaataagagcttcaaggttagaatgatttgggaagatggattttgcattttcataggtatgattatcattgtcggtgttcgttcgtctacgttttagttttgcgattatatttttaagttatggctgattatattacatagtgatggatgggtgtttaattagaggttcatgaatcttttgaactccattgtatcttcttcttttgagttgtattttgtttcttacttcctcatgaatctatctttgtgggtaacaattgttttagtagtacttctttatattttttccctccattgagattgttaaatgtcaaattgaaagtcccttttacgtctctctttatccaatgaaaccgttgtatgttggaaggcacaagaagatggtcaacaccaaaaactttttgatattttatgggttatgtaggatcatttagtagcaagatccacaatttaaggaaataaacaaaatacccataccgacgttcccttgcaataatatgacacatgacaccatcatatgaatacaatggtctcatttaacctctacaaatatccttcctttagtctcaacaagtttctgtcctgagtaaagggacaggccaaataggtgttagataccaaactaaaaacattcaaacaggctcacgggttatggatttctcatcagcgaatatttgggaacttttaacacaattcggatctactctcgcttggcataaaagctgttttgttccagaacagaattcataagcatgcattggtgcttggtttgtcactttgtgaaatgtgactttgaatagccatcctacctcttggcagaattgtttttggatttgggttatatcctatcaaattccaaaacttaacaaaccagttttgtttgatttcaactggaatcttataactagctcatagttcctacatatcttttttttgtttgaatctactacatatcaggcagtagtattctagactcggacgaaactttattagtccaaattaggctgcaccaaacgaaatgcagatacatcatacatg

SEQ ID NO: 25047 - DNA, 3003 bp, Unknown; identical to SEQ ID NO: 25046
  misc_feature (1)..( 3003): 2750-1469P.txt file - cDNA_ID_2702449; gDNA_ID_2214608; Annot_ID_187289

SEQ ID NO: 25048 - DNA, 3000 bp, Unknown
  misc_feature (1)..( 3000): 2750-1469P.txt file - cDNA_ID_2702453; gDNA_ID_2214608; Annot_ID_135708
tggacacaaatcattgagtgagtaaattttatatcttatgagattagtatgatgagaaataagaagggaggatcctttcccatatttagcaggtcggcagccaaatgacttaggaccctcgaatagtaaaaaaataagtcccgaaaggcccaaaataagagtattaatttatttacttaccaataatcatttctctaaaaaaacaaaaattaattttatttgcacattttttttttctttctactgcaccaacaaatatcttatattttaacctttatcttataatatacatatataaaagtgttaagaagatgatattttttttaaaatcccaactttgtttttttagctataacaaaataatatttataatttttataattaatcaaataaatcctgtttaaaaaaaaattgtttcagccctccgaaatatcaaaacctgtctatttggaccgatcgagactgaaccacccctttttaaaaaatgctcatatgtcattgcgagtggattataaacctaaatcccaatccaatgttttatttgaaacttacgtccaaaattttaaaacctaaaaaacaagttagatcagtgtccttgggtttttgatctaaatttatgtgtttgatatacttttgtaactaaattaaatctaaataaattaattaataaatggaaacatgttattttcatagaagaaagagttaatgcatgatttaattatggtgatgtgtgtcatcgctcgagagacaccacatcttttatatataggataatggcctttgtggtttagcatgtctgagtttaaacgatccaacgtaagtaattaagaggcgttttataacacaaaaggaaatacaagttttatttattatagcggccgttcgacaaactataaaatatgacaaacacatgcataggtaaacaaagacagaagccacaaaccaaaccacaatgtaagaaacatgcacacacacacgcattcgaagctagattgaggtcaatgaccaggttcgtttgtgcctttgaaagacctctggggcggaggaggagataaatgaagacgactacatgtgccttttcgaagacattccggaataggcggatcttttggcgtagggcgtataaccttaggaatatattttggcttaataggaatagtaaagcgtgcatcatggtaagtcttttctgcacctacaccacccgaaaagcattacattatatattacagtgtcaatgtttgatcatctttgtgctcatttgtctattcaaatgaggagaaattccaaaattcaaaccaaaatcaggattaaacacaactaattaataacgtaaaatgatactaatgacctcggaacatctaaaataccaaaagactaaccttgtttctgggattcctcgtgtgcgcctagggctttatccatatgcggaaacacaagaagaagaaggaggaatagaaccatagtagatgtcatcttaatattccctcttattttgcttattagtgtcactcatggttatgcatttatataggctatacagcaaattataaaagaaatttaaagatatggtggataatatagaaaggctaagagacaaagaagatgaagaaatctgtggacagtctagcgagagacttaaaagcttatagtcatcgacgacttagttggatcacttattttatgagtctcgaagtttttgttgtattatttggtgaaaagtcttcaatagccaattcgccatatgattttaaaagatcattttatattccttattttcatatttgtattactaattatactgggttaagaacccgatattgcagagaactcatttttaacaaatttttgtatttacgtgttatattataaaataatatttgtttgtgattatgtattaaattattatgatatctaaaataataataaccttttttaatattagacttattattcgttttgatttttaatgaatacaaaaacaaaggctaaggcccaaatacagatgataaccgaaataaagaaatgggccaaaccaaactaatcggcaaacgaggccgaacaccaggaaacttgaggaggcaaaattacagccatctgttgttttctctccagctctcgttccagcttcattccctcgtatcaatcttcttctacattcgaaaatcgtatgtttacctataattaaggaatctcttttggtgagtttgaatctgctgaatctcaaaaccctaattctctgttcctagagttttgcctcagcagtttttattggatcattgatatatcatatatatgtacaattagcatcatgaactgtttgtccattgacgcgtctaatggaatcttcacatattaatttcttcactgtaaatgcattttgtttttgcttttctgattgttctgttccttgtgtagtttgcatatttagagttttcttacttcttctggaagaaacgtgtttcttctattgtgtttatacgtatgaaatcaacgaacaatttaggactacacttatcaaaatctgtagatgtgtcaaacgttaacattttagcttttagccaagtgtgatggttttagtggaagcttttgctagtaatttatctgatagcccatggaaaattttctactttctttgtttatggcctcaaggtttataatctttctcttagactaccatggagaggacttgtccactgtgtgccaggtttggtgtaatagctaataggagaaacagaataccattaattacagacagttaatggttattagaaatgatattgttctgctgacagataagagtaatctattgttctctattgattaattagcattctatattatgatgacaatataattatagtatgtgacatcttgttgttggataatgtacgctatacaaaattttgaagttacaagatggcaacattctttgttcaatcttctttttgtttgttgatttttcttctttactctttccgcttacagtacaacacgagaatg

SEQ ID NO: 25049 - DNA, 3000 bp, Unknown; identical to SEQ ID NO: 13254
  misc_feature (1)..( 3000): 2750-1469P.txt file - cDNA_ID_2702457; gDNA_ID_2214608; Annot_ID_135707

SEQ ID NO: 25050 - DNA, 3000 bp, Unknown; identical to SEQ ID NO: 13254
  misc_feature (1)..( 3000): 2750-1469P.txt file - cDNA_ID_2702457; gDNA_ID_2214608; Annot_ID_187285

SEQ ID NO: 25051 - DNA, 3003 bp, Unknown
  misc_feature (1)..( 3003): 2750-1469P.txt file - cDNA_ID_2702493; gDNA_ID_2214610; Annot_ID_135736
ctagagttctgaagcttgtttatatggttaattttcactttatttgaatggctctacctttaatagactagtcttcttctagtttgtggtacttgagcgatgaagtttgagttctgggattagttacttctgatagttttgatgtgattgccaaattgttatgtgtttgtttcggtaaagggtttaagctgaaagaagatatatgcttgccgtattgtcatatccttctctttgttttgatgtgagctaacaaaaatcgtatttagtcatatgcttgtcgtattgtccaaaacagtcttcttttctctttgttttattgattctttgactgtgtctatgtgattaattcttgtatttggctaataacaggttttattaagcaatctctaacttggccttatttctatgtatagttatttgcagctgatcttttacaaaaaatggacaatgaagacgaatgtacttatggtggtgaaggtgggcaaacatcagcagatacatcacaatctaaaagtttagtaagtgcttctcgttttaaaagaagtagaacatcagatatgtgggattactttacactagaagatgagaataacctcgtgattttcccgccaaaaaaacgtaacctcgtgattttcccgccaaaaaaacatgaccccgtgattttcccgtcacaaaacgtaacctcgtaattttaccgtctaaaaatgtaaactcgtaaaaatttctgaatcaataaatatctcaaatttaataataatgaattaatgatgatgataattatttattattgttttataataataattaattaaattattatttaaatggttaacccatttaacaactcaacccatcaaatgaaatgagttatgggttagacccaactcatttaacaaaatgagttgggtcaacccataactcatttaatcataaactcatttgattatgagttgggttgggttgggttacccattttgacacccctagtaacaacagaatgaattttgtttatagagacaaaaaaacatgaagtaatgaacattaaaaaaaatcttagtaatataatgggttctctaatataatctaaccttcgagtgagaaaaaaatgaacataaaaaaaagaaacaagaacaataaaaagagtgggagacaagagggtgataaatggtatagctacgggacggtgacgtatgatgtgaaagaaaggaagagcgcgggtgatgatggaattaggtgacaggcatgtgaacaacagtgaagctgcaaagcctgatttggttgtttcccttctctttaagcgtgcttccaacgtgtctctttgatcatgaccttcttcttcaaatatacaactcttcacttctattttcatttgctctcattttcacattgattgtgttcttagaattttgttcctcgtgcaatctcctcactagtttaactaaataattatacattgatttttgttgtgagtctacttaaattatggtatctattattgtacatttcataactataccacaccaaaagtagagcatattaagcagccggcaaaacaaagttcaattgctgctttcttgtctctctcgtatcatcactctcctttgctaattgctctcagcccataattataaacgagtagaagaatatttaacactctttttcgtaaattttcattttttaccacttgttaaatgctctgtcttactttttttttatccattgtaattttcattggcggtatgcatatttttagacagacaaaatttaaaccgatacgtggtcccataactattgaaactctgattataatggaaaacatattaaatttataggtattttagaccactcagcctcttaaatattggatggtcccatttctatctaaatcattttaacaacaacaaaagaaaatataccataaaacaatctgatttgattttacttattgctaaaaccatataataattttaataaaatataataaacacacgcatgttatttgtggacctacaaaataaaataaaaagaataacagagacaaaaaaaagtcatttcaaatatataaatcaaattaaaattaataatattttcatgtttttttaagcttccttacaaaacagaaacctgaaaccatgttacctataacaacgacatgtatttattattatttctccattagatctaacgactcagaatcactctcacttactcattctcaaccgtcagatctaactacagtactccacaccacatacgaacaaacctaatctatccttaatacccttacttttgtagtttattactaaatttaccactccttccatgtttttgtttctctcttcttcttgattgttgcgcttttgttagctttctctggttcattttccatggacggaccttgacctctctgcttcccttcgtgcattttctctctctcactatcctctctctttctagtgtttgtttgatcctctgcgtactctgttcttcttctctcttcaggtactagtttcaatttctctaaaaggaactattgaaacctccttctctagtttcaattttcaatctgggtttgtttgtttggttcttgtagcttctttggattcattatcatttgggtttagtttatttttctcgtaagtaagtgatttagttgtgattctgaattttagggaaatgctgaagaagttagagtaagaaatttttggtttttgaatggaaagtgattgattttggggaagatgagttctgggaacgataaggttgaattctggctatgaaacctaggttaaagtttctaactttatcttacttgttaagcaaatctaacccaattctcatctgaaaccctaatttttctgggttcttcttaaaattgagaattttgttcatgcatctatagaaagtgaagatttttatgtaattagattgattttgggttgttcttcttgttgttgtgatgctaagcagataaaacaagtcctgcatattgaagatctgatg

SEQ ID NO: 25052 - DNA, 3003 bp, Unknown; identical to SEQ ID NO: 25051
  misc_feature (1)..( 3003): 2750-1469P.txt file - cDNA_ID_2702493; gDNA_ID_2214610; Annot_ID_187344

SEQ ID NO: 25053 - DNA, 3000 bp, Unknown; identical to SEQ ID NO: 13274
  misc_feature (1)..( 3000): 2750-1469P.txt file - cDNA_ID_2702512; gDNA_ID_2214610; Annot_ID_135731

SEQ ID NO: 25054 - DNA, 3000 bp, Unknown
  misc_feature (1)..( 3000): 2750-1469P.txt file - cDNA_ID_2702524; gDNA_ID_2214610; Annot_ID_135727
gtgagtccaaccattttttaacagacagccacgtgtcggtatcttcaaacttttcgtccggttttggaggcaaaactccgaccggtataaccggtttccggtgaagttcttgtgtaagtcctaaccactccgcttcatactcgtaacagctccgtacgaagatgacgtcacagccgtcaattacgccgccgacacggtggatgtcgggaacattcccttcggtggtttccgccataaatcctttgaaaatgaacctgcattcaaataacttgaaagctaccgaagtttcaaacggaacccacttaggcggcttcataaaatccgccggcgaagtacggtactcttcgaaccccggcggtttaagaataccgagcgtcgcgccgttgaaagcgctaaagaatccggttttgattccgagacgacgagagattggaggaagccaaaaccccgcgaaatcttgaagaacccaatcgggtttcgaagattcaagaaactccgtcaccggaacttttaacccgtcgtaagcgatttttaagtaaggtatgagttcgaaagggacgtctgtggtagcttcaccgtcttccgggagtttgttgtcgccgacgggaagtgatagcttgacgaagttaatgacggaggagagattttccggtaaccatgggaggagacggtcgatgttacgtggagtggaaatgaaagagactttgtgacccttttgagctatgagtttagagagctccaagtatggaaccatgtgaccaaaggctaaccatggaaacattaccacgtggagtttggttccatctccatcgttgtctttgaagtttgtcattttcactttgatgatatcgagttatcgactcttgactatcttcatttataggcaagcatatagatatatatacgaacgggtcagagtgggttacgttcgataaaataaaggtattaaaacattacagcattacaagtatagtgttattttatttgattgtgaaaacagatgttgtaggtacgattaacagctgagattaagtttaggtcggtaagatgtgtggtagtattaccgtacatatggacacccaatagtatcagattactataagtgatctgtttccataatcaccacatatagttagactacttttgagatctgattctttccacaaaaagttcatgcatacgaatttttaaattcgaatatctattttgctaggacaaagaggttgcgttattatagtagtatcgtgcatagtcattgatagtttagcatttcattggaagacgtatcattgttttcttcggtaggcgtaaaattttattcaaacaaaatgatcaaggttttcctacaacgaccccatataagattttgatttcgcttttgctttaaatttttgatttggttggcctatcaattcaacatgtttctaccgatatgttgatacaggaatcaaacaagtacaaagaatgggatctctggagaagtaagaagaatcttcaagttgttcgagccggaagctaagtgaggtagacgcgttgagggcaacgatctcagaacggggaagagtgggagcggcgatcctgaggtcagggcgatccttcctcgagtcttcagctcgtcgaattagggcgtcaacaatcgtttcttcgcttgtggttgtattgtcgctgtattagtgccaaattcccgtcccatcaacgtttctttccattctttatttatagccgcttgtttagggcgtacgacgagggtaatccggccaattccctctgtttaatgcgatgatctgtcctttctccagaacattcattttcaatggattgggctttgtttgtaacgggctttgacttataagtcgaaatcgagctgtcaactctttttgggccagaattgagacttgtccaattcttccctcaacacgatagttctgacaaattcatcttagcgatgtctctcgtctcgtgatatatcgatttgtttgacttgtaatgtaatatttttttaaaaatctttttggtggtctttcttaacaatcggtgaattttatcataacctatagtttagagaagtcatttgggtatttgatatgacaatagacaaatcttttcgaggaattgatctccatgataacttcctcttcctaaagacatggtctgatgatggtgatgttatcgatgccccttgattggattatccatcttccatagaaaaagaaagcatagttacaaatcggtaatgattgatagggtattataaaagacatgttccaaaaccattttaaataaactatttgtatgtttgtataataagagtgttgcaaaactcctttgagaatttcatctataaaatgttagccaagtatataaaaaaaagacttaacagatttcatatgttgtctctaaaacttccatttaggaagaagtgttactaccatttttttttatcgaaattatggtcttttattttggtaataattatatttaaatggtttatgtatcatgtaacacatttctgatataatataattgaaattgaacacaaaataaaatagaataaaagttcaaattttgatgcataaaagtttttctttaatattaaaaaaattgaagggcttcgcttgtgattgcctgcctgattgggaagtctttttaactaatgggctcgctttgttagcccataatctgctttcatctgaacaggcaaaaagtatatacgtaagacggtaagagtcacagagagatcaaaatggaggtgcggggaatcgaaccccgtgcctctcgcatgcgaaacgagcgctctaccatatgagctacacccccaattggtaacaatactaattttatttattatatcgaaatacttaaaacagaaatttatattatctgaaaattatctgactaagcaaaacatgatccagtttttgatcatgtttactctatattaattactttacaaatttttgatccagttttctcaattttttctagactcgtatcgatatg

SEQ ID NO: 25055 - DNA, 3000 bp, Unknown; identical to SEQ ID NO: 13280
  misc_feature (1)..( 3000): 2750-1469P.txt file - cDNA_ID_2702541; gDNA_ID_2214611; Annot_ID_135758

SEQ ID NO: 25056 - DNA, 3000 bp, Unknown; identical to SEQ ID NO: 13280
  misc_feature (1)..( 3000): 2750-1469P.txt file - cDNA_ID_2702541; gDNA_ID_2214611; Annot_ID_187379

SEQ ID NO: 25057 - DNA, 3003 bp, Unknown
  misc_feature (1)..( 3003): 2750-1469P.txt file - cDNA_ID_2702545; gDNA_ID_2214611; Annot_ID_135757
atattattttaaacctctgattactttaacataactctgcaacttccattcacatggttgttccggaaagaacgcaaactgcccaaatagaaacatgaaccattctttctattctttttttgttctctctctctctcttcttatttcttaataggcgtagcattttggcttattatgagcttgatttctgcttagagttaaacgacaaagtgcaaatgtttaattcgtatgactcattatacctctagttgcataagggtctatctgctgaggttatagatcaacttctatagtattccaaactaataaaatcttcggttaccataaattatcttgcctacgtgatatgtttctactgacttgtgctgcaaatgcagacgactggattacaaaggatctatgaaaatttgtgtaaaagttcagatagtgtttttgcttgattcacttattcagtatttgattttttattgtaccacgagtctactgcatttgtcatcaggaatagatggttagatcaatgggctggtgggttcttgtgagaaattccaccagagcagagaaatatcaaagagccgttttaagttttcatcagtcagaggtagtgcaacaaaaattgaaatcagtgcagagaaagaataaagagtctccaggaacagaggtccacatcacggtttcaatgatctgtttgtacattccactatttagaaatctctccccttactcagaattaagaaattttaaagcacacaaatccatattcctagagaaaaagtgggaataagcagaatggctcaaattagcacaagaggaggaaaaagaagatgcagaagcaagcaatgaacaaaactatctgcacattgggctgttgtgaggttggtgtgaaggagtcttaggacagtctgatggatgctggtaactcgtcttatcatctgctgctgcattgaacttacattcctgcttagctgttattggcgtcaccaggtacccttcgttcttctcctccattatcttcaatatgctctcaaaaacagaaacttcacaaggaatcctcaagacaccggcttgttgaaacccgaactcttcttctgcctcacgcagaagaacatagaaagcttgatggctgaggtactcggttggtattgtgtacctcttcttctctaacccgaccgaaacagctagataccctttaggcacagctgttacatctgtaaatgacagtgtcctcttcagaaacttgatgctcttgcttcccccgccactgctattgttgtcttcgttgttgttgttggctgcttttgatgcaattgcttgttttcgccatttcttgagaagctgttgaagcttaacgatctctctgatcttgtttgacttcttggcttccatggtggagatagaagacaaaagacaagaagtttggtactatgttttgtctagcgtctgtctctttctatgtgtgtagtgattaggacgtggtgaatattgagaatcggggatatatagaggtggtgaccacggaattctgatttaattagttttgtttctgcttaaaatattgtgctaatcatatgctttggttttttttaatgatttaaaccaacttgaatttgttgacaagcaaaattaagcagcttgaacttagaaaatgatatttaacataacctcaaattttgtcaccaaaatcagacaggcaaagctggctcaagcatcgcttaaatccctgtaaaacgcaactatgtaattaatattgagatatacttgttgctttctgactctgatttcattcactcggcagcattctcgtgctctcggctgctgttgccaaatcttatggtatctttctcaaaaagctcatagtaccgttgtgtctccatcagactttcattgatgtaagtcttataggtactactaagatccataatatgtaaggcctcacttgcttctttcccatcataccatatggctctttctctttttccacctcccggtactgaataacagcatgttgcttgctacaaaatgtgtgattagtaggaatgtcggatctttctctcacgtccaaagaggtagcaaatttggtaatgaatgcaaagtgtctctttcagtggttcaccatccttaaaatgataaagtctccatctttctttgggttttctattatctacgggattattgaagaggagtgtgatacctttgtatatgttggtttcttcagcaagtttcctcgatagctcaaaacatcgcacaccatgtttttcaatcatcaaacatgaatgaagtagcagctatcgagattctctctctcgtccggtacttagccaacacccttcctccgaatctctgaatgtcagattgatgtctcctggcacttggaggataatctaagcagacatggatgggtcctaatcgatcaagatagtatcttccatataggtctcaagagtttgagaagatgtctttcaccgtttcatgcggaagttgactccttactttaagcaattgaatgcatgatcgtaattagtgatatatttggagttttcgcttccggttactctgatatgatatctttcctcgacaactataacgaatgaccaatatttgtaatagagatagtctattttcgatctctcatttgtttctttctttttttaacattacattttttcatagaattctaatactcacagattgtttaatgattttttcttacaaaaagtatcattcagataatttaataaaaatggtatcgcagtgcctttatttacctttaggagtaagttttctttcttccgatatcctaaattgttcgacacgtgtcaatcacgaaaccacaaccaaaaaaccttgtcgtcttctccaatcataaaaaaaaaaaaaaaacagtgtcccaatttgatcaaacaaaacaaattcataaattcggagaagagaacgaaaaatcttcttgttggcaaatctccggcgagatcatctttcttattttgttccacggaagtttcagacatg

SEQ ID NO: 25058 - DNA, 3000 bp, Unknown; identical to SEQ ID NO: 13288
  misc_feature (1)..( 3000): 2750-1469P.txt file - cDNA_ID_2702554; gDNA_ID_2214611; Annot_ID_135765

SEQ ID NO: 25059 - DNA, 3000 bp, Unknown; identical to SEQ ID NO: 13289
  misc_feature (1)..( 3000): 2750-1469P.txt file - cDNA_ID_2702566; gDNA_ID_2214612; Annot_ID_135771

SEQ ID NO: 25060 - DNA, 3000 bp, Unknown; identical to SEQ ID NO: 13289
  misc_feature (1)..( 3000): 2750-1469P.txt file - cDNA_ID_2702566; gDNA_ID_2214612; Annot_ID_187405

SEQ ID NO: 25061 - DNA, 3000 bp, Unknown; identical to SEQ ID NO: 13295
  misc_feature (1)..( 3000): 2750-1469P.txt file - cDNA_ID_2702623; gDNA_ID_2214613; Annot_ID_135785

SEQ ID NO: 25062 - DNA, 3000 bp, Unknown; identical to SEQ ID NO: 13295
  misc_feature (1)..( 3000): 2750-1469P.txt file - cDNA_ID_2702623; gDNA_ID_2214613; Annot_ID_187435

SEQ ID NO: 25063 - DNA, 3000 bp, Unknown; identical to SEQ ID NO: 12746
  misc_feature (1)..( 3000): 2750-1469P.txt file - cDNA_ID_2702627; gDNA_ID_2214569; Annot_ID_135023

SEQ ID NO: 25064 - DNA, 3000 bp, Unknown; identical to SEQ ID NO: 12746
  misc_feature (1)..( 3000): 2750-1469P.txt file - cDNA_ID_2702627; gDNA_ID_2214569; Annot_ID_186112

SEQ ID NO: 25065 - DNA, 3003 bp, Unknown
  misc_feature (1)..( 3003): 2750-1469P.txt file - cDNA_ID_2702631; gDNA_ID_2214569; Annot_ID_135021
cataaccatgactataaccagaaccataactataaccaaaaccatagctataaccaaaaccaaaaccatcaaggcaacaaccccaagaagatgcatcgtcaaccatcttcgtccgattctgagaacataatgagcacacgagtcatcaccattgcaggtgaaaacaaaggtgcagtaatggagatcctacgatctcctcaaggcaacaaaaccggtggttcaggaacacattcctctagggtttcacacggcaccggagagaaaggacggagacttcaaagcagcagcagtagcagcagcgacgaaggagaaggtaagaagaaaacgacgaagaacgtccctaacaaaggcaatagtaacctcccaatgaaagcttttatgaatagtaacgttcagatgataaacaactccattgtctacaactcgacggcatctcatcatgatcccggcgttcatcttaaaatctcccggaaacctggctccgacaatggttttcatgtcagtgattacggtaataatggcggatacaccaactgatgaaagaagaaaaaaaactaaactaaaataaaaaaaaaggttttggatttaaaattgcaataaattcgatttaattaaaataaatgaaaaaaaataaagaaaatatgagtggggttaatggtttctgattcttctctaaagcttttggaaccctctcacttatatggaggctttgattcgtttacttaaaacgaacttctttttttaattacttttgtaaacgcgcgcattggttctctctgacgtaattaatgagaaatcagttattgctttaataataatcatgaaacccatattattgtgaaggcccgatgtatactacataagcccatattcatacctatgggcctatataaacaatttgtatttaccgtaatatatttacttttatcaattggggtaacgatttggataattgaatccaaaagattattgtgccacaagcgacaagtttatgtgaagaaaagagaaccaaaccttgtatattattaatcaaatgactttcaaatcaactcaaatgtctaattggttcctgtgtccgttatgagaaaagctcatgcttcaataaaccctctaataagatcacattatttatttatacaaaaatatcccaaccaatgtatatgcttttatatttttaattttttttgtaatgtagaatctattctacacaaatcgttttagtgattgtaacagtatctgaaaaagaagtggggaactaaagtgagcattttgaatgcataaaatagaaattggaggagttgaaaagccagaggggtcttttataagctgatttattctttattagttcttgagtcgatttttgtgaatatttaaaattcaccaggagcaaataaaaacatcactaccttataaaatcataatacaatactttcgaaaacttatgcaattgaataaattggccatataattaggcaaaagataacaagaaaaaatgtccaaatcccaaaaattcgagaacaagaagcaactgacaaagagaaaggagagtgaagtgtccaaatcccaacagtatgtgtgtggttttgtgtgctcttcaaaaagctttagagggtactttgcatgtgcatatgcatatgcattatgcatatagtcctcctaatctttaatattgtatctttgaggatttaataggtatctgagaccttgcaagttgcaactgaagaatttgagtaaagttggtcacagattataaatccgtaaattattacattttacaattaatccattagtaacggattggccatgtgatttggaatttacaacttaataatgttgtcaataatttaagtatagcttgtttctgtcaagagaaatggcaatggcatagctttttacaattttgaagataattttacgtcaacgttctaaaacgttgatgattatcactctgaaaatttgacgctagggtttgaatacattattgttgatagtgaagaatgatccgcgatgacattccgcgacatttatattatagtgaccacagtgaccgaattgcttccactatatttggacccttcttgagggaatccaaagctggtgaatatgacattttcaaataagatattaaaattgtacgtccatttttaaaaattgattgaaaccaaaactttcgctttaatgcagcgaatttttcctttgatgtctaatcaaatgatacaaacactgaaagcaacagaagtctaccaacaagattacaagaaatgaaccacggaaagatcaaggaggcactgaaaattagtattaaaattttcttgtcaaactttgataatttataagtaatcgggtcaaaaagcaatttcttaataattaagggtgggacaacgaatagtgtgacgaccagattagcaagtgacatgtggcacctacttattggccttgcctcccaaaagtcagaccgatccaacccactctttgtaattaacacgtgtcagaagctgaaggactctcctatatgatttatttaatgtcttaatagatttctcatttcacactatccttttttgcttgagaactttcttcactctttcaactgctaagaagaaatagagaaaactatgacggtacgtaaattttgttgttaattattttgctttaatccttttttcatatagttcgtaattataaatctataattgttttccgggatttttcgaagatctttaactgggtgcagaaaaagctgcaccaaaatgtcatcaaaggttagtttttttttttatagataatcaatatcagctttattttataaaaaaataacaaatttgctttattttccctttgtttattagaatatcgtaagcttcactaaaatagtagtttactttttgtagtagtatcatataggatcatgtggttccctgtttaataaatagttttatattaacgtataccacgttttcgctaaagcataaattttgtccaacctatatttattttcatatg

SEQ ID NO: 25066 - DNA, 3003 bp, Unknown; identical to SEQ ID NO: 25065
  misc_feature (1)..( 3003): 2750-1469P.txt file - cDNA_ID_2702631; gDNA_ID_2214569; Annot_ID_186110

SEQ ID NO: 25067 - DNA, 3000 bp, Unknown; identical to SEQ ID NO: 13305
  misc_feature (1)..( 3000): 2750-1469P.txt file - cDNA_ID_2702642; gDNA_ID_2214613; Annot_ID_135796

SEQ ID NO: 25068 - DNA, 3003 bp, Unknown
  misc_feature (1)..( 3003): 2750-1469P.txt file - cDNA_ID_2702646; gDNA_ID_2214613; Annot_ID_135795
gaaccgatttttttgtttactcgaaccaattcatgtattatgtataagctatattctcttagataataagttaaaaattgggttcttctcttctccgtcttcttcgctggctctcatcatccataaagtgaaaggcaacgcatagaagagccatcactcacaaacaaagaaaaggcaaaaaaaaaaaaaaagtcctccaaaaacattcttctctttggcctttactcaaaacccacacacatctctctttctctctctctggctttctctttgtcggaagtcatggacgctacgaagtggacacaggtgcttaaaagatcttcctttgcctcttctcttttgtttcttcttcttcctattaactacttcttccttttttctctcttatctttctcttactctcttccctatccgtgaaagatttcatacttgtttatatgcatatatccgtgtgcatatgtgtttgtggttatagagattggagatatacgtatttcagtttgtttgcacattttctatgaataattaatttgcatgggaaaattattattgttgtatattatagctcaaaaacactttttctcagccttttcatgttattaatcattaattatatttgagaaactaatggagatattagaagaaagtcatgatttgtatttaccctttgttcttggtgttcatctattttcgttttccacgagatcctatatacatagttctatagaatatctaataaggaaaatctaatgttcatgtttcatttttctgtttaattagtgcttaaaattgcaaagcatcgtgcgaactaaccatatgttttaattagcttattatataacttatgtatcaattatggtctatacataattaatatacatgtacattgggtttcaattaagctctaattaactctttaaaattcaaatttttagggttttcaagaaatgatgaacgttaaaccaatggagcagatcatgattcctaataacaacacacatcaaccaaacaccacatccaatgcaaggccaaacaccattctcacatctaacggcgtctcaactgctggagcaaccgtctccggcgtaagcaacaacaataacaatacggcggttgtggcggagaggaaagcaagaccacaagagaaactaaattgtccaagatgcaactcaaccaacacaaagttttgttactacaacaactatagtctcacacaaccaagatacttctgcaaaggttgtcgaaggtattggaccgaaggtggatctcttaggaatgttcctgtgggaggaagctcaagaaagaacaagagatcatcttcatcttcttcatcaaacatccttcagacaataccatcttcacttccagatctaaacccgccaatactcttctcaaaccaaatccataataaatcgaaagggtcatcacaagatctcaacttgttgtctttcccagtcatgcaagatcaacatcatcatcatgtccatatgtctcagtttcttcagatgcctaagatggagggaaatggtaacataactcatcagcagcagccttcatcatcttcttctgtctatggttcctcgtcgtctcctgtttcagctcttgaacttttaagaaccggagttaatgtttcttcaagatcagggattaactcatcgttcatgccttccggttcaatgatggattcaaacactgtgctttacacttcttcagggtttccaacaatggtggattacaagccaagtaatctctccttctctaccgatcatcaagggcttggacacaatagcaacaataggtctgaagctcttcatagtgatcatcaccaacaaggtagagttttgtttccatttggggatcaaatgaaggagctttcatcaagcataacacaagaagttgatcatgatgataatcaacaacagaagagtcatggaaataataataataataataactcaagccctaataatggatattggagtgggatgttcagtactacaggaggaggatcttcatggtgaagcaaaatgatcaaaaggagattatgaaattagctttctaattctctttttatgatctcttgcctcacatgggttactttagttaaagttgtcagaacttagctaacacaacatagtctttttattcttcctttccttttttttttttttttttttttgttaaaatcaatatttattttctaaatgttttgtagtttggtttgatgataatttgggttggtttttcattttggtttgttgattaattagtatataaatcacggcgttatgtatgggtagaagaatatgtgaatacgaatctctcgagtgttgcatatatggtatatggtatgcactatgtaactatgtattcatcgcttcttctatctgtataagtgttttcataaaaggattattcatatgatcatatctattatcgatatagaagttagtgtgatatactctctagatcgatcacttggaaaaatcaataagcccgggccatcaataaggcagctaaagtaactacgtaaccattggccattgctaagatggttatgtaggcttctaacatgtcctcggtcgttggttcaaaaagccacaatgatcattttacctttctcttagcaattttatatccagttaacaactacttagttcatattttttcataatagtcacatctcaaattcagacgagaaattaccgttacatcaaatcagttaaggcttggacggagaaagagatattttattatatgtcgacatgtcgttattattgtaagagaatccaattccattgaagtaaataattgaaagacacgacggaagaaatcaagaaacgaaacttctccgaaacttaccattgtcttgtctttcttttgataacaatatatgggagtgggaatgcgtcgtattcacggcccattcgaactttccacgaaaccacctaataatcagctgcttccctccctactcacgaaatcgcattttatcttggaatg

SEQ ID NO: 25069 - DNA, 117 bp, Unknown; identical to SEQ ID NO: 329
  misc_feature (1)..( 117): 2750-1469P.txt file - cDNA_ID_2702650; gDNA_ID_1563893; Annot_ID_148473
  misc_feature (3)..(3): n is a, c, g, or t

SEQ ID NO: 25070 - DNA, 3003 bp, Unknown
  misc_feature (1)..( 3003): 2750-1469P.txt file - cDNA_ID_2702690; gDNA_ID_2214617; Annot_ID_135825
aagtagtggatctgattgttcatagagtagaagactataaaaatcttaccagtttaacaaagagttacttcgctgccttaaccgatcgcatgttgcttttgttatttcattttttgagtcctttgaaaatattggaagtgtaagcagtaaaagttaaataacattttaagtatcaatttcagttattgttagtgtgtatatcgtattgttttcttatgcaggaggtttacataccactgcccaaagaattagaccatatgtctgtttaagtttaccagcttcttagatgttttggtatgataaatggtcttcatttttgggaagcacaagatctcaaggggaaataacgaggagtggaaagttacattaaaatgatatggatttctaatttatatctcactcattgagataaaagagtttcattgtacgcccgaaaaacctaagttgaagttcaagcttattattattgttgatcagattttgtacaaaagttacgttaaagccagcagggatcattgtagaatggatctatgatttatcttgttgtagatttgaacaaatttatggcgatttgaattatttttttcaattaccgttttaatttctattttttttatatataaaaatattgattagttagtttttaggcaaaaatattagtaacaaagattttccttaccattccaatctgtaatggctttgattaagttgtaaattaaaaatttgaagtagattttctatttttttgaaagattttatctattatattgtatatataaaatttgtttaatgattggtttatttatcttgctatatttgttctatttataattcagttagagatcaaatagtgatttgatacctttttaattttctgaatttttgataaatatagatttgttagttttaggcaatatttaataaaacggtttgattacgttttttgataaatatatctttattgttttttattacgttgaatcagatttttatttttgttgtaagatatcgtcaatgattttatcagaaaaggtagttttaagattgatttaatggtcttgctctatttgttatattttataattcggttagagataaaataatgatttgatttgtcctctttataattgtccatgatgacttatttcagattcatagttagcacaaaactttgaacttttttgcctatataagaacaaatcaaacaagaacaccatctatatttgctagataaaaataaaaaaccaacagtggcgacttgaacatcagagacaaaagaacgacctcgatttaatcaaattgtgggtaaaataactttcaaaattgacccatttaaaacagatggtcatgatataaaaacgggaaaaatgtcgtttaatcccccaactttccaaaaatggccaatcaatacgtcaattttgtaggaggccatttaaaacatcaacttacaattgactaacatttaaaacacgaactttgcgttgactaggcctaataagaccgacgttaaatcgattaacagatccattagacgacgttaagaactgttatcatctctctgttagtgaagaaacgacgacgttttaaagcttaatagataacccgattgtttgtcgaaaatccccaaatcaaatacttcaaatccctaattccctaattctcttcttcttctctaaattctccatcaaaagctgaagaaatgagttgcaaatctgggaattctaactaatggcatccacgaacacactttcaagatcgttggagataaattagggtttgtttttgatttggggatgaattcgatttgaggatttcttctcgacaaatccctaattgggttatcaattacgcctaaaacgtcgtcgtttcttcacaaacagagagatgataacggttcttaacctcgtctaatggatctgttaattgatttaacgtcgtgttttattaggcctagtcaacgcaaagttcatgttttaaatgttagtcaactgtaagttgatgttttaaatggcctcctacgaagttgacgtattgattggccattttttgaaagttgggggattaaacaacatttttcccatttaaaaactggccaaaaaccaatgactaagattttatttgatcatcgggtcaaaactcacaagtatcgggttaggcaaccccctcgttcttcaaataaaattatttaaatgaggtttgatatcctaaaacgtttataaatttgattataaaactttagcatttgcccatatgtttgcaaattcattaagacattaaattcaattgtaacaattatttgcaaatgaataatcaacgtaatccacatatttataattttatatgcaaaataatcaaatacaaaatattttaacaacttacattattattagtatattaaaaatataataatattgtctaccacataactataactattttaaaaaaaaatcttaaacaaacttaaaaacagatttttttttatccaacactgtattatgaaagattaaataaaattgtgtactacacaacaacaccaacaattatctaactaaaataaatatttaacaagaataaaataaaaatgtattttttctactacaataacatctagtaaaatataaattcacaatttcgaatctgaaaaaaacattaattattatctagtaaaataaattagtcttacagtcacaataaatcacttacctcacttttagaaaaatagaactttaaaagttgagataagtatctaatggcccagcctcggcccatttacccaattctggatccggatattatcagcatcactttcgtttttttgcaagtagcagagcattctccatgtttgagaaacccaaagttccaaattccaaaattggtcaaagctcgataacgtgtgtattgcttctcttagtcaatggtgatttcgattcattgactgggtttaaaaaccttgctagttctcaattctcatgactttgcttttagtcttagaagtggaaaatg

SEQ ID NO: 25071 - DNA, 3003 bp, Unknown
  misc_feature (1)..( 3003): 2750-1469P.txt file - cDNA_ID_2702694; gDNA_ID_2214617; Annot_ID_135824
ttaaatacttacaattctttttctaaaagttaaaaaatgcttgtaaagactttataagagttttaaatggatttacaaatgtttaaaatccttttcaaactcttgaaaaactcttgtaaatcatgttttacccttttataagcttttaaaatccttgtaaatcattctataccacttacttatcttttaaaaacaattgtaaactatgcaaaccttttttaaaatcccttgtaaatcattctttgacacttacttatgttttaaaaacgattgtaaatcatgttaaacacttttaaaatcccttgtaaatcattctatgccacttacttatgctttaaaaacgattgtaaatcatgttttacccttttataagcttttaaaatcccttgtaaaccattccaatgtcacttacttatacttaaaaaaacattgtagaccatgctaaccatttttaaaaatccttgtaaatcgttctatgccacttacttaggctttaaaaatgatagtaaatcatgttttacccttttataagtttttaaaattccttgtaaatcattcaatgtcacttacttatgctaaaaaacgattgtaaaccatgctaacactttttaaatcccttgtaaatcattctatgccacttacttatgctttaaaacgattgtaaatcatgttttacccttttataagtttttaaaatcccttgtaaatcattcaatgtcacttacttatgcttaaaaaacgattgtaaatcttgtaaaactattgtaaaaagttttaaaatgatttacaaaggtttaaaaggcggtttaaaagtatttatctatgtttttaaagactttataaagattttaagaggttttaaaatgatttacaagggtttttggcaactaccaaagcttttaaaaaatttacaaggatttttaaaagcatttttttggttgggaaaaaaaatttacgagaaaaattttggcaggaaattttttttttggcgggaaagttttttttttggtgggaaaaaaggtttggcggaaacttttttttggcgggaaaaataaatttggcgggaaactttcagtttccaattacatgttcttattagatgagggtaatttggtcattctgttcaagggaaatgatatttttaaaaataaacaatataaaagggtattgttgcaaaagagtagtaaaaaaagggtaattttgaaaatctcccatatttttgacccaaatttattcaaaagtgattagatacctataaatattataaatatcacaaaatttatatattttgacacaaattattacaaatataaatattaataataatatattattaatatttatattgtggatatgtacagaaacccgttggaatcggatttgggtttattttttttggatttggaataaaactgggtattttgaaaatttgggttcgggttggatcaggttattattggattcggatcgggtgttgggtttggatattatgcccagcaatggtgagtactcctctcgccatcatcagtctttactctgttccaagtcttccttctttggctcaaatggggtccacgatcatcaatccaaatagattcgactttttgttctggggtttcgtcgagaattcgatttttgggtttctttcgaaacttggtcaaatgtcgaatacgcgttacaaagaacaaacctttctctttatttcgtttgtcttcgtcaacggctgaatcaaccaaatggtccctggaattaataaacctctaataataatggctttgcttttactctgatgacaagttcaaaaatggaacaaagatcactcctttgcttcctttatctgctcctactattcaatttcactctcagagtcgctggaaacgctgaaggttcttcctttttctgctactctcatgaaaagtcccttcctttttggtggttgttagatttcgaaagttcataactttttttgtttgtttgctggtttggattatgaatatgtgtacaggtgatgctttgactcagctgaaaaacagtttgtcatcaggtgaccctgcaaacaatgtactccaaagctgggatgctactcttgttactccatgtacttggtttcatgttacttgcaatcctgagaataaagttactcgtgtgtatgtttctctctctctgtcttcttttttgctctctgtgctggttttgtctgaatgaatggttcaataatccctttgggaatctactgtttgatgtttgcttagtgaccttgggaatgcaaaactatctggaaagttggttccagaacttggtcagcttttaaacttgcagtacttgtaagccatctcttcctcaatgtcgattaattctatagtgttcaagatggacttgaatttgttatgcatatcatatgcttcatcttacttgtttaatgactgtgacatagttgtgtttttgctttcaaaagagaattgtggataaacaatttttttctcagagtagaaaactatgtgtgtgcgctctcttgtggttgatgcatctgaaatatatatatatatgtcgatttatttttgatatcgttggtaatcaccaatcagtgccattttagatctctttagctaggcttctcgagccttgttactggaatcctttataatcatctttcagctagaaccatggcattatgaaagacattttattttttgaattctctatgtcaaatgttctcatttaactctattagataagtaactggagagtttggatctggtatttctctacaggtgatctcaactctacatatttgtgttgcggctgcaaaatgtttttttgaaaatattgcttacaaatatagtttccacgttcatgtatcttagctgtctacgattattatagttcttcatattaatgggtatcttgtttattacatacttcattatgttttctgtagcctgaatttctggtaaaataattttagagattttccaatcgacaataattaagcaaagcttaatg

SEQ ID NO: 25072 - DNA, 3000 bp, Unknown; identical to SEQ ID NO: 13337
  misc_feature (1)..( 3000): 2750-1469P.txt file - cDNA_ID_2702734; gDNA_ID_2214619; Annot_ID_135840

SEQ ID NO: 25073 - DNA, 3000 bp, Unknown; identical to SEQ ID NO: 13337
  misc_feature (1)..( 3000): 2750-1469P.txt file - cDNA_ID_2702734; gDNA_ID_2214619; Annot_ID_187602

SEQ ID NO: 25074 - DNA, 3000 bp, Unknown
  misc_feature (1)..( 3000): 2750-1469P.txt file - cDNA_ID_2702738; gDNA_ID_2214619; Annot_ID_135842
tcagtataaggttaaagtgaaagctgtaagatctgacaatgctccagaactgcgttttacaagtttgtatcaacggaaagggattatggcttttcattcttgtccagagactccagaacagaactcggttgtagaacgtaaacatcagcacattcttaatgtggcaagggctctcatgtttcaatctcaggtaccactttttctatggggtgaatgtgtcttaacagctgttttccttatcaacaggacaccttcacagcttctttcaaataagactccttatgagattctcagtggtactgctccccaatatggacagctcagaacatttggttgcttatgttacagttctacatcaccgaagcaaagacataagtttcagcctcgatcaaaagcttgtatcttcttgggatactcgtctggttataaaggttataaacttatggatttggagagtaatgccatttttatttctaggaatgtggtgtttcttgaggaggtgtttcctttggctggtactaagaagtcagcagattctctgaagttgtgtacaccattagttcttgtgccttcaggtattcaacaacaatcttctttttcttctctttcatcacaaatttctgatctaccaccacaaatttcttcacagagagataggaaacctcctactcatctgtcagattatgtttgcaacaatatgcaatctgatcaaaaatatcctatatcttctactatctcttactctcaaatttctccatctcacatgtgttatatcaataatatcacaaaaattcctattcccacgaattttgctgaggcacagggcactaaagaatggtgtgaagctgttgatgttgagattggtgctatggaatctacgaatacatgggagattacaacattaccaaagggtaagaaggcagtgggttgtaaatgagtgtttactttgaaatttttggcggatggtagtcttgagaggtataaggctagactggttgctaagggttatactcagaaggagggtctagattatacggatactttttctccagttgctaagatgacaacgatcaagttgctgttaaagatctctgcttctaagaaatggtttatgaaacagcttgatgtgtctaatgctttcttgaatggggagttggaggaagaaatatacatgaagttacctgaaggatatgctgagagaaagggtattatcttaccatcaaatgttgtttgtcgtttaaaaagatccatttatggtttgaaacaggcttctcgacaatggtttaagaaattttccgcatctttactcagtttgagattcttcaaaacacatggagatcacacattgtttctcaaagattgtggaggtgagtatgtggttgtgttagtgtatgttgatgatattgtcattgctagtactaatgaggcagcagcagtacagttgagtcaggatttacagaatcttttcaagttaagagatcttggagatttgaagtattttttgggattggaaattactagaactgaagcaggaatctcattgtgtcagcgaaaatatgctttggagttgttggcatctactggtatgataaattgcaaacttgtttcagttccaatggttccaaatttgaaactgatgaaagttgatggtgagttacttgaggatagagaacagtatcgtcgaattgttggcacgttgatgtatttgactataactaggccagatatcacgtttgcggtgaacaagttatgtcaattctcttatgcacctacgactgcacatcttcaggctgctcacagagttcttcaatacattaaaggcactgttggtcaaggcttattctattctgcttcttctgatcttactttgaaaggatttgcagactcggattgggcgtcttgtcctgatagtcgtcattccactactggtttcactatgttcgtcggtgattcccttatatcattgagatccaagaaacaacatgtggtttctcggtcatcagctgaggctgaatatagagctctcgctcttgctacttgcgagttagtatggttacatactttgcttgcgtctttgactgctgctactacaattcctatattattttcagacagtacagcagcgatttacatagcaatcaatccggtcttccatgagcggaccaagcacatcgagattgattgccacaccgtgcgagaaaagatagatgatggtgagttgaagttgttacacgttcgcacggaagatcaagtagcagatatcatgactaaacctctgttcccaaaccaattcgaacatcttaagtcgaagatgagtattctcaacatttttgaatcctcatcttaagggggcatattagagagtgttggtttatttatgtgatttagttcattatgtatttcgattatattaaccggttgtatagtcatagtatatatacttgtacaaatacattttacaaagttaatgaaaaaatatcttcatctatgtctaacaaactttctcatctctctcaatcgtaatatcaaacatgtctctattactaactatctatttgcagttaccccaaatcataccatacttaagctgctagcacgattacattatatacacataaacgtctaaaatgtttaatgttttaaaactgtggaattttgttaaaatatttatcctagctctgtttttgggtgacgtagtttagcaaagatactggcccattgggtcttggttcattgggccaacgaaaaaggatttaaataagttaggctgtcatcaaaacgacaccgtatggttgaggacgcttttgctgcacgacgaagcataagcatgattttccggtcaagtcttttgagtatcagctaactgatttacagttttcgattcgaaaatcttaatctccatttcattccttcgacatcttcacacaaaccctaatctcatttctggtaaatccgattttgggaaactctaatttgatctcgagatcgctaacaacgatg

SEQ ID NO: 25075 - DNA, 3000 bp, Unknown; identical to SEQ ID NO: 13338
  misc_feature (1)..( 3000): 2750-1469P.txt file - cDNA_ID_2702746; gDNA_ID_2214619; Annot_ID_135844

SEQ ID NO: 25076 - DNA, 3000 bp, Unknown; identical to SEQ ID NO: 13338
  misc_feature (1)..( 3000): 2750-1469P.txt file - cDNA_ID_2702746; gDNA_ID_2214619; Annot_ID_187612

SEQ ID NO: 25077 - DNA, 3003 bp, Unknown
  misc_feature (1)..( 3003): 2750-1469P.txt file - cDNA_ID_2702750; gDNA_ID_2214619; Annot_ID_135846
ccgtctttagatccaataagccctataatctagatattaacctgtagtataccgcatgtaagcttatattttagttaaactaaaaacttttattgtaaagatgatttaaaaatatatgatattattttatttgattttaaatgtatagtaaactgtgagttgtatatgttttgttgatattatctatattgtttagtgtttaagattatacacttgtagtttgattgttaatttaagagtttcacctgtagtataccatcttgtattaatatcgatctaaacccgtcaattctaggattttccagcttgtattaaaaattgaattacatcatacacataaaaaaatctaatatgttattaattattatagtatataagattataaattttcaatataatatgtatgaaatttaatataaatatttcaaattatgacccgttactcagtagaaagttttcttaaatctatttttcacccgttataatatttttttcatgtattgaatagtgtatattcgtttaaaaaaattctaattatggaatatgcgaaaaaactctaattatttttttataatgatgatattattttttcgcaaaaatagaatcatataaagatgagaagtgaattataataattaataaaaaattaatatgataatttagatatcaaatctaatttgttgattttaattggttactttttttgaaattaataatgtatttcatttttctaattatatcaaattaattaaaaattagatatcaaatcttatatgttgattttgattgtttattatttttgaaaattaataatatatttcgtttttaaattaaatttaattaattaaattagtatttgactttttaattcttaaagagataaattaatttactctttaaaattttatttctaatggcatacctatgtaattacttataaaaattaaggttatatttaaaatgtacttcccaaataatatagtaggatatatattaaaagtatttaaactgcactgcactttatccaaagttgagcgacacatttctatttggagcattattttcttagtagtaattaatcggaatcgaaactaatatatagttttttgacaatttttttcttttcttaaagaaattaataaaaatattatcatcatcaaaaaataaattgtattcttctttttaatatccaagtacaaatcaatcataatcttttttagctaaatatttaagttatcaagttataagtttgactcatagtgttcacttattagatttctaaaagtaagttaaatagcaaacaattcaagtgtcttataaaggattaaaagattgagcaaaaaaaataatatatatatatatatatatatatatatatgtagttacagcatgaaattatattaaactcattaattaacaatagatagatatttagaaccagaatataaaatggttttatttaatcttaaaacatgcagctaaaaaggtcagaacatttaatattaccttctacattttgtttttatgtaaacattaccaatttaccatatactttccttgtacatatttagctaagaaatcgtggactcgaaattgtattttgattttagcaaattaattttttttctcccttgattgaattaaagtttacatttttttcttataatcacttgtgtgataccactattaagtcaaaaccagattttgtttttcaactgaaaattacttatatattttttattctaataatttggagagcatgatgatcgtctctgtccgatctcttcaactactgcttcttttagtgatgttactgttttgccgacgctatcactttacctcctcaaaagttttcccatgtatgctcttgctcttcaccctctaattcttatgagatgggaagttggtagagtttatggctctggttttgaggattttgatgtagctcattcggtttcgatgggcttggatacttgtgtttctacatttgtgttcctttgcttttatcgttttgatgcgatcatttatagcaatattcggattatgtatttatttgcttatgttaaaaattgtctcgttgcagtttagaaaagttttttgagtttagacaaccaaccacttatcctagtttattgaggctttcaatagccatttctgctttatagatcttgttatccttctaaatactttatttgtgtttagtgataatgttataaggagcattgtgtgcaagactattctacttgaattagaagcgggcattgttgttcaagactgttcttgtccaacatttattggccatatgatgttgatttgcttcctcctccttatggttttgacaaagacttccaaactaaaaagtgtatgctttattgaatgttcttggttagatgatgttttggtagaacttgtaagttcacccctattccgaaatctcaatttgagtgttattatttatgttagcttgtgcttatgcttattcttaacctctatgttaatcgatgttttgatttatttgactcttcgtaggcataatgtatcctgtcaggttaaacttctttctaccagaggataagtttgtcaaaaaaattgtttttttgtcgaaggtgcaactagagaacatgtaatcgaatccgagacaaaacgacatcgttttggtgtccgtgctatgtccaggacaattgtctccgcagtctaataagaaaaagaaaaaaaagattccagcccaaaaaaaaagccagataggttgaagaagaatcctccatgtttgatcatcatcattactcttgattcaaatctctacgatcttttgcccagcttcacttcaaatctcccaattctagcatttcaatttcatccccagtagctagggttttcaagacgtcgaccttctgagattgagaaagctaaatttggatcaaatttcctgactggtaatttcgtttgattagtctccaatttcggcgttttagaacgttctaagaagaattgaagacgaagatg

SEQ ID NO: 25078 - DNA, 3000 bp, Unknown; identical to SEQ ID NO: 13341
  misc_feature (1)..( 3000): 2750-1469P.txt file - cDNA_ID_2702754; gDNA_ID_2214619; Annot_ID_135847

SEQ ID NO: 25079 - DNA, 3000 bp, Unknown; identical to SEQ ID NO: 13341
  misc_feature (1)..( 3000): 2750-1469P.txt file - cDNA_ID_2702754; gDNA_ID_2214619; Annot_ID_187615

SEQ ID NO: 25080 - DNA, 3003 bp, Unknown
  misc_feature (1)..( 3003): 2750-1469P.txt file - cDNA_ID_2702769; gDNA_ID_2214620; Annot_ID_135859
atatagcaatgagagattactggagagactctataagacagtttccgaggaagtgcagtgcgtaaaaccgcagactgttgtccaattcagatatgttgtactctttgatccgagaaaaagatggtgtaaaccaaaatggaacatttcaaagtctgaaaagagagattgaatcagctccaaggcataagggaaacccgctaattcagcaagactgtttaatttcctataaatattctatttttattttcttttcagatatttattcatcacttatcagcgatttgacgagaagagctttttggtttctgcgaatcatccaaaatccgccatggaagcaactacaagaatcttgagtacttcttctgctctcaatcgtcttcttcttctcagtaagctcaatctaaaatcagatccccgtaatatcaattccacaaatcagctactacacaatgccgttacccgaaaatcctctatctccgccgctcgtatacggtgctcttcgctccctgcgaatgcgaatctcttcagatcactcttcttcctaacgtcaacgtttcgtctcgagaacaccgccgttcacgctaatccattccgatccgaacctaacgacggcgtcgccgtctggaacagagctccacggatcgtgaacggaggtggaaacgcggcgatattcggcgggaacgaggggaaagagacgacggtggttctccttggttggctaggagcgaaagctaaacatctaaggagatacgttgagtggtacaactccaggggaattaacgccgttactttcactgttgacgttagggatttgctccggttagatcttggtcggcggcttgaacgaaggatagctgaatttgggaatgaattggttaattgggtatcggagaaagaagatgatggtagagagaaatgcttggtgtttcacagtttcagtaacactggttggcttgtgtaggttgatgaaaccaaaatccttcaaaatcctacattgtgattgcgattgtgatttagtgttgatttgaattagatgatgaattttaagcatggtgggcttttttacttttggtagatatggtgccttgctagagagcttcattggtagacaagatttagtagaaaggattaagggttgtatcattgactcgggaggagcagatcctcttgatactaaggtttgttctctctttcatgtaaccaagagttttaaatgctattcaatggtttctccactgcttcaagatcttgtattggaagtggaaatgtcaatattgttgtgaagtgaaaaattctatttgagctatgttgtcctctttttcaataatgattcattttatgctagtgtgaaagctttgctagtttgagttctatgttgaagaactttgtatcgattacaagcatttgcagaaccatggctaggggacttttgattttgatatctaagcaattagctttgtagatagataactcagtacttagaaaagactatatagctatgagttaaaaccgctgatttcttttggttacgtagccatcactcacaggtttatagtacatcggcctatatatcttgtgaatgtgatcttgttctcttgcaagatatgatgtcttaggcatgtgaacaagataaaatgagcttcatagtatgtgcctgagtttgttctgaagccccttttgttgaaaattgcttaatcattgcgtagtcctaataagccatcataatcattcatcttgcataagattagcaatgcgtacacctgtgcagattttatagatcaacaattgaattctgttcttttgcagatttgggcagcggggtttaccgcggctatactgaagaagcgtagctccaccataaccacagaaccaaacagtcccataaaagaagaggatgcttcaacaccacaaaagaaggaacctttaggaatcgaaaacataatgctatcatctctggagaaactcttccccatcttcttaaaccacccagacgtcaatacgtaagcttcacaccacacagtagacaacccatctgcttcttctttgtatattaggttgattaatctgagttattgtttgtatcgcaggaggctaacaaaaatcattcaaaaactatatgagaaccatcctccatgtcctcagctctatctttacagctccggggacaaagttgttccatctcattccgttgagctccgcatccgagaacaacagaagattggaagaaagatacattctttcaatttcaagtcctctcctcacgtggatcattaccggaactttcctgacttgtattcctcacagcttcaaaacttcttgcaagaatgcttcacaccaacaaaacaacaagctctgtgactttggaacatctttttttgcagaatatttgtagccttggtttgtttgtttgttttctcctcaaaagttgtttattattgatgatagaacaagataatccgaaggagacagaaactccaaactgtgtcgacgagctactgagcagagatagtttctgaaactcttagattgttgttgctagtttggcttcatatgtgaaacttgaccgatgctcggacaaagaaaaaatgtaaacctatttcattcccttgttcaacggtgtggtctaccccttcctcaaacggctcgtcttatattaccttaaactacgtcgtgttggattctttaaacggcgccgtcttgccgtaccataacacgacatcgtaatagctttccttaaaacggtcgtatcaactttccttaaaatgtagtcgtaggaatattttgccgttttgtttgttgaaaaactacattagagaaagaaaacgacacacatgttaaagcagaatgggtttagaaatggtcagaggagagttgaggattttgggagtgggaatcgatttcttgtgtgtctgtagctacggattcgattcgagtgaccaaaggaactcgatttattggttctaaagtctccaaatcagaaaattcagagacgagccctaaatg

SEQ ID NO: 25081 - DNA, 3003 bp, Unknown; identical to SEQ ID NO: 25080
  misc_feature (1)..( 3003): 2750-1469P.txt file - cDNA_ID_2702769; gDNA_ID_2214620; Annot_ID_187637

SEQ ID NO: 25082 - DNA, 3000 bp, Unknown; identical to SEQ ID NO: 13351
  misc_feature (1)..( 3000): 2750-1469P.txt file - cDNA_ID_2702784; gDNA_ID_2214620; Annot_ID_135857

SEQ ID NO: 25083 - DNA, 3000 bp, Unknown; identical to SEQ ID NO: 13351
  misc_feature (1)..( 3000): 2750-1469P.txt file - cDNA_ID_2702784; gDNA_ID_2214620; Annot_ID_187634

SEQ ID NO: 25084 - DNA, 3000 bp, Unknown
  misc_feature (1)..( 3000): 2750-1469P.txt file - cDNA_ID_2702795; gDNA_ID_2214620; Annot_ID_135873
atttaaaggatttaacattcatttcctaaattaaatatataatatgcctttacaagatcattttcaaataaatttcagtctactttcttttgttggtcaatgcagatgtatatacaccaacttaagatttgtttcggtttttagaatttatctttttactaattcaatctgtccattttagttttttttttggtcttatccttcttcctcagttacccattggcaactccaaccagagcaccaaagttggtgttgaaatcacacaaaatttggtgttatagtgtcccatttttttttctcatctccaaccacaacactaaatttacaataaatactattcttatctataattatattattaaatataaaattcttttattttttaatatatttcataaatactattatattatgttttcagtgttatttgaacctttagtttttaatctcaattagtttcatatttatttagatatcttgtacaaattaatattttatattaaaagtgaattcatacaaaaatattaatggtatatttgtctttagttggtaaataacaattaaattatcttacttaaaacaaaatacaaattagataaaataaaaatttggtgttttatgaacagtcctattggagcaagactaacaccaaaatggtgttttggtgtcaagttggagaagcccttaggtgtgcccaagataaagttttatacatatatgttgtatccaaaaataaaactgagcaagctctttcttcatactataattactatttgatagatatgtgttgatgatcattatgcagcaacaaacacaacaaacaactcaagaataatagaagatgagatcattactgtaacaattataactgtaatacacatctaataaccaatcaaatcttctatttagtgtacaaagttggatactaagatcccaactattgccaaaaccaaaactggagctattctctggtcttacaagtgtaaattaagaaccttaaatgtccaaatcatcatcaggatcttcatcagaatcaggatgctcatcgtctgaatctctgaaatatataatctcaccacccttacccgacgaaaccacatcggtctgcaactccattgacgacaatggtgttgtctcaatcttgccatccacaagagatctcctcccatcatagatctcgttcgattttccatcatctgaagaacagagaagtatcaacaacatgttttatccacaatctcaaaaggcttcacagtatctacactcaccttggtgctcaaaaggaagcacaactttttctttctcgacccgttctttctcagacaactggagattgaattgaacctgaaccaaaagaaacaatgatcttatgccatacaacttacgaacaagagatcacattatagcaagagacacagaccaagtaattaaaaagcagatctaggtaacttgccttaggcaaaaggcttttagtggctgcaataacagtatccacagaggaaatgggtgaaaagtttatccccgattgatcaacatgatattcttcagactgtaggtaaagagttacaagagtgttaactaaacgagaatgatagggcatagagagcagagcaagagaaaacttaccattactctcacacgtccttttctaagcttaaaccggacatgaaaccgtcctttaccgaaatcctgatgaaccgaaaagaggttttctaaagcattcctttgcccatctgaagatggacacaaaggttctaagttcgctttcattgtggatatatattcaagcgcatttgtgaccttctcttggtgaaggtcagtgttcaatgaccaaaagacactggaaatttgcgctgcaccgaaaaaaatcaacctttgtagttaaacctaacaaggaataaaactaataaactagtgctcaggtttatgtagcaaagtaccatggcttcgaagatctgttaaaagaccagaaactaatggcatcgctgaatgtcttagcaactcatttacctgattcaaagtttagatatataatcacttctcttttctatagatgatgtctaaacaattagagcttaactcaccgaatcaatggcaacgcagaaacgtgtcttcccagttccaaccaactctgcaccaaagcaatcacttttaatctcatataatcctttagataaagatctaactgaaaaaggattcaatgtaaaagaagtacacctcttcctgcttcaatgattgaagaaaaaagctttttcaagtcactcacacacttatgtaacttaatcaaacttgaaccttcactaaaactagttgaagattgatcaatccatcccaatggatcagtgtaacaatccaaaatacgaatccttcaaatcaaaaccaattgttatcaaacaagtatcacagtgattcgagcaatcaaactactccacaagctaggataatatttagaaaacctaataactcaccatttagaagatgaagagacaacgattcctttttgcttcaacaattgcaaatagaacgaagggctccgcgagaatgtgatcaacacaagacccctgaatcgcaaagtgggaaaaacgaagactttagcagtaatgaagcaattggagatcgaatatagaagaattagggtttaagagtatactgcgacgaggattttccagctaaaattgaagaagatagatttgtgagaagatagccggagacatcgagtccgaaaggggaagctacagtttcttctatagtgagagctggtgcgagttcgccttcttcgccaccatctctgagctttctgaaaatcgattccgccattgttgagagattctagagctctccggtcaaaagagcggcgaggaaacaaaacatcgaaaagttaaaaagggcttttgggctttatgatgtagcccactgggctttgttcaaagaaacactcgttggaggaataaacatcgtgccgtttttttaacatggataaaacgtcaaccactttgtatg

SEQ ID NO: 25085 - DNA, 3000 bp, Unknown; identical to SEQ ID NO: 13378
  misc_feature (1)..( 3000): 2750-1469P.txt file - cDNA_ID_2702834; gDNA_ID_2214623; Annot_ID_135909

SEQ ID NO: 25086 - DNA, 3000 bp, Unknown; identical to SEQ ID NO: 13378
  misc_feature (1)..( 3000): 2750-1469P.txt file - cDNA_ID_2702834; gDNA_ID_2214623; Annot_ID_187715

SEQ ID NO: 25087 - DNA, 3000 bp, Unknown; identical to SEQ ID NO: 13405
  misc_feature (1)..( 3000): 2750-1469P.txt file - cDNA_ID_2702853; gDNA_ID_2214624; Annot_ID_135937

SEQ ID NO: 25088 - DNA, 3003 bp, Unknown
  misc_feature (1)..( 3003): 2750-1469P.txt file - cDNA_ID_2702869; gDNA_ID_2214624; Annot_ID_135926
acgacatcatcgatatcgaatcaggagaggaggatttgtacagcgatggtggtaacgtatccgatgactacaaccctgtggacgacacaattagtcgatctgagaaaagttacgttgttgttaaggaagaagacattcttaagcttcaaagagacgatatcgaacaagtttcgacggttctctctgtaagccaagtggaatcgattgttctgcttcttcactatcattggtgtgttagtaaactcgaagatgaatggtttacggacgaagagagaatccgtaaaaccgttggtatattaaaggagcctgtcgttgatgttaatggtacagaagtggatattcaatgtggaatttgctttgaatcatacactcgaaaggaaattgctagggtttcttgtggtcatccttattgcaagacctgctggactggttacatcactacgaaaatcgaagacggtccgggatgtttaagggttaaatgtcccgaaccttcttgttacgctgttgttggtcaagacatgatcgatgaggttactgagaagaaagataaggacaagtattatagatattttcttaggtcttatgtcgaagacgggaagaagatgaaatggtgtccatcaccgggatgcgaatacgcggttgaatttggtgtaaatggaagtagtagttacgatgtttcttgtttgtgttcgtataagttttgctggaattgctgtgaagacgctcactctcctgtggattgtgaaacagtgtcaaagtggttactaaagaacaaggatgagtcggagaacatgaattggatacttgctaagacaaagccttgtcctaaatgcaagcgtcctattgagaagaacactggatgtaaccatatgtcatgctcagctccatgtagacattatttttgttgggcatgccttcaaccattgagcgatcacaaggcttgcaacgcgtttaaagcagacaatgaggatgaaactaagagaaaaagggctaaagatgcgatcgatagatacacgcatttttatgaaagatgggcattcaatcaatcctcgaggcttaaagctatgagtgatttggagaaatggcaatcggtggagcttaagcagcttagtgacattcagagcacaccagaaactcagctcagtttcaccgtagatgcatggcttcaggttagtaaaagtaacatttacaagaccattgaaaatgtttgtggaaacgacggaacataatggaattactaccatagtagatatataataaacgacaagctttcttgaagacgattttatgagtaacttatcattgatctgaactgatgaatagatagattacaaaaaaagtgtgtataattttcaaactggcaaaaatcatcccaccattatgctagccaccaatgagattctaagttagattttgttacttacattgtaacagcggaacataatctgtagtagaaaaaactagaaaagctttattaaattgaaaaatcatcttaatgacggttaactttccgaaatggtgaaaccattccaccattatgcatgagaactaccaattagactctaagttagttacggcattaattatattctcattccaccattatgcatgagaactaccaattagactctaagttagttacgacattatattaattcttgttgacatgtacttgattttactgttacagatcatcgagtgtaggagggtcttgaaatggacctatgcatatggatactacatacttagtcaagagcgcaacaagcgagtatttgcaaggtcagtttttggtacggaaacacttaatttgtgtgtaatcttaatttttccattaattgtagcagaactttttcgttgtcttgttgttcagctgaggcagaaaatggtttggagagacttcatcattgtgcagaggaggagttgaaacagtttatcgggaaaattgaagacccatcaaaaaatttcggtgagctccgagcgaaattaattgatttgactaaagcaactaaaacctacttcgaaaatctggtgaaagctttggagaacggtcttgttgacgtggcatataatgagagccagtcaatagaagaacctgaatcttttaccaaaaggtccaagacaaggaaaataaaaactttaatttagagttttagtaacttcaatattttctatggtttatgtgtttgctgcgaaggactgtagatttttttatgcctttttttttaaccttagacctcaaagttttatttatttacaattaaggatttgcgactttgctgcttggttgctttatatttcatagtgcaattttggtgaccataatttgtatttattgtctgaaaacttctctagattaagagctaatgtaatatccattcaaacatcggatgaaacctctcctaacatgacaaagattaaaaataaattacatgaattgtgagaactcaagcatctataattctattttcgttgagctcatctatacaactctttctgaagtccaacaaattctaaaataacatgaaaaagtatgatccacaaaaaaagaaagataacataatgaaatcaaaatttttatcggacccacccacctaatctcctcccttcatggcttcatctacccgccacgtttattatatggcatagtaagaatctttttttttttaccatcacaatgtcttaatcgtcatagattgctctctacacatttcatagaaatcaatcctgaaatactctcacgcattgcatacaaacttattcacaaaaaggaagcatcaatttataatgaatcattccttcaaatttaaaaccaaattaacagaagaagagaagaagaagacgaaaaagaagaattgacaagtattctaaaaattataataacttttatccaacatcgtaaataatgagacatgtatataacactatattcacttaacttacataggagacacaatatcaacaacttattgttcctttggttcgaacaattttaccaaaaaaatg

SEQ ID NO: 25089 - DNA, 3003 bp, Unknown; identical to SEQ ID NO: 25088
  misc_feature (1)..( 3003): 2750-1469P.txt file - cDNA_ID_2702869; gDNA_ID_2214624; Annot_ID_187744

SEQ ID NO: 25090 - DNA, 3003 bp, Unknown
  misc_feature (1)..( 3003): 2750-1469P.txt file - cDNA_ID_2702877; gDNA_ID_2214624; Annot_ID_135928
ataatcagctagaatggttgagaaacagaatgaagtacttttagagagcatatagaacagtgagtggaataaaaccagactagatacagccatcaagaaatgccgaggagcacaatgtttgaccattaacgtaactaataggtaccggatataagatgacaccaaaacgtatgaatccataaggtactacctcatataatacgacaccaaaagagtaagaatccacactcctgtcaaatatttcatctttgtaaacctcaggtgccatacagtaatctgcaaacaacaaaaaaaatcatctgtttaaactattgcctcatggaaatggaccattcttataacttatgagtatatcaatagtagaaacagtttctatacttaatacttgtatcaaagtttctcaggaggaaataagcatttaggacttacttgaaggatctatatgggccccgtgattaaggatttttgatttatcagatgataactttgcaaaacttatcaaaccaaatcccgccaccttcagatgtcctccactatcgagcataatatttctggcaccttacaagaagttgcaaaaattagataacgagggtccaaatatatgttctcgaaaaacttaacgtgcaaatgcttctttatttagttatcttacttgggttttagatcacagtggattactggttctggtttacactcgtgaagataattcattcccctgagaagagccaaatgattcgttcaaaagattattaaaaaaaatgtagttgtaagttgaatacaatcttgccaaaaaagtcacatgcctggctatatcgagggcaaatcttagaactttggctggagaaagacgaccttttttttgaagatagctcccaaggtccccctgcaagttaccaccaagtggacaacattagttcctaccatccaaatattgcttaatgagggaaaaatcttttaaggtgtaaaaagagggagaagcttactttaggatgatactcggacacaatcatcatggggacattttgagtaacagctccaacaaattgcacaacattaggatgacgtaccttctcgaataaagtaagttcgtgtttgaaggcatttctgtgggtacataataaaagtcagatgagaagattgcagaacaaacgtaatatatgaaaagaaaaacaaggattaacacagagggaatgaagtggattccagaaaatattactggaaatgcacaattccaacatagaagattctataagaactatgattgaataatgttacagctcatatcatcatcactatgaacataacaaagatgatttcaacgatctatagcttcactcaagaagaaattcaaactccttcttgacctgttagctaacatagacatattactcactgaagagaagagtaatcttacatagtgtcagaatccttgtagagatccttatcaagtatctttacagaaaccttagtcccattccatttagccacttgatatattccctggcaagtggaaaagtgatgtagtatcttgttaaaaatctataaatggaaactaagacattattacaggaaagtaaagcaaagagagatcttgcctttgagataccatcagctttccgaacttgaagttcctgcggatttaactcgtactcaggaacttcacgaggattcgccacaaccatgggtgtccttttggttttctaaaaccaagaagaaaatgtaactataaacatattaagatatgaaaagaacagagcttgaatcaatgaaaaatgcagcaacataccggaactttagctccacgggctttcaaaatgttgaaaacatccatgttaccataatacttagcatcagcagctgcctatccacacaacacaaacataatttcaaaaccaaaagcacaaaacctaaccaataagagacaacaatagaaatttatcacattaccgtgcttccccaacgatcacgagcatcaatattagccttcctagtaagaagaagcttgacaacatcgacatgaccttcacaagcagcgatatgaagagccgtacgaccatcaagatcgatactattaacatcaataccttcatcaagcagatcctgaacaccttcaacatcacctctacaagccacaaatagaagctgcatagtagcgtcgagattatccggtacagcaagctgcggaccgttagaaccatcaggactccgacgaatcggatctaaagacgattgtcgaccaaaactaaatcgcatattgttccggcgaggatcatgtgaagcttgacgcgtgaattgacgactaagcgtacgacgaagcgatccagttgagaattgtctcgagattcctcgttttagctgtcccactacattcgccatgatttcaaatctctttctcttcttctctctttcgtcttcttctgcgaaaaaatcgaatggataatcacattttctttttctcgagaaaattgatctggtgattatgtgagatccgtctctagcgcgttgcttatcgagaaataattaattttaatttgacgggtgaagatattattggcgacgtctgtttccgattgactttgatttgacttttcctttcaatcattatttggcgagtcccgcgtaaatatggactcttcttgattgtccacttttttcggtggctttaccggatttaaaatcattttcttttcctaaattatgaattttaccctaaacttctcataattacaattagttccgacgaacccaagatactttttagcaaaattaggaaaatagttgactcgaaaaggttgttatacgtggagctgacgtgttggtcttatctactcgaagccttttgggcttttcttaaagccattgatttctaaggtcgtcaacaaccgaaccggaccggacggtttgaccggtctaaccaacatatatacgttctttttcacttgccgtttcgtcgtcgtcagtcttcttcagtagcaaaaaaccttcggcttcgtctcgtcaatg

SEQ ID NO: 25091 - DNA, 3003 bp, Unknown
  misc_feature (1)..( 3003): 2750-1469P.txt file - cDNA_ID_2702881; gDNA_ID_2214624; Annot_ID_135929
gatttgccgcaactttccaagctgttattaactttgtgaggattttctgcaggtccatgatcttactcatttgccattttctgaaagagaactgatgctgattaagattgccgtgaacgctgctgctagaagagatgtcctggacattgctagtattttcagggctaaagctgttgacgtatctgatcacacaattactttgcaggtaaaatacatttctcataaatgggatttttatgtagctgttattgcatctcagatgagaaatcctttcaattggagatcttcaaagtttcacgtctttccataggtcttcaacttgtttgacataatcagagttccgtttgaaaaaaatatatgaagctgacttggattttccatcttaatctctatttttttgcttttgtgttttggattttgtgctgaaatttgttggctgtgggtatagcttactggggatctagacaagatggttgcactgcaaaggttattggagccctatggtatatgtgaggtttgtttcgcaatctactttcatctcttagtgaatgcataaccccgtgaattcttaatttcttataatgatactccaattgttcggataaagtcccaaaatttagttgtagtctttacgacttagaaacagagtagtgaaatctaactctctggtaaaatcaataaccaaagctggacctagttacatgaatcttcttctggttgtgtgtagaacaagaataagcttgacaagccatgactactttcagattatgcatcgtgttgacgcttattatgaacaatcaatcacaggttgcaagaaccggtcgtgtggcattggctcgtgaatcgggagtggactccaagtaccttcgtggatactcctttcctttaacaggctaaaccgttgcagagtgcatccatcgaacatcagaaacttttgaaggtaaaagtttcattacacagtctatgaaccaactcaaagacagacagagagactgcgtagatatatgtttgtgactttgtttatgaaacaattagctgattttggcttcatttcgattcttttctttttgagataagaaaagttgttaggattattaatattcgttcgtcttattttcccaatatttcccaagttattattatgagatggctaaaagaggaaacacaaatggactttgtaaatgttatagtctagagagtcaaaagtcaaactaagtaagcgttgactgacccggacgtgtacctaaaaatgactcctcttctacaaattcgattcttacattggtaacttcaataacgattactcctgacaaaagtaattcaataattgtgagtccaaataagatccatacgactcatatcatcatctcttaaccttttcaataaatgtcacttctctaagaatatactttcaagtttcaaaaaatctaaccattttcatgattattctgtatttagaatcggggaaacttagatttggaaaaatacacttttggaaagaaaaagttgtgtttctcttcgatatgcatatgtaaaagaaaaagtttgagaattgcaattatagagccgaccatgtgctttttatgctttactcgtttattttaatttgtctgtagtgactacaaaattttcgggcactatgaatggatcgatcaatttatttatgctttatcggcggaagatataaattattcattgaatcataattttgtaatctccttgtttcttaatttattttgtactaagacagttctcaatttaaccacagtttataaccgtaattttgtactaagatataactgtattttgtagttagtgtagaattttgtctctccagctataaaaagctagagttaacttttgagaattttttacaacacttttccgtattttgtaatatgatcatattactaagctaagaaaatccggtcaaacaaattgtttaatcatttaattagaaatgtgaataagttaagaaatgcaagttctttttagtcgtccttagttttgtgtacaagacattaaattacaacactacacaaaaaggagaattcgttagttaactaacaaagtgatcaaccaaacaaaaccctaaccaaatgatactgacttggacttttaactagagcaagtaagtaaaaacgactagttgtatcgtcttacctttgtttagacttttaactccgattaggtgacatggcaccatccatagattagtcaatgaaaagagcattagagacctccatcaattattcaatttcttttatcttattagactcaaactgaaatatctaacacaccatagagaaaaagctttccactgtcgacacaaaaagagaaactaatactaaaaagtaaaaagtaaaaactttattatcgcttaagagtgatgcttgcataaaagcgtgttattaataaaaaagaggcactaacaaaaataaaacaagagtttgtggctgctgaaattcttcaaacccaactgatggtgatgctgatgttcttcttcttctgacattctctctctcttctctcttttcgcagcttcttcttcatcttcggcttaacaacaacaaaacttcacacacgtggtgagagagcacacaaaggctcaagctttttcaaacccttgttgaaattcgagctcttttggtgtttctcttttttttgttggtatcaatttggtgtttctcttggtcttgttgaggtactgaatcagcttcttcttcttctccgatcttaatcgattctaagtttcttcacagcttgggacgatttgacatctactctccaattcatttcccgtaaagttgtttttttttcttcttgttgcttgcaatacatggattcttcgaggtgataatcaacaaaagcttatctcttttgttttctcaaggtttgtgtattagagattagtgtttttgttagatttggggataatatatagataatctgggtttaggtattttagttgataacgacgataaattggagtaataggatatg

SEQ ID NO: 25092 - DNA, 3003 bp, Unknown
  misc_feature (1)..( 3003): 2750-1469P.txt file - cDNA_ID_2702881; gDNA_ID_2214624; Annot_ID_187747
gtttcacgtctttccataggtcttcaacttgtttgacataatcagagttccgtttgaaaaaaatatatgaagctgacttggattttccatcttaatctctatttttttgcttttgtgttttggattttgtgctgaaatttgttggctgtgggtatagcttactggggatctagacaagatggttgcactgcaaaggttattggagccctatggtatatgtgaggtttgtttcgcaatctactttcatctcttagtgaatgcataaccccgtgaattcttaatttcttataatgatactccaattgttcggataaagtcccaaaatttagttgtagtctttacgacttagaaacagagtagtgaaatctaactctctggtaaaatcaataaccaaagctggacctagttacatgaatcttcttctggttgtgtgtagaacaagaataagcttgacaagccatgactactttcagattatgcatcgtgttgacgcttattatgaacaatcaatcacaggttgcaagaaccggtcgtgtggcattggctcgtgaatcgggagtggactccaagtaccttcgtggatactcctttcctttaacaggctaaaccgttgcagagtgcatccatcgaacatcagaaacttttgaaggtaaaagtttcattacacagtctatgaaccaactcaaagacagacagagagactgcgtagatatatgtttgtgactttgtttatgaaacaattagctgattttggcttcatttcgattcttttctttttgagataagaaaagttgttaggattattaatattcgttcgtcttattttcccaatatttcccaagttattattatgagatggctaaaagaggaaacacaaatggactttgtaaatgttatagtctagagagtcaaaagtcaaactaagtaagcgttgactgacccggacgtgtacctaaaaatgactcctcttctacaaattcgattcttacattggtaacttcaataacgattactcctgacaaaagtaattcaataattgtgagtccaaataagatccatacgactcatatcatcatctcttaaccttttcaataaatgtcacttctctaagaatatactttcaagtttcaaaaaatctaaccattttcatgattattctgtatttagaatcggggaaacttagatttggaaaaatacacttttggaaagaaaaagttgtgtttctcttcgatatgcatatgtaaaagaaaaagtttgagaattgcaattatagagccgaccatgtgctttttatgctttactcgtttattttaatttgtctgtagtgactacaaaattttcgggcactatgaatggatcgatcaatttatttatgctttatcggcggaagatataaattattcattgaatcataattttgtaatctccttgtttcttaatttattttgtactaagacagttctcaatttaaccacagtttataaccgtaattttgtactaagatataactgtattttgtagttagtgtagaattttgtctctccagctataaaaagctagagttaacttttgagaattttttacaacacttttccgtattttgtaatatgatcatattactaagctaagaaaatccggtcaaacaaattgtttaatcatttaattagaaatgtgaataagttaagaaatgcaagttctttttagtcgtccttagttttgtgtacaagacattaaattacaacactacacaaaaaggagaattcgttagttaactaacaaagtgatcaaccaaacaaaaccctaaccaaatgatactgacttggacttttaactagagcaagtaagtaaaaacgactagttgtatcgtcttacctttgtttagacttttaactccgattaggtgacatggcaccatccatagattagtcaatgaaaagagcattagagacctccatcaattattcaatttcttttatcttattagactcaaactgaaatatctaacacaccatagagaaaaagctttccactgtcgacacaaaaagagaaactaatactaaaaagtaaaaagtaaaaactttattatcgcttaagagtgatgcttgcataaaagcgtgttattaataaaaaagaggcactaacaaaaataaaacaagagtttgtggctgctgaaattcttcaaacccaactgatggtgatgctgatgttcttcttcttctgacattctctctctcttctctcttttcgcagcttcttcttcatcttcggcttaacaacaacaaaacttcacacacgtggtgagagagcacacaaaggctcaagctttttcaaacccttgttgaaattcgagctcttttggtgtttctcttttttttgttggtatcaatttggtgtttctcttggtcttgttgaggtactgaatcagcttcttcttcttctccgatcttaatcgattctaagtttcttcacagcttgggacgatttgacatctactctccaattcatttcccgtaaagttgtttttttttcttcttgttgcttgcaatacatggattcttcgaggtgataatcaacaaaagcttatctcttttgttttctcaaggtttgtgtattagagattagtgtttttgttagatttggggataatatatagataatctgggtttaggtattttagttgataacgacgataaattggagtaataggatatgactataatggaggagaagcagaacaacagtcctgtgggagagaagcaacagagctttaatggtataataataaaccaaacacaagagaatcagacaaaatcaatggagaaacaacagagtttccgatgtgtggtggagaatcaaccgagaaaggcgagagctttagagaaacaagtgagtttccaaggtgtgaatgtagagaactatcagcaaagcagactcggaagatcaatggagaagcaacagagttttcgaggtgtcaacgttgagaatcataaacgtggagttatg

SEQ ID NO: 25093 - DNA, 3000 bp, Unknown; identical to SEQ ID NO: 13395
  misc_feature (1)..( 3000): 2750-1469P.txt file - cDNA_ID_2702896; gDNA_ID_2214624; Annot_ID_135934

SEQ ID NO: 25094 - DNA, 3000 bp, Unknown; identical to SEQ ID NO: 13404
  misc_feature (1)..( 3000): 2750-1469P.txt file - cDNA_ID_2702904; gDNA_ID_2214624; Annot_ID_135936

SEQ ID NO: 25095 - DNA, 3000 bp, Unknown; identical to SEQ ID NO: 13411
  misc_feature (1)..( 3000): 2750-1469P.txt file - cDNA_ID_2702931; gDNA_ID_2214625; Annot_ID_135955

SEQ ID NO: 25096 - DNA, 3000 bp, Unknown; identical to SEQ ID NO: 13411
  misc_feature (1)..( 3000): 2750-1469P.txt file - cDNA_ID_2702931; gDNA_ID_2214625; Annot_ID_187781

SEQ ID NO: 25097 - DNA, 3003 bp, Unknown
  misc_feature (1)..( 3003): 2750-1469P.txt file - cDNA_ID_2702935; gDNA_ID_2214625; Annot_ID_135956
taagtctatgttgcatgaaaactctttccgcagtgcgtttcccatttctgaaacgtttcgaaaacgaaaactctcgcaaattagatgaaaacttacgaaaacgcgttttctaaaattctatgtttggaaatatgatggaaactcacgtttctgttttggaaatgcgaaaaatcttttttattttattttgggaacttaataatttaaaagtttggaaatattaagatttaactacttgtatgactcgagttttaacatctttctctcgacaaactagttttcaagtgctttctatgatttttgatggaactaatgtaaatgatggtctaaatatttgatattaagtcttttaatctttattttttagaattttagtttaaatatttgatatttattttttggattttgattgtttaaagtatatatatgtaccgggatgtacctcttattaaggatgtatttataattggattgacttctctctttttctttaatagaaatgtgaatatatatcatattaatgaaagttttttgatatacatattaaagaaagttgagggtttacaaaatagcttaaccaaacgtttgtaatcttgccaaaaataaaggtaaaagtcaagagatacaaggtattaggtgtgttgagtgtgaatcaacaagtgctaccggatccacaaaatcatcagacttcttaaacctacgatattcgatactccaatatgatttgttccatcagtaacatataatacatattttgatttgtttacgaccaatttgtcacgtgaattatggggtcctatatattttagacgtttgtagacaaaggaaaataattgaattgctgtcttttaacgtgcgttcaaaaattttaagaaccatcatcacattctcacgtcttccaacttaactgtgtcaatattacctaatgatttttgagccagtatggcgtttcttaagactttttaaaaaattacgcttcatataatttttagtttgattttcgcttaaaatggattaagtgttatttatttgtatatttgtatgatgcatttacatgcagatatgaaatgtttctcgatttaattcatattatctagatgtacaatagtaaatggatgcatttttgaaaaggaaatgaattttggtgcataattgacttaaaaagaaagaaaaacatagacacacaatcccacatgcatgcatatctcattttcgtctccttttatcgtttgatgttaccgaaccaacgtatttttgttccatgcaaattgcaattagagattgcggaatgagggaataagaaataacaaaattacatatatgtgatatgccactactgagtttaattttgctagttctcttttaacaaaagactgatcatttaatttccgttgagtttagttcatatttctaaaataaaattttatctttataaaaggaaaacagaagagaaactaggagaaaataacaaatgtaaactaagagaagtagagaatgaccatataccatatgacattatataatcatttggaccacgtgaaatgacatttctcttttcttaattatcttcagaaattgattttggacccctctctcttcgacttccaaaatcattttttatgatgaatgacttccaaaacattactagagctatctattcctcaatcttcatcatttttcctttgatcacatcagatcatagtaattaaactgcatcagataaaccgaattaatttcaccattccaattaagataacacaaatgttcgagaaataatataaacaacatacagtgagaatatgtcatttttataagaaagaaagcgtgtgtttttggcatgaaacatgtgaatgactcagtttttattgatatgtttcctagtggctatctttctctaaactatttttttccaactcactctcgtttaattacttaaaacaatgtgacgatccttgtagaaacctttttgacccttaatcaaattttctcaaaactcaatctttttgtgattaggtcgaaccattataaccgcatgaatatttagtggacaattcggatacgatgtgtcacggttgaattggccatcgaaaaatcaccctcagcactatctgacaaattacctcagaaattggtttggattcattgcgaaactcttcaatgtcatagttgactgagtcatagttaataatgtattttagaacatgagaaaaagattagaccaaaaaaaaaaaaaaaacatgagaaaaagatgcacaatctttctctaaaatcttacttttcacgtctcacacaaaacatttctcattacatttgattcaaaatttttatttattattaccgtagttgatgattcatagggtttaaacgcaacgagttcaattgtgagaatatggagaagtggacggttgcgaacttgccgtagactatcaagtgttttgaatgattagtaaaacataaataattattaaaattgagagattaaagtgtttgacaattaacatgaatatatatatatatatatatatgaattttattttgctcacgtgatttttttttactcggggaataaaccttaacaatctcaaagtaatttgaaacaatataaaacgttttttaaatgattgattttaaaccaaaatctgcaggagaaccaataagttgtatagttattgataaacgaattgggtggatacaataaatacctggagattctttttcattaattaaaaatatatatacaaaaaattgactaaaaatattttattttaaaaaaataaaaattgagggccctataaataagagatatccactcccactgaaacctcaaatcaatcagagagagagcttctgagacataaacatcaattcaaatcgacgcaagcaaagaaagcaaaatgtaagtcactgaagagtttggaattcccatttctgttcaattttcaattgagtttttgtgtttttctcttcagggaaaatggaagcgggaaggtgttgaagccgatg

SEQ ID NO: 25098 - DNA, 3003 bp, Unknown; identical to SEQ ID NO: 25097
  misc_feature (1)..( 3003): 2750-1469P.txt file - cDNA_ID_2702935; gDNA_ID_2214625; Annot_ID_187782

SEQ ID NO: 25099 - DNA, 3003 bp, Unknown
  misc_feature (1)..( 3003): 2750-1469P.txt file - cDNA_ID_2702942; gDNA_ID_2214625; Annot_ID_135958
aaatcttgtataaacaatttcataggtaaaattgaagcgatcgatacagaaatcgctaagaacaaagcatgaatattttgtcatctataaatgacttgctcaagaagaccaataccatacagagcttttatttgagacataaagaaagtttatgatatatagaaacgaaaaggagatgatggtatgcaacaaccactatatatacaaagaacctcatcaatagtaatttgtagggtttcttgttttttgtcgtatcctcgtatccgagtccaatctgtgtattccgcttcgaaaactctttttgtgttggtttcttatttagtcaatgatatagtattctagaaagtcaagatcacacatgtgaagtcaagagcaaaaaggaatgcacgtgtgtgttttgagctggcaacttgacattgacggtgatcattattaacgtttactttctttaccttttagtataaaaagcaacatgttatgttcatgctttcttatgcgaataatctggttgtattttatttctagagacttctagatttccctcatcgttttaccgaagctctttcgtcgagactcttgtaggtgagaagttgatatcgcgttttatgaacgttatatcaaattatcgtaataggaatactctgtttcggttctctgcatttttactttgttttactcattattctgtttacgttatcatcagtgaaacatgaaattgaaagcaattaactgtctcattttagttaactaaatttgtcttgaactgtatataattaaatcaaagaaaaaaaatacaaaatatgaaagtgatgaccggggatattcaaagggagactctcataacaacttggtatatgaataaagacttaaagcactggaatatgagtaccttgtttccttaattattgactcactgtttgtacagaaaccaaaaccagcactgcaaatgaaatatatcttaacagaacagaaataacccccaaaaatatttcaaaaagctcgaaaacatatggttccattttgtatagcgttgcacaatgtaatgctaaatcaaaagagtagattagatatataagatagaaaaaaaaaagagcaaaaaggatagaacaaagtattatagatagaatgtcattgggcaaaattaatccaaggactgatacatacaagtatacaaccatcgtattaacctatgaaaaagtattgcaaaatataaaatgatttttaaaacaatgaaattacacctatccaattgttacgaatgaaactcaacttttaaacactaaaaaaatgtgtatatttgcagtccagattacaaaataaaccattatataataggatccaactgtattttgacttaaataaggtagttgaaaatatcttgactaagaagtatatttggtttactcggtgtcaagactaataataattagtaagtagtgtatcgaataaatatagcaatcgcttttgcagaaaataaatatctactgaacagatgtatcgttctcaaaggaaaaaaacaacactaattggtgccgcgtatctaaagatttgcatgggaccatatgtctagtagtctagtaccatataaacctttttttgcttactcgtcagtagtttcttttgaaatcttcacaacactttcaacacttctcagtgaccgtgagcaacgaattattttcagttcaacgactccgcggaaatggaaaattcagaaaatgttccctcttacgatcaaaacatcaatttcactcctaatttgacgagagatcaagaacatgtgatcatggtctctgctttgcaacaagtaatatccaacgtcggaggtgacacgaactcgaatgcatgggaagctgatcttccacctttgaacgctggcccttgtcctctttgtagtgtcaccggctgctacggttgcgtcttcccacgacacgaggcgataattaagaaggagaagaagcacaaaggagtgaggaaaaaaccatcaggtaagttctattctaatacaagctttgagtttttctagtactagctagttttagttcatgtattttcatatatatataagccacgagcccatgaggtaaactatgttccaatacgttagcatgcagttgatgtactttcataaaccatcaggtaaatgggcggcggagatatgggatccgagtttgaaagtaaggagatggcttggaacgtttccaacagcggagatggcggctaaggcttacaacgatgcggcggctgagtttgtcggaagaagatcagcaagacgtggcacaaagaacggagaggaagcatctaccaagaagacgactgagaaaaattaacggagaaggagcacgtatagaaaggcaggaagaggcatcttacttgcttcacaagtaaatcagaatttttttgaaaagtaaaaacgttattttgtttggtaataaaataaagtaaaacaaaatattgctaacgcaagacttatcaagttcagtcgtgactgtgagtgtgtttttatgtatcttacttcattttttgtctttcaattgtgtgtgtgtgtgtgtttttttttttttttataatctatttggtttgggtttattgtgaccaatgacaagaaaagtctatattttatagttagacgtattatatatatcatgagataatatacaagcaaacacaattgtaagcatatataaaaatcaatcaagttgttatgatatttatgataactttaaactttgattaacaagaaaggtaatccaatagtaatatttgtcatacggtgccgtttcactaataaatgggcttacgtaatacggaccaacacaaagtgacgtggtttcattttaaaggtgttacttatcgtcgccaatgagatattgtcaaggcccaggcccatttgcttgtatcctcgaggcagcaaattcttgtattccatttctctcctcttcttcctctttctctctctcacatctgtatttgttgtctcgatcgtgtaactgagaacgaaggatg

SEQ ID NO: 25100 - DNA, 3000 bp, Unknown
  misc_feature (1)..( 3000): 2750-1469P.txt file - cDNA_ID_2702954; gDNA_ID_2214625; Annot_ID_135949
ctcatctctttctcctatctcgatcggtaattttactcattagggtctctctgtttctgggcaaattttcttcatctccgccgttttgcttcaatacagatttctgggattttttttaccgatcaaatttaggttttcgttttcactcagaaccttagaaaccctaattttgatacattagctttagagaaccttccatcggatccgtgtacaataaaaaagtttgcgttttttttttccttaaatcgattgaacgtgtttgaagatgcctccaaagcaacaaccaaaggctgatttggcgaagaagcagaaacaagtggaagacaaaactttcggattgaaaaacaagaacaagagcaagaatgttcagaagtatgttcagagtctcaagcaatctgttcagcctaaacccgatgcaactaaagctgcagctaaggtacacgtctcttgagatgagttttgagttttcttcatgaatttgaagttaggaggctagtggagtagattttttgaatatgtctaatgagttagtgtgagagataagttcttaccaagaaaaatggtttttttgaggacagaaaaagaaagaggaagagaaagcgagagaacaggaattgaatgagttgttcaaggtagctattagtcagcccaaagttcctgtaggtatgtatgttgaatgttgatactgtttctctggtttgttcactttggtttcggtattatttattgaatacggtgtgttgtttttggtgatgtatcttggcaggtgtggatccaaagtctatactctgtgagtttttcaaggccgggcagtgtcaaaagggtttcaagtgcaaattctctcatgatttgaacattcaaaggaagggtgagaagattgatatttacagtgatacgcgtgatgaaggtataaaagtgtggcacaaagtgtcttatatatctatccctttggtcctttggatgatggtcatatttttgccttttttatatggctttagatggagatatggatgagtgggatcaagagacccttgaaaaggttgttgaatcaaagaaaaatgaatataatcagaataagccaacagatatcgtaagttgtttctcttatcttgtgtttctcggactttttattatatgcttgtcgggacatgcttatcagttattagtagcttttctcttgttaatgcactgtgaaaatgtctgaactggtttgtgttcaaatatacagccttttaacgtgtattatgtgaagtgatgcattagttttggttgcacttgctgtgattaacctttagctgatgtgcattcgccttacgatgcgcttcctttagctaatagcacggttcatattaagagccattagggtcttagatgttattatgcctcccgttgttcccttgtgtttttctgcgcacttggttcatgcctgacaagaactcatgcttttggtgatgttagtgctaatcataattttgaaataaatgtttcttaactatatacgtctatgctaaaagaaataatatctctgcgtctcatctcaataatcatctcataaacttatcctaaacacatgagttatttgtctcgctgagttttattgacttgtaattgtttttgtgtttactgaaaaataataggtttgcaagtattttctggatgctgtggaaaagaaacagtatgggtggttctggtcatgccccaatggtggcaaagagtgtcattacagacacgcgcttcctcctggatatgtccttaaatctcaaatgaaagccctcttggaagaggagtcatcgaagaagctggcagttgaggacgaaatcgaaaacgaggtttaaaatactcctcaagtttccctcatagctgctaggacccggtacttgatttgtgagacccatgttttcttgttctatgtttcagcgtgcaaaactgcaaaccgcaacacaaatgactcctgcactatttatggaatggaagaggaagaaaattgctgagagagatgccggtttggctgcttctcaagcggagagagctaagaacgaccgtatgaggtaatccccattcatcattctgttacatatccatctccagtgtgactctatttttgtccttggaagctgattcattgtgtggatttgtaacctcagtggtcgggagctgtttctgtccaatgcaagcttgtttgtggatgatgctgaggcttgtgaagaatacgagagggaaagagagcaggaagagactgaacaaaaggtgagctctctctctctctctctctctctctctctctctctctctctctcactcactcatcatttaaaacaaccaagtcatgttaatggaatcttgagttttttgcttttcaggcaaagaacaaagaagcagaggcagggacaagcaagagtagtggtgatgctgaacagagttcgaaagaagtcaatgaagaagaagaagatgacgatgatgatgatgatgacctagacatggatgagctggatgaattggaagcaagcttgtcgaaaacatcgatccagattcgtgagccaaacgacgaagggtcatcttgaaatgaaaaatggtctaagaggaagaggtggaggagagaaagcacatgttttgtttttgtgtactttcaatagattggattttgcagacacaaaccccattttggggtgttgaataatttctgttactgttttacagtcttaaatggcctcatcaaagaactagtagtatcttttttgtccaatcattttcatctttctttgttgttgttaattttatcatgatgtgtaaataaaaggtcgtaaacttactagagaaaataaaaactacagaaatgtattaaaaacaaagaattttaatcaattcttatgaatatttagttgttttattgatatttataaataaagaacaaaaaatatcggcgatataaaaagaggtaaattaatctgagggcaaaaataagaaaagcatccaatttcgtcggaagaagaaatcgccatg

SEQ ID NO: 25101 - DNA, 3000 bp, Unknown; identical to SEQ ID NO: 25100
  misc_feature (1)..( 3000): 2750-1469P.txt file - cDNA_ID_2702954; gDNA_ID_2214625; Annot_ID_187776

SEQ ID NO: 25102 - DNA, 3003 bp, Unknown
  misc_feature (1)..( 3003): 2750-1469P.txt file - cDNA_ID_2702969; gDNA_ID_2214627; Annot_ID_135991
ttcttaagcctctgtttccatagtttatatcttaatacgtgttttctctttcttttggagctttgattatctcttttaaactatgttttcgaagatatctttgttttctgccggttttgtaagatcggaaaatatatttttattttataatattaataaaaaagatgacaaaacaaaaaataatgattttctttcaaacttaatgaacataaaaaaaagggaaacgaaatcttattttgcctagctgacataattaactaatgcaactaaatgtaggtaggattaagtaaacaaaaatatgagacaaaattaaacatgccaacctccagggcatagtcaatgggtcaagtcaagcgaaagttggtctggatcttacaatgcaacttaatgtaaagtactcatttttcttcgacatgggacatccgccgaaattgttgatttttgatccatctttacacttgttttctccgattacaacaaaacataacaattcgactacgatttaacacctaacctttttaattttttaggacacgcatttagtatttacgatgcaagccaacaaatttaatccaacgtattaaacacaacttgctttttgtcaatacgtattaaattaaatagttttcttgcaatttttgtttacacatttcattagtattgtttttttccaatatttttgtttctatgttcaatcactatcatatgcataatacacattataattttggcacaattagaattacacacaaggattttataaatgtttttaaaatgatttacaaaagattttataaaaattttacaaaagtttttaaaagatttaataaaagttttaaaacgattttacaaagagttttaaaaacttttaaaggttttaaagaaagtttatgagaatttacaagaattgtaaaagatttataataatttttttagaattagaaaggagaccctcattttccacccaaatcgtcaaccttctcataattgacaagttattacactctctccacttactagttactataaaaccaaaggagaccaaatctcttagcaattatgaatttggtcttcgctataatctcacgttacattaaattggctcctgtgaacctaaatttatggactatgatcccaacaccaatccgttcgaccttcatttctccggtaaacttccggtgagtttttcaatttcttcgaaaatttcacttcaattttcgaggttgtggtgattattcgtggtgttcatatatattttattgcctgatttagaaaagagaagtctcggcttcagcttctaaagttgtagagaagaaatggttagtgaaagatgaggttagttctttcatcgaacactttggtgtgcaatactttgacctcaaaatttttgactatgagtgaatggattaggttgatcaagttctcatatctgatttagacattgaatagtttgtttagatcggtgatgctcaaaagttgaacaaatcaaagctttgtcttacagcttagtttggtaatggtgattttcattttacacagaagagaaatatgctacaagatgaaataaaccgggttaattcggagaacaagaagctaaccgaaatgttagcaagagtctgtgagaagtactatgctcttaataatcttatggaggagttgcagagtcgaaagagtcctgaaagtgttaactttcagaacaaacagctaacggggaaacgaaaacaagaacttgatgagtttgttagctccccaattggactcagtctcggaccaatcgagaacatcaccaacgataaagcgacggtttcaaccgcttactttgctgctgagaagtctgacacaagcttggtaaggagatttctactacaagtatcgttctttgagtgtattgatttgttaacgaatgttttgtggatatacgttacttgtagactgtgaaagatggatatcaatggaggaaatacgggcaaaagattacgagagataatccatctcctagagcttacttcagatgctcgttttcaccgtcttgtctagtcaagaagaaggtactttggtttaaactttgttaaagagttcttcgatatcatcttgctgtctgattaaattccctagttgtgtgtgcgcttgtttaggtgcaacgaagtgcagaagatccatctttcttggtagccacttacgaagggacacataaccacaccggaccacatgcaagtgtgtccaggacagtgaaacttgatctagttcaaggtgggcttgaaccagttgaggaaaagaaagagagagggacgattcaagaggttttggtgcaacaaatggcttcttcgttgaccaaagatcctaagttcactgcagctcttgcgactgctatttccgggagattgatagagcattcaagaacatgaaagttctctagaacatgtatatttctgttttgttctattttgttgctcattcctagtaaaaaggtaaagatttgtttgatcttgattaggaggcatagatgtcaattttaatgtgtgtgtatataattacatcaaatctaagtatccaaaaagggtcacccccattttatcttatgttgaaagagttttgttatagctcggtgtaagtatggtagattgacgctgcttcgacagtttatgtatcttccaatgttatcttgttcagttgtttgtattaacttccattagagaagaatgtgatgccattacagacataaaagaaacagagaaacccggaaacagagtaaaaccacgaaaaacagagtcggtttaagagaaccaaaccaaaataaccggtacagctataaaaagccaagaagaaaaattatgaaccgagtccaaattaggttacggttagcttccaatcccaacttcttcttcttcttcatctgtgtttagtcccaaattgaagaatcaaaagtttcgtgttttgagaatttgacaaaaatttgtttatgtaatcttagttttcgctgattttgagtaagttatcgacatg

SEQ ID NO: 25103 - DNA, 3003 bp, Unknown; identical to SEQ ID NO: 25102
  misc_feature (1)..( 3003): 2750-1469P.txt file - cDNA_ID_2702969; gDNA_ID_2214627; Annot_ID_187844

SEQ ID NO: 25104 - DNA, 3003 bp, Unknown
  misc_feature (1)..( 3003): 2750-1469P.txt file - cDNA_ID_2702975; gDNA_ID_2214627; Annot_ID_135973
ttcttatgtatgtgtgttttgatgaagttcttacagcttctactgcatctcttgcggcaagaacaagtatatcagcacaagagactgtgccgggacaaaagatttcgaggatatttttgacgctttctatcacagcgaatcctcctagagacgcattcccagggtcgcttcgctctgtaccgtttcctcgaatcaacactgagccatcacaaccctaagacagcaatgacaagaacaaaaatctcattaaattggaaatgccttgttatgcaaggaagaggcagtcctgtgagaatgtaatgtacctggacgaagcagtcatggaagatgagacgtaggagcttcccaaggactgatggatcagaggaagaagcagatctaacggtgtttctgacgattaactcagctccaggacaagaaccggcgtagaagttgaaagagagctcagctactgaagaagaaagaagcaaaagtagaagaagagaggagaggaatgtatattttggtttgcatgaaaaaaactgcaacgccattttttaatgtgtctgtcagaagatggaaagtgaagttgcttaatcagccgagagagagaagagaagttgtagttgttgtgataaatgaaaactgtaaatgcatgtgcgttcgtgtcagagagagagagagatagtgatggttgagtcaggagaacttaatgacaatctctttactctcttatgcatgcatccatgagatcgagtcatcaattttacaaacaaaacaagaatttgaaagtggtgaatccaatcactgcatgcagtgaattttatgggtaagaaaccctaaaatagtatgaatttctccattattgtgacaaaaatcagaaaacttttttttgtacctttcagatatttctttttgaagatttaaaaaaatcactcatgcttattgaattcatctttctttgacttgttatagtatatgtcacttttgcatacaaaaaaagaagagagaatctataaatagaaaaatgtacaaaaggatctaataatgtgcttcagaaactctttatttgttgatagtttctgttgataagccaattctttgtctttcatgtctcagaaaacctgaaaagtacaagaaatggtggaaatcagtaaaaggtttgtcgtttttagataataaactcgatatagaacaaaaataaacaagcaacggagatatttggattttaaaacctgggggtcgtggctttggactcgaattcaataacctaattaagcaataatcttataatttcgaaggaaacaaaacaagcaaattttttaatgttaggtttaaagctttgtgaaaaaataatagaaaaaatgtactccatctttttctaatcattttaagtttattccactttaattttgtagttttttttttcttttcttctttattgactgatattataaatcacaaagttcaggatgcaatgattaaatttattagattacaatcaatgagtattagtttatagttattaaaaatatttaatataaaaaataaacagtcataaaataatgtttaatttttaatgtgtgtaaaatccaaaacatcaatgcttacggagatttccttaagattaataaagttgatttttatgtaataagaaacaaaatctcattaaactttaaaagtaaaaaaaataaaaatatgaagtgtcacttatggtagtagtatccaaaacaataagttaatggatttgtttctaaagaaaagaaaaacactataaacagaggatcctcaccatcaactttcactaatcatcacaacttcaacttttcaatactcagattaacaatggctattttctccaaattacatcttctcttcttctccttcatcatagccacatgtatacataaaacatttccaacattttaagatgactactttgatttaataatttatctgataatttttttttgttgtccgtcctagtaatttttttttaattgtatattcttcaaggtacaatttctattgtctccggcaccgtcttcactttatcaaaccgctgcaactttactgtgtggcccggaatcctaaccgcaaaccgcacactactccgcggcggcggatttgccttagcttcaggttcttctgtaaacttaaccgtttctccaggttggtctggtcgaatctggggtcgaacgggctgcaacttcaacgcctctggttccagaaaatgtaaaaatgcaccggtgcaagaggagcaccaccagccacactagcagaattcagaatcggctcctctggaaagaaatacaccgtacaagattcttacgacgtgagtctcgtcgacggttacaacgttcaggtgaaaatcacaccacaaggtggctcaggcaattgtaaaaccgcgggatgtgtttcggacgtgaatgccatttgtccaaaagagctacgcgttaacggctcatcgggtgttgtggcgtgtaagagtgcttgtgaggcttttaacaaaccggagtattgttgcaccggcgctttcagtaaaccggagacttgcccgccgacgaaatactcgaagatatttaaaggagcttgtcccactgcgtatagctatgtgtacgattatgcttcgagtagatttacatgtactagtgctaattatgttatcagtttctgttcttaggcatagtatagccttttttattgttattattatcaacaatgaataaataattaatcactattaacatagttttatgtttttttttcatcactatgaaatgtattaaagcaaaaaagactaatgttaaaacttaaaagattaaaaataaaataaaaagaagttaaaatgacatttaaataacgtaaaaataaacgacgtcgtttagccaaagtttctactatctatgtatgtggtggaacgaggtccaatggttgaacaagcaaccttatgatatattttatgagaagaggcaaacaacacctaacattggattcgagctctctagtgaagaatccgccatg

SEQ ID NO: 25105 - DNA, 3003 bp, Unknown; identical to SEQ ID NO: 25104
  misc_feature (1)..( 3003): 2750-1469P.txt file - cDNA_ID_2702975; gDNA_ID_2214627; Annot_ID_187822

SEQ ID NO: 25106 - DNA, 3000 bp, Unknown; identical to SEQ ID NO: 13436
  misc_feature (1)..( 3000): 2750-1469P.txt file - cDNA_ID_2702979; gDNA_ID_2214627; Annot_ID_135976

SEQ ID NO: 25107 - DNA, 3000 bp, Unknown; identical to SEQ ID NO: 13436
  misc_feature (1)..( 3000): 2750-1469P.txt file - cDNA_ID_2702979; gDNA_ID_2214627; Annot_ID_187825

SEQ ID NO: 25108 - DNA, 3003 bp, Unknown
  misc_feature (1)..( 3003): 2750-1469P.txt file - cDNA_ID_2703017; gDNA_ID_2214628; Annot_ID_135999
aacagaaacagtaaaacactcgaccaacacagctctttgcagagcattgggtgaggtcgagtgacaggtcgagtaacagacaaaaaataaaacagggatactcgactgcacagtctgttgccagacaactgggtggtcgagtatcaggtcgtgtaacagtaaagaaatgtagaaattaaacaacagatgacaagatgcagtaaacaacagtagagtaaacaaagaattcaatcagataaagaattcccgaggatggggtaatcgagtagcttcgttttctaagtttacaggtgattgacatgctcaataaattaaccctagacaacaagttcattaaccaaatctaagtgccaccgcaacagagaccctcaagttaacctagtcccagactcaatcaccattgacgagagctacctaacaggcatgacgaatcaacaagttaaagccaaaacgctccctgcaaccaataccttggtacagggtcacgaatctctggaattagtggttcagacatttcatcgaataccttttgggagcataaaatgtctgggctcaaattccagttgatcagaaagcaataggcattaagaacaactaatccagaagggatctatcaatcaatactcaatcacctagcatactcagaattctacactactctaacccatcctcagaaatctattcactactcaaacatcataacagaaagcataaacgttgaacaagttgaaaacatgataacaacagtgtaacaacaggatgataacagaatgaacaacagtaaacgaaatcaagacaaaagctgaatactgaatactgaatagataaagagaaatccggattacaaaaagactagaacacaaggtctgcggaataaaactaggtaaaaacttctttttgcgaaaatgtgaagtacatgctacttatagccaaatatcccgaaaccctaatactcaaaacgacgaagtattgggacggataaagaactgtactcgacccatgtggtcgagtgggaggtcgagtgagtagctggagtcttctttcctttcctgtgctcgagtgtctggttgagtgcggaatgaagaaggctctgaagcttgtcatctagtatgcagtcgagtggtgtgatggtgatactcgacttccaagtagagcaatgaggtcgagtagtggtctggcaatgaaggtgaagacactcgacctcgtggtcgagtgaagtgatcaagtgtttgtcaggagatactcgacttccaggttgattgacgaggtcgagtggttgtctgatgatggaggtgaagacactcgacctcatggtcgagtgatgtgatcgagtgatggagatgagggcactcgacctcgtggtcgagtggtgaagtgaagtggtgatgtcctctactcgacctgggggtcgagtggtctcttgagatcttgaagctcctactcgacctctgggtcgagtggtttatcatgatcagatccgcttcttccagatagctcgtcaacagctccaaatcacctgaaatcaacgcaaatatgcaacatgcatgcaaaactatcctaaacatgcaaagttatgacaaatgatgtgaaatggtataatcagtgatgatatgatgctaaagtgatgacaaatggatgctcaaaacatgcaaaatacacatttatcaactcccccaaacttagtctttgcttgccctcaagcaaacaatcaagaacaagctggaagtaaggtttgaaagcggggattcagagccaaagaaccagatagaccagatgaaatcaatgtccaagttgaaagttctaagctgcaagatcaaattctacttaaagacgttagccatgcctcattatcaatcaatccgactcatatgctcgacccacacatgttttcaaatctaccaatccctttaacattcattagttctggaacgtgaatcaaacaatgcatcatcaatgaactcatttggctaaggtaaaaggtcaagagacaaagatggtcccttacagaataggcttcagtaacaggggatctctcaaaaaatgattaagctttaatagaatgctaaaggtaagtcccaagctatgcatactgagataagatcccatctacacagagtatatcaaatgaagctctaatggtaattgttgattctgtaatcaaacaatgaatttgtactaagggatttagacaaattcactcctctcttagctcacaaataatcaaaggaaaagaactaagttgcttgaacaaaaagctagggtttgctctgtaatagtagtctcttgtattaggttaaaaatggtctcaatggggggtttgacccctctatttatacaatgggtcgaatataccaaaatatgataaacttctaattatcctaggtctaaatcttcattacttctattcttcataagatcctcttctcttaaatggaagttttccctttacacgacctaagaagttggttatggcgatcttgattgtcgacttaagtcttcgggcgagctcatgacttaggcccattaacaggctaaccgggataccccggttcaatcgacttctcgattttattcacattattcctcggtttaaattggtattgtcggaggtgctaattcctgcaccaacaattagtccccccccagtccggagaatccgagttgcctaattcgaaatttccgaacttagaaattgaatatttgatttaaatcttggaagacgtgaattaatcattagatctccgaatcgattcgtatttcgaacgtatttgacacgtgtcaaatcgtcgcatctgtacgcgcgcgtgaagctcaagaaccgaagcgtcccgtaggtttaatgatgacctcgtaggcttgccgcccattcgtctctatttatattcgaccaaaccctcgggaaatcattttctgccgcttgcaagaagaatcaaaggtagctttcgctctctcctctacgaattattttgtattctcgattctttatcgatttttccggcaatg

SEQ ID NO: 25109 - DNA, 3000 bp, Unknown; identical to SEQ ID NO: 13466
  misc_feature (1)..( 3000): 2750-1469P.txt file - cDNA_ID_2703032; gDNA_ID_2214629; Annot_ID_136021

SEQ ID NO: 25110 - DNA, 3000 bp, Unknown; identical to SEQ ID NO: 13466
  misc_feature (1)..( 3000): 2750-1469P.txt file - cDNA_ID_2703032; gDNA_ID_2214629; Annot_ID_187912

SEQ ID NO: 25111 - DNA, 3000 bp, Unknown; identical to SEQ ID NO: 13465
  misc_feature (1)..( 3000): 2750-1469P.txt file - cDNA_ID_2703035; gDNA_ID_2214629; Annot_ID_136016

SEQ ID NO: 25112 - DNA, 3000 bp, Unknown; identical to SEQ ID NO: 13465
  misc_feature (1)..( 3000): 2750-1469P.txt file - cDNA_ID_2703035; gDNA_ID_2214629; Annot_ID_187907

SEQ ID NO: 25113 - DNA, 3000 bp, Unknown; identical to SEQ ID NO: 13464
  misc_feature (1)..( 3000): 2750-1469P.txt file - cDNA_ID_2703042; gDNA_ID_2214629; Annot_ID_136014

SEQ ID NO: 25114 - DNA, 3000 bp, Unknown; identical to SEQ ID NO: 13464
  misc_feature (1)..( 3000): 2750-1469P.txt file - cDNA_ID_2703042; gDNA_ID_2214629; Annot_ID_187904

SEQ ID NO: 25115 - DNA, 3000 bp, Unknown; identical to SEQ ID NO: 13463
  misc_feature (1)..( 3000): 2750-1469P.txt file - cDNA_ID_2703045; gDNA_ID_2214629; Annot_ID_136013

SEQ ID NO: 25116 - DNA, 3000 bp, Unknown; identical to SEQ ID NO: 13477
  misc_feature (1)..( 3000): 2750-1469P.txt file - cDNA_ID_2703053; gDNA_ID_2214630; Annot_ID_136028

SEQ ID NO: 25117 - DNA, 3000 bp, Unknown; identical to SEQ ID NO: 13484
  misc_feature (1)..( 3000): 2750-1469P.txt file - cDNA_ID_2703053; gDNA_ID_2214630; Annot_ID_187923

SEQ ID NO: 25118 - DNA, 3000 bp, Unknown; identical to SEQ ID NO: 13478
  misc_feature (1)..( 3000): 2750-1469P.txt file - cDNA_ID_2703094; gDNA_ID_2214630; Annot_ID_136030

SEQ ID NO: 25119 - DNA, 3000 bp, Unknown; identical to SEQ ID NO: 13481
  misc_feature (1)..( 3000): 2750-1469P.txt file - cDNA_ID_2703102; gDNA_ID_2214630; Annot_ID_136033

SEQ ID NO: 25120 - DNA, 3000 bp, Unknown; identical to SEQ ID NO: 13481
  misc_feature (1)..( 3000): 2750-1469P.txt file - cDNA_ID_2703102; gDNA_ID_2214630; Annot_ID_187932

SEQ ID NO: 25121 - DNA, 1295 bp, Unknown; identical to SEQ ID NO: 13501
  misc_feature (1)..( 1295): 2750-1469P.txt file - cDNA_ID_2703122; gDNA_ID_2214631; Annot_ID_136062

SEQ ID NO: 25122 - DNA, 3003 bp, Unknown
  misc_feature (1)..( 3003): 2750-1469P.txt file - cDNA_ID_2703132; gDNA_ID_2214631; Annot_ID_136058
gccaaaaagtcatttattttattaatattaattttattaatgatatgactctgaattataatctaaatattttagctaataacataggagtgcaccatatttatttaatagggaaatgtaccatatgacccgaatgcatttttatccaaatccaccaaaaaagtcttgcaaaaatactataaagataagaagcgatagtcggttttgatagatataagattagcaaatatattagttagcttaaattagttaaagaatacaaattaaaagggtatgcaccatatttatttaatagggaaatgtaccatatgacccgaatgcatttttatccaaatccaccaaaaaagtcttgcaaaaatactatagagataagaaacgatagtcggttttaatagatataagattagcaaatatattagttagcttaaattagttaaagaatacaaattaaaaaggtatattacactttattcaaatattgtatcaaaacttatataacacagagatttgataatttttaattgttgaatacttcttttttgtgctaattttatgtgattaagatttaattgatttcatatataaaatattaaattgacttatttgtttataatttggtaacagatagatatttgaatattcagtatattttgcttcagtttaggaaatctttgatgacccgtctttagatccaataagtcctataatctagagattaatttgcagtataccgcaggtaggcttatattttagttaaactaaaaacttttattgtaaagatgatttaaaaatatatgatattattttatttgattttaaatgtatagtaaactgtgagttgtatatgttttgttgatattatctatattgtttagtgtttaagattatacacttgtagtttgattgttaatttaagagtttcacatgtagtataccatcttgtattaatatcgatctaaacccgtcaattctaggatttttcagcttatattaaaaattgaatcacatctaatatgttattaactattgtaatatataagattataaattttcaatataatatgtatgaaattgaatatgaatatttcaaatttatgtccccttactcagtagaaagttttcttaaatctatttttcacccgttataatattatttcatgtattgaacagtttatatttgtttttaaaaattcaaattatggcatatgcgaaaaaactctaattatttttttataatgatgatattatttttccgtataaatagaatcatataaagatgagaagtgaactataataattaataaaaaattaatatgataatttagataccaaatatagtttgttgattttaattggttacttttttagaaattaataatctatttcgtttttctaattaaattaaattaattaaatttagatatcaaatcttatatgttgattttgattggctattatttttggaaattaatattgtatttcgttttttaattaatttaattaattaaattagtatttgactttttaatccttaaagagataaattaatttactttttaaaattttatttctaatggcatacctatgtaattacttacaaaaattaaggttatatttaaaatgtacttcccaaataatatagtaggattgtcactacgactacgagggacacttgctaaattttcggaatattttatcttatgaattagaaggaaaattattatggaagttgtaataaaacatgtacaacattttaaatatcataggttttttattacaaaagtattatattttaatagtatatgggaaaaacaattgtctcttcaaaatttattcaaaataaaaaaaaaattaaactatagacgaatgagcctcgaaaacgcaattcctcaaacatttttttttacaatcttatccaccaacgtatgagtcaaatcaaacaaatagacaccttaaagtaaagtatatacatagttcactaatatttttgctagacggttaacctctttatacatatacgagattcgaattatctactctgtagataaaatatatgatacaaacttatcaagaaagacaattgggttcgactcacaaactcttgcctttaagaatcctaccactaattccgcagctctagcctcatcactctcttctcccatgggatatacaattcatagtagacttcctacaacttcggtaaacgagccgagtatacaatgtttagcgcacaatttccgcgggaaatacaaaaaagattgtgatgttaatgtgatgaatttgtaattaaacacacgataaattagtgcaatgtgtaaaatattttataaatttgtgagtaatgggtaaaaaaaaaagtaaagaaggaagcaaagttcagttggtgaatcattttgctggccattactctataagagagagagatcctatctccataaaatcccataccctcaaacacacacacactcaccatcccactaactcgaatagttaacatgcgcacaccgatccttggcctttcgttgctaaaatgagcatggtgcgtgattcacccgcttacttgctcgatttctccttcacccttttaaaaaggaacgtcttttagcttacctctgcctcctttaccctctctctctctctatctctatctctgttctttcctttttccggcgaatttctgggctgagattgttagtgtctctgagtgatgcagagatcaactgttgtagttaatcaatatcttctgacataagctaaactcgattctttcttacaatctctctgtctctctctgcttccttttctactgtcttctttcttcttctctagcttttgaattttcaatattgatttctcccatggcgagtagcagttgcagcagatctatctctgtttcaaattctgattctctcggtgttttttgtttgagctagggctaaattagtttccttcttgggtttttattcgtaatccgattcaaagtttgtatctttgggagggatg

SEQ ID NO: 25123 - DNA, 3003 bp, Unknown
  misc_feature (1)..( 3003): 2750-1469P.txt file - cDNA_ID_2703136; gDNA_ID_2214631; Annot_ID_136057
cctttgtctctgtagtagctgtagagcctttcgacaaaaagatccaaatcagcaattggttgaacatttaaactctctccattaagaagtcccgatgggctctcactaccaggacttggtattcctccgtagttagatagctcaatctcgtgtgactcattatgaagcaatccagtagtcaaagacgatgatgattcaccacgttgccatttaaaaaagttacgtacatttggacccttatgcccactgctcatcatttgtaaacacagacgattggccaaaacagccggtccattccctgcttaccacgcggaaatttgaagaaagtgtagtgcgcaatgagaatgcaactacaaatcctgcatcaaacatgaataacataaagcatccacaatgcaaatcacctaatgacagagataatttatgtatgcaaacaaaaaagtgccactaaaatgttcaagctagaagcacatacaatgaatatactaaccaatgagacactaaggcaaatcaaatccttaaacgcagaaagacaaaccaaggatacggaactcgtggcataacctgctaaagaaatgtttctatatctgttttccaccatgatggatataaaccagacccacctatcctttgcttgacactcaaaagactattcgatttcaaacacttcctttctttttcaacaatagcattcatgcacaagcagaatctttggacaatgcactaaatgcctagcactctgatgacaattgatggtgcagagaaagcgaagacgaagtaatctatactcaatcaagaggctgacacaagattcacgcaacctttgcacaaccaatagaccttgatcaaagtcaattacctaaaaccaactctatttttcacaagaagacgaagcaaaaacggcgaattccttcccaatagaacaaggggtttatctacttttaacagggaaatgatcaggagcaatacgattctaaattgaaacctcaaaaacccttaagctaacactataatctcctccaaccttaaatcacagtgcgattaatcaaaaaaaatcaacctttctcgataacagcagatgagaaaatcaaaacttaccagagacccacgaaaggaacagcaattagaaagcgaaggtctataagcagctaggaagatataattgtcttaatatccgaagctttagagaaggaggaatcaaatacagaggctatgggcaatggaaaattcgatgaagaagttgaaaagacaagaatttgatcgacgaatttaggggagaaaagcaaaagaagaagacgaagagaattgggtttgcgtggaagaaaagaggagtgataaaatattgatgctttggagtttggagtactagttttcaattttcgatttgggcttttcttcttcctcttctcttctcttctcttctatacaacattacttaaccaaagaaacgtgatcacgagttctcttcctcttctatgattttggttttactttgatctttggttaaaaaggtaatctaacatttattagcttgaatccaaaaaagtctttgcacacacaaaaaaaaaagtcttgaagccaaaaaattgtaatttttctttaatgtgatatattgaattttattttaacaacttgtataatgggccgattgttttgagtgggcaccggcccagattctaaacagacccaaaaaaacaatagttaagatgtacattatattactaactttaaaattgagttttgaaaatatgatagtgagtcagttgacataaattttggatctagatcagattcttggtatcaagatcaatatttagtctcagagcataatataatacaaattgatacatctagctcctttaattttttaaatgttaatcaaaaataaaaactcatgaaagttataattattttataacggcattatatttttttttgtcaactagacgataaaccgataaaagaaataaaaattggtatttattattataatcatcaaaacttcatatattgacataaaacaacaaatttaaataagagtatatagagaaataataatatcggaaagtataacatttaataaaaagaaaagttgaagttttgttagtaagaaaatagtagtaatgacaattgaaaagaatctcataatcattgaaaatttattgaattctttgatttagaatagggatgtggtaatattcaatgtttaatatttatgtgttttcttttaataatcaatatttatttcatgattttatatagatttcctcattagcaaatataatataaaataaaatggaaacgacgaaccttaataagaaaaagttcaagtatatacagaaataacaataccggaaaaatataacatttaatagacaaataaaattaaagttttgttagtaaaatattagaaatgacaatagaaaaaatatcataatcatttaaaaactgtttaattctatgatttaaaataaggatgtggtaaatatattcaaagtttagaaagagaaacatagaaaacataaactaaaccattgattatatttgatttgctgggctaactgttttatcttaatattttactgttgataagattccttatgatgagattatctttgatttttcaaaaaaactataaatactgaacaagcagcataaacattgcacgacgaccttatataaatcatgttcatataaaaaaaatcacaagttgaaaaaaagaaatctggtctctttggtttgcatctattagattcgttcagagacagcaattcataatgggcctaattaatgggcttcttcgtagataagtgttttcgcgggaagcaacgggttaataggcgcgggaggtatacgtggctttggtacacgtaggattgcgcgccaaagacctaaataaatctaaacccttcttcttcttccgtcgtcttcatcgtcttcatctatctcctccactatctcctctctgcatctgacactctatagacattgttgataaaaatg

SEQ ID NO: 25124 - DNA, 3003 bp, Unknown; identical to SEQ ID NO: 25123
  misc_feature (1)..( 3003): 2750-1469P.txt file - cDNA_ID_2703136; gDNA_ID_2214631; Annot_ID_187969

SEQ ID NO: 25125 - DNA, 3000 bp, Unknown; identical to SEQ ID NO: 13493
  misc_feature (1)..( 3000): 2750-1469P.txt file - cDNA_ID_2703140; gDNA_ID_2214631; Annot_ID_136056

SEQ ID NO: 25126 - DNA, 3000 bp, Unknown
  misc_feature (1)..( 3000): 2750-1469P.txt file - cDNA_ID_2703160; gDNA_ID_2214631; Annot_ID_136048
atatatatatttatttaaagttaaaatagttctcttggtcaaatcttgtgtacgggctctatttttccttagacctggacccttccttagtcttcattttgggatattttgatcagtgaaaatgtcccaaatatatcacttttgttgcatgttgttacatataatatttgataaatgcaattatcagaactaccttatacgagggttagccaatgctactgcctactggacacataactagtaagattctgatagagcatgagaggaggtaaaagattttgttggttaagttgtgtttcaggtttggttagacttagaccaaacttaatttcaaattatcattatgcatgttgttaataaataaaaaaaactacagaaaataaaaatgtcattaatgtattaaaattaacatttcaacctttcatgattatttagcaatttgttaagtgatgaaaatgtttactttgttattcttatacagatttcaaaatttagttgagacattttattttagggatagctagttggatctgattgaagaagataagtaacacctttttaaatattaactagtgaaatgtttaaggcttctttacttttgacatgcatgtataatcaataatgcaaatcagccgacccttggaaaattacaaaaagaagcgacaaagttagtagttgaatggacccacaaatatctagatttcgttaggtcacgatccatttgaatttatcaattatcaaacaaaacacttgcattaaaaacatgggaactccacaattatattggagtagtgttgtaagagaagataaccctcgttgtattagaaaatgaaaccccaaaaagaaaacggaaagagaaaaaaaaaattgtgaaaaagggcaagatcttggtaatgatggaattagatatcgacgatcttcgttttgttttagtctattctttttaaaacgttgtaatcttggtctaaatacgtttaatttgaaacagtatacaaaagttgcttttgacagagacaaacgaatagtttaactcaaaagtaaatgttgtaatggtgagtgaaggtgtgcaattgaaagaagccaagaaccatatcactaaatatcaattgacgacaatttcatacattttacgatctcatggttgtaattatcttacgtaatgacatataccgtaagaaagacatttctgttttttttttacggtatgacactatgaataattgacgtgtttcaaaataatctggttgtctattttattttaattactaactcaccggtaatttaataaatttaaatttgtatttacaaagtaaaattataaatactctttcgaaattaaagattcatatgaccaaaacaattcagatgtagtatcaagtcatatttaacattaaaagaaagcgggaaaacaatgaccaaaaagtggagtcatcaaatcatattctagctaataaatcatttcataaaaattttttgttaacaatatgacctctgattctctgaatcatattagaaaagaggaacccctttacgtacgtaccgtacctacttcgatgtctatgattttccctcttgacaccacaattgttttggctctacatacctattttttaattaatcgtaacggtattatatacattaagaaagaaaatagtgtaagtgtttaatatgcgcatagaaaaatatgaaacttttaatgtttcttattgacttataggtcacccaacaagcttgattgagattaaaagtttgattatttttggcccatgatttgatcggaattgagcactatgagcctctttctttgacatttttatgcatatataatttgaacctttctttcctctcataatgttttatattattttatttcctaatttcttattatttatattggagcattttttgcttaatatcttttttatataactccgtaatccgaggctccgagcgggagtccgggtaaactagaatggagcaagcttgtgaaatacaaacacaccatattaaacatttagactacatatcaaaaccagtcgtccaaaaaaaaaaaaaaaaaaaaaagactacatatcaaaaccaacttatccaataaagttgttccaaaaagaatatgaaacatatatgatagatatatttaatagtaattaagatttgtcataaccaatcaagtaaacggatcatggcttgtataccagtggttttcaataatagcttgtataacagtggttttcaataatagatttagatatcgggtcattaacttttgaagtgggtacacaggtcgaccatatgtcgatctttcatatgaatcatgtgactcatatgcttagtgaaactagcgtccctagaacatgataattcagggcaataattgcataagtagagtgatgtttgcgttttgcttctcatcacacactcgtttccctggttgcgtgttgcatctcaaaaatattgcaaatatcccgaaatagaaagttttggaccctatctggtgatatataaagagaatccttttggcctgagtcgaactgattaaccgttaaatattttactactgaatggcacctgaattataggcaatctttacacaacaggagttacaggacatcgaggctccagtggtattcgtcgacctcatcaaaacagattaaaatacattagaaaaaagttttttttttaatgaatctaaaaaaaaagttcaaaggaaaaaggttaaaaactttggactgtgtagatcaaaattagtatgagaaaatttcaacttggagttgtcccacggttgcattgtgattatataataataatatgtgtgtatatataataacacactaaacgtcgacatcgcatacttccttcaagcatttggcttctttagctctcataaacttcatacccattcaacacttgtccttctaatcattttactcaattgaagaccattttgtttttctttttctgagtgttttttttcttgagggggcaacggaaaaaagaatg

SEQ ID NO: 25127 - DNA, 3000 bp, Unknown; identical to SEQ ID NO: 25126
  misc_feature (1)..( 3000): 2750-1469P.txt file - cDNA_ID_2703160; gDNA_ID_2214631; Annot_ID_187959

SEQ ID NO: 25128 - DNA, 3000 bp, Unknown; identical to SEQ ID NO: 13514
  misc_feature (1)..( 3000): 2750-1469P.txt file - cDNA_ID_2703183; gDNA_ID_2214632; Annot_ID_136082

SEQ ID NO: 25129 - DNA, 3000 bp, Unknown; identical to SEQ ID NO: 13503
  misc_feature (1)..( 3000): 2750-1469P.txt file - cDNA_ID_2703187; gDNA_ID_2214632; Annot_ID_136071

SEQ ID NO: 25130 - DNA, 3000 bp, Unknown; identical to SEQ ID NO: 13503
  misc_feature (1)..( 3000): 2750-1469P.txt file - cDNA_ID_2703187; gDNA_ID_2214632; Annot_ID_187989

SEQ ID NO: 25131 - DNA, 3000 bp, Unknown; identical to SEQ ID NO: 13536
  misc_feature (1)..( 3000): 2750-1469P.txt file - cDNA_ID_2703272; gDNA_ID_2214635; Annot_ID_136116

SEQ ID NO: 25132 - DNA, 3000 bp, Unknown; identical to SEQ ID NO: 13536
  misc_feature (1)..( 3000): 2750-1469P.txt file - cDNA_ID_2703272; gDNA_ID_2214635; Annot_ID_188088

SEQ ID NO: 25133 - DNA, 3000 bp, Unknown
  misc_feature (1)..( 3000): 2750-1469P.txt file - cDNA_ID_2703286; gDNA_ID_2214635; Annot_ID_136117
ttgttttcttttaattattgaaatttatatatggataaagtagtgataaggtccataaggatatcagaagatacgaaaaagtgtttaggagaacataggtttaccaccaattttaaatcacgtgatcaaagttgtatcctattgactgtatcatattaaaacgtcatttattacctcctttacaaaaaaacaaatatttcttaatgaaattttgtggtgtattttgcgatgataaatttaaaatgtaaggtaaataaatattttgaattttactcacttatttataatataaataaataaacgtaaattaacataattttgcaaatttttagtattagtgaaaatttagttgatttttctttttgtattagttccctttttttaacggtttgtattagttcaaataccagcaatatttatgctctctattataaaagctcaacttacaactataaaataagaataggatttatgaatagatcataatagtattggtcttcatctttttaaaactatccacataaacaatagtaatgaatctcactagatagtagtagtgtatagtttgggtaaaatacattttagagtagattactgcatattggttttgtcgaggatgattttccggttcaacaaattctgttatatgcaagcataatcaaccacatcttctttatgaagagatcctctcccgttaaatcaccgtttacttcacacaaacacaatatatgtgtagtgtacagataatttattgaccataaattcaactatccaagcttcaaatttcgtaggaatatgacatagtaatcaagtggtggtgagaaaattactgagagacctacgaatcctagaaacataattttcgtaactcctaagtgaaaatcatcatcataaactcagactttgaaagtcaactttgaaatataattttcagaaaattatatccgtttgatgattacccccaaaatctctttggatgatcatcaagcaagacatcatcttctgaatctctgatgtaagattatggacctatgttcaatttctaatcattgtttctctatttttatatataaatcaaatgaattttggcgtgttgacattggacaatatagtttaggttagacttggggatgtagatcatccttcttcctgtccctcctaggatagcaagagaatcattagggataataccggaaaaaaatggacaattagccaacactaattttggagacttgaaccaattattattattattatatatttacaaggaaaaaactacataaactatcaagaaacattagcttgcagtaaaagaccataattccaatattgtgtcaaaaaatagattctaagacatgatgatatataaaaaaaaacttggagaagtgtcaattccacaaacaatagccaagccaacacggacaatcgttggtactatcgttgtacatgagaggctttgttaaaggaaagagaagtaagacgaacccaaccacaccgcctaagaacgctgcactcaccaaacctgagagaagaaccataaccatgtttagcttattcttttgcatttgcatttgttaacaaccttgaactttatgtcttaccttttccatttgcgtatagcacaggcaatcccatgtagttgcaaaatatatgagcaaacaaaggagcagcaagatgtcctgtaaaatttacacaatgcaggagacaatcatccattagaaaggcttttacatgtataagatatataaatgcctggaatgttaccggttctgatgaagagaaacgatgcatatgcaccaaaaatgactgtgtagccaagctgaagacctgatcaacggacaagtgaagctcaggactgatcaacaaacaatattattatgattatggatggcaaagacataccaacaataagtgaagcccggagatagctgcggttatgcctgatgtacatctctctaaaatggtttaagtgagctacacaaaacatataaaagtcagacaaatccagtaattttcttttcactcgagttgtaaactgttattcacagagagagagagagagagaaagaaacaaacccaagctaaagagaactgggcacagaaagatggcagtgttaatcctaaacccagcacacagaagcaaaggtatcatacatgatcggaaaaccagctcctcagttactggtgcctgcaaatcataagaaacgccagctctaacagattataacttgttcgatttagaacttacttatacaccaaactgatgcatatagtcctcagacaattagcaagcaatgccttatgcaatttcaataaagaattgacaagataagcacacagagatggcaaacatatgattaccacgataaaattgcgccaaacggaaacattagaagcacttgtcaataccgaagcagggattgtttggaaaaagcttctgatgtaattaaaggaactacatcctccgccattttccttccatgattccaggagagtaaacaacttcaacaccaaagacccagcataaacgagcgaggtcaatagaagaggatacaccactccttgccactgttccatatcacaaaacataaccattttaatatgaatagtgtacaataagctacgagtaaacaaattgagacaaagaacttaccagatgatctttccttatgccataaactccaagtatataagaggcctcccagctttttatctaacattactcaagcaaaaaaggaagacaagtttcagagattcctgtaactagcgttgaattgtaccaaacacaacatagtcaccaatatttgagtgttacattcttagagacaaattgtgtgaacctacaacaactagtaaaagctaattcaactctcaacaaagttacaaatacatcaaatttctttacttttagtttaactttcatcaaaacaccaaatgcatctagatttggacctaatttggttacagatcaacggagaatgaacttcaaatcgagaaatg

SEQ ID NO: 25134 - DNA, 3000 bp, Unknown; identical to SEQ ID NO: 13537
  misc_feature (1)..( 3000): 2750-1469P.txt file - cDNA_ID_2703289; gDNA_ID_2214635; Annot_ID_136118

SEQ ID NO: 25135 - DNA, 3003 bp, Unknown
  misc_feature (1)..( 3003): 2750-1469P.txt file - cDNA_ID_2703292; gDNA_ID_2214635; Annot_ID_136120
aaaaactcggtgaccatattcaaaactttcccacgttaattctctcttctttgttttgtttcagattcattacttttctccaaaaaactttcttcaagatctgttcttttaaataattatggcggaagaacatcgatgcgagacgcctgaaggtcaccgtctctgcgttaacaactgcggtttcttcggaagctcagcgacaatgaatctatgttcaaactgttacggcgatctctgtctcaaacaacaacaacaagcttccatgaaatcaaccgtcgaatcatctctctctccggtgatcgcacctgttctcgaaaactacgcggcggagttagagatcccgacgacgaagaagacagaggagaaaaaaccgattcaaattccgacggagcaaccgtctccgccgcaacggccgaatcgatgcaccgtatgtaggaaacgggtcgggttaaccgggtttatgtgtcggtgtgggacgactttttgtgggagtcataggtatccggaggttcatggttgtacgtttgatttcaaatcggcgggacgtgaagagatcgcgaaagctaatccgttggttattgcggcgaagcttcagaaaatatgaatcggagccgttgaccgatttctatctttaccctgagaaaatttcgattgtctcggtggatctcagccgttcattatgttattgtattacggacacgtgtcgcaagattaaggttgagatggtttcgtaactttttaattattttctttgtttatttccgaagaaattaaagtttttatgattgtgtggcttttgcttgtaaaaaaaaaaagggtttctctttgggaaaaagaaaagaaaatatatgaaattgtgtctcgcgttttggataatgttttataccgacagaaacagtacaaagacgttttgatcatttcaaaacgttagatcattgaagaaaatgaagctcatgtccttattgacgtttgtttgctgattttaattcttagatttgtgaggaaaatggaatataagttttaggtcagttgatttagacttttatctgaatcagtttacctaatcatctctaaagcatttagctaaggttgtttgttcttaatgctttatggtcaaatgtttgtaagctttttaggcataatataaggccggattcattttggtaaagacgaggatacaatagcttcgaatgtgtggccatgtttcgctaagcgatcatcaacttgatttgtcttttggtatgtgaaagaaaaggaggttccatcaaacatctttcagctcacttgaaaattatttgaaatgtctttcatacatttatgatctatcaatgaatacaaatgaactactatttttctcttcaaataattattctctttctgttgacattatgaaatttagaagttttcacaataatcaaaagtaatataaaacgtcgaaaatatatttatctttatatgaccacttgatgatgaagactcaaaccaacaaaaaactagtgtttgttttatttccgtggtcaaatgtaataatatatttctgtgtgtattaggtgatatttagaatttttgtataatttccaaaacaagaaaatacttcaaataaatttcatattaatcttatcaaaacatatctttcatattttatatgaccattattggatgaagaagagtcaaaccaaatatgaactagagtagtagagttcaatttttttttttgacaacaatgttttctttttctggtcaaataaataaaccttttttgttcatattaaggtgaaagaaaattagaaattatgaacaaatgttttaaaaataatataaatatctagatcatattgcatatatttcatttaccaatgttaaagatttgtgtatatatagaaaagaaatcttcaacaaaattaaactgctaagaaattattaaaaaaatgtaaaagaaggaaaaatatctaaaacatgaagccagagaaacgaaataggagtattaattaattaaagaaacaaactcaattaattaattcaatggaaaccgctaaattattaaccgttcgccataattaaaatttaagagacacacaccttaaacctcacctatatattttccatgcaaaaaaaaaaaagacaacaatttcaaccatcatgaacattactaaactcactccttggtttcttttctcgtgtctgattcttctatcaggtattattagtctataactttcattttcttcttcttgatctgtttaatgtatgtatcgtatatcaaattacagcaattaatttgtattaaatcagtttcatcgattaatttctttttccttttgatatacgtgctagactacataaaggtaaacagctcaatttctccatctagcgagcaaacacaagaagatggcttttttggtttcaaacctacaaagttgtttgtgttcggagactcgtatgcagacactggaaacacacctttcctgatcgttccctcgtggaggtttcccaatggaatcactttcccgggaatacctaccgggcggtttagtgatggtcgtgtttccactgattatctcggtacgtttgaactataatgttttgtttggtaatctgtcacaatatctgagtctgtaagatttataatattgtaaacagattgcaaagctcagtgaaaaactcttagattagatatgtcttagctgtacatttgcattgcatctcttatataatgaaacgcaagtcaataaattttgttcattataatttgttttaaatgttgaccatataagtatttagtttaacgttttcactctctcaaaatgcaagatatctctagtttaacgtaaatcggttgccaacagtaattataccctatatatagaaaacatatattatgcaataaatcttatagtttgacttatattgtaacatgtagcgaagtatattggagttagaacgccgatcacatacaaatgggggaaatacggacgaccgagactagctgtgaaaagaggaatg

SEQ ID NO: 25136 - DNA, 3003 bp, Unknown
  misc_feature (1)..( 3003): 2750-1469P.txt file - cDNA_ID_2703300; gDNA_ID_2214635; Annot_ID_136122
gatgacacactcacgaggaaccgtgaggttgaagttgaggcgatgctcagtaggagaaagcaactaaggacaacaacgacgaggacaacaacgacgaggacaacaccattgagcttgtcttcctctgcttcaaagatgaactggtctaaaaacgatgagcttgtcattctcggggttagttagtaaattctttgcagcttctctatattcttctttatcctcttctaactttttttactctattttgtgtgtgtgtgtaaaagggtattgtggactatgagaatgaaacgaaattgagctatagatctgactgggatgccttgtaccgttatatcaaagattgtgtagaagcaaagttttcgaagattcagctcatcaataaggtcaagaacatgaagagaaagtttacatacaatcaggggagatctaaccatggggaacaactttcttttactaatactgatgatgatgaaatcttcaaattgtcattgatcatatgggacaagaatgaatcagagtatgtttctaatgagaatatagaccaagctaaggtgagtgtctttgttctgtttttcaacaatctcttagactactaatgtgcaatgaattaatgatcttgttttcttgatttgcataaggatgttccttctggtgagccagagactaatgatgtgccttgtgaggagcaagacgatagggatgtgccttgtgaggagcaagagcgagcgaatatcgagattgataatggtgtgagagagaaattggaccaagccaaggtgagtgtgttagttctgttttttctaccaatctccttgttaccatcttaaaacatgatgtaaaaaattgtgttactaatgatgtgcaatgaattaatgatcttgttttcttgttttgaataaggatgttccttgtgtggagcaagagagtgaggatgtgccttgtgtggagcaagagcgggtgagtatagagattgataatggtgagaaagagaaattggaccaaaccatggtgagtgtgtttgttctgtttctaccgatcttcttattaccacctcaaaacatgatttattgatcttggtttcttgttttgagtaaggattgtgaggagcaagagaatacggatgtgctttgtgaggagaaaggcgataaggatgtaccttgtgaggagcaagagaataaggatgtgccttgtgaggagcaagagcgggtgagtatcgagattgataatggtgaggaagagatgagtagcgaagaagatggtgtggatgaggtaggtgttatggaggacacacttgattctgggatatcgtttcaaggtttaggtaaaaatggtgtgaaagacaagagtgaagaagatgatgtggttgagttgggtgttctccaggagatatttaaggaggatacattttttcaaagtttaggtagatatcaacaaaaattgctgcttcagaatttggaaaacgttggagttgaaagaagaaaagagctcatcaacgaatggaaggcattgtttgttgatgagcagcgattgtgtgtcaagaaactaactttcgccgcaaagcttgcaaacttaggagtttctccttgattcaatgaagaaaaatctctgcttttggaatgatctcatttttttttggttgtgtcatattgataagaaaaaacatgatgtatccacgatccgttcttgttctagagccaggtaactgaggtaagtaacagttagagctaaccatagcagattctcctttttttagtgttgtgtttgtttcgactcttccttttgggttgggcttcgataacgattgttcaggcccactaacattcttttcttattgtgcgtctgtctctttcgagaaaaagacacaagcacttaaagccaagattcgcattttgccacatgccactaatttcaccttgtgttagatattatttttgtactacacactcaacgaagaccatagatcaactcaaaatatttattacacaacaattatcggagaagagattgatgtgaaatgtaatgaagacgaaaagaaaataaaaaaagaaacgacgaatttggacgtaattttcagccaaaacatatgctttgggtcccacactttcacatttcaactttatcatcacaccgaaacactaaacaccaaaatccccgacaaatttaaagaaaatttttccattttttttttttactctatctctgtgagagattctcttcaagctcaggcctttaggctttaggtttcttttgggagtcttcttgagctctgtaatcactctctagaagcttattttgcctcctaatgttattaggtacgtctttgtatctgtacttgcttctgcatttttcgatatttgtttcttttgatgagatttggggactcttccttcagaaggatttgaagattttgacatcttccattaaaagttgaatctttacttaagctagtgttcttagcattctgtttatgttagcttcatgagatctgggatctcgaggctgctttttttttttgctttgatttcacatttaatgggttttgattacattttcattaggtgaagtgagttgaacttggcttgtggttttgatgaatttctttctattaaaagttttggtttccctaccaaaaaaatgtcttctttttgttaattaaagtctaaaagtagctaatctctatctgtacttgtgtagggttcatcatttgagtctataactataatgactttcactgttcatttcctttttaaatctcttgttgtttccctttccttactttgttcatcatttctccttccctttactcaatagacactgctcttcctttggattattgctctgtgagttatttaaaataagccataaggtctcttcttatgattgttgcagggtgttgtactggaattattaggatgaaccaaggaagatgagtctctcggtctttcaaaaaccaagtcttgtaatgaggagctgtccactgttgtaaagtaagtcattaagatg

SEQ ID NO: 25137 - DNA, 3003 bp, Unknown; identical to SEQ ID NO: 25136
  misc_feature (1)..( 3003): 2750-1469P.txt file - cDNA_ID_2703300; gDNA_ID_2214635; Annot_ID_188098

SEQ ID NO: 25138 - DNA, 3 bp, Unknown
  misc_feature (1)..( 3): 2750-1469P.txt file - cDNA_ID_2703300; gDNA_ID_1563948; Annot_ID_148567
aaa

SEQ ID NO: 25139 - DNA, 3003 bp, Unknown
  misc_feature (1)..( 3003): 2750-1469P.txt file - cDNA_ID_2703319; gDNA_ID_2214636; Annot_ID_136124
ccaaaaaaaaaaacccactattttggtttaatagacaaaatttagtctctgttgtttaattttgtttgatggaagtttatattggtccaaaatgagattcagttcaaattaaataaataaattatctatttaaccaaacttatttaaaagaatttatatgctctcaatctttttgtttgtaaagatttaaaagttaaaattttaaacaaataacaaaatggagcaacgacgaatctatcaacgtacgtacgttctcagacattacattgtacaattatttcgacaaaaaaaaaagcctcattgattatcatttatatattatatcatagagattcgtgccccttatctcgttttttttgcaagactaaacaagtaacaaattgcctagctgcctaaagaagtgaagataatactctttctaaaatcacaatattctcatagtaaaaaaaaacatatttatcatcatatcgtccaaatatttcagttttgttgtttgtttaacaatacaaattaacaatgatttaatttggagcacttgaatataatagtacaccgaccacaaccccacacaattcacaaacttgagaaagagagagaatatgcccaaactcaccaaacctaatcattttcataattaacgaaaaaaatagtttcggtaagatgatgatgtcttagttaacttttgcttactacttttttaatcattaaacaaaaaaaaatattaaaaatcgttttcacttgttcaatacatatttttaagttttatttataaggaaaaaaacttaatagcttattgcaccaaaactaatatggtccttatggatcagtttcatgtttttagttttttatgtaatgaaaatttgaattattttctaaaaatatgtgtacgatatggttcgatttaaatagaaaccatggttcaaaacgtcagattagtaacgttcataaaactgaacgacttaattatgtccacgtatacggttggtttctttcaacgtttttagatagttaatgctttgaaatcttagttagttatacaaaggtaaggtaaacggtccaaaaatgattgttctcaatcaagttttaaataagaaggagaaaaagtcaacaaggaaatgcaccaatcaataaagtgtcaccaaatatatgaggaattccgatgattagctagcgttttgaaaatacttcggctactagctatgtttttgagaagtacgtacatgtggttggtaaaagaatactggaacattgtcactagaacgttcgtgattgtacgcagtattcatgccagttgatgttgtgcaccatcaatgttcattatgtgaaccacccaaaaaggcaaaaacaatggatcatccacctaacaatccaccccaatctaggtagttctaaaatcacacgacttacatcaaaggaaaagtttcacatgtttatcaatcacaggtcacagtatgtttgaaagagatgatagaaaaaagatatcaaatttgtcccgtgttgataggaaagttggtttggtatcgtattataattttctctacacacacacgactcatgtttcatgtgttaaaaaaaaaaagcaatcgttttaatcccttccaatttatataaatctgcgggctctgtttttatataaagaaaattggatcagttgtatgaacttcgaactgtgcaaaaaacttcaaaatggttcaactattttgtcaaggcttgtaaaataaataaaaattagcacactgttaaaatttgtagtattatatttaaaaaaaaaaaagatcaaattaaacaaaagaaaaacgaaattatcacgtcttttatttattattattttaaataaataatatgacattttaaattttgtttggaaattaatcactttctggcagtacctctcagccgaattgtaaacctaaaccgcccaaaagggacagattgcatcgtggtggtaggacattcataaattattatttttccttaagtggagggccgtcacacaatactttttgcccaatagataattggcccacaaaataaaatgctaaaataaatatataatctttctgtatgattgtgaaaaaatgtgagattgtctcgaatgttaaaatttggtgccacaaacaatataaatatataatcacagaaaaattggtgccacaaacaagataacatcttataattttctcgtatacttggagagcgagttgaaagaattgcgattagaataaagcgtagtgatttggcattgaatatcatttatgctacataattctacttagcgataatataaaaaaatatcataacttatggttagcatgtaatgtcactatacgaatatcaaattcataaaactagccgtgacttatctacacagaattatttatgtttcgagaataaagacccaagagaaaacaacgacattataacaaaaaaacaacgacagattataagtaaggaagaaacaaatgactatagattagatatgaaatatttttagtaaccatctttagttataatttttgttttggagcttgctccgtatactcagttgagtatttttaccacacatatatcaagactaaattctaccactaatcaagtaaaaacctcttagcaaaatagttggagaaaaacaagaataaaatcgtattattttcctctagaactatcgatcattcgagagagagaatatgaaaaagggacaaaagctctatacatgtacaaacatgacaagtcattatccgccacgtagattggtcggttccgcttcgctggaattatagcgatgtacttgtttagcctgttttcaaaattatttaaatctctaaccgctccaatcaaataatttctccaccaaatattaataatatatcatccggtaaccggtcaccaaaatggcgccacctcagatataagtaagagcacatagtagaccagaaaaaatcatcaaatccatctcccactcttctagcatcttgaagcttaaatctcagccgtccgatcatg

SEQ ID NO: 25140 - DNA, 3003 bp, Unknown; identical to SEQ ID NO: 25139
  misc_feature (1)..( 3003): 2750-1469P.txt file - cDNA_ID_2703319; gDNA_ID_2214636; Annot_ID_188114

SEQ ID NO: 25141 - DNA, 3000 bp, Unknown
  misc_feature (1)..( 3000): 2750-1469P.txt file - cDNA_ID_2703326; gDNA_ID_2214636; Annot_ID_136130
gttctaaattaatctgtgtttggcttgttcatatgtgtcaccactttgctttaatcccttttctctaaatttttaattctctatttctcagctttcccacctaggttcagattaacttacgatgtcatctgatcctctaaaccgatattgtatatctctctgaaaccttaacagttcttattccatatttccatcttccacctgctatactatttaaataaacgataaatcatctaagaatatcttgttattatttctttattatatatcatttttctccattgccactgtgttgcatccaatcactctaattcatttcataatgactttttctctttcttttttgcactaaaaaaaagtctattcatttttttctctaaatgttagcttgctcgatgtcaattattttcaatatacattataaattttttgaaattttttattttcatgaattttctttccaatcaagaattatatcttttttctttttgtgaaagctttatatttgcacgttaaccctaattgtatgattgtacggtcatgagatgtcattttttgtttgtttgttgatgcttttatgattttatccatttattagaccactcagccaacttacgcacaactagatttatttccaaaatacgtacacccaacacttttacatgttttcaaaatttaattcgaggtttactcaatgcatgttgttaattaaatgaagactagctcatcattcaaaacttgtataaactttttcaatgatacaggtggttcggatttgtaggaattaggatcaatatcctcccatcttttagacatttgattagtgattagctccttcttaaatcatcgctatgaccatatgaaacgcaataatgttaatccagaagcattgaaaacttggatatgatagagaaacaaacgttagctctttggaaaatggaaagcatgtgtgcactaatcctcttccgttatcttactactttcccaaacttttttttcctttctattctatcatttttgtacctcttaaattattattgaaactaaataaaacaaatgaaatatggtagtagctagagtttcaagggtccatctcattcacgtatccgtgacatctagcaaatgcctagaaagtgtatgaaacgaccttattgcttttggtgaagacatatgtatatgtccatatctgaatttgtttcctttactgattgattggtcgaactcgaacttatccaaatacgatttccttttcattttttcagataactttgtacctacatgtatcatgcttataattcatgattgttttaaatctcatacatgcattttaagtagagattgtttaaacatcacttcagttatataacgaaactttagaaacatttaatttgcctaatttcacttaagtgtcctttcaaaagtagactgtatacatacactaagtaaaaaaacaagtaatgtaacaagtttgtttgcctaaaaagaaaaaggaaagaaagtgaaacaagttttgtgctcagctaattttgaagaatattttgttctacctggatttgtgagaactttatgattgactgtatgtaaaatatcgatccgcacatgcatgtgaatatgacttttgtgattgtgaaatgtggtgggactggggcgttgttgtgtgatataagtcataggaaagatacaatgaacaaaaatcaaagacaacctaattaaaacgaaaacctaatcaaatatgcaaaaaaaaaaaaagagaagtgcaaaaaaagatgtacgggggaagtccactcaataataggaaacatcttggaccactaaatttccaatcttactattcttatgaaacaaccttgtacctaactagtgacaattgaagtttcacacaaaatgaatcattgaaatttatcacatatctttcatgtaaacaagggtacacgtgaatcgttgaaacttcaaagtttatttcatacatttcacgtaagtaagtgttcacaagaataacactagagattagtgaactcaatctattagactattacttaccgccaacctccagtctcttcctacgttcaaacatttagttataatttgacgatgacgaaaatgaaacgaaacatctatcggcaacttttagctactgcaatgttttccaccactattacaagaacaacaatatcgtattattacgagtttgttttataactaaagatgtgtcgctttgtattttaaaccaagaggagttggtaatatatatctatctacctaggtgttcctttttttcgtcaaatgataatgacatttacaatattacactaataagaacgtaatttaaaaaatatatctgaatagtataggttttatatattaataccggcatgatgcactaaagctactctatcagaaaaatattcttgagcttgtagaatagtgaatttcagtttgtccccttgttggtacacaaattaataggattctccaaccttccactacgttaatatgcgaaaaatgtaacatagtcttttagactaaaacgaaaagttggttaatatttttcaaagaaaaagtaaaggagaaaatagtggaggtgtggattccacatcatcttcacacaaaaaaaatgcttcacaaaactctcgttgattagagaaataagtatagagatcaatttgtaagcctgtgttggcccaacttaaccttcaggcccataaaacatttcgatatgggcctaacgaagcatttagcgctttttcttgtttcctctaactccgattaaatctcgatcttttctcgtcgtaacatctccgattgcgatttatcctgcggctaattccaggacggcgccacaagtctctcgtctgctctctcttgctcaggtgattttgaatttcgatccgctcttttgttcctctccacacttgttttgttatattactcattgtatacgaatatatctgattcagagacgcttcggtaacgagaagtcctgatctgagagatacaatg

SEQ ID NO: 25142 - DNA, 3000 bp, Unknown; identical to SEQ ID NO: 25141
  misc_feature (1)..( 3000): 2750-1469P.txt file - cDNA_ID_2703326; gDNA_ID_2214636; Annot_ID_188124

SEQ ID NO: 25143 - DNA, 3003 bp, Unknown
  misc_feature (1)..( 3003): 2750-1469P.txt file - cDNA_ID_2703333; gDNA_ID_2214636; Annot_ID_136142
tctcgggagttatttcaatggctactgacactgagatgaggactagacctgttatagaagtcgcgtttaaggatctaactcttacattgaagggtaaacataagcatatattgagatctgtcaccggaaagatcatgccaggtcgtgtttctgcggtcatgggtccatcaggagctggaaaaactacatttctttctgccttggcaggaaaagcaactggatgtacgaggacgggtctaatccttataaatggtagaaatgactctataaactcgtataagaagatcactggatttgtgccacaagatgatgttgtgcatggcaatcttaccgtcgaagagaaccttcgatttagcgcaagatgcaggtaaatttattctcatatcatagaggagattgagagtccaattcttaaaaaaatacatttttattacatagtgtttatgcttcaaaaaaatgttgcatatcatttatttatatatgtttctttacatgcagattaagtgcttatatgtcaaaagcagacaaagttttgatcattgaaagagtgattgaaagcttaggattacaacatgtaagagactcgttggttggtacgatagaaaaaagaggaatctctggaggacaaagaaaacgtgtgaacgttggtgttgaaatggtcatggaaccttctctattgatattagatgaacccactacaggtttagatagtgcatcttcacaattacttcttagagcacttcgacgtgaagcacttgaaggtgttaacatttgtatggtcgtccatcaacccaggtatgttatctcctccatgaattatgttacaattttatgttaagaaatactttttgcttaataattggttttttcctcttattagttatacaatgtacaaaatgttcgatgacatgataatactagcaaaaggtggtcttaccgtgtaccatggatcagtcaaaaaaatagaagaatattttgctgatatcggaatcacggttcccgatcgtgtcaatcctcctgatcattatatagatattcttgaaggcattgtgaaaccagatggtgatataactatagaacaacttcctgtgagatggatgctgcacaatggttaccctgtgcctcacgatatgttgaaattttgtgatggacttccttcctcgtcaactggatcagctcaagaggattccactcataattcttttagtaatgatctatggcaagatgtgaaaactaatgtggagattacaaaagatcagttacaacacaattactcgaattctcatgacaattctaatcgagtaactcctaccgtaggtcgacaatatagatattttgttggaaggtatgatttttctagatttgatagatggaattttgtggttaatttcatatgtacattaaaactttagtctatctatttcagggttggaaaacaacggcttagagaagcaagactacaagcgttagatttcctaatattattagttgcgggagcttgtttaggaactcttgcgaaggtgaacgacgagacaatcgatacacttggctacacatacaccataatagctgtctgtaagtttcttacgtacacaaatattaatttacatttactagtattcgcgatttttggaacgttaactaagctcttttctgtatgtctttctttttttgtagctcttttgtgtaagatctcggcattgagatcattctctgtagataaattacaatattggagagaaagtgccgctggaattagcagtttggcacattttatggctaaagacacaatggaccatttaaacacaattatgaaacctttagtgtacttgtccatgttctacttcttcaacaacccgagatctagtttcgaagacaactacattgtactagtatgcttggtctactgtgtaacaggcatggcttacatttttgccatattgtacagtcctagcgccgcacaattggtttgtcctcactttctcataattcatatatgaaggaaccaaaattttcactaaccatatggtacctgaatttgctgttatgttcttgcagttgtcggtgttagtccccgttgttatgactcttatcgctaatcaagataaagaaagcatggtccttaagtatctcggaagcttttgctaccccaaatggactctcgaagcctttgtcctttccaatgctcaaaggtagaaagtttgaagatttaattcttctaacacataatcaaatcttaattcagaaaatttgattttggactcttttttttgggttaggtactctggagtgtgggtggtgactagatgcagttcattgtctcaaaacggatatgatcttagtgattggatattgtgtctcattgttctcgttctcatgggactaatatgccgattcatagcttatttctgcatggttacattccagaagaaataatctaataattacacatgattaaaaagcttacattttgtaaaattcttctatttttcatacgttaaatattaaatgagttatataagtagtttatagaattagagaagaagggattttagaattccaattttgtaatttttatttgtagataatggtgattattcatcatgctttttctttctttatatggtaaccggttttggtaagatagagtcatacagagaatgatatacaaagaaatcggtttattttcagttacgattctttggtttatatgatccggtttaattggttactaagatgatgtcggaaagagaatagggaagcggcgtaactaaaaaacacgacacgatgatgaattcggcgtttcgaaacgttcacatcactgcgtctcgtttgataaaccctaagcccttttcttcttcgattctccattttcttcctctctgttccggcgacgcttctcctcgccgttccaatcctctccggcatagaaactcggtgtctccttcatcttcctttcccttctgttcgacttcttccttttcttctttctacattcctatg

SEQ ID NO: 25144 - DNA, 3000 bp, Unknown
  misc_feature (1)..( 3000): 2750-1469P.txt file - cDNA_ID_2703356; gDNA_ID_2214636; Annot_ID_136125
tttcacattttctctcgggacaagaactcattactttggacgtactattcttcacggtggtgcaaaggtatacttgcttttatacatagcaatgtttccgtttttttcttttttcttttaaactttctcaaatgcctgtgcgttctttatttgatcaacagtatcgagcaactggcagaggttttgtggttcagcacataaagtttgccgataattacagactttattctagaagtcattttgttaaagcgtaagcccatttgttaatcagttacatatgccaaataacatttatcatgtggatgcttagtgaactgcttcttactaactttgcgcagttttgaagtagctctactgttgatcatttacattgcctatgggtatacggacgggggtgcctcttcgttcgttttgctaactatcagcagttggttccttgtaatatcctggttgtttgcaccctatatcttcaatccctctggatttgaatggcaaaagttagtactgtgcttgttacttggtcttcattccatttccgtattcaattgattttctctggtgacacagatggcactatgtcttaaattgtattggatcgtgacctgtaatctttcatgcttgatacaggactgtcgaggattttgaagactgggtcagttggcttatgtacaaaggtggagtgggagtaaagggagagctcagttgggagtcgtggtgggaggaagaacaggtctgtccaaaattttgtattttgatgtattaccgtattctgtattggctagtttttttactatttgtgttcctttacaggcgcatatccaaacattaagaggaaggatattggagactattttgagcctgagatttttcatgtttcaatatggcattgtgtacaagcttgatctcactcggaaaaacacttcacttgcggtaatgcttgctttttttccttctatcctcgtttaattcagttgagctattgcattccaatacattgctattattgcatgagtgtgcctgactgaatcctctcttttgtgttttgcagctctatggctactcgtgggttgttttggttgttattgtgttcttgtttaaggtgtgtactaagatgttcattagtgttttctccagattttgatttttttggtaacccatgacactaacattatcatgcctccttgttacttcagcttttctggtatagtcccagaaaatcaagcaacattctgctggcactgcgttttctacagggagtggcttcgatcacattcatcgccctcatcgttgtagccattgcaatgacagatctatcgattccagacatgtttgcatgtgtccttggttttatcccgaccggctgggctctactctctttagccatcacatggaaacaggtgcttagggtcctgggcttgtgggaaacagtccgtgagtttgggcgtatatatgatgctgcaatgggtatgctcatattttctccgatcgcccttctttcctggttccctttcatctccacgttccagtctcggctcctcttcaaccaagctttcagtcgcggacttgaaatctccattatccttgccggaaacagagctaatgttgagacctgatgaacgagagagagagagaagttagtgtggaagtagaagaagtattagacattttgtttgtagagtttgtagaacatcattggaagctcatagactcgaattttatatggttgtaatcttagttttgtttactctaagcttactgtttattgtcataggttgactatattttggtaacttgattttttttaaaatgagatttgttgattgtctgagatactttaatctttaagagactctttctagttcctgtaactatcaaattggaaattatattacactataggtagtggtcagcgggtgtctgtgatgactttattttgtgccaatgggtgtaatgttactaggcttagattggtacttgaagtcgtagcacgctgattatgtaatcattcattaaaccaaaatactgtgaatcataattttaggtaacagtcatcgtaattggtatatttttgtcgcaaggaaagatctgattgcttgcaaatacgtgatgacagataaacatcattgtctcagaaaaattaatatttcatgtggaatttagtagtgtgtggattcaagaagtaaaatttacccgtggtgacataagacttaaaaaagtagatttggaaaaagtaatttgaattaagaattaagaaacatctgagctcacagctcacatcgttctggtaataaaacacaaacagtgtagtgtggtcacgtaaatcgtgtaggacttgtcatttgcttatcactatcgcctaaagtcctcacttttaggagtagactagtaaacgcttctgactaaaatacaattaaattaagaaactgaggttcactaaaattccaaaatgaacaacaaaagctcactaatactcaaataaattcttaatcaaaagcattccgatatgattttcaattactaggatccaaaattgggacacaaaatttggattagatacactgcctacaagtagataattctcctgaatattcatcaatcaagaatattcatctaataactagtaaccaaccaaaaaaaaaagaaaaaaaaaactagtaaccaaccaccattgtttatttagacttgcttttaaaaaatttgttagttaaaaatataaaatggaattagacaattagtgggttctatgtacctctaaaacgagaaaaaataaatcagataccaaagagagaagattaataagatagttttgaggaagaaatcacaattagagcttaaagcataggaggaacaacacaaacatgggttcaagtacaacaacacgacgaatcacttaagctcaacacgacaacacctttgactctatctttctcatctccaaataaaaaccaaactaaaccatcacagaagctgaaaaagttcaaaactttaaggtacaagatg

SEQ ID NO: 25145 - DNA, 3000 bp, Unknown; identical to SEQ ID NO: 25144
  misc_feature (1)..( 3000): 2750-1469P.txt file - cDNA_ID_2703356; gDNA_ID_2214636; Annot_ID_188116

SEQ ID NO: 25146 - DNA, 3003 bp, Unknown
  misc_feature (1)..( 3003): 2750-1469P.txt file - cDNA_ID_2703360; gDNA_ID_2214637; Annot_ID_136157
atatccgtgattcacggtactaggttgtgacaaatcactgattctccaattactagggccttgtgggtctctatgtatcgactgaggcatgttcataaaggttgcggcagaatcttgatacaaatcggtttgaaccggtacggaaatctggttctgtaagataccaatcaaatcaaggttgttgggaattctgatgttctgatgctgctgctgagtccaagtgttgggaaaatcattcatttgctcaactctaaacttatctcttcggatttgttgaaaatctggttttatcatatccatctttatgtaccttttgatattctatcataagaaattaccaacaaattaaatatgcatgagttccatatatatagcaaattaattaataaacatctgtaaattggaagaggttttttttatgatcacagaaactacaaaagcgagttgtatgaatggaataatcgttagactgttcaaaaaaaatgaaattcttactaacatgaacttaaagatccaaaattaaaaccagtttacaagaacataaagattcatgcgacagggaccttttagctaacataatatatgcattaatttctatataaccaacaacaataacaacaaaagaacgacgacctttaattaaatttccaaatgaaaaactacaaaaaaaacagggaaaacacgaaatgagagatggacgaagtaaaaacacccagaaaataatactttttatataagaacaaaaccctaggaaacttcaagaacaacaaagagaagaagaacaagaaaacaaaaaataaggtgtgagaatataactagtattcggatttaaatttggtaatatatatcataatcgtcaagatttcaatttggaactataagtaccatgagcaaaacaaatactcgcgaggagaaacaaaatgaataaggtaagtggaagtgataaagacagatagatctcagaagaaaaaagggaacacaacacataccgatcggaaggtggccggaaaaatcgtcggagctccggtggtgagtttagatatgtatgtaaaccgaccgtgggagatagagagagagactgagagagactgagagagaataatgattgcgtaaagccgtaaaatctgtaatggtttttttcttgacgtattaaggtgggttttatcagtctttctattacacggtactgtacttactctcttaaaaatctattttgtcggtttttttccacgaaaattattttcttctttaaactgatacacatgtatcaatatccaaatgaaacacatttttatacaaattgaaacatgcaataaactacggaatatctaaaaaacaataaaattaacggccctaaaattaattttaactaaattctttaataaaataaaataaaatcataagtctataaagtattagttattttatggtagtttaatggttaataattgttttttcatatagaacataggaatgtggttaaatttcagaattttaatacacttttaacttaattatttgtttatatgaggcactttaagttttagaaaactataaacacatatgcaaaacatcaaaccaaattatgtttttgcatgtcttttgttgcatgctctatatatcctaactatttttgcttagtagtccactaaattgtttcgtttcaatcacaaccactcaagaaaataattacaatagattactaaaacaagttaacaacagtgttatttatttactctttttgtcgtaatgctttaaattacatgtctctttcttttcatcggacaactgttagtgtgtttttttgtacatcaggacaactgttagtttactcatgttttctacattgtacattttggcagtcaattttacggcacggtttccattaaagatatggacgtcatcttatggtaagctgcatcttttgaggaataatacatgtagacgtccctatttataatttttgtgttacgtaacttcccttttgttattaattaagtgtgtttatttggtcaattcactcaatcaaatcaaacccaacgccaaactgcaactatttatgtgattgacgcttcagagttgaaactgccacttttgtcagatttattatctcacttcccaacttttcttttccgtaactagtgaatttattcatgggaaactaatttaatgcatggtatatgatgcgtacaacaagcaatacttatatgaaaaaagatttagaaacaaattgtattggcttaactaaatcaattaatcatgtagcaattaggtgatttggagtctattctctgtttagaaaagtagtaactgttgtctttatgagagtttctgttttacttagcgggtaaatctactctaagctaggtgttttcatccacttaacatgtattttataatctcatggttttcacaagtcttaaattgtacttattagtttggtctaaatattactccctttgtttcattatattggatgttttagggattttattttgtttcagattataagatgttttacaagtttaaatttaaatttaatttgactatttgtgactatttatattttgcagttttcattatcattttttttaacaaaatctaaatactattttttatatacaaaatgacctaatatgtatccatttaccttaaacctcttatattttaaaacagagtgagtacattcagtaagagaatggataaaaacgaatttggaatacacaaactataaaagtttcttgagtactgtttctattattgggccataaacagtgagacaaacaggcccatagaagtaggtgaaaaaggcttattaagatcaacggttctctcgttacgaatgcaaagaatcttctggatcctttttctctcagctactctctccatttatctaataaaccctaacccctcctcccacactattcgtttacactaaccacttccttatccacaccaatccagaacgttcctcaaaaagctccctccttttctctcaaaatg

SEQ ID NO: 25147 - DNA, 3003 bp, Unknown
  misc_feature (1)..( 3003): 2750-1469P.txt file - cDNA_ID_2703372; gDNA_ID_2214637; Annot_ID_136145
ccaaaaagggaaataatttaaacaaaatatgattttattgacgttattttaattaagcttcagtcttaactcttaactcttaagtagtttcttaaatagtgtgtcaaaaaaaaaagtaagtttcttaatactgcttctaatttgcatgtcgtagtatcagaagttttttcaacaaaaaaatcattatgaagagagtttatatgaatatcgctaaccattatgtggaattgtggataatggataaattttgagaactaattggattcatgtgttgcctcacagtgagctgacgaccgttcgatcattgatatacatacacatatgatgaaaaaaagatgctaatttctcgttgctttttttttttggtcttttcaaaaaaggattgagacaaaaaaagaagagaaaaaatgatgaataattaggtacctttccgagaagcaaaaccctcgaaactctcatcaaatatcctaaccatacctttctttaaaatttggattttgcacaaatccatttacaaatttaattactttttcttttcgtaggtatatatttatttatacctttataaatatataactttataggaagaagtatcgtatagtactacttcctactcgctatacaataaataatacaatgcgaggttgtttgtttcttatcacaaagttgtaccctatgcaacaacattcatataatcatccttttcccgagcattttgactgatcaatgcttcagtgcttcttcattatcatacaacacgttccaaccaaacttgaatcatgtatttttcccaaatcccaagttacacctaaatgataccaaagattacaaatacaactaaacatactcctagttttttcttatggaaaaggaaaattaagaacactagttagatgcaaacaaataaaaggagaaamcaataaaaatatatatatatatatatgagtgtccgaatcgaacgaactgaataatgtggaataagtttgattcgggataggttttgttttctgaataatctgcaaaactgacaaaccgaaatcgaataaaccggtcggctcaaagtctcaggtttagatatagcccaaatatgattgcaaatcacttaaaagttatacggacaccactatttgatcaacataaaaccatgttctacaataaagatttaagaattttaaaaatgggttggattggcctgaaactggattggaaaaattggtatttcttcctttaactaaatggcacacgatcaatttctaatttctccaaaaataccatttcttttggtattactaggtactagcccatgaagataaaagaattcattttactttatttcattctagtatatttcttgaacaattctaatgcaatttcaatgtcttgactatactcttgatcctccaatcgaatccacaagattttctaccaaaaccgctttacgacttacacctcaatcgtaaccatccatgaacttaattcggccaaaatcgattattctatttggcacgttatgttatggactgttcatatacgtaccacgttccaaactcgtttgtatctaaaaaggaaaaattatctcacattagtgatttttttttacttgcatcaactctattactatatactaatatatattaccattaccattttgaacgcgttacatagacattatttagtcattagtcaaatccctttactatataatcccatttgaaatgtaagaattttgaatgttgacagatgcaaataaggattagcatacaaaattactttgtaacccttatttacgtgataaaaaagtttagcctatcgttccactattaaaaacatgaacatgtaaaagttgaattttctatcttttcttgtatcaactatcaagtaatttgcaagtacctaagtaaaagaaaacaaataaacacaacgatctttattactatatttaaaacaaataaaagatagacaactattaatttgtttatatgcatatcagtcctttgcaacgtagataaaagcggtattatgcaaataaacttttcttttgtcaattgtcgtcatcatgcaaataaattttcaaatatcactgtcattattcaaatttcaaaccctaataaaaaagcaaattaaaaaaatggtttcgtacgacaaagggcttaacgaaagatgataagaacaaacattaataccgtagcttttgtatttctaacatcagtaaaaataaaaaaatcagacctcgtaaccaatgaagctgccataaaacctgagatggtgtagttaaagagggaattatgatttgtgtcagctatcaatatcatcataattagctgaaattatatttattctttggagtttttatttatttatatttgaacatttattatacaaacaaattatatacaaatagtcgtaactcattttatttttctcttcttcttttgttattatttgtcaaaataaatagtcctttatattcgtaattcgtaaatcagtataaattaaagcagaagtgaaaacataagccaatagtggtaaaaactgttattctatctctattctggttctgcaaaaagcatatatcaatttataaaaaagtgaacagactaatactagtagagttaaaatagactgtagttaagttaagaaaatgtacgatcaacagcccacaccgccacagatgaaattacgtggaacgtggtaaaaaagccacgacggtaaaatagtaatttaattaactcttcgattttccttttaactctgaagagggcaaaatggtcaatgataatttcgtttatttagtcataaaaaaaccgggaatgcaaagagatgagggcaaaatagtcaaattaaaaaaccgacgatcttttagattccttttaaaacctagacgtcccactctcacacaatacacacaagtaaccagttttctctctcattttctcagtttttctctctctccgtttttgaaaagatttttgtttctactttgggaagctttccgctacaatg

SEQ ID NO: 25148 - DNA, 3003 bp, Unknown; identical to SEQ ID NO: 25147
  misc_feature (1)..( 3003): 2750-1469P.txt file - cDNA_ID_2703372; gDNA_ID_2214637; Annot_ID_188160

SEQ ID NO: 25149 - DNA, 3003 bp, Unknown
  misc_feature (1)..( 3003): 2750-1469P.txt file - cDNA_ID_2703379; gDNA_ID_2214637; Annot_ID_136147
ctaacttttaacttctctcaaggaattgaatataaactgatgcgtctattgtgaaaggttaagaatgttgatgaacgttttagttagtgagtttaataggttttgtttactgtgtaggctaccttgaggttggtacagctggataaagtggcagaaactctgtctcaccatgttatggagcatcatgaagtaatgggtaagtattcttgaattgagaagatcatatgcgtttggttttgtgagtattaatatttgcttttggccagtgaaggggatgaatttggtaagagaattggagaaagatttgaagattgcaaatgtcatctgcaaggtatgagtttcatattcttaacctaaattttacataaacaatacagtggttttattttctattttatctattactggtttgacttggttttggctgtttttgtgtgtttattgccagaatggaagacgaaatttgacttcttctatgaatgaggcttcaagagatcttattgtacacactcattccaaaaagaaacaagctcttctggtaggcttctcaatttatttcagacatctaggctccactgattgtttctttaatctgctttcttgaaatatttcatgtgttatagtttccttctgaaatcaccatcaatgtgctctagaactttgtgtacaaaattactctgtattatcatctatcagaaagtggccgagtatcttttttgttttaatctctaaagttacgaacaggatgtttctagcaagtagtttcttagatacaatctaagtgtaacctagcctaattttttgttttaattgctaaacatactgttgagattattattcctagcatgcctgtttgcttctctggataccatgtaataagagcgacatgaaagtttaatctttttacttgcaggatatgcttcctatactaactgacctccgccatgcaagagtaatgcagtcaaatcttgaagaccttgttgaagatggaaactattgcaaggttggtagtttaccatcgtctctgttgtatacttccatggttttcttatatgaattatggtgatgttatgttatgaaactaacaagagatgggaatttattccttattatgcaggcatttcaagtcctatcagagtatttgcagctgcttgacagtctatctgagttctcagcagcccaagagatgacccgtggtgttgaggtagttatagcttattcatgaccaaccattgtcttcataattttctatcgtcagtcggttgagcttctcatactcttttcaaggtttggttaggaagaactcttcataagctggattcactgttgttgggcgtttgccaggaattcaaagaagatagttatgtaatggttagtaagccaactcattctcatgtatctctgtagctttctcctttgtaaactaaaaggattgaattgtgggccttcagtttagtggagaactagaaattttgttcagagatttaacttgtttatgtgctcatacctttaggtcctcgacgcttatgcactgatcggtgatgtctctggtctcgcagaaaagatacaaagtttctttatgcaagaagttatctcagaaacccactcagtgctaaagagcattgttggggaggtatgtgagctaaatatcatttgttgctcctgtaggatgtagtcgtgcatgcttggatggttgaatgtattgagcttgctggtgtatagcgcaatcgttgtttttcctatttttttggtgcaagccgcaatcctttttctgtgttgcttagatgtcacttttgatcctagcagatacacgaaagtagcaaattgaaacctgcacattagtacaagttttttttacacgttgtgatttatcttatttcattctgcatgcaatctttgtcataggcggtaatgcttttttacttcatcatactgagcacgaatgagcacgaaatgagtttattaacgtcagcatatcaaaccaatcagattgttgatctattctctgtatatatatttgcttttgtaggataacagtgctgccacccaatatagtaggtatgctctatgcacttgagttattactggtacctattacattatctagtatttatctctggtcccttttgtttggattctagtatccttgctgatttttttatttttttttaattaatttcagacttacctacagcgatctatgccttcaaacaccagaatccaagtttaggcaatgtcttttgagaacactagctgtgctttttcagttaatatattcataccatgagataatgagtttcacgccagaaaaggaggtaggttccattccttgctttagtttgtatttaacattttcttattaccttgatagggttgttgaaacagcctctggttctaatttcagtactacagtataatatttgttggtagatctcatagtcttaaacacctctgcagaccttttacttattgtctgagccaaactatacctaaaacttctctctaacactgtagttagaggaaatcttagcatatggttgtaaatttactgtgtgtttgtttagtttggtggtgtggaactctaagaagacctgctttattgatagggatctatctcgaaatttattacttgatttcctagttaacatacaattaagtggggtttaatatctaagcctctgtggcgggatttaccaggttaacttactctatgttaggtaattgattgtccaagaatttggataagttctttaattttagtttaatatttttgtcttattccctttcggcttgaaagataatgggtcctaaaatcttttctctttgatggcttcattgctctgtatcttatacattgtcagcatccttaagatttttttctgtatgttgtcaatgttaatttgtttaaattatctctaatgggttctaacttctaagggctaagcttctgaactggaacaggcagaaattttggtctcacccagtcttgcaacaactcaaatg

SEQ ID NO: 25150 - DNA, 3000 bp, Unknown; identical to SEQ ID NO: 13567
  misc_feature (1)..( 3000): 2750-1469P.txt file - cDNA_ID_2703390; gDNA_ID_2214637; Annot_ID_136154

SEQ ID NO: 25151 - DNA, 3000 bp, Unknown; identical to SEQ ID NO: 13567
  misc_feature (1)..( 3000): 2750-1469P.txt file - cDNA_ID_2703390; gDNA_ID_2214637; Annot_ID_188168

SEQ ID NO: 25152 - DNA, 3000 bp, Unknown; identical to SEQ ID NO: 13575
  misc_feature (1)..( 3000): 2750-1469P.txt file - cDNA_ID_2703394; gDNA_ID_2214637; Annot_ID_136155

SEQ ID NO: 25153 - DNA, 3003 bp, Unknown
  misc_feature (1)..( 3003): 2750-1469P.txt file - cDNA_ID_2703414; gDNA_ID_2214572; Annot_ID_135090
tggaaaaccgcatggtacctaaatcctacaacaatggattccttttccttaggtatgttttcgtatatgtatttatcaatcgaagatttgtatggtttaatgaaatatttatcgtgtttttgttatccaaaagaaagcaaaatccaatagtcccgaaaacccatgcaaccgtgtacataataatatatatatttaaaaatccatgtccaatctccaaaccattttaaaacaagagaaacaatagtttgaaaatatagaaaattgcgtgtgagtgtgtcataattcataaatgcaaagacaaatgtttgatctttgattgtaatttctgaaactcacggactttcctacctctttctgatcttcccgaccccatcaacacttttttgtatctctatcacacatataaaatcgtattttgattaataccattttccagccattttgcctctgtcctctcctacttactcttctctcttatgtttccagccatcactcacgagcccatttatgaactttaaccctaaaccagtgtatatctcctcccacttatatatccctcacattatcattccaaactctctcaaaaaaacaaaaataattacttcaaactaaaacccaatgttcaacacaagagttcatattgtcattatcactctaaaccttttattcttgtacgctggagggagactaataccactggagagtgttccaagctcgtcgatgatgcctttatcagtcgaagacacggtcaaattgaatccgaggaatcagatttttcatgggacacaagtaaagagttgtatgcctaaagggttccgaccaagatccgctccgagccggtttgtaaattatcagcctcttgtttccattaagtgttcctcatctaaagttacctcccggtccaagatatcgccttgattattttctcttctattttgagaatttaattatacaaataagactgatgtgttgattcttttggtgtctatatttatgaagacgtatgtaatgcaaaagtatgtgttattttctatgcttttttattcaaatttttagttttggataactcttctttattgcttttattcagggttgtttttgaccaatttctgactaaattcatggtcgaaaattggacagttttcttgtagtagaaaaacaagaaaatgttaagtttgttacctcaagttcctatgtagtgccgaatagatgataacgcagttatatagttcggattttatttttggttgaccaaaattttcggggttttggtacgtagatttttgaactacaaacaaaaacaggctaaatgaatcattttcccaccgccgagaaccaaactcctggtcttgagagactcttccttttgaagttacccactacaaaaatcaagctactagccttggataggtcgatatattcattttataggaaaaccaagaataccaaatgaagcattttcttatattttctgtctttgcatggtgaaacttgaaagaaagaaaaaaaaaagagagcagaagagtaaattgctaaatagagtggcaatggaggaggagtatcatggatcacgtgaacgatttcaaggaaaatgatcggaaagagggaaataattgcaaatttgtgtatgggccgttttacttcttcaagcccacttaaaacttgccaccaatttcaacaaaaccaaatagtgtttcccattcagatagtaaatagttactcaaataacgttaacatcgagaaaaaatgaaaaaaaatctgtaagccatttatcatacaaacaatatttttttcttattttaagtagctggtttcttcatgcttgattataaagataaccaaatatcactttctttttcttttcttttcaattaatatcattaaataaaaagaagaaaagctgatactaataccaaaaaagagcaagatatttcaaaattttgtattatatcgtttaaaatgtcagcaatttgtttgcataattaagaaaagcactaggccaaacctttgttcagatatctaaagcttaaacgaacaaaaaagcttaaagttgaagttagtattttttttctttaaattattttctatattgacattttttcacaagagtattgtgaaaataggcattgtttaaaatttctaatagaaataaaaacttttttacttcaactaagccccaaaataactttatatatccaaaggaaaaacttaactaaaaagaaaaaaatccaaaggaaaaatataatatctgcaaaaatgccatagtgccttcaaattttaagaaatcctattttcacaatactttctataaataattctttttatgcaaattaagtttatatttttatacaataatatgatttttttttcttaaaaggtaaaaaaaatggaattttgctcacttttatgtaattcgttaaagcatttggtttcagacaaaacaaaaaacaattcccaatccatttttttgtttctttatttgcggaacccaaagggtttggttagagagacgtcgtcacttgagagctctctcactcttgctaccaagaagagattctccagtctctgtgcgtctttctctgtggatcttacttcactcagatccaggtttgtctccttctctatcttgttctcatcataactcgaactgagtctcttctcctgcttagtcttcgtttagttgctgagaaaatctatgaacttgaagttactctgtttcagtgtctcaataatgcagaaactgaaaaaagttagggtttttatgatttatactaagttacttaattaggaatcacttctcactagtcactaaactgtaatttagtgagcttttggaaaaagtttagatttttaatagtgcttcactgattcctactatatatagtagtctcttcacttattggcctttttgttttggttgcattgattatggaatctaaacattttattgtaaaatttgtagtttctttggaacattttgtgttcttgaggtgtcaaaggatg

SEQ ID NO: 25154 - DNA, 3000 bp, Unknown; identical to SEQ ID NO: 13597
  misc_feature (1)..( 3000): 2750-1469P.txt file - cDNA_ID_2703430; gDNA_ID_2214638; Annot_ID_136190

SEQ ID NO: 25155 - DNA, 3000 bp, Unknown; identical to SEQ ID NO: 13597
  misc_feature (1)..( 3000): 2750-1469P.txt file - cDNA_ID_2703430; gDNA_ID_2214638; Annot_ID_188214

SEQ ID NO: 25156 - DNA, 3003 bp, Unknown
  misc_feature (1)..( 3003): 2750-1469P.txt file - cDNA_ID_2703442; gDNA_ID_2214638; Annot_ID_136164
tttagtcaatgctggaaccaacaaggcggcatcaagcggcacatctctgaacacaaaaatgcttgatgatgacactgagaaccttactcgtaagtcttatctttaatcatttggtttattaatggtgaattgatttccctagtgtctagaatatggtagtgtcaggctctgtatctaggctaatgtgttcatttcttgtttcaaagtgttcaacgtattggaaaactgttcttatatgagtagagtctgtctatctttctgcctgtgagtctttgatggttatagtgagaggaactttttattgattgatgtgtattggatgctgaagcttcatgttttgaattatgcaattgtgaattcagatgaacgtgtgcctactgagctaaagaaagccattatgcaagccaggacagacaagaagctaacccagtcccaacttgctcaagtatattatccttctctctatatgtcccttattattaccctattttgtaactcggttcatgacaaagtgtttgtttctttttgtgtagatcatcaatgagaagccacaagtgattcaagagtatgagtctggcaaagctatacccaaccagcaaatcctttctaagctggagagagcgcttggagctaagcttcgtggaaagaagtgagccaagttctactgatgtagcaagtaacaagaatcaatgctttcgtctaatgccgtaactttgccaagaagaatattttctgattgtaagaaagcaaaaccgtttgaatgtttgtttcgttgatggaatctctatctcataaactcatatcaatataataacttgggtcttttcatcacatagttgaactgcttattgttgatttatcatgaccttagagaaaaatacagaaatacaatttagaattcaggtacaggttcttcttcaacgggagcaagaacccattcaccatcttcgttcttgatcagtcctttgttcttctctacccaccaagatcctggcaccaaacactcagctttcaagaactcgcatgacttgttcactaatgcaatacttctcttaaccatcagtttaaactctcctttcttcccattccatccagctacaacatgtaacatcgcctgcacacatacatggaaaaaatatgtaaaagtttctactctgtatcgtttgagtcaaatttgaaagattcttctcacagattcttacctgaagattatgccaatcccctggattccttgaatcgcttaggaacggtgacttctttgtatcgatcacaaagtttattcctatgtccacataccctaaaagtccccctgggtatcgagttaagagatcaatcgtgttccttacatggaggatctttaagttcttgtgactcattacttcgtctctgaactccttgtttcctacctgtggacaaccaaagactatagcagtgaccggaacatcatcactggaaccgttctcagctatatcataggcggccagaacagcctctgtagctcccaagctatgtccagtcaacacaatgctcggtttctcgtccttatacttcaacagaagctccttgatcttggctaacaactgtgaccgtagactcagcttagtgaatttcgattcggggtgattagaagtatagattgtgagccacccgagcatcaccttacacccttcttcatcttcactgtcactatcaaaagtcgtaccttcaactacaccaccagaaccatcctgctcgggtccgtgcagcaaggggtcagctgaagttggcctagcacccaaaacattgacccactcatagttcctgctcgttcctctcaaagctatatagatctcacggcgtcctaaagccttagaccgttcatcagacgtgacagcaatgtagccaaaccagttagactcacggtcccaagaatctcttgattgtgattggagaagcaaaccttcggggagagaaacacgagctgtggcgtagaggaagtttacaacctcgtagtcggaagcgttttcgagcatgaccttgtcgaagaaagaagatttgccgtagcggctggctccacagtacttggagttttggtcgttgacgaaggcatcgtaggtggcttgacaaaagtcgccacaacgtaagatgagttccctaagtgattggtctaatgggtctaagatagtgtcccaattctttgagcctaagagttcttcccatgatgtggttgttgtagccattagagagaaatggtgtgtgtaaggagataataagtgactcttgactcttaagttgtttaactttatacaaatggttgtggactggtgatgatgctgtctgacccacttatgtccaaagcgataaaaggttatcactggtgtgggaatattattggcatatagaattatccacaaacttgcacatcattctcaaccatacaaaaaagagtaaaaataaacccaatcaaatagagagaagaaaattcaaccaaatcaatcgatacacacgaaaagagacttattgtttgtttgcaactaatcaaacgcgacgacaggcttgtcttcgtcgtccggaatggccatgacccaatcaccagcctcggtcttgagcatgcctttgtttttcgcgaccccaccaacacccatccttcaatagtgcaaatgatttgttaaccaatgttatgtttcagttaatcactttcatctccaatatatccccctttgataacattgcatcctagacccgttaactaatatatgatgggccataataaatcaaagataattcaaagcccaaaaagtgtaaaaaagcccaacaaagtgacgatcatacgacgaacgatatcaagttaagctatcatgttcgtcgtcggtgagatttcccggcgaagcgaaagcagtgtttctccggtggttcaggcatcagtctgatttcagacaacacatctcatagtaatttgattctaactggcgatttcactctagctcgaccaattgtatccaattctcgtagctgagagcaatg

SEQ ID NO: 25157 - DNA, 3003 bp, Unknown; identical to SEQ ID NO: 16500
  misc_feature (1)..( 3003): 2750-1469P.txt file - cDNA_ID_2703454; gDNA_ID_2214638; Annot_ID_136169

SEQ ID NO: 25158 - DNA, 3003 bp, Unknown
  misc_feature (1)..( 3003): 2750-1469P.txt file - cDNA_ID_2703461; gDNA_ID_2214638; Annot_ID_136172
tggactaattacgtgtggacccttttgctgcacaacacacattaacacacaagtaacaagtgcaatcaaattcaaatgtcagactcataaaagtcataatacaccattagaattgttgattaattacttgttctttccgttatacaattcaaattgttcataaataagaaatttttatatgatgcgtacactgtaaagtatatgatgtattcaaaatttattcttattattcatttatatatttacaacgtagataaaaatacatattactccaaggttcattttggctcttccaaggttcgaatatctttagatgcgtgtggactcaaagggagcgtaggaaaagagtggagccatcataaataaacaaatactaatatttagaagcaactcgttataattatttagcaattcttttcatatttaacatgtggtaagacatttccatcctatacctaaaagtgaccaacctctctgcaccttaatttgatatctctcaaccacgaaaccaacttacaaaataaaagagttgttggttagtcttacgtacatatacgattctctacttctctttcatatatgtaatctatcaacatgtaatagtgaaacacatatacagtcaatcaaggcgtccacaatataaagtatatctggagattagttttcttttggaattagttctttggttgtaagaaaataataattgtagcaaaccagattatcggggtcgggattcatcattttttatagggtaaaaaatcaatctagtggtttaatggttatttttaaattaaagtagccgtactatatatctcaaaacataaaaatcaagttgtttctcagtacaacaaatatacaatttaaacattattaagcctaaaattaaaacaataatatctaaaatacggaatacggtaaataaaggcatttgaattcataaaataaatggtggaaaaatcaggccaatcactgagaataaaattaaaaggttaagtcataagattcaaaagtttaaagtaatttgttactgagagttaaaatgataaaaattcaaaaattatacagtaacttctcgaaactaataatcccaacacccacaagtagttgaactcaagaaaaacactcaaactaaagtttttagaggagatagttttccatgagtttgatcagagtaacacattagttgtgcgatactcaaagaaaggaaggagtgaggatgagaagagccttccatagtctcttggtaaacagtaattttgtatttgaaacctttcagaatgatatattatcactcagcgaggctgaagaatacaaatataaatgtaactacttgctcatagttgaagataagtagaagttccaaaacacagaacccatggacatgaacgctactcgagcttgaagcgggactaccctgtaaatttcacctttcatcagacctcaatcctattatacataatcacacaatctataaagaccctctccaaatgacttaatgatagagaaagaaagccataccaaaagttaagtatgctaacgggaacccagaagcgaaatcctgcagtaatcccaagaacagtaaatatttgaacgatgctatgtaatagtaaaaaaattactctctgtaattggtagctcaccataaagaagcgtaggaagagcatctttctgatacttgtttccaagctcagagagctttcccagccacaagttgttccaagcaaatataacagcaatcacagatggaccaaggattacttggttaagcagaacctaacatgggatcagtataagcagtaaaaactatatcacaacgtgttccaagtacaaattaacaaaacacgcctagatttgtaccttaagcactagatttgtcgcagttggtttaggcaaagaatgatcaaggaattggtaccacgcataagaaccaggaccatacaagagaaacccgtaagaactcatccgcagcgcacgaatccagtcatgttctgagaaaatgttccacaattccccctaagtaaaacgatccaatcataaatccttagtctcaagccaagttccaccaatgtacgagaccattttgcaagagagtaaatatgagtcaccccaacaagaattcaaatcaaacataacctaaccaaagactgtcactactcactaaacaaccatactcaccaacatttttggttatgcaaagatccagtttcagtagaattctcactataccacactaggaacttgattcatgtaatatttcaaacaatcaaaacattcactaaaacctctaaaattcaaatctatgactcgaaaataaccaaaacttggtcagagacaaacctcgtcaagctcagaagatgattgtttaagagcggttctctttttccatctccctgatagctgagcaatcgtgtcaccggtgaaagtgagtgctccggccgtcacagcttgcttcaaaggaaaccgataaccgccggcgtctctgctcacatcgacggaatccgacgatccagaattacgtttcttacctctatcaccggaagacttcttctttctccgttgatcgaagccattccatccccagaaaccaccagcgccgccgcaaccacccaatgcgtccattaaaaatgcttccttttgcgtcgaaacagagaagagttttgcctaaatcttaaaaatcgcaaatgagtcctgtccatttgttttttccggtttggttcgattccaatttattggatcttgggttttcggaaacaggtcaaaagtcaaaccaattctgaaccgaacgaatgttatcaaactgaaaggatcaaaccaatttattggatcttgggttttaatcagtattatatctttttgaggtctctatatttatttcactgaatttcgatttattttgttcagtccatatgattcggtataagaattaatctatagtttgagttaatattcggttcatttattttgatttggttcggttttatgcttagtgtacataaaacgatg

SEQ ID NO: 25159 - DNA, 3000 bp, Unknown; identical to SEQ ID NO: 13586
  misc_feature (1)..( 3000): 2750-1469P.txt file - cDNA_ID_2703469; gDNA_ID_2214638; Annot_ID_136175

SEQ ID NO: 25160 - DNA, 3003 bp, Unknown
  misc_feature (1)..( 3003): 2750-1469P.txt file - cDNA_ID_2703484; gDNA_ID_2214638; Annot_ID_136183
tctatttagttcaagtgaacatataactcatatcgtggaccaaattagatttcatagttagttcacatgatggaccaaacttagatgttaaaattttgtacatatcttaaaaactcaacggccttgaaatatgatgaagttcaatttgttttaagtacatagccgagacaagtttgattcatcttgtagataaaatactagaaaacgttaacaaattgtatatttgcttatcttttgcttatactctacttatgttttacataatttttgtttgtttatatttggccgaccacaaaaaccaaatctaattatggcctttaccggaactaatttttgtattggtttttattttattttattttattaatttggattgtaaaatccagtaacaattttactatttcaacgtaagtaatgtagagaaaaatctcttgcaaaaagaatttacttgttcgaaagtaaactatataactgctgacaaagacaaaaaaaaataaaaaataataagagagtggcttgtaatatagaagaaatataagggtagagggatggcaaaaaaaaaagctaggtaattcaccaggagaaaattttacatttttactaaagtattttatatgtttgaaatctattttaacaggtttccgatggagatcttgtcatttgcttccccaaacataaccaaccagcttttgcccatcctcgtttaatacatctcaagatacaggtttgtttctttactttttaaattttgtttctttactttttaaattttgttgctcgattacttatgattcctagaatgactggaactagcaagaaaagtgaatggcgaacatcagaggcacacgtcagtaccgccaaatgtcctgaaggtacagtgccaatacaaaacataaccgttttggatcatcgagcaaaaccagaaagaggcaataacaatactagtttcatcccctaacatgaggtacataaactactagtttcatcccctaacatgaggtacataaactgttaaacatatatctatcattgtacttctctctttggtaatacgtatttctctctttggtaaaaatgaatgtacttctcgatttttagttttgaagaaattaaatgcattattaattggtaagtgtttttttcccaaccgttttgtcaatatattattttcctaatatttgtgatgatagagtgattattttttacatatatagagattatattgagatttgttttttttttaaacacatctctagatttgttttaggtccataatagacttcgataaaaaaaaatcacaatttaattttatgaaaatacaaaattctgcacgagttgtaatactagtatgatataaatcacataccaataaaacctcaacattgttttgttttgtaactgatcactttgacaaaatgcaaatccgttaatgaaaaatttatgtgacttttgacttaaactatttttcaattaaatttatcggataataaatgtgagaatgtcagaaatagttagaataagtaaatgtgatgaattttatttattcagtttacatgttaaaaagtcattcagaaaacagcaaaagtatttaaaataaagtaacaactccaagttttacatttctgatttgcatcataagtgtatttgtgactttttaagtccgtcctagaatttgttcttacaagttgatcataataatgcgagagatgaatctatgagaaataaagttgagtatcagactaaattttctcatcgaatgttcaatgttgcatccttgttgaccttgtccccaactatcatatactactactatatttcaaaataagttccgacatattaagaccaaaataatagtggtttttctaacatgtaattaaagcccatattttaaatgttgattagggcccataatgttatagtatatactaataattaattatttgattatttaaattattataaattttttgatatacattacatatgaccataggacatatagataaattcctgtaaatattaacatattagatgtcaaaatatttttccttgtagagtttaaaacaaattatcagtgtccatcaaaagctggtttaggttcgtgtcaacggttgggccgaaaaaataaacgaatttcaaaaattatagactctaattaagtaggattacttattttgattgtaatcactacataaataaaataattaaatatccattttttctctctctctttctcagtttttttttttttgggtaagcgtttgctcgttgtgtaatttcccggcaacggaagagaggaggaggaagagtgtaagcaataaattcctcttcttctacgaaacatttgctcttctcctctttctcttctcttctcttctcctttgcttctccgattctcttccttttttttagtttgatccgactactcaagctttttttctgttcatggtttcctccatcatcgcaggtactacttcacttcttcttcgatgaaatttctgctaatcggtttgatttttggttattattcatatgaaattttgtattccttatttgtttgactgctctatgattatcatgtagtttgattgtgactgttctggtttttttttactcaaaactgatcatggtttttaacgagaaaacaagttgatactctctttggttccgtggaattcactgatcatcgaatcggtttttgacctgtttcaaaggtttaagctttgatttgagtttattgctctgtctctgatgatgttttgtcgccacaagcagcaaaattttctattcatcgagttgaccaactcatggtcttgcttcgattttcttcttctcagttatgtttgttgatgtatggactactaggaaacacatgagtagcttgtgatcgagaactaatgatcttagcaagttactgttctgctttatgatgcaaaatcagaaatcaactagcaggtctttgatatttgattcatatctgcagttgcagaaggcaaaaagatg

SEQ ID NO: 25161 - DNA, 3003 bp, Unknown
  misc_feature (1)..( 3003): 2750-1469P.txt file - cDNA_ID_2703523; gDNA_ID_2214639; Annot_ID_136215
caatgacccagtaaccaagaaggtagtccggttcattgtccgggtcgggtttaaaaacattggacttcaaggtaaatctctaatagttctgatatatgtgacattaatggttctgatatatgtgacattcaattttgaagaagaaagtctctaaggtttgtgctttgacggaagagtatggagcttcaaaaaattaaccttctaatcggattagatctcaagatctaaaaattcaatagagatatggaagtttaagaaagcgcatgaagatctattaaagcatggtattgtggaaaagattataacaaaaagaactgaatcatttattctcagtagaaatcaaaagagatttggttgcttatttgagaatcgttaatttttccacatgattaccaggtcaagaaagaatcattcgactgttctctctttgccggcgaatattccaatccggcgatagacaaaacagagatgacgagttggacgcgtgtaaacaagtcaatgaaattcatttgtacggcaccacgtttagagatgacagagtgtgttgctttgcctaagagttttcttgttgggcttggttttcatttttaggccttgttataaataatggcccatgtttgttttggtttactagtgtccggtttttttggctctattaataataatctatgttgcatgggaactcttcccgtagtgcgtttctcgttttcgaaacgtttcggaaacgaaattagacgattaatattggtataatgggcgttcaatgtggaattaggcgaatttgttgattcgtgaattgattcactgcaaataagcatcaaaatcaatcgattttgaacacctaacatgacatatttgcctctttgtgcagctagtcttgttgtctcaggaatatatcatccacaaacattaaaaaacaagcgaatctctgaaataattgtaagtcatgtccaagtatttgaaagttttgtagatttttggtgtttttatactatagatcttctagtttgtttattgtattagttgttgctttctttagggttggtatataaatggtagagatatactctgtttgtggagagtgtgaacaaaatgataagttttagtgggttttcttgtagacacaaacaaaggtggatccctttgtgaggtagatgagaatatctcattcaagggcttagttgagagtgtcattgaagatttcagatttgatccggtgagcgacgaagtcgtcgggtttttcgaaggcaaagctgttggatttggaagaaatgagattagatattgtgtattttctatattttattttaattaatttttagaggattaaaatttttgtgtgctatttgtacaagttttaaaagaatgtgtcatttttgcaataataaacctttttagtgtcatttatgtcaatctcctatattttaacacttatagcgaattataaatttacaaattgttacaaataagtgaattatttttatggtggatataaatataaatagtagattatttttaaacttgtaaagtgatcaaaatactaaatagtaaagagacaaaagaggagaaaaatgttttattacttctcttgtaattgaaataatgaatgtcatttacaacgatcgaaatcgtttatgtagacgtaaaaaagttaattactatgcatacataatgacaatgaattctacataatttgcgtaacatttattatatatatatatgtacatatatttttgacgttgcgagaagtcacatttattaaattttgtaaaataaataatttaatttcagtttcccttatcaaatactgttctcgtatttaataaagtttaaataactttttacaaactgttcagacctggtgaatatagtgtcttctccaaccgaatggacgactttctcagagtatttggaggaattacggaacaataagaaagaattcacaagtttttcttcatctttaatttttggtagtgtaaatattatagcggattctttgacaagaaaaatccgtatcgaaccgcatcatattacctatgtaaacaacatttcttaggaatgactcttttaagctaaattattagcggtcgacaacaaaaataaaagaaatttaaataactttattatttaaacttttactttaccctttaaaaccaagttaacataataataagtatgaaattagcataaaacaatatccctaacagaattagcaaaatccaatcattaaatggactatatatggaaacctgcctctacagttgttcttgagatcaaaaacatcctctgttgtcacctcgatctcttatcaagagctcaacagatcatccgcccatgtccatctctccttgtcacttggtttggcgtttttcagtagaagattcagttggtttctcttctggacctggagccttgtttcggtttttggcattttgccatctatttggacatgcggcctaatttcggtttttattgtgtatttgggcctgtaactttatttaaacgttttgtcatgtatattgatttaatattattggaaatttaaaattaaataaaaaaatggactatatacttaaataaaaaaaaaaaattcttttttatttttactgtaaatcctgaacaaaaaaaaagaaaagtaaatctgcaataaatggctcagttaacaattttgactcagttagagatcctctctctcccgtatctattacagaacctgttaaactgagagactgtttaaagaagatttacataaatctaaactccacgtggcacgtatctatccgaatcagtattaatcccatcgaagaagaaaacaattcttcatacaaaaaaaactctcttctcaagtctctccttcttctccgtccttcccaattcttccgttcaaacaaatttctccaaacccaaaccctaatttcctccgtctgtgaaatcaagggttttctctgatctgggttttgatcagaaatcagatctaggtttaattttcgaaatcaaattatg

SEQ ID NO: 25162 - DNA, 3000 bp, Unknown; identical to SEQ ID NO: 13620
  misc_feature (1)..( 3000): 2750-1469P.txt file - cDNA_ID_2703554; gDNA_ID_2214640; Annot_ID_136223

SEQ ID NO: 25163 - DNA, 3003 bp, Unknown
  misc_feature (1)..( 3003): 2750-1469P.txt file - cDNA_ID_2703558; gDNA_ID_2214640; Annot_ID_136218
tgaagacggatgtggtgatactccctgcaaatttaacaatacttttgaaatttttacaaatctatcgacttattaaatcaataaactcaatctaaatccaattcccattaacatttcttctaaatatgattatggatatcattatagaattacctgtcataaatgtggtagaagcattaccaaccttcgaaaagcgtacaggtggaagatatgattaaaccatcatgacaagcgtctggatttttagatctaggagttcttgaagacggatgtggtgatactccctgcaaatttaacaatacttttgaaatttttacaaatctatcgacttattaaatcaataaacttaatctaaatccaattcccattaacatctcttctaaatatgattatggatatcattatagaattacctgtcataaatgtggtagaagcattaccaaccttcgaaaagcgtacaggtggaagatatgattaaaccatcatgacaagcgtctggatttttagatctaggagttcttgaagacggatgtggtgatactccctacaaatttaacaagacttttgaaatttttacaaatctatcgacttattaaatcaatcaactcaatctaaatccaattcccattaagacctctaaatatgattgtagataccattgtagaattacctgtcataaatgtggtagaagcattaccgaacctttgaaaatgtaaaggtggaagatatgactaaaccatcatgacaagcgtctggatttttggaatctaggattttttgaacatatagtgtggtgattttttggggagaagagatcattgttgatgtatgttgcctgagttatggccgcgacgaaaaaatagactgaaatgtgtgaaaagatggtataaatatctttacctaggtttctaggttttgattactgggcatgtgaaatgggttttaataaatgggcttgggcttgtaaaattgtggaattaagctattgtaatcacgcatatgagttatctaattggataacttattagattgtaataatgagggaaaaaaaaagattattataatgagaggtccacatttaaaatgatgtgacactcttagcaaataaatataacatggcaaaatttagaagtgttgtcaaaaaacgataagcgtaaaatggaaattgtgactgaaccaccataagaagcgtctggatttttggagtccgagagatttagaaagtggagtgtggttgttttttttagagggggaatgttgttgtttatgccattagagtcatggtggcgtcgaagaacaataagtatatgtgggaatcagagatgtgtgtaagagaaacaaaaatttatttggttgggttttgaattttcaagaaaatgttaaattatttcatcgagtttctttttttttctctatgttaggaaatggtatggtcaaaatctattgatgatggtgatgcctaacattaacaaaaccaatagaagggagacaagagacataagacatcttcttgaaattcatcaacattacaaacttactaaaactcctcctcccaatcccaaatgaatatgtacttcttaaagccacgtgtctttctctttttcattaatatttatttatttttttaaaatgtgaaattatttctttggtttaatatctctggatcattcttctacaatgatcacaagtatttagatcatgtgtaaatagtcccatcatgaagttttaattaccaatcggtattgcacatcaccgattggtactgatccacctgcacttttgtcgatcttttgggacaacgaaaaagaaactaatttaatatattttgttatccgctcgaagatattaattataagctttaatttggaacttctttatatcaattatatatatatataacttctttgttaatagaaaatgggaacgatccaaaacttaagacatttgatctccacaaggccgtcgacgtacagagaagaagaatggccaaaaataagtaaataaaagagaagaaaccgaggggaagatgattttgcattgccacgacccacgagcatccatcggccatcgcctttttggattcacatggcaaagacaaacttcgatcttccttttttctcgtgaagttattatctctctaatttctagtctggtcgaacctatatttcatcatatatatcattatttaattcatatgctgatgcatgggacattatcatgttaagtcattacaaaaaaataaaaataaaaataacttacgttggactctcagtttaccttctcctatggatttcacttccttgtataagaatatacatcttactcaaatcatgatttatatgcaattttcttttgtgagattttttttacatataaaccagaaatgttgaaagaagaatatccaaacacaacaaaataatagaagaaatctcacgtagaacatggaaatggaaaaagaagtgaactcgtgaaccgatatatttaccaaaagtgcacacatagacaagtctttctcattaaagcccaatttcacactttcacattttcgtgacgtcttttgaagttttgaatacgaattaatgttcatgtacgctataaagacctaaaaggttgtcatatttctccactttcatcttctcttcacaactatcctaaaccttttttccttttcttcttcttcactctctttcttcccggcgtcactatggcggctgccgccgggtaaaggcagcgaactcgaccacatcaagaatgaatccgttgatctggtatatatatttacgtcttcttagttttctattatctatatgttttaaaaaatctttggccctactaattttaaattttctgttacataaaagatacatatatgtatagtacgtaactagtaactactttgatctaatcagttaatatatttgtcccatgcgatttactcatgtttccattagaaatgattagtcaaaattatataaatgatgggtctaggtacgaatacccatg

SEQ ID NO: 25164 - DNA, 3003 bp, Unknown; identical to SEQ ID NO: 25163
  misc_feature (1)..( 3003): 2750-1469P.txt file - cDNA_ID_2703558; gDNA_ID_2214640; Annot_ID_188285

SEQ ID NO: 25165 - DNA, 3003 bp, Unknown
  misc_feature (1)..( 3003): 2750-1469P.txt file - cDNA_ID_2703562; gDNA_ID_2214640; Annot_ID_136222
ttgaactataacaaaatcccaaatcataaattttaacttaagggtttcaagatttaaccaaaaccataacactcagattcgcagatgagacttgccaagaaaagtataaagatcaaattttcagatcaagaacatagtaaaagacaattatagatacattcatgagtcaaaccaaaccaaacccaaacttacttaataggaagagagtcttcaagagaagaactaaacgaatcaagtgttcctcgttggcacgaaacggcgtcgtcttcttcttcttcctcctcgttttcactgctttctccgatagacgacgaactatccgaagattcctccggcgacttattattattattactcatccttaatccaatcccgatctgtgatccaccacgtcctgattcatcagccaagaacagagccgtttgaacagccttatcctgcgccgaaacaccgcgatgatctctaacgtacgccgccatgccgattccaaacgacgaaccaaccataacctccatataaacttttccgattaagatctctttctctagcctgtgaatatacccgaaagactcagatgatcataaatcgccggcgatgtgcgtaggtgaagagctttaaccagcgcaggttaatgatataggaagagagatatacaaaagaaggtgaaatgcaaaacaacactgaacgagaaaaatggaataaattctcatttacatttataacgacaatatcgtataaaaatacgattacgtattgaatacgaatatttatacgtatttatgagtctggaaacacatgttcctaaatatagaatagtcctaggcacgctaacggcgactttgacggtatagacacggtcttgctgacgtggagagttttcattggtttaagtttggacttttgccggacgtttcgggttactgtctccgtttaatccgatgtatgtcgttgtaccgaaagttcggtggtcactatcacaccatatctcaaccttatccatttatattttgattttgtttctttaaatgttttaagatgttttagaaatatgtggaaaaagggaaaaaaatcttgattagttatatcaattcaattggatggataatatttggtatgcaaaattaagatgctgatttttttctgttaataagtcaaaagattacaaaaatattcgtgtatgatttactttatgtttttaaatggaaattaatatatttaaaaatatataattagtactatctgaatgattagtttagtacaagtggacaaattaaaccttatctcgtttacttttagtacaattaaaaccaatatcgttaatgatacaaaaaaatctatattataatgaaaatttgctaatgctggattagtgcggaagcaagaactttgactcgttcaaaatgcgaatattggtttattttatactttaattagcaaattactttgctgagtcatgaatgtttaaaatgtaaaatgaatccaaaatcatctattttacaatatcatatacatgagatcaaattattgtatgatccaatcctaagattttaaatgttggtttttatacagttcaaagcaattaggttttgttataatcatgagttgatatagatcaaataacataatatatggagggatatcattagaccaattagataaatctaaccttatctctttaactgataatcttgtttatgaaatgtggctaacttaagtctattaattgtgtctaaagggtatcttcctgtttagctttacctctggcattttattttagaaaattcaatggtggactatgaaacattttttaagatattacttttttgtcatcctgttattaaattaattatcaaaatctgttaagctcttaatgttaatgtatttcctcttgtttataattacgttgttagactttagatcttgacgatgatactgaaaagaattggtagtttgacttgtataaatcgaatatgtgaactagctgtgttgttgtttgctagtgacttgatgaatgattgccgcatttttttttaattgaacatgttagttgtgtgtatacttgtgtcgtgtgtatatttgtccgcatttatataatcgagttgatagacacaaaattacttccaacactcgtataacctatatagccagtttaaacttttgagtcttaagtatataagtttcaacccatcaaataaatagatgggttatattctcccataagaaatctcgaacccaaatttatttgagttgggttgagtcaaccagttcaattaatctaatggataacattttgcatgtatttatggccccataatatagaaatagatctggaagcccaagcccaaccttctcccacttatactcagagccgacatttggtgtcggcaacgccaatatattattggagaagttgaaggaagactcatgttgtgtggcttcagagagtgatgccaaaaatacgagaactagacagacccgtgagtgatatcaattgttttactcttcgacacagacaaatgggaaacacgcttaccatcatatattcatataccttttactcaaatgaaatgtgaaacctgatctccaagactccatttttcagcaacttctggggccaagtttttgtatcagacgcatcccaatatgataagtttcacttcccaagtatttggtcttttctagcatatatattggatttatctaaagaaaactatacactaaaaatggttagcaaaaaataacactttgctttaagtattaacttaggtcctcttttaaaaccttgcttaggtaaccatattctctattcagtcgttaaaatctttattaatactataacccggcttttgtttttatttttcagcaaaaaaaaacacaaacacacacacacatttaatcagaaatccagcaaggtccaacaagaagaaaaaacacaatcaaaattccttataaattaatcaaaacactagctagacagtagacacaatacaaatcaaactaatg

SEQ ID NO: 25166 - DNA, 3000 bp, Unknown; identical to SEQ ID NO: 13624
  misc_feature (1)..( 3000): 2750-1469P.txt file - cDNA_ID_2703576; gDNA_ID_2214640; Annot_ID_136230

SEQ ID NO: 25167 - DNA, 3000 bp, Unknown; identical to SEQ ID NO: 13623
  misc_feature (1)..( 3000): 2750-1469P.txt file - cDNA_ID_2703588; gDNA_ID_2214640; Annot_ID_136231

SEQ ID NO: 25168 - DNA, 3003 bp, Unknown
  misc_feature (1)..( 3003): 2750-1469P.txt file - cDNA_ID_2703637; gDNA_ID_2214641; Annot_ID_136251
ccaaattttatgtggacttgtagattagaaaaaaataaatttgaaagtcattgaaaattgttgaaaaatgtatttataaatttaaacaaataataatgcaacaataaatgataaacaaagaaaataataaaacaacaattaatgattgagaaagacactaaaacccccactaatcatatacatataggtaaaagaaacaaaatcaagaagagtgtttatggttaaacaaagcaaaaatgatcaaataaaaacaagattatgatgttgttgttgtaaaacggcatagtcaagtcacaagcgcaccaccagacggtgccgcaacaacaacaacaacaacacctacaccgcataagttacattacaacacaccctgtctttaaaaactctttcctttttaataataaatctttctttaaataccatctctcttcttcctcctctgcttctcttcatcttctaagaaagaaacaaagaaagacttcacattttaccattatttgctctgagctcaggtcagcttttctctcttcccctctctcctctctcttctactttatggtacagttgaattaacaatgccattgaactactacttccatgaatgtatcttctttacacttgttgtcttaagtttctatttttgtctgatccagatctagtttcttctcttgtgtcttgtgaacactttagcttcttactgtctttatgtttgttgttgttgtgtcggtttgtttttcatttttccagtaatgttgaagaaacaagttcaagatctgacttaactaacttacactagttttagtttgctagtagctatataattctttgatcctgttaaagaactcaaagatcattcgttcttgaaaacagatccggatctgagatagggttcttgataaagattcgatatttgaatcctgatttggtttcttgtaatgcagtaggagagttcaagaaacaatggcaaagatgcaattatcaatctttatcgctgtcgttgcgcttatcgtctgctctgcatctgctaaaaccgcaagccctccagctccagtgctgccaccgacaccagctccagcaccagccccggaaaatgtgaatctcaccgagcttttaagtgtagctggtccgttccacacattcctcgactaccttctctcgactggagtcattgagactttccaaaaccaagctaacaacactgaggaaggcatcacaatctttgtccctaaagatgatgctttcaaagctcagaagaatcctcctttgtcaaatctcacaaaggatcagcttaagcagcttgttctcttccatgctctgcctcattactattcgctttcggaattcaagaacttgagccaatctggtccagtgagcacctttgctggtggtcaatactccttgaaattcactgatgtttctggcacggttaggattgattctttatggaccaggactaaagtcagcagcagtgttttctccactgaccctgttgcggtttaccaagtgaaccgcgtgcttctacccgaagcaatctttggtactgatgtccctccaatgcctgctccagctcctgctcctatcgttagtgctccttcggattctccttcagttgctgattctgaaggagcttcttcaccaaagtcctcacacaagaactccggacaaaagctgctacttgcaccaatctccatggttatttccggtttggtggcattgttcttgtgatcagatggttttgcagattgagttatgtttttaagttacaatgtgaaagattgtattacatcatttgaattgtctttttgatttttgaaacccattttttattatacatttttatcattattattgtttgtcattacgattgttgtgaattgaaattgttcctccattttgcttttctttagttaattttgcttcatttgcaagttaagatgataccaagaggtttaaagttcattctctttgatataatctgaagataagtcaataaatggcttgggatttgttcaatctggataaataatatgcagaatttgtttcactagtctgattacggcagtaactaggcctcggcataatacccgaaccctaaattttcaaatacccaaatgggtttaaatttcaaaatccgaaaaacccgaataggtaaccaaacatatctcaagtataagtatatattagttatatttatactaatatatataaaatattagaatttttcagatattttagttatttttgtgtatttttagatatattcaagcaaaactactcgtgttgttttgggaatttttgaaaatttcaagtaatttaataaatttgcacagaaaattttgatatttgaatatataaataagtctgaacctgaactcaaaccgaacccgatccaaaatcttaaattacccgaacgggtcttaaacttctaaatccaaaaaatccgaacccgaaatatttgacctaaatacccaaacgcccaggactagcagtaacgagccttaacccgttttgagtaaagctttttttttttatctctatggttacaacgccattacgagacgcccttggattcataattatgggagtagaaccatcaactatccacaaaacaatgaaatttcctactccatggagaataaaagagatcaaaagagagtaggagtataaacattcatgtaaccaaattgtgttgaaaggcaaatggcaaccattataacatttctaaagtcaatagatatttaaagagatgttattattatgtagattatcattctcactcttgtgaattgagatagttcctccattttgcttttctttaattgatattggttcacatccaagctaatgtaacccatctcataacagatttataatttcgtgtataatataatctccaaatcactaattatgacctcacattttaggataatgttttttttttaaatgcttatggtcaagaaagaagataacgattcaagccacacgaaacagaagaagacaatg

SEQ ID NO: 25169 - DNA, 3003 bp, Unknown
  misc_feature (1)..( 3003): 2750-1469P.txt file - cDNA_ID_2703670; gDNA_ID_2214641; Annot_ID_136238
tctctgtttcaattaaaaagaaaaaaaatccaaacgataatcattgtgataaatcacaagatgatatcatcttgaacactaacattaagagtcttattctggagaacaatgcttcctatgactgctacttcatcttccacagttacagcctcacctgcagaaacaaattaatcagaaaaaatataacgaaaaatttgttgaacaaaaagaaaacaatgaagttaccaagaatggtaatcccaagcctgtcattgtaatctccactagcttgaactcttgaccatctacctatagaagatttccatccgataattgagtttataacaacagcattctcctgcatttaacaagagtagagaacattaaacaacgaatcttttggattcataacaagaagaacattctaaaacactgattccaaattaccttgatttcaacatcgtctaagattatgcagctaataagccttacaccaggtccaacacgaacatttgctgatatcgacacatttggaccgatcttgttccaaagaaatttaagtgtgtcatttcatttgcaaactgaatgagaagtttagctagaattcatgagatgaaacaaataaactcacctttgcggttggatgcagttttacggatgggtgaatataaacatcaccaattatagttggtttcctattagtaccatctcctgaagctaaaatatgaggcgatgtttcgcggaattgggaaagatataaagccgagcatttcaaagatttcctgtttaaagcaatttcttagcataaggagtaatccaagaacgtctgaaacaatgattaccaccaacttaccccggagtcttgatctgttcccagaaatccttgttctcatatgtgtatagttgcttctttccagcaagaggtgacaatatatcttgatctaatctcacaaaatctgcaggaacagaccttgtagcggattggtagttgctagctgccaagtttaaagagattatacaatgaataacttatgaaaagaccaaaagaatcatgaaaatgatgaagcaggtctctaattgataatattgcaagtctctgagagaggccaataatgaatactcacatgtgtctcttatttggctatatacttcttcaattgcattgaagatatctgaagtaaacacatagacaccacagtttatcaagtcactgacctgcattgagtagataatttaagctaaacaaatttcagagcctgtgaaggaattaagaaaacaggattgtttagcagataattacgaaagtctcgggcttctctgtataatgcaggagttctttagtatcaggatcagctatcaattcaccaaattggctagctgcttctgcagaaacctgaagtgaaaaagcgatattcatgtttatgtttgatctttatgtttgtttccttagtgacatctaaaataacatcaggataacgaaccttgattactagcatagttccaataccaccatatcttcgatgtgcgtctacgaaaagtagtgaagtacatcaaagtaagaaaatgaaaacgatgaagcagattagcgatttcaaagggagattaccaagtatgccttgaagagggaaagaacagcaaacatcacagttgaggaggaaaacatgtgactgttcaaagagacaagaaatggaagatcaatcaggaaaacaaatgactgatgaggcaggaactaaagttgggaatttcatcagaaatcaaaccggtttctcttccataattctatcacgaaagtaataaagagcaccagctgaaccatggggtttatcttctttcaagtatctatataacaagaacatcgttcaattctcgatttcacattacacaccaaaaaccaaaaacacaaatgctactacaacttaccgcactggaattttcagctcgttagatattgaagacacatacaaagcaaattctcgttcctcgtaaaatccaatcagaaaaatctgagccagatttgatatctgtccatgccaaatacaaaacaaatataatatgatcaatcatcattacaaagttgagaactttcccatcctttgagcctgaagaaactatgaaaagttcaaaactttgacactacaaatcatacaacaacaagaaaatattccaaagtgtagagtactaaaatggaacaaacccacataaagacaaacgatccatgtcaaatcaaaacaagttatgagcaatccacatttcaaagttgacaactttcacgactcaagcaataccaaacttttctcagggatcaaaagcaagaaatagtaaaaagaagaaacctttttacaagcagagataggatgatgaatcataggttgaccagccaaaggaatcaatggtttcggtgtattgaacgataacgggcgaaatcgagttcctaaaccaatccacattagcaaaaacccaaaaccaaaatcaaaaattcatgttttgaaaatagaatttgagatccaaaagagaatgttatacctttggtcggaccaccaaccatgatcacagcgacgactttctcctccgacatgtcgagattcaataaaacctagattcgttaaagttaaacacacgacgatgatctgattttgtattgaaaggtcgtatctttgtagtcggatattctcaagttttttgaactaaagttgaaaaacagagtaatcagaatggagcctaataaaacgtcttttttaattccgttttgtttttgcgtttgttagcgttttataattgcgtttgtgaatgaccaaactttatgaatcttcttctatagcttctctctctgaacttcatcaatgtaaatttcaatcttttcttcattaatgtgttccgtttgattttgtttcttcagtgaaatgaaattgagattggtttctgattttatcttcttgccagtgaaaccctagtaattgtgattttgctgggcaagaaattagggttttaggaggttttgttacttactcaagagtgaaaaagatg

SEQ ID NO: 25170 - DNA, 3000 bp, Unknown
  misc_feature (1)..( 3000): 2750-1469P.txt file - cDNA_ID_2703674; gDNA_ID_2214641; Annot_ID_136239
taaaatacaattgtagcttttttggaaactgcttttttaatatcttccttctgacccgtattaaaaaatttcgatcgctcttccactttgtacttggttacataatttcatagaatataagtaagtatatatagtttataaatcctagaaggcacaaagaataattatccactattagtaattaaatattgtcaaatgaatttttcattattaatatttgtatatggtatttgtttaaatttagagaaataaaaattgaaattaaacatatatatataagaaacaacaaggaggaatatgtggcctagaaaatctctattttttttgtcctcactctcttataggaatacttatggactacattttctttactttcttctatttttggaaaataagttttttatatacaacaattagatgattgtgtcataagcattctaccaaaaacaaaggaaacaaaacaaaagaagaaacataaagtaaagcaaaaatgggtaaaagtgtaaatgtcactggtttcatcattcatatgatgattttcttgttgattttaacaggtaatatatatatacattgtgatatattaatctctttgaagtcttatatattcttactttttggatttatgactaatgtttaggcaactttaataaaaattcaatagctaatgtgaaaaaaaggaaccagaaaagtttcccttttcgtttggagtttctgtttgcatttatcataacgttattttatcaaacaaaaatgttctatttctcaaggatttatatttttgttttaaaaattgaaaacgtagtgtaattcatcatagtttaaaggattaaagtgcttcatgttttttttttaccattgtgtatcaatcccgacataaattttattgctcttgagatagctgagaaatggcatatatgttacgtgaaataaactttacactactaatcattttgtatgagatttaagtagtaatcctaaagttactgtacatcaagttagtagtcatgcaagtaatcatcatagctagagattattaatgtttttaagcatcatcacttttaaattgtggattaaccaaatttttgaggcaagagaatgtagatctaattgatcaaaaccaaatgattaataacttatgtataagagaatgatagatctaattgatttttttttgtataattagaattatttaaatgtatcttacatatcgatcactaatggattaggaatatatggacaaaagcataagaggagagtgcttcaagtaccgagccccttacacgcgtggatcttgtgacaattataaacacgtcaagtccgcagtatgcaaaaaagtttgccaacgtagaaaggattttgatggaagatgtgaactttttcaggacgaaagaggattgcaactaggttgcttatgtttttcttcggattgtaagtgacaattgcaaacttcaaatcctatgtgcaacaatattgtttattattaccaaccatcaataatatgtcattaggactttgtggtatacatatcatatgatatatccatcatatgctatcttcaaatcttatgtataagaatatttaattttttcgttattagtgtaacgcccgtgaaccggaaaatcggttaggatttgtttttaaatcatccggtttaattggttgggttaattggaaaccctagagtgtgcctataaaagaatgaaactcgaaattagggctttagttagccacttttcgttttataaaggagaaaaagagagaaaatgagaatgagcagaatcgttagggtttgggagaaatcagtttcgtcatatcaaatcgtggtaaaaggtaacgaaattaggtatagttatttccaaatcctttatcgttattctccagtttacagaattagatttggattaaaattggttgagttattcgcagtttcgtgagacacgttttctcagacgcgaattaggaccagcggagattgaaactgagatcgtggtctcgtctgttttccgatcggcacgagattttgtgggcagctttgtgacgtctgcagctaggatttaaccggagcgattgaatagttaacggttagcttgtattttagggtttcgtctttgagacggtttgtttctggtttttcctgtccagtttgcttcaaggttgcttttggttgtgcacttgttgcaggacgtttctggactgtttcagacgcaaggagagtctctcctgggtttaattgctattagaatcaatttgttaaggtgagtgcgtgaccatgagcttatctgagcgattgggttgtgtgatgatatgtaggtgtggtgaatgtgttttgggtgaattgttcaatgactggtttatttgtattgtattcgtgattatacctttttatttgcttgtgtgtatagctcgtagatgggaggatcgcctcactaagtatttatgacaatacttacgcatctcattgtgttgttgatgcaggtaaagataaagtgtgattgtgaaatcatggcaaggaagagaggatgatctaggaactcgtttgttttatgtttggtgtttttggttattggaacccggttaggattgtcagttattcttggttttgttgatcgaattatttatttattcataaaatagtatttctgacttgcagtttaattattatgttattggttggtttaattagatatttatgggaatatttaattattattattatttttttaaatgggtcgggttgtttcaatttggtatcagagcgattacggttctatgatgtgtagaaaaattaattgatgaattattttcctgttgattgatgtgggatgagctagggtgttagcatattgaggattgattatggagtgtttagtcaattgtgtgttgttggagtcctagcatcatcttctccgagccttaattgagattccacggtaagttgtttgtgatatattcgattgttttagtttcttagccatttgttcttgagtagcgcagatg

SEQ ID NO: 25171 - DNA, 3003 bp, Unknown
  misc_feature (1)..( 3003): 2750-1469P.txt file - cDNA_ID_2703682; gDNA_ID_2214641; Annot_ID_136241
gctgcaattttggatacaattgagcacggaagccatcaacatcctttatattactacactacatttgactggaagccttgtagccgatgcagagaggagggcgccgttttatttcgttgtgatgagtgtgactacattttggatggaaactgtgctctttttccaaaaaaggtaatgagaaatagatacgatgatcatcttctcttcttgtctttcggtgacaagaatgtgagtggtgactattggtgtgaagcatgtgaaacgaaagtgaacccaaaggaatggttctatacatgcaacgattgtggaaccatattacatatatcttgtgttgtgggagatttctcatatatcatgccaggttctcatataacaacatggagagctaacgtggtatccaacacctctatttgtagaccagtttgctatatgtgtaactctcgatgcaaacttccttctgttcttaagctttctgacaccaaagttgatgtatacctttgttctttcaaatgtgcctattttattaggaaataaaattatgtatcatttttctagttaatgttaaatctatatacacatttttagcagcactttttgtctttaatgtttgaatttctctcactaatattttagttaagatgagtcaaaatttacccggtttaattatgttcggatattacataactttaatggatcggattatttacctggttttattgtgttccaatcctgagaacattaatttttgaaaaaagttaccatttctatcaaaaaaataattggaaacgaaattaattatttaattatcaaatttaatatatatatatatatataatatctttaaactaatcatattttttatttaccttaactaattttttaaaatctctctatctagaataaacataaatatatgatttaaacgataaaaaaataatatatatgtacaatatttcatattacttaaaaaaatgggtaatagtttagagttatattatagggaaatttgggtgtataaccataaaaaatttaataatttaacaagtaaccattcaaaaagttggatatgatattcagcatatattgtgtagtatatacacatttgcccttgtttatacacgtgcttctctcctctctccaacatgatgcatatatcatcatctctttcttctccaacagtttttttttaaagcaaaattcttttgtaactcttttcacaacagtcattttctctctttgtcatcgccaaaacaaattcatctacgacaatggagatatagcaaaggaggatctcacatcagcctcacacaaaaagttttcaatttcgatgacgatgagtaaatatttacaaaagtgaattttaaaaacatggattagctaattagtttttaaaattgcttataataaataggactataaatctcacaggaaattctagtgagattaagtcaaacaaatcattttttattttaggaaaagtttgcaagatattattctattttgtaaattaaaaataattttttattcatttatttattttaaccaatctgttacctaataaaaacatatttaattataaaatttaatatacaattaaaatgaaaggatatatctatttgggtttacaaaaagaatattagggttttggattttatgattaaacaatgttaaatattggtttgagtttataaacaagtttaaattttacaactaaacgaagtcaaatgtcggtttgggtttagaaagtacaattagggtttagattttataattaaacgagtaaaaatgttggtttgggtttataaacgagaattagggtttagattttgtaattaaacaagattatatatcggtttggatttatacaagaatggttaaagttttgattttataattaaataattttaattatttattagttgaaatattttgattggctagaataaagaatggtgaatatgagaacccaaatattgttctttgtgaatatactgtttacgtttatgttatactaggtgcgtttaaactgaattgtttgttttgattgatattcattgtcatgatagagtgttttcattggccaaaccacagtgtttgaaattgaaatactatttgatattgcatctctactttcttgtctatactatttcagtttttagaacaccaattttttttacttacaaccatttttctattttgtaaatattggttcattttaaaaaattcaaaccactacataatcagaaaaaaatctaatgttttttttaatatagctagaagtctaaatcagtttattttagagagatttttagaaagaaaatgtaatggggtgtgcaaaataatattatccaaaaacataaaattaatcttttctcttgtatgttcaccacgtcagctcgtccaaagccttgcaaatgaggagtttgtcgacatttcatgtcatctacatgttacttacttagttttagattttatagtgctatatccttaaataatttatgaaaagtagttacttttgcaattcaccctatattataagatgaaataaaattattttgaatacgaatgaacaaaaaacttgagtttttaaacttccaaaactaaaaatgttcggtttattatggttctttattttaaaaaatataaattttaaaataaatttaaaatattataaatatttaatttttattatacggatgaaatcttacaatggactaatttaaatcgattataataataaacgacaaaaaaaaaaaaaatcgattataataataaacggtataatacatgtgaattcctagaattaaagaatattttgcccatctcctgcaagttataagttaattacaatatgatgaaagaagaagataagagagatccaaagagataagaataacattaaagttactctctcggtgtgggtatgacgacgaattgacttaaaattttcgttagtcatcttttgtcaatttcgtttcaatcatttttgacacaaaaagtatg

SEQ ID NO: 25172 - DNA, 3003 bp, Unknown
  misc_feature (1)..( 3003): 2750-1469P.txt file - cDNA_ID_2703684; gDNA_ID_2214642; Annot_ID_136263
gcaaagactagagaggacgatgatgagcacaagatcagcatcggaccccaagagaagaaagaagagaaggatggaggtgtggtttactatggaccaatctcatcaaccataaagaaagtgaaactcctctcactctccacttgctgtctatcagtctctcttggcccggtcatcactttcatgacttccccgggactgaatgtgatcatgaaaggtgctgttgcctctactgtgatcttccttagcgcatccacaaccgctgctctccactggtttgttagtccctacgtgcacaagctgaggtggcagcctggttcagacacttttgaggtcgagatgatgacttggctcggcacatttagcgcaaagacactgaaattctcagacatacgttatccagacacgcaaagaccgtatgtgagcttcaaggctgatgggaatttctactttgtggatgcagatcattgccctaacaaggcattgttggctaggctcactcctccaaaggatgctcatgactctgctttcaagaacttgtaatccaaattcgtttcttttgttatactctttttttgggtgtggatttttgttgggtttgtaagctctttaagatacttggatacctcctccccttctcatcactaatacccaaaaaaatgcaaataagaaaagaccggtttgatccaattgctaattctattgagaaattataaaaccggttttgaaccggttggcgttaaaaccggtttagctcagcctcaaaggttttgattgagttcccattttggttgcagcgatcggagagctctgacggcatcagccacctctgcggcttcgcaaatccaaataagctgtggatgaaacgaagaatcctagatttctgaatggtacgtaattcggaacactaatagtctcttccagaaattagggttcatccgttagttgtgagtcttgttctgtgaatcttttggattctaagttttataatatcatgaatcagtgctctgttaatcgtgtttaatactggtcaatgattttcttaagctaaatcgatctttcttggatatgaatctctcttggctcattttgttgataaggaaatgaatctttgaagagtcactgccttggcttttctcatcttgaagagtcttgtgtttagttaagataagatttaaaactgactgcaaaatacttctttcatgaatgtagtgtgtcttaagtccctttggattcttgtttgcaatgtatttgtcatttactgtagcagaaatgagtcctctttgcaagttttaatcaatagattttgaaaactgtgacaagtgagcttgattcattggagaatgatgatggtaagaagaataaagcatatacaaatgcttaattttgtgttatgcgtttttggtacaccaggcgacaccatttatagcgggggttgcagtagctgcaacagcacttgctggtagatatggaatccaagcatggcaagcattcaaggcaaggccaccaaggcccaaaattaagaaattttatgagggcggtttccagcctacgatgacgaaaagggaagctgctctcattcttggcgtcaggtgaaggaaacacacacacatactctctctttctcttgtgtttagtagtttctcaatcctcaatgatcaatttggttatagcattagcatagtttccattgaagaaagtgtaacgttgtttgaaatgtggggttttgtgattgaaaacacagggagagtgtagcggcggaaaaggtgaaggaagcacacaggaaggtaatggtagcaaaccatccagatgcaggtggtagccatttcctagcctctaagatcaatgaagctaaagacgtgatgctaggcaaaactaaaaacagcggatccgctttttgatgcaaatttcaatcaaaagacttccttatgaatcatcttatgttataggactgtaatgtcaaaatgcagattttatgctaatttataagcttgtggtctgtttgtgacacataaagactcgaatcttttctttcacttgttgtcgctgaaaagaacacaaaaataaaaacgcaaagcagaagggcgttctagtcttttcggttttaaaaaaatccagtaatagaaactctagtacacgtgtcatgtggctccagcgacgtcttacgtcaacctctatccattcattcccctattagcaactccctccacaaaactatttttaattttattttttattggcaaaacaaatctattatttaatccttgtttttttttttaattattcgacaatcgaccgtctaattatcttttaattatcattagctcttgctaaaggcaaaatcgactcatttttcttgttttaatgtgaagttttaatcgcttataaaagcctaaaactggattatgattaatgagacccggtcatgatttatccactacatgaaagaaaatacgtaaatatagtactagtattaatttattaattattattattatctgttataatatccatgtctttatcttcttctaattttcattttcattttacgtttttttaaaaaggcaaaaaaaaaaaaaaaaaaaggagaaagaaagaagaagaagggaactaaagagggtcatcatcatttcatggttacctcctcttcctctcttcttactctcaccatatctgctctctctctctctctgtttcaagcttttgctcccatttttcatttccttcgtattctcgctcgagcttagcggttgatgtaccaatgaccaaatcgatatttgaatcgccgtggctacctttctttttcttctgatttctctatctctcgcttgattctaccacttttagggtttctattattcccagggactttgggtttctttaagaagttcgattcgtctccgttttctttttagggttaacgaagtctgtggtgttggatttcgatctttttttttttggtatcttccccattgactgttgcggtgataagagagtgacgcaatg

SEQ ID NO: 25173 - DNA, 3003 bp, Unknown
  misc_feature (1)..( 3003): 2750-1469P.txt file - cDNA_ID_2703702; gDNA_ID_2214642; Annot_ID_136266
ggtcccaacgacgctcaattggatctctctaaaggaatcccacggtactctttcccgattctctaaaactcagattctttgttaatctgcgtttaaattccacatctttgacgctaatttatcattctatgtgatatgtgttggtgttggttccaaaaatagttgtattgattagttccaagttgtgagatttataacaaagtcctagcttttaggttaataggtttcagattggtttgttctcaatgtgtgatataatttcgtggcaggctctatatacttaggctgaaagaaacacccttagggtttttcaagatcacgcatcacgcaaaggtgacacagtgtctaggatcaataggaggtgatatttggtatatgggagtggctaagccatctcttattgaagatgatgatgatggaaggagagtagatacagtaaaagcaaagtctggtcacttgtacattccacctgaggtggaagagattcgcgtcttcaggttctcgggaccaaagtttgtgaaactgcaccgtggtacatggcatgctggacccttgtttagtggcagctccatcatggatttctacaacttagaactcagcaacacaaatgtgagtcagtgagtgatggttttaaattgttaatacaatgtagtgtgatgaatgacttgacaacattgttgctgttgatgatgttgttcaggtggtggatcacacgtcacatgatttcacgaagaataatggagtcagcttccgctttgacacctaagaagaataatggagtcaatcctatcatgagtgtgcttctgtttttccttgtgtgtaatgtaattgactaattgccaataccaatactgtgtattgtgtactgtgcacacaaattggttatatgcaataaaataccggtttaagttaaccaaccctggttcataaaatcctaataattcttgaattggttttctaaaaaaagaaagcaaatcatgaatactaaagaaatttgattacatcatttggtgtttctagtaatctgctctgttgccagttataaagtagtatatttaattattaagcattattaaaacgaataatacgtataatataatcgtagccgttggatataattacacgtgcgactatctttcgatcgcactaaaagcaaaggaaaggctaaaaagaagctcgagggtcgagatcgatcaaaattgtaaatcaatcataacacattttaactagctctaacacaaactctaaaattttagattaattcagacttggtaacaattttgacttaactacgagcgtcattaccattctatgcatcgttttacacgaattacactcacatctcaaagatacatgtccacatgctacgtaccgagtatcgaccacacccgataaacaacgggacaagccctagaatcccgaaaaggcaaaaaggtcccttgttttctctcttttttcatgttaaacacatactttttaaattaacaagaaagcccagatatttttggtgttttcttactgaatctagacttgaagagaattttaggaaaactccaaaaagctcgtacgctaattcttatcttcacttccatttttcctgtggtgatggtgagagttcaagtgttccaacgatggcgaaatccccggtagaggtgaaactgatcccgatcgaagctactcctgagaatttcgcagactatggtcaagtcatcgaagcctctcgtgacggtgcaggtttcggtcccaacgacgctcaactggatctctccagaggaatcccacggtactctttatccagtttactaaaatttcgttaatacctaagattattgattaaaacacatgcttcttctaatcatattcgttgttgattaatgtctaaattcctcatctttgatgctaatttatcaatcaagctatgtgatttgtattggttcctagatagtcgtgttgatcagttcctaataacaaaagacttatagattttgtaggaacgtacttatttactacaaaattcaacaaaacgaaagaccaattcaaactagactcttcttactacttcaagtaattaactgacttcatttacaagtcctagcattaggtttcagatttgtttgttcttttttttttttacaattagctaatcatcatattctcattatgtttaatacttgggacaggttctatataatgcggatcagagatacaccctttgacttttccgtactcactcaccacgcgagcgtgacacagtgtctaggatcaataggaggtcatgtttggtaccttggagtggctaaaccgacacttattgaagatggtgatgatggaaagatggtagataaattgaaatcaaggtctggtcacttgtacgctcctcctgcggttgaagagattcgcgtcttcagggtctcgggaccaaagtttattaaactgaaccacggtacgtggcatgttggaccactcttcagtgacagctacatggacttctacaaccttgagctcagcaacacaaatgtgagtgagaatggttttattgttaataatgtatggaatggtgatgaatgacttgtttttattgacgacattgttgttgttgatgatgatgttcaggcggtggatcgcacgacatatgatttcatcaaaaataaaggagtcaccatccgagttgaccccaacgatgttgacacatcgtcctcctaactcaatcttatcatcagtgtgtgcttctgttttcatgaataaattgagcaatcgtgaataaaatttgtatgcaactgtgtacaaattgttttttttttttttttttttttttcaataaatatcgaaaatacttgttttctcatattttcatgttaatcccatacttttaaaattgacaagaaaacctaaatatactttggtgtcttctgattgattttaaaaacattttgagtggatacaaaaagagctcaagatacaatcctctttatttttattttcttgtggtgcgtttcaacgatg

SEQ ID NO: 25174 - DNA, 3003 bp, Unknown
  misc_feature (1)..( 3003): 2750-1469P.txt file - cDNA_ID_2703714; gDNA_ID_2214642; Annot_ID_136275
tttttctcatatcatcatatgtattggctaacggtttacccaataagacaaatacgctgttaaatatctggttttgtttaacaaaaaaaaaattgctaataaataaaccatatgattgagaaagattgtcagactgactatcaaaaacgcctaattgattcgatcccattatcttaagttccaacttgtcctcaaactcttttttttttctttgacgtctcaatatttaaaatgatctctcaaagttcaatacaagccaagaaacatatttgccaatattcaaaacgactttaattactctttcttggtacgtatgtatagataaactcgttcacattgcttaaagaaaaactaatccaacaaaattgtgaaaaattcatccttaacctcctttctcttacaaatcttcggcttcgaagagtgtatatacagtgatcagttagtgaccaaaaataacaaatttacaaggaattaaaagaagaattaataacgagtttaagccggagattagtcaagatttcgatttcttcggttataaaataaacaaatcactaggacattcttgtggcggccacggaggaggctaaagggacaacctcggcgaggggagtagacagaggagttggaagcggcgaagtccgacacacaggacacgtaggattgagtctaagccacgtgtcgatacatttaaggtggaagagatggttgcaatctggtagctgccgcagcagatgttttcccttgtagtctcctaaacaaatggcacaacacgacgccgttgttggtccctttgcttccgagtagagaatctttggatagctttgaatggtgtcctcgtcaagaccggggacaacgtcgatgatgacatggtggtgatggtgatggatacgtgttgaatcttggttggtttgtgaaggtgaagaagagagctggttacgtgtgcaatagtatgaggtgagggtgatggtggtgatgaggaggaggaccccgatggagacaccgattccgtatcgaaatcctcctatgtcgtccgtgccgaggaggccgttgtagtccggcatctcggacggtggcggtggttggaaattgttcatggcgggtttggtttgatggttttgtttaatgggtttgggaggaggaagaggagaaataatggagaggtttttggtcagcgatttgatataagacaatgtaaattgaagcatcttggggttatcaaaagtcaacgctaagagagagagagagacaaagggaggaaatgcatgtgaatgaggataagaaagcttgtcaaagcaaagcaagaattgtgtgacttgtggatggttaaaaaaatattcaatgtataaattttctaatattgtattggtaatactgtaatagtataacgcatatataaatatattgacccattaattcgttgtttatttcaaacataaaacacttagttgcacaattgaattggatacagggctaatgaatttaacgtgtgacatgtattaagatttgatttaggaatgtagggaggggccagtggctaagattagagaaggtttacgctgaattagtttgaagtcaacgttgtacttatatactaatcttgttgtttatgtacgtttagttatctcctttattcaggcttatttaagtccaatcatgtcacctaagcaacgtttagtttccttcacttgcttttaaagtcgcagtgttatcttattttagtattagaatatttaaaactttgaaatctctccatattagaagattaatataaagttttgtttttctcctaaaagtggcaagacaataaaataaaatataattgtaggtaaataatttgtatatactaggaaatccaaatttaaccaattgagtcgtgggcattaacatttgtattacataaaattatattttggcaaactaccataggataaaaatcattcacttaacggccaagttactaacacaaggcatctttgataatggaaaacaatctgttggacagttgttattaatgaagaaaatgcgtcattgcatgctcgcatgatgtatattttaatatacactagctatgatagtatataaacagatatacatgtaattaagaatggagataaatgaacgtatattatccaggggcggattcatttggtgaagaatgaatgtattcagtgaattttaattgatattcgaatacaccattgttattgaacacttaattattgccgccgctcttccaatttttcaattctttttttccccaatcagtagagtaactatgggcttttaaaacccatagctccggattcccaatcatatattctatagtctatgtcatctaaaacaatatgaatttagataaacaatttatgaccttcaagccatatatttgggccggatactcaaaacatatgaaattacactcaaacactaattgagctacttaggccaaatatataaaggaaacacttactactaggcataaaaagtttggaagaaataataagagagaaaaaaatgttataatcctgacattgtttttttattgttaactcactcttggaataagttgtccaagtctcatagttgactcagtttggtggtgtcacaaattagttccatcattactaatttgctatcagtttggtgatgtatcaaatactgttgatctagtaatttcacaaaaagcgcatatcttccggctaatgatattagatttactcatatgtgtaatgtgtatgtatggttgaaagttgaagctaaattaggtttaagtcactcatatcatatgtgtgtgttatcttgtatagtgtaatacaaaattcaatacaaaattttccaataagcaaaaatagtcgtcagtgcgagttcaactttaaactgtttcaaactttatattcattacgaatgcaacagtccctctcttgtttctccacgcttcgctttctccttccattttcttccaaactctctccgcttcgtcctctctttcacaccgccgctatg

SEQ ID NO: 25175 - DNA, 3000 bp, Unknown; identical to SEQ ID NO: 13660
  misc_feature (1)..( 3000): 2750-1469P.txt file - cDNA_ID_2703718; gDNA_ID_2214642; Annot_ID_188362

SEQ ID NO: 25176 - DNA, 3000 bp, Unknown; identical to SEQ ID NO: 13660
  misc_feature (1)..( 3000): 2750-1469P.txt file - cDNA_ID_2703718; gDNA_ID_2214642; Annot_ID_136277

SEQ ID NO: 25177 - DNA, 3000 bp, Unknown; identical to SEQ ID NO: 10452
  misc_feature (1)..( 3000): 2750-1469P.txt file - cDNA_ID_2703736; gDNA_ID_2213650; Annot_ID_132455

SEQ ID NO: 25178 - DNA, 3003 bp, Unknown
  misc_feature (1)..( 3003): 2750-1469P.txt file - cDNA_ID_2703742; gDNA_ID_2214643; Annot_ID_136305
tcctcgaaatcccgagatgctctaccgaatgtgaaatcgtcatcctctgatttggtaaaagagcagagagaacattgtgaggtttcgtagttttatgtaaagacgatgtgaacatgcattgtagtttcatggttggtttggctttggatttcatttgcgtcttaggagtaaaatgaatgcaactatttaggtacttggctggagatatcagttgttcttagaagcaatttgtatcttttggtgattttgtgtaaagccaatgtggatcgtcgtagcagtttcattactacttggtctaatgatattatgatagcttaattattttgctcattcgatagtgaattttctatggcacttcatggatctatctatatctgttcaattgttataaaactctaagcaatgtcaagctcttcaagggaaaaccttctagatgattccaagtctctgcttaatgtgccaactagcctctacgtcactactttgtgtcgtctccaattctcatccttcttgacaagaccaaacgtatcactaatgttggagagatgaccaatgtttgttcatacatttgtttgtaatgaagacatatagcacaacaccatataacatatgatccattctattaattttgctatttttacagccgaagaagaagagtataagaaacatgtttaagattcagccttacacaagtgtagcagaagcaaaaaagaaaggctatcaacgaatgggaactttgatccaaccattggcaaaagcaatggctaagatgacgaatggcgttgacataccgaagatgataatgtaaggaagaggcgtcttcatcggattctctccttctctttctccaacgctttgccaatacctataaagttgtaatgcaaatctcatccataaccatttcgtcagtcacaatattgcatgtttatgaaaaatgtgcatgcaagagtttaagattcttttgactaacttacaaaaaccaaatattttcgatcaaatttatggttcgtgtattgatacaatactaacacaaaccactagtctacatgtcattgtcacataccaaacaaaatctaaattctgcaaaggagactaaaattacattaccatccaatgagtttctgtttattttctacaatctcatgatggaaaaaattgagaattaagatgaactaactgttctggttcttcatctttggtaatgaacttcttcttatctttaggcttcacttctccatctcctccaccttaagcaagaaccaaggattaacagattttcatctacaaataaataaaagatctaagagagtacctaacttggcgtgaagcttgaactgtgggaatcctaatggagatggtggacagaagaattgaggcaaagcaagcaatgatgaatatgaagaagatgatgaggttatggaatcattagttctgtggctaaacgaagaagagggaatgcagagttttgctgccatttccaacaactaaacgttttgtttttgtatatgattttttttgtatatattagttggagatatatgtggcatttgtagtgacatttggcaaacttgtagactaaaaccttatcctcttcttacctctctttgtgttctgattttttgtattagacactccatttgcagtggaacatttgaactaaaccgaatcaatttaataaaagagagaatgtgtaaaccaggcctttttaaaataatattgtaattgctgcaaaaacaaaaaaagtttaagaataataattttgcaattaatttaatggactagttatacaaaaattaatcagcttttatatattttgcaattatttgaatccattacattatgtatgtcaattgggctgcttggacccaatctgaattagaatttcaaaacccacaaatctttcagtcttgcccaactcattttactatcttacaaattcttgttggcaagaaattagttttggaatgaaaattatttgtttgagctttaaaagccggtccaaagactctaactcgcttgggttagacccaataaaccttttattctgaacgaggtttgatcctacttgactgtttctgaatcttattttgcgtatatgaagttctccttgatatgcctaaaatcccttcgaggttcatgtttaaaggtaaatatgtgagttataagactcgtacttttgaacttttgatctgatttttaaaccaatgattaaataacaatttattgtaaaatatttcaaattatatgaagtataatttaagtttaaaatctaatttgcaaaggcaattaaacactattagtacaacatgtaattatataataataataataataataaaaacataaattttgattgatttttgtttgagtgattattttggttatgattggtaaaataccctcaaaccacatttaaaaccatgagatgcaaatgttttgtattgttaactaaagaaatcctctaaactgtagatttggaagtctattttaaaatcactagttcataaaacactagatttcttaagatttttttagaattcatgatggtcatttcaacacaaatcattttaaatgtttgattgaatacacttccctcatttttggaagtaatggatatgattattgccaaatagaaactattaatgatccaaaacatgatttgtaagataaggtttttcacattaaatttctgatgatacactttatgctatattatatttgaagtttagactaaatacaaacacctaaagagattgtaagtatgtgtgtaaatgaagtaacgtatgaatgattaaacctttaaatagaagtatcctcttaatcaaataaacgtcatggaggatgatgcaacattctaacgaactattcgcataaagtttgattacaaaatttgtaattaaagcaaataatatcgttttaagaaaaagaaaaaacacagcagtcaacaattggatggcagaatcgtaaattaagtaacaattgatcggtgactaaaaaaaaatg

SEQ ID NO: 25179 - DNA, 3003 bp, Unknown
  misc_feature (1)..( 3003): 2750-1469P.txt file - cDNA_ID_2703746; gDNA_ID_2214643; Annot_ID_188418
tcatttcctctttcttggaggttgttagtgcttcagaagatgatgatggagctgcaacgcttgtagtcttactttgcatattgcaaatgaaaaggtgagtacaattgcattaaccaccagatatatctattaacctttgtagtttatccctaggtggcgtgatttcaccggcgatcagttctctccctgaactagttgagattaacctccaaaacaactttctcacaggcgaaataccgaggcttccaaaacacgtaaaggtcatttacaaacccggaaaaaggttcctcatacacaagtcaagagataacaagtgactataggcatactcattgcaatcacaattggaggagcacttgtcttgatcaacatgggaatcatggtttacgtttatcagctcaagaaatctacaatggttgcaataaaatatataaaaaaataaacagttttcttctaataaaaatatctaaatgtcaaatatgggtttacaagttacaatcatgaaactctttggtaaggaagataatcaaaatatggatttgtacaattcaaacatgggcttctaatatgatataatctatataataataacaattttaattaatgtctttaacaattgtgttttcttttaatcgcattttttttgataaactagaaatatattttgcagttatttttttttagaaagttgcaatctggataaatgtcttctactgttacatctttttttaatcgtaaatcttcataaacggttgcaactatttagttaaagcattacaatatttaatttatttgaaaaatcattgcaatttttggtttatttatgaatcgttataatatttaataaattggattctaatgtaatgccaagttagattatcaaaagctagggtaatgatcatacatctcaagatgtcgcgaaaatgaagctagtaaggtaaaattcggcaatcgccaaaaaatcagagtctagatttgtaattttaattgcatcttcttctttttggtcaatagtaacatctggtcatggaaagtgttctgcaaaagtatgtttatgcagctcctagtagaatgagtacaagaacggaagaaacactacatgcttagacttttgatgatgataataaaagtttaccaaaaaagtgaatccaaaactgaaaaagaaagaattataacacttaatctgagattaataacttgaaaattttaaagcttaactcatattacaacataacaaataacatgcagtattctcaaaatctacatatacatttttggtagactttttggccaaaaatctctcaactatttactaataacatttagatccttacaaaatatatctcaactagatattctaatactaaaaatttacaatttgttagtttgcattaaatacttaaattaactcttttctatattacatatttagtccctacaaaatctatctaaaaaaaatatgtgtctaattaaactacattcaattaattactaatttcttaaaatttctctatctacattaaatataaatatatgctttttctttcacttttagttgttctaatatctaatttatttgattttatataaaatatatatagttaataaaatattagattttttctatatatgatgtaattcaaatttttaaaaacagacatatattactcaatcgatgaagaaaaaaaagtaagtgtaaaaagtctcacattgcttaagaaattgggcaacggttcagagtcatattataaaaagaaccaaaatgattttgaataagaatgaactggaagttgatttatcaggcatcccaaaataaaaatgttattcggtttaaagaactgaatctttaaaaatttcaaaatattataaatatttaactttcttaaaagtgaaatatcaaaaaatttataacttttaaaaagttatactttattaaaaaattaaatgcattaatacgggacaatatactacgggtgaaatcctatatataacaatcaaaatagaattataaagtttggatcgatattattattattatttttaatttcaataccataaacatttaaactttagaaaaaatgacaaaatgatgtttaattccacgtgacggggttatatggtgggacgggtttaagttgatattaatacgggatggtatatagtatgggtaaaatcctataattaacaatcaaaatataattatataattttaaaaactaagccaatgtaacaatattaatatatatatatatatatatatatataaaacttaaaattttaatttttttagttctaaaattgtctcagagtattatacgttaaaataaaataacatatgtctatatatcatcttaaagacaaaattcatttttttgataaaaatatacccatgtgatatacctcttaatatgttatatatatatatatatacatatatgtaatataatattaattaaaataaatcgttaactttctgtgtaccgcggaccaatctctagttaaatacattttgggacagttcttattacaaaataaaaaatatataaaaatgttacaagtttacagaaaattacaaaaaaccatggttacgtataaaatgtcgacccatatttagtgggctttgttggcttattgggcttttgtgtataaaaaactcatttatatacactcgtgagaactggaaggttccgtcaagtgattcctcattcccagcaactgtttcaacttccgccggcgacatcacgatctacagttccggcaagttattccattccgttcgatcaaaacaatgtagttcttcttcgtcgtcttcgtcttcttcttctcattttacacagttttgttttaggaattttcttcataagatttttgacaaaccctagcctgatcacttagtctcaataaggttttagttttagtttctcttcctcactggcgatttatgtttgcatgcatgtaccttttcttacagatttttcgtggtgcagaacaagaacacatatg

SEQ ID NO: 25180 - DNA, 3003 bp, Unknown; identical to SEQ ID NO: 25179
  misc_feature (1)..( 3003): 2750-1469P.txt file - cDNA_ID_2703746; gDNA_ID_2214643; Annot_ID_136303

SEQ ID NO: 25181 - DNA, 3003 bp, Unknown
  misc_feature (1)..( 3003): 2750-1469P.txt file - cDNA_ID_2703753; gDNA_ID_2214643; Annot_ID_136291
gtaggagagaaggagagttgagtttctcggaggagaaactttgagaaactattctcatccaatttggacaggtgtcatcatactattagttcaactattaaataataattaatatatttgttttgattaaattattaatatatttttttttgagaaactttctttatttttactgatggagatggtctaaacatcttgtctcaccgccatggtatgaaccatctgctgcccaatctcctccgacatgcaatcgaaagaaaagcgtcctaacaaatacaattatcaaaaactctctaaaaatctgataaatttatgcgtctgaaaacaatttaaaaaattgagagaacaatcttataatagttaccttaaaaagctgagagaaattttcctttaataatcttttcctattcgtttaaattttattttttcagacttttggaaattttatgttctgttgtttaatataataataaaatttacatataaaatgctaataataaattttttgcctttttgttttttgaaattttattttattgaaaactattattttgtatattctaataattatattatacatttttactatttccatatcttgttgaattgaagagatcacttaagactttcatcaccttctaattattattataactatttgtataataataattactatattgagtttataataattgacacgtcataatgtactggatcacgtgcatcgcatgttttagacgagagtatcatatggcaactcgtaagaagaaaagctgaaaccagatcttccttcgttaactgttttcagctccagcttctgaaacaaaatatcatcagggttttatctcaaacaacaacagattatatagtttgtagatacgaggaagatcttggactaacctgctgtttggatcataatagaaaccgcgcgctgatggatccgtcgctgcaggagaagcatacgtagtaaaatctagctattgttagtccacaatctgtgccaacatttacaaagtattgctctttccatctcttgcaccaccacaaaaattatccggagtgaattatataggatatgtaagagtaaaggatcatcgatattgatacgaaagcgagagttataccataaatatataagggtaaatgttatgacctgacactcacagaatcaagaatcgtttcccgtattagaaattcaaagggaaacaacatgaagaaaaataagtaagagtttaaggtcttacaggagtgtctgccatgggaacgtttagagcttccatggtgccacaaagacagccatgttcaaggtcaattccctgtatctggacattaactctccaagcttcctccttgtgttaattagagacattttgcgtaccagaaaatgcatgcagcataaaaacatgtgtgttcctcatctttaggttcaatatgaacaaacaatctcttggagccaatgaatgttatacaatcccaactagatataaatgcacttgaattaagcatagatgtcaacatgaaaaagatatcaagccaatcaaagcagacaaggccaacttctactattagctattcttgtgatttcaagtattcataagtcagaacttgtcaagtctgagagaaatttcaccttttacatataaaaatccctaagacaatgtctttatagatatactcagattctgcttacacataaggttatgttcataaaaagagtgtgcatacataaccacagatgcacaagcataactaataaagttctctctagtcctaaccaatattcccaagacctctatggtcagacacttataaaattcaatttgttaaaccaaataaacagaatcgaaaaccacatctcatcatacccggttcggttttcttaaccgaatcaaattatatataaaacggattaggcttctccggttttctactgcgttttgtataaaaccctcacaaaaaccctttctccaaatccttcaacctctattatcgaacttgctatataacctttggacctgactttcctacttctctctaactccaggtttgtcttcctctcaagttgaagctgcggctttattagtttcctgttgacttatgttccttgaatccattcacatgagcttcttacgccgttttcattggtttacctattgacgttgacttgggtctaccatactttttcatgttacttgattgcatatttataaaacggtgctcctttttgtatagcattctagatgttgcttctgaaacaaagctcatctgctgttcttgtcgttgggaatacaaaaactccagtccttcacacttgtcgctccacctacagagttggaaccagaacgcactcgttcaagagtttgactatggcaaatttgcacaagcacttcttcgtctgggaaactgaatacggcttcatctgtgccttgtagctctcacgaggcttctcctatcaggtacctatgccccctgtattgagtataatggtgtcaaccattcttcttaagtattttctcgattcttgttattttcttggctattgtcagtttcatggacatgagaagttgcatagctgttgtagttaagattgcatcacaccaatataataaagaaactagctgtgtgcttccctgctcgtttctctgttactagacacgaagatttgaaaatagtaagactggttaaggtatttctaatgttcattttctttcctctttgcaagtgagaataacgagaataaacatgtccatggagtttctgagacaattgtgggagttcttggggtggacaattgggtcagtttccatagcatcatttggtatctatattccattggcttttaatttctgaatgctttgaaacttatatcaccaaaatctgttgtatataacctttttatgaaacacttgaacccttcatgaatcttcaaagtatctgactgaatttgtggtgcttgttgtttaccacattgcagagacacctcgtgttggtatcatcatg

SEQ ID NO: 25182 - DNA, 3000 bp, Unknown; identical to SEQ ID NO: 13679
  misc_feature (1)..( 3000): 2750-1469P.txt file - cDNA_ID_2703765; gDNA_ID_2214643; Annot_ID_136297

SEQ ID NO: 25183 - DNA, 3003 bp, Unknown
  misc_feature (1)..( 3003): 2750-1469P.txt file - cDNA_ID_2703769; gDNA_ID_2214643; Annot_ID_136296
tgttctttaagaatcagatggatgaaactttgtggacaacaatcgtaccaaaagcaccacatatagcttttccaattcttaacatgtaagaccaaaagattcacaactctcatcataacaatctgcacaatccacgatgcgtcatccataatgtgccatccatataaacattccattatcgtcatccacattgttagaactaagatacaaacattccataaacaagcaaaatctaaaatctaaaaagccaacaatcatatgatcagtttaacgtcatcaaattcaagagagtggccaagtgctatgcaatgataagagtatccatatacatgtgaacaaattgtcaaaacaaattggtgattgcagctaatgtaaaaagtcatatggatatagaggtgtggataggtgtgtgatctaaacacatcatttctagatccggaagatgtatctgttgggaaacgatagctccaataaaaccaaatatcacatcttccctagcatttttgagatagaaagagattaacacaaagttattgttagccaaagtttttgaagaccaactacgtatctataggctggaaatagagcaaaaattaaacaaggaattcaaggtgttcccagagaagggtattagaattttaactggaaaactagatgcattttaacaaatcaaatttcaatgtcaattcacaacattcatatcactggatcctaacttgggattgagtcaactacttaatttaaaattcttcaagtaatttgtcaaatcgatcctaacttgggattgaatcctatcttactatttatcaatttaacattcaatcttaagaaacagataaagccaagtaaaaatccaatacgagagaggataaaatttggttaaagatgctcttacctctcccaaacaatgattcagtttttcttcttccccaattcaaacatccttagtgatctgagttgagaccaatattttctgtcttaatcttcggcgaattggatttctaatgttaataatccttcgataagaaacgatggtggtggccataagttttccagcgaatggagaaaaatatacaaaagtaaaaaaaaaaaaaaaaaattagggtaaacatagattttgattgtgaatttaggataacctcataattttcatgattttgtaaaaattatagagaacgacaatgattttgaaagagagattgaaaatgatgaaaaacaaaagaatatggaagagagagatgataaaagggggatagtttcttacccacacgatctcatcaaaaataagtttaataattattgtgtcatcattacttcaggggtaaattagtccaatttctcctcaaaaagatggcaaagtgcctaatccctgaaaagtgcctcaaaaggaataaaattctttaaaagtgtctaaacgtgtcacattcccttatcattttagtcctttaatttttatatattcaaaatatttcaacactttgactcgtaatctacagattaaaaataaagagacttatctatctcttcgtaatgcattgattgatcacatatgagagcattacgaaaataattttattgagtaatttgtaatttataagttaatttatgtatttttaatttttatttatatgtattttatttataaatgtattgttttgttaattaagattatgtgtaatattttaatgtatgttttagtgttattattaaagttatatagttttaaaataattatgaacaatataaagactataatgcaaaacacatattttagaaacttcatatttaaagtatactcttggagaagaaactactcatactttatatttgaagtttacatactctatatataaaatatcttttggatatgctctaaattatattggattatcttttagagaacctaaaactttatatttgagggatagagtatctcttggagatgctcgtggtagttcaatattgtaccttaactgtaacgtaaatgttgttatctttacttagacgtctttgatatgtaaaaattctatctctgtatcctgtttgtactggcctctccaaggttcaccattattggatgatgcactgggttgatatatataacataactttttggcaaaaaaaagaaacaagaaaaaaaaaacagtctctttggcgatagcgatttggtcggagatttctccgattacattgattgggactttagtgaatcttcacagaagcaacttcacggagaacggcgagaagaatgtggaattgagagcgtcgttagaggatcgagaagcgtcggccgtttcactggagagatctagtgttgttcgttgatgaaggggttctaatttcgatacctaacggaattgatcattgataaggtctcattccggtggcaatcgtcgtcgccggaaacaatgtgcacagatacgaccttgaggttagtttattcctttaaaatctaatcacaacaaaatatatcatttgtattcatgggattatgttcattgtaatggatttgaggatttggtagataaaagtagtaaaaattgtggattgaagaattttcttgtgagagatggttgatgtaagggaaggatcatattctggaacatttgttagctttggttacttctcaccattgtgatgaaatttgctatatccaggggatgattcaagtgagagaaagataaagtttttttgccttcagtctgattctgcattgaatacttccagtgggctgcaggttagtgcttagtgttcttttgatatccttgcattgtcattccgttgatggctattctattgcctccaatgtatactcattccacttattggctccaatgtatactcattccacttattgcctccaatgtatactcactccacttattggctatgggctgcaggttggtgcttagtgttctgttgatactcattccacatattaccactctctaattttgtgacgtcaggataatacttaaaaacgttgtagcaaagcgggagatg

SEQ ID NO: 25184 - DNA, 3000 bp, Unknown; identical to SEQ ID NO: 13666
  misc_feature (1)..( 3000): 2750-1469P.txt file - cDNA_ID_2703785; gDNA_ID_2214643; Annot_ID_136290

SEQ ID NO: 25185 - DNA, 3003 bp, Unknown
  misc_feature (1)..( 3003): 2750-1469P.txt file - cDNA_ID_2703825; gDNA_ID_2214644; Annot_ID_188445
cttgttttttcacagattccagaatccttcaacgaatgagattgtaacacgtgtaagtgagacaacttaggtgacaattccatatttggagtcggaatttggcttacgtggaacccaccgaaatcgtgtaatagaagtcaaacgcatctatatctgtgtttaagctaaaagtaaacctcattgaagaagtaacataggaaagctttcgtagccgtcagatcaaccagacaaaacgtcatatcgagacaaaaactttcgacggagcagattctacagatacaatacacacggtttcactggatttcgcccctctctctttaaacaaaattaaataatatcagaagacacgttcttcttcttacgaaaccgactttgtagtttcttctttttttccattacacaaaaacgaaaaaacgacaacacaaaaacaaataacaaaatcttttaaataaaaaataaatcgactctcgtgtttgtttaacttcttgtttatttttcttagaggttaattaatttcttctctacatgaacgatccaatgggagaaacaggattttctagagaatcggcgccggagatcgtgttctcggagacggatatggctgcggctgagcagcttatgcatctaagcgaagaagaaacggttagctgtagcagcagcaccggcggagattgcggtggcggaggcggagacaagataaagcatgaatatgttagctcgagaatcggaaacgagctaaacgacggcgtacgaggaaactctattcttggcgtggagaagaagaggaagaggacggtgatgaaggaaaagaagtttcgatctcttgagagtatttacaaagggacgaaggagattagggattaatggaggaaagggatcggagagatggttaattatatatcgtttgttaattacttttgttaatcgatgttagtaacctcttcaatggtttttttggtgtgtgtgtatatttctagtccttgcttaatttaacgttggagctgaaaatttgtgataatagtttttggagattttcagatgaaatctgtaaatattttggttctcatatatattagacgtgatgctgttttttgtttttccctagtcacttcgttgcaaaaattaacaattttactttggttttggatctgatagtacattcatttttttcgtaagatttaaaagtttatttacgtgcaaatgatttcgttttgaatttttaaattttgagttctatgatgtgccaactgccaactgagatcattttttttttaccttttcaaaaagtatatattctacacaacaaaccagacacatgcaacaccaccaaatatcttaaaattgtggtgatgatttttatacttactgcagtaaagaaaaatcataaattttatcatgttcaactaaaggcatttgaagatgcctcatgtgggtgttgagtgaactcgggtcatgggtctttttcgtgaacttctcgttgagagcttcatcttcttaattatcttggagtcatcttctgattcttgtagcttgtattagggtttttgttataccttgatgagcatgtaaagagaggtcaagagtgagtgagttcctatagtaaacattcagttgatcgattggatgtttgtgacacaaaatgtactgtaggagaactagtgactatgtatggaaattgtttatgcattgatgtttagtcatgctaaaaacagatttcaacaagtggtattagagcacaactattctcaaggatagtcaaatttgtaacagaaaagcatattaaggcatgcaagcaatgcaagttgcacaagaagattctattctagtctcgattcttgtaaaatcgagtcacaaaagatcaaggtttcctagtatatcaaggatttcatcgggatataattcctaatgtatcttttttgcaatcatggcttgaacctctagacggttttggcagtatttgtatccatcatttccataccaaatcgtgtttgcctcaacattctacatgtaaattgcactatctgctcatgccttccacaaaatacctaggcaaaagacattaatttttcaagtttacgagcacggagtttagaggagccatcacactgattttacaataaatgaagaaaaatctttttgttatcttgattgacgtctactcatcccatgttttaacttgaaactttaattggcagctaatatctatagtgttatatccacaataggtggaaataaaaccctcacgttccacatcatgttgaataaataaagctgtcatccgaaatagatttggaggtatatagaagttttgactctttgagataacactgtggaagtcaaaaaaaaaaaaaaaaaaaaaaaaaaagtcaaaacatcctcctcgtctgagatgttccatgcaatatatctcttcataattctttcttgtcttcaacaaagtccagcaaggatctgagaagtttgcgtcgattgattatgccaacttgaagttggaaatagaagaagactaggcggaacatctcatcaaaaccctatacattcaacagggaaattcttttgcacgaatgttagacttcaatattgaataaaattcatagtttcaacaatctcataaaaaaagagctgggctccattcgaagacacattaatttccatgggcctggtccacatacaaccatactaaatttgaagtaatttacccgccatttaaaaaagcccataggctccttctcctagaagctggcgggaaaatcccaaaacttttcccgggaaagtagataaaaaatttcggccattaaaggacaaaatcacaagaaagtagaaaccctagagattttgaaaccgaaaccccaaaaacccctttgacgcctccttcttcttatctctttataaaaaaccatttctttcctgcaacatcgttgcttatcatcagacgcacatcacctgttcgataaaattcctctgagagtgttttttttgttttccttctgacaaagaaatatg

SEQ ID NO: 25186 - DNA, 3003 bp, Unknown; identical to SEQ ID NO: 25185
  misc_feature (1)..( 3003): 2750-1469P.txt file - cDNA_ID_2703825; gDNA_ID_2214644; Annot_ID_136315

SEQ ID NO: 25187 - DNA, 3000 bp, Unknown; identical to SEQ ID NO: 13690
  misc_feature (1)..( 3000): 2750-1469P.txt file - cDNA_ID_2703829; gDNA_ID_2214644; Annot_ID_188452

SEQ ID NO: 25188 - DNA, 3000 bp, Unknown; identical to SEQ ID NO: 13690
  misc_feature (1)..( 3000): 2750-1469P.txt file - cDNA_ID_2703829; gDNA_ID_2214644; Annot_ID_136323

SEQ ID NO: 25189 - DNA, 3003 bp, Unknown
  misc_feature (1)..( 3003): 2750-1469P.txt file - cDNA_ID_2703833; gDNA_ID_2214644; Annot_ID_136313
tctgtttcttggcaacactgtttttgttctttgtccaggtataaattataaatgcggttttagtcacacggaaaaatccaaagggagatgccattatatcatttaaaaaccatatattataacaaaatcattactggagtttgcatacatcaaagtttcacagaggaaggcgccggagaagaaccaccggaatttggagattgacagaaaccacgaagaacgttggtttcatcagaggtaaagcctagagacgtgagcatcgcaggccaacaatcggtggtgatgacctcgacggcttgacagcaatcgacgccgagtttggtttcaccgttgaggaagaagagaacgatttcgttggtgcatgatttgagctcataaagtgcgttccaacactccattagtcctcctccgttgagtcttgccgctatgtttgtggaatcttccgtctccgggagagttcttccggagatgttgagaacgaggaggatagcgatggtggcaaagaggaaacttgtgttagaagccattattctttctttttggggtttttgttttgttttgttttgttttgcgatgattgagttacgagagttctgtttttatattgtggttttggatggattcgaagcttagtggtgatttaagagtaattaaaaagttggattagtgggaggaatgggaaaggattgacggtaaatagtcacttaatcatgaaacgttaaagcatttgactgtagaaacgtatttagtatatattggcatgttgaatcagtagcgctcctattggagacgaaggtttaacgtcgtgttacagaaagtgaaccaatgcttttgtaataaactcattgaactttatgctatatactgtatatggtttttactactcattgaactttatgctatgttttctttaaactccttgtataaatatatttcttaggaattacttttaaattatgtacaaagacatgtattacagaaaaatttcatgttgtaatctaaataagatgctatagtgttgtcgatgtgtcatgtgtgtcactatccatcattaaacatgtggtaaaattacagtctataaccatcatctagatcagatatatctttttaagaatttaaacttatggtcaaattttcacaatctcgaatacaaatatacaagaatgtatattctcaagtctcctagtttctctgttatttgcatcttttgtgacttacaaactatgataacttttataaaatagatataattagctatcttcttggacaagttacctctcttaggttgtttctgttgtttactatgctctgattcttaacaaaaaatggtttattttgttctgataatggttttaagctattccagctcagtggatctctgtccttgtataaacgcaatgataaaccaaacgcaaatgcttttattccaaactcaaaatcagtgaacagacattttctcaccatacattcatagaaagctatatattataaccattactaatgtcttcttacgtcagcgaggaacatttatcaaagtttgacaggggaaagagctggagaagaaccgccggagttcggagattgacagaaaccacggaggacattggtttcctccagtgtaaagccaagagaagtaagcatcgccggccaacaatcagtggtaatgacatcaacggcgttgcagcaaccgtagccgagtttggtctcaccgttgagaaagaagagaacgatctcattagtacatgacttcagctcgtagagtgcatcccaacactgcatcagtcctcctccggttagtctagccgctatgttggtggaatccgccacgggcgggagtgctctgctggagacgttgagaacgaggagaagagtgacggtgacaaagaggaaacttgtgttagaagccattgtgttttcttttgaagattttgtgttgtattgtgtgatggtttagaggatttggtaagagctgctatttataatactgtgattatgaaaggatttttgaggtttaattatgattaaagatggtttttagtggaggaagtgggagagggcagagagttaatgattttacttaaatcttaaatcatgtaacttagagaatgattgaataggtggtcttaacggaaagatacaagcgaagagtcaatggttacttgataaatatagaaactttgaagattgtataacaagagtggctgtaatacagtggttagtattctacgttgaggccgaagggacctgggctcgattcccagcagacacactatctttcatcataatgtcttccaacacttttagcttcatccacttatgcacctaacgcttcttctctctatatgacacatacaggtggacacatagagggaaagtcagcttttttcttttctaatttgtctccagaagttttaccatattctccgctttcactcaaatcttttacagagatcttttcatctcagtgagctttcactttctttcatcctcaacttcagatttttgtctcccgtatagtttttgttgttgttgttgttgttattttctctttctctctgtgttccgtgtgtctttctctaaaccctagaatttcacattgcttctgtgtcactcttcaaatttctgaatagatttgatcacaaaaacgtaaaaagggttttcgtattttgtggaatcacattgcttctgtcagtctccaatttctttgacccggaaatattgtttctttttttccctttttcttttgtaaatttgggattttttcggagcttttatttttagttattgaaaacaaaaaaaataccaaaaggcaagactcggactcagtggttctccttctcccttttatctagtgtgactgcgcatttcttgtaatgggagtgcaaccgtctggatccattatccgggtagggtcagacccgttcatgttctctgagctgaagaatctgtaaaaagatacactttttttctgtttttgtgatctgatcggactagtgaatcatg

SEQ ID NO: 25190 - DNA, 3003 bp, Unknown
  misc_feature (1)..( 3003): 2750-1469P.txt file - cDNA_ID_2703856; gDNA_ID_2214645; Annot_ID_188491
aatctacactatcaataatgtgttcttgttttgcttcgtctagccaatttatttggcataaacacttggtgttttaatttggtttttctaaaattctactgttgctttatctaaaactctacttgagttttgttttgtttggtgtttgcgtttgctttttggagtgttttcttttgaacttttgctcaagtgattgattgctttttggagtgtttatcatcgagtcgttagttatgtagccactattaattagtcgtttgaaaagtagatgaaaattaagacttgaggaaatcaaacacaatccataatttgaattcaccccgaagataatgatcagctgctattgtaatcgtcaggcttcaagtgtatataatttatatttgtatataattcataattcgtatttatttatttatgtataattatttgaacacactccataattcgtattcgtatttatgtatatacaaacacactccataattcgtatttatttatgtatcaaacatataattagtaaactaaataaagacgaagaaacattattgagtagaatagaggcatcgaataacaatattcgtcggcctaatcaagaatatttcttggaaattcgggttgaaatccacatatggaagaatcttgaatagcacgtactttatcaatttaattacatccctcttaacggtctagctactctaattatcatctaaacctttttccttgtacgttatctcataatttgcaggactcttaatcattatcacatttcaaattttcaatattttactaaagagacgtctcgtgttcgtgcgtagctctatattttctggtttacgtaaaatagttcatgattttgtttagcttaccttttgaaaaaaataagcgaatctttcttcctttacttttcttccactcattaaaatgttctctctatatataaatgataaatctagtcttctaatcatatactctctataccacacatatctagaacaacaactagatattcaatattagctctaatggcttcttgtgacacacctgatgcgtttgcttggcttcaaactcttcctcctctttctctatggaaaggaaatttaatgtccatgtgtatttgctctccaaattcatcacacccatctttgaacttcactcttactcgtacccctcaatctccaaactttttcaccttctcgatagtagccaatttcaagactcctattactctctttatttcaaaaactttcagaaccattagcactaattcaactactttcctcaatgaaaacgtcatatctactctattgatgggttttgtcgacgttgttctcaactataacgtcaagagaaccacttgttcaatccaactccaaaacctaggctccacttctaacctcaaagacgttttcaacctcgctttcttcactttcgtgttcctcatctgcatctacgaggcgccaacgagcctgagaacaacttgtctcaaaacggtgaaagatcagctggtaacttgtaggtcaaggcagggctctaagttgctcatggtgcaactaggctctaaccttgaagaacaatggatgagatcgctgaaccttgcaataaccaactggatcatcgagatcaaagcgtttcagcatctcaagtctccttctcctttgttttcatatgctttctcgactcaaggtctatggaaagttcatatgtattgtcctgtggtagcaatggaaatggagagcgtaaatagttctctaaacgacgagagattgttcttctcgctaaactatcatcaacttgaaggtgtaatccaattgaaccacaggatttacgttcgtgaaaagtggtttaacgtcgcagtaaatattgacaacgtcaggtatcgtaaaattgtgtgtaatcaagcatacataagtaatttgttcatattaatttctcttaactatagatattgtttataactaggtgcgacataataaggcttgtgaacgagaaactattatcggaacgtggcatgggaacagaggaaaaacatttcccctcaagaatatcattgcaactaacaccaacgaatcaatcaaacatcttaatggtatccgtacaaaaatcttcagaaaacccattgacagaattcgaagtagagaaaggcatagaagcaacaatagatccaccaaacacattctttggactaaaagtctcagccaacgagaccacaacaaaaagcatgaagccatggaagttcgaggaatgggttcatggttatagcgccaatctcacttggtttctccatgatcttgacgatggaagagaagtttcgtcctctaaaccatcgaaagtctcgatgatgaaccctcgagcttggttcaagaaccggtactcgagcgcgtttagaccgttcacgaagcaaggaggagttgtgtttgcaggagatagttatgggcaaagcgttttgtggaaagttgataaaacggctattgggaaagtaatggagtttgaggttaaaggttgcgtttggttgacttattggcctaacaagcatcatactttttatagtgatactagaaagttggaatttaaggagatgctttacctcaatcttccttagatatttcttttcttactttcaccctaagcaaaatattcccctagtttgttgcttttttcagtaaagtttgtaaaataatacttatgatggaattattgaatttagaaaatacagtattgtgcttttctaatgacttcaccgacataaagaaaaaaagttttgtatatatgaatatcaaagtcgtatatagtccatagtttttttccgttgttgttatccataaatttatttttcaacattattatacgtataatttggtggatctaacataaataaaatcatgtagtagaagtttttttttatttttgaaaattggagaaccacacaagagatggcaataaaataaaatgaaaagtctctatttgtagatctagagcaatgcaaaaagctgacgtgtaccaatg

SEQ ID NO: 25191 - DNA, 3003 bp, Unknown; identical to SEQ ID NO: 25190
  misc_feature (1)..( 3003): 2750-1469P.txt file - cDNA_ID_2703856; gDNA_ID_2214645; Annot_ID_136355

SEQ ID NO: 25192 - DNA, 1146 bp, Unknown; identical to SEQ ID NO: 11173
  misc_feature (1)..( 1146): 2750-1469P.txt file - cDNA_ID_2703868; gDNA_ID_2214482; Annot_ID_133278

SEQ ID NO: 25193 - DNA, 3000 bp, Unknown; identical to SEQ ID NO: 13707
  misc_feature (1)..( 3000): 2750-1469P.txt file - cDNA_ID_2703872; gDNA_ID_2214645; Annot_ID_136351

SEQ ID NO: 25194 - DNA, 3000 bp, Unknown
  misc_feature (1)..( 3000): 2750-1469P.txt file - cDNA_ID_2703882; gDNA_ID_2214645; Annot_ID_136344
cccacgatctcgtacgtacacgtgtctctcatccgcagcctcatcatcaacacatcacaatctcacttttacatatatctccctcgcctcacgaaaaatccattcgtcttctccaattttctcgcgaagaaaactttcctactttgtttcaatccaaacgagtcaaaatgcttctcaagactgtttcttcatcttcttcttcagctctctcgctggtgaatttccatggcgtgaagaaggatgtgtctcctttgttaccttccatttcatcgaatcttcgagtttcttctggaaaatctggaaacttaactttctcttttcgcgcatctaaaagctcaaccaccgacgcgctaagcggcgttgtcttcgagccgtttaaggaagtaaaaaaggagctcgatctcgtccctaccagctctcatctctcactcgctcgacaaaagtactcagacgagtgcgaagccgccattaacgagcagatcaagtaggttattctttctcaccccagtctcttagattcggtattataatctggttgattggctataagatttggtaacttggaacctcatgttgattctgcttattgtttatgaacctgtgaatttgaaattcttcaatggattttggttgcagtgtggaatacaatgtctcgtatgtgtatcacgctatgtatgcttactttgatcgggataacatcgcgctcaaaggtcttgccaagtgagtctccggttattcaagagtgttgatattttcggattttttttgtttatccatagttaattgttggtttcatggaatcaggttctttaaggaatcaagtttggaagaaagagagcatgctgagaagttaatggagtatcaggtcttatgaaagttatttccatttgtttaccttattggagctaatttggttctaacatgttttagtttttttccatgaattgcagaacaaacgtggtgggagggttaagttacagtccattgtaatgcctctttcagagtttgaacatgttgacaaaggagatgctctttatggtaagctcaaaaatgctaacactaataatcccaagtgaaaaaacttctttagtttcatatgtctgccacattctaagaaattagatattgacaccaatgattttgttaagcttttgaagagattgcatattttcactagcaaagactgaattttatctgagttcttaagtattatgaaaatgtatctctcatatggagattcaagtctcaatggatataggaattttaacatacaattctgtgatttgttgttgcaggcatggagcttgctctgtcactggagaaactagttaatgagaagctcttaaaccttcacagtgtaaagaccatctcttcttgagttcatactatatatgtcaaatccgtatttgagaagtaaatctaatcttcactcggcaagaactgttctcagtttggtaatgctttgcttcaacaggttgcttcgaagaacaatgatgtccacttggcagattttattgagagcgagtttctgacagagcaggtaatttatttggtgttctatgttagtggcaaagagctactgttgtatataagctatcaaagagaatctaataggaatttttgataaaataaaacatttctcaggtggaagcaatcaagttgatctcagaatatgtggctcaactgcgacgagttggcaaaggacacggtacataaataatctctcacattttgttctaatctataaatttataaaagaacaagaaaatccacttattcatcctacgtcgtgcctcaaacttggttttaatatatgtctttgaatgcttgtgggtaatttcaggaacatggcatttcaatcagatgcttctggaagggtaagcagcttcgagggactcttgtgtctactgtgtttctatatgtgtctactttatgtttagttctttagcttttacgattttgtgaggtagtagacttctttttctgtaagagacaaaagacatgatcacataactttatattctggtataaggttcatcaaacccacctggtgatcgattctacatcggttcggtcagaatgtttttggactgccaaatgtggattcgagctctagtttagtttgctccggtttaaacgcaattcatgaataagcaaaggaaatcaatccaaacttacgttgtgaaagaagttgggccgaaaatgtctgaaacccgaataggcttttaacccctaaccccttgaaactatcttgtggcccaattaaaacctaattgtttaactgacacggtgccgtttaacttggcatctttgacgcaagtcgactcattttccgtttgtgttccttgctcatttcttatctctagaaacctgtctgatttgctccgtcgcctaaaaagtctaaaaccctaagtgtctccgcctcgtagctttacccgattcaacgaagagtgaattcgcgtgagctcaagcagtatcgaaatctaccaatcatggcgagtcaaacaccgaatctcgagtgtcggatgtacgaggcgaaatacccagaggtggatatggcggtgatgatccaggtgaagaacattgccgatatgggagcttatgtttctctcctcgagtacaacaacatcgaaggcatgatccttttctccgagctctctcgtcgtcggatccgaagtgttagcagtttgattaaggtcggaagaattgagcctgtcatggttctccgtgttgacaaagagaaaggttacattgatctgagcaaacgtagagtcagcgaggaagatattcagacttgtgaagagaggtataacaagagcaaacttgttcattctatcatgcgccatgttgctgagactctttcaattgatttggaggtaaaatatcgtagttcaaatctgggattatctactggatttggattttgcttgttagagatattatcaaatatcatagcttagtgatgtgatcgttgaatagaaattgatttgagctttcatg

SEQ ID NO: 25195 - DNA, 3000 bp, Unknown; identical to SEQ ID NO: 6142
  misc_feature (1)..( 3000): 2750-1469P.txt file - cDNA_ID_2703885; gDNA_ID_2214645; Annot_ID_188479

SEQ ID NO: 25196 - DNA, 3000 bp, Unknown; identical to SEQ ID NO: 6142
  misc_feature (1)..( 3000): 2750-1469P.txt file - cDNA_ID_2703885; gDNA_ID_2214645; Annot_ID_136343

SEQ ID NO: 25197 - DNA, 3000 bp, Unknown; identical to SEQ ID NO: 6141
  misc_feature (1)..( 3000): 2750-1469P.txt file - cDNA_ID_2703889; gDNA_ID_2214645; Annot_ID_136341

SEQ ID NO: 25198 - DNA, 3000 bp, Unknown
  misc_feature (1)..( 3000): 2750-1469P.txt file - cDNA_ID_2703927; gDNA_ID_2214647; Annot_ID_188534
catatgtcttcatttcccttaaccttaatcttaacatagtaaaaatctccttctgtgaaatctatatattttttaaagggagcaatataaaatcttactgtgatatatatatatatatatatatatatatatatatatatatatatatatttcttcattattccttaacttatgattcttcaattttacgtttgaatctaatgatggcagattggtccttgcttccgaatgacttactagaactaatcgtgggtcatcttgagacatctttcgagattgtcctcttccgatccgtctgcagctcatggcggtctgttgtacctccacaagatcaatcccgctgcttaagtatcaaaactcatgatatatcattcaatgccgggttttcgttcagcggccaaccaacggatcatcctctgtttggaagcacactaacaaagatcccaatttatctagtgaaattctggactccgtttggtgatgattatttattggcagagatgcgtgaacgagagggtggggaaccgatgtttttgttgtcgcccttgtcatctaatcgtattatatatggaatgggaataaataaagtgttgttcaactctcttacctcaccaattatcccatttggacaatactacgaggttggtgttcaaaagctcatattattttttcaaatttttatcttttctttttgataaattttgccacttagatagtcatttaaccaccactttttagttattatggtgcacgagattgttacttatttcattgtctaactgattttgaggtaaatcagctaatgtttggaattctttgtggtattaatcacgatcctgtaaataaatatatacaagtcacacaattcataactaagatatataggatttaaactgatatcaaacccatcatattagcagcatgtaatcttatctctaataaattctccctgaccttgctaattaataaataagaccgcaaagttggttttgttattattattactattttccttgtgtcttcaatttagccccataatcttcgatgcagataacctactctgagaagcaacccattcgttaccgctatggattaccctgtcatttatgggataaattagagtgggtggagattaccgagagagttgaatttcttaaactggatagtgaagatagcagagattttgcggtgctttttgctggaagaatgtgcaatttggtgatgtatagaagccgtaacatgagttggactcaagttgtggagcatcctgaaaagtatgcatatcaagatttggttgcattcaaaggaaagttttatgctcttgattcaagtggaaggggacgggtctttgttgtcgaactttctttggaagttatggagatcccctcagtcagaggatcacaacagtcttctaaagaaaatctggtgctgtcaggcgaggagttgttgctagtgcaacggttcacccctgaagtgcggcattatgatgaatatctatatacatggttcagagtgtttagacttgatgaagaggagggaagagaaagtgggttcaagttaatgactctaacgaccgagtgatctttcttggagctcagacgaatctctgctgctcggtacataagctcccatgtgcaaaggagaattgcattgtgttcattgaatcaaataattgtttcatcattgacaatgactcagtccttttgtttgacttaaaaaccagaagaactagtactgcgtttaatgaatgcaaaggctacatgggcgtgttcggcgcaaatcttgaatctttgttgtcttgtggacttgtgaccattcctgacccaacgttaagctttgatttcggttatgattatgaatgttagtctttttattctggattccaatatgacagtttagatgtaacatttaaactatatgaaataaaccatccgaaatacctaaaaactatatgagccagatattttatttaataatttatgtgttgtaatatcgtatgttatagttaagacatttgttaaattttagtgaaacttgttcaattttatttagtaaaatttatttttaaattgtatattagctttatgttttataatatttccaactgggttctaattaaatataaaaatctaaatatttgtaaaatggagaaaaataaaaatttatcatgacatatgatcttcatttcccttaatcttaatcttaacataataaaactatctttctttaatttattatatatataggattttactttaattattttttaaaaaagattatacttttaattgagttataaatgtgaaatttatatatttttaaaatggagcaatacaaaaacttaacgtgatattcagttttacgtactcatctttacgtttgaatctaatgatggcagattggtccttgcttctgaatgacttactaaaactaatcgttggccattttgagacatcttttgagattgtcaacttgcgatccgtctgcagctcatggcggtccgttgtacctccattagataattttccgctgtttagatatcaaaacaaaggttataccgtccaatgtcggcttttcgttacacggccaatgtccgtttaaaagcagtgttaattgcacactaaaaaagatcccaatttatcaaactaaatataatagagtgaaattaaaaaaaaaaatcttagaatgtcaaactaaaatttaatgagtaagaaatgtgtcacgaaagtataatgccaaaagtcgtattatgaggcaaagttagaaaaaccttgtcatattatataagataaaataggattttacactaattatttttttaaaaatatattatacttttaagaaaatattatactcttaattgggttataactgtgaaatctatatattcttaaaagagagcaatataaaatcttactgtgatatatatacttcttcattatccttaacttttaattcttcagttttacgtacagatctttacatttgaatctaactatg

SEQ ID NO: 25199 - DNA, 3000 bp, Unknown; identical to SEQ ID NO: 25198
  misc_feature (1)..( 3000): 2750-1469P.txt file - cDNA_ID_2703927; gDNA_ID_2214647; Annot_ID_136370

SEQ ID NO: 25200 - DNA, 3000 bp, Unknown
  misc_feature (1)..( 3000): 2750-1469P.txt file - cDNA_ID_2703931; gDNA_ID_2214647; Annot_ID_188535
tcgaggtcttgatttagtccaagcttttacgatgatgtgaaatgtcttatggtgatctcatttctgtgaaaatattgtgtagatggttgttgtatagataactggagagattcatgaatcatgtagattatcttgttgagttttttgcagattcttctggatattagtgtgttaatggagggagttggaggtgacgctgcttcaatggcatcatcacctgtacaacaacgagcgaatgaggcgtggaggctgtatcagtattacttagacaagactaagcctcacgcggttaataggtggatcgggactcttgtgattgttgtgatatactgtttgagggttttctatgttcaagggttctttatcgtttcttttgccttggggctttatgttctgaactagttgactgggtttttatcaccacttgttgatcctgagcttgatacgtctgatggtccaatgttacccaaaaaaggttcagatgagttcaagccattcatccgttggcttccagagtttaagttctggtaattttacagtacaagctctctttatgtgctaatatctgctaagctctaaagcctggttaaaaaaatgttatgccatggacaaatcaagccatatgtgagatatctagagagtgattttgagtgagaccagaattaagtagtgcctataagcttagggacagtgatgttatatctgtttttcgtgaatgaagacaagtgaaatacgtttagaagtgacgtcatcttgtttggtaattcttttgtgttagagtgtgagctataggttaatttatatgttggcaggtactttatgactaaggcgttctgcatagcgtttgtgatgacattcttttttttctttgacatccctctctttcggccggtactactcttcagtctcttctattggattgctctgtttgtgctgacaatgacgcgtcaaatagaacacatgattaagtacaaatacatccccttcaatctaggaaagcaagtaagttgtgcatgctaatgaactagtccaaacgtttagaaatcacaaaatgggtttgatgttgatatattgcgtattactcatttcccataacagaaatatggagggaagaaagcttctggcagcagcagctctcgcgcagactgaagcatatggagaagtagtaatgttaatatgggcatgtccaccccatttaaagtccgtcccatttaaaacccacctcatttaaactcatttaactttaagatctattagagttgtccatttaaacccatatacccatttagacccatttagatataaattctaaaagcaattttagtaacttggaatacaaggcaactatttaatcaacataaaaatatgtctaactttttataaaacaaactaaaatcaacacctaccattaaatttatctacgcaaatttaaaatccaaaagaggcattcagtcaattgtctaaaagaagaaaattcaacatttcattgtttcgactttcgtgaggttaattggaaaccatgaaggcgtgtgtcatggatgtatggattcgtgcaatcaatatcaactagggtttcagaatccaatgggagaaatatgattacatttcaatctttgtgacctcttttgatgaataccaccaatcagtggcaaaatgaagaaatgatcaaggaagtgacgcttcgtaccattgcggaatacaacttagataatgtcagtgtgttttgtggattctctacacttcgaaatttggtattgtgttttgattctatggttcttagttcatggaacaaacattgtgtttgttgagcacgtctccacgaatttcgcgttttactggttattggcacactggctcatattcgaggatagatatctgtcttccccttctccaaagtcgaaactccatcaaatagaaacattacagcgcacaagcttgtttcatattcctatttttagggtcaaacagacagaggaaagtgcactttattcctagtttcttttgatctttgtattctttatttatccgagctaacttctcaacttagcggtcctttcacatgacatttccgctttccttcatttgcaccggtgttatatttttgttacatatagaaatttaatagaatagtttaggtttgtaatcaaaatatactaatagtgatttgaaaagtgtaaaacagggatgaagaattgatattgaataagtaaacattaagagtcaatttaccttctcatgatgtgttttcaggctaagtatcaagaattttatccgagttacttgtatcacaaggttttctattgtgtgtgttggtaacttggtatgcagatataaaattgagctaggtttctttcaacagagcctgtataagaatattcattttattcaagtactagttagtaaactaagaaaaaagcatgtttaatcttaaaaacaaaaagaagcgaattaagctatttcttgtcttaaaaagaaatcaacatttcattgtttcgtgagggaatgatttactatttgctctccggttattctcaaacacacgaaatcaaccatccgaaatacctaaaaactatatgagccagatattttatataataattatgtgttgtaatattgtatgttatagttacgccatttgttaaattttagtgaaacttgttcaattttacttagtaaaatatatttttaaattgtatattaactttatgttttattatattccaaactataacttataattaaatgtaaaaaactaaatatttgtgaaatggagaaaagtaaactattatcatgacatatgtcttcatttcccttaaccttaatcttaacatagtaaaaatctccttctgtgaaatctatatattttttaaagggagcaatataaaatcttactgtgatatatatatatatatatatatatatatatatatatatatatatatatttcttcattattccttaacttatgattcttcaattttacgtttgaatctaatgatg

SEQ ID NO: 25201 - DNA, 3000 bp, Unknown; identical to SEQ ID NO: 25200
  misc_feature (1)..( 3000): 2750-1469P.txt file - cDNA_ID_2703931; gDNA_ID_2214647; Annot_ID_136371

SEQ ID NO: 25202 - DNA, 3000 bp, Unknown; identical to SEQ ID NO: 13725
  misc_feature (1)..( 3000): 2750-1469P.txt file - cDNA_ID_2703938; gDNA_ID_2214647; Annot_ID_188543

SEQ ID NO: 25203 - DNA, 3000 bp, Unknown; identical to SEQ ID NO: 13725
  misc_feature (1)..( 3000): 2750-1469P.txt file - cDNA_ID_2703938; gDNA_ID_2214647; Annot_ID_136376

SEQ ID NO: 25204 - DNA, 3003 bp, Unknown
  misc_feature (1)..( 3003): 2750-1469P.txt file - cDNA_ID_2703965; gDNA_ID_2214647; Annot_ID_136374
atatagtattatttatacataatgtaatactctaataatcgataagtttaatatcatgatttgttttccttattactaaagtatgattgcttatcttgcctagttgataactaatgtgatataacatcaatataattattcgtatatttttaaacattaaattaagtttagaaatgtatttcctgataaattattgtttaccgaaatactcttaatactttaaacttctctaactctatcatactcaacataagtaaatggaaaatcatgctggataataggtttagatcgtgctacaaaagtatatttttaaacattaagtgaaaaagaagtttaaatgaattggttttactttgccagattaatctgctaacttgctgtccgcaataagtcaatcacttcagtttgcaatccgtgatgggccaacctgcttggcctgctatttcgtggacataaatattaatgtctaaacccaccccactacagtactatttggactaagcccgtttgacacctttactaattataaccactagtgagtagttatataagattatcttcaatagtagtttcttagaatagttataagagaaataggtataaaatttaatgtttaattcatataattggtaagagatgactcttatataagagtctaaatacatcttaagagccagacacgtgttgtgatataagtgggagaatgagaaatatttgcaaaattctgtaattatgtactactaatcgttttatgtatgtttatgtcatgtatgtttaaactttgatatcatgtatgtttcaaattttatgaattgcaataattattaaaatttttaaaaatcaaatgtttatatattttttaaaaacctcaacttaagagcttacgattggacattgccaaacatttaaacttttatccaaacttttaacttcaaaactttcaaatcaattataaaaatattgctaagaatctttgctaagaattcaccattatagattctctaacaaatcttggcataatcattattattaaaaaaaactttttgtagagttcttgttttttcctttataatttacttttctttctctttttctttttttttggcagaatttaacaattttttaataaaaatttaaaaatatagcactatatatgtatcagttaactaacataaaagataaattaaatgaccaatggaggaggtgacggctccgacgatggtggctccaacgatggtggtaagttcggcaacagtgtgaatctagtgaggacatgcggtggatccggcgagtggttctcgcgaggatggtggcttggaggacggcgatggtggtgaggacactggtagctccggcgagggcagtggttccaatgaagatggtggcttggagttggaggactgcggtagtggtgatgaagatgacggcggtagtggtggttccgccgatagcgaaactgtggtggtgatggttgttgtggtggtggttaatggtgatagtagggaggataaaattgtcatattatatattatacatcaactctaatataaactttattgtataggttagtttcctcatcatttgctattgcaagttatttctctctctaaagatttgatgtaatttaatgcttacttagccattttgcacgacgcaaataaactaataccgcaaaattcgtgattacgcaaataacattatctaaatggccaaaaataactcatcccatctcttcttttttttttttttttggtctaaaactcattcaatctcttctacacttgcattttctaattactgaacaataaactgcttcatacaacataattttaaatatgtttcgtttgagataaattgttcgacattactaaagattttggctgatcaaaaaatttatcaacctttaccacgattcaattgcctagtcataggcacgaagactcttgttttcgtttacaagcatttgaatgctaaaagtacatagccgtctttggagacatgatctaataaaaaaagatctacgttgacgtatagaaaacacattgattaaagaaagatatctcttaaactttatgggcaagaagaagatatttttataacctgatagacacacatggcaaaattaaaaatatctagatatatgtacagttaatgttcttgatattattgtgcccatttgcattagacatggcacaaaaatgaacacgtcatttttcaactaaaataacttttcaacttattaaaaaattcgaagataactataattcgtcgatgcctatacgaaatacgaggttctttttaacaccttctttggacaatagatattgagatttacatcttctgctctttccgacaaaagcccatctcttctgtcttattttcttctgaaggttctgttttttttttttttttttttttttttctcatccaaataagtacttgagagaattataagaaaattcgtacttcgtttctttggacagtgtacctccacgtattcgtctctggtaataatctccatcacaaatctcttttttttttcttttgtgtgactcttgtttctggtggtacagtttgctcatcgattgaatcgatttgtatttcttccacacaagaaaaatggatttgtacttgtttctggattttatatatctggtgtaattgtaagtataaatttgtggaattagcttcttttttttttttttttttttggagaatttactgaaaaagaatgtgatcctagtttatcaaaaaaagaataagaatgtgatcctcctcacatttgtttgatgaaactttttgtgttctttaggtttaattctgaggttgtgtgaaatttggtgaagagaattttgagatcatagtaattatccacttgcttgatgctcatgagctctagtttagtattgtgtttgttttgaattatgattgagataaaggatatttacttctcaggtgatttaatcaaagcctctggagaagatctgtaggtacgtacaaatg

SEQ ID NO: 25205 - DNA, 3000 bp, Unknown; identical to SEQ ID NO: 13746
  misc_feature (1)..( 3000): 2750-1469P.txt file - cDNA_ID_2703969; gDNA_ID_2214648; Annot_ID_136389

SEQ ID NO: 25206 - DNA, 3000 bp, Unknown; identical to SEQ ID NO: 13745
  misc_feature (1)..( 3000): 2750-1469P.txt file - cDNA_ID_2703973; gDNA_ID_2214648; Annot_ID_188572

SEQ ID NO: 25207 - DNA, 3000 bp, Unknown; identical to SEQ ID NO: 13745
  misc_feature (1)..( 3000): 2750-1469P.txt file - cDNA_ID_2703973; gDNA_ID_2214648; Annot_ID_136390

SEQ ID NO: 25208 - DNA, 3000 bp, Unknown; identical to SEQ ID NO: 13743
  misc_feature (1)..( 3000): 2750-1469P.txt file - cDNA_ID_2703981; gDNA_ID_2214648; Annot_ID_136392

SEQ ID NO: 25209 - DNA, 3003 bp, Unknown
  misc_feature (1)..( 3003): 2750-1469P.txt file - cDNA_ID_2703998; gDNA_ID_2214649; Annot_ID_188602
ggagttgctcgaagttttttgaagcttatcataaaattgaaccgagtttcttcgcgttttaggcttgaactggagaccggcaaatgggaagggacttaccaccgatacagaactggaccgcgatggctatcacagttggcggtgttcggcgtgatgcatgcaggggtgtccaattacctgacgcgtggctcggcggagttccatcactcaacacgtgtcagcatctaaagattaggattttaatctcgaccgttaaaattacgcttgtactttattttgggcgtttccctatgtaaaaagtccattgggcctttcttaataaaatcgttggccgactaaaaaaaaagactaaaatcttatcaactatatatacgttaaattgagattagtatccacagatttgtgcatcacaccacacaattgctacttgtaagctaccaaattagacaacattaaaaatttatatttttcatatattgattatggttttttgtagtcataagtttttcttctacagaggaagaaaaaaaagagtaaaaataagttactttcttttccgcatcaccagttatattaaactagataaagcccgcctaaataggtgggtgtaagatataaattcaaatttttatcgataattttaaaatttgaatagtaaatagtgtttcacacacctttttaatatttaatttagtaatttttgtattaaacaaaatattaatcatatacattcgattttactatacattttaactatttatttgaggataattaaatctattttaattttatacgctccatcttatagttgatatttgaattttatatattaactcatacacttttcagcctacaaaaaaaaaaactcatacacttttcaaatatttaatttagtatttttttcaaccaaaatttaatcttacaaattcaatttttcaaaacaatttaaatatctactttatcataatacaatacattttgatttgattgtattcaaactgaaatacaagtcgatttgtaatacaaatatagttttagtctatacattccaccttatttttagtttttctttttagttaaaaaattaaaagttaaatattttaaatatctatgtttcttttatttagttttcctatttatttaagaaaaaagtaaatattttttgtcatgtcaacatctgaacgatagacttgatacgtgtcacgatcacgcgagttagtaactttgaaaaccatactttatataataagattataggaaatatactctattctacaaaaagtcattcatgaaccaatttgcttacatgagagaaaaggcaattacgatttcgagagttcttagctaaacaatctgctcgagtattaaaactacgagctaatgctgaaagaagagaaaaaacaaactaaataccaaaaagaggccaattccgttgcaaaagttggtcaatcgtcttggtgatcaacgagagagatcaaatctgcgcaatcggtagcaaaggtatctgtatcgccaatgctgatcatgcattccattgcccctagcaaagattcaagttcgacgtaaagcggagataagttttttcgaagaaaaaaaaagttactcatgtaagcgagtaagtaactcaaaaaaacaaaaaaaaacctagttttctctctcgcaaaaccagccgccgtctaaagaggttttgcagttttgaggctagaatgcggtggctaccttagcactgattctggccttgtgcgtctttgtttaatttcgtctgtagatttcttccttctcgtttttatggtgatatggttgtagggttgatggtgttggggagtgcggggaccaatttctcttctatatctgtttcggaggttggtctctatgttgttggcagctcccgtttttaggctttgtttcaattttggctgtatatgcggctggggttttgattgatttccagatcttgatctggttttgtcagttgaagctatgtcagtgtttgtcacgatatggaattgtttccttttgtcttcccccgttgtgttctgtgtgtttgcagttgaagatgaagtcgttttgagttggtggatgcctctggtgatgggttctgaccgggttatgtgacgttcttgttgtggactaggcgacgactcgtcagggtggtggctgtttggaggcgatttaggttgtcttccggtgcgggtatttggctgaaactgggtcggcaaatgcatgcgtgcaagaggtgtttgtcttatttggcttgtcatttggcgattctcaagggcttcccttgttcctagtttattttcgtcttctcgtgtgccttggtatggtgtgattgttgtctctctagtatcatttggttcttgctttcgttcctggcggtttgacttcagaaagatgtcttaattttgtggcattaccagtcttattgctgcttcacgtgttcttttggaaatcttagtgagaacctctatggaacaataggtcagcttagtgctttggtctccatctcttctttttgcgagtttatcttgttgtttttacctttcttggtaatttggctgtctggtttttagggattagttttcctccttttggtctttgtctctagggatttttgtttatccgccggcttatgtatgattttcgacttgtatgttctcgttgcaattctaataagataaaaaaaagcgagtcacatatcaaaatttcaaaaagcttggtacagttttcaaaacatgtaaaacatttccaataaccgttttgaaattcattatttcaataacacggtttacttaaccggttctacgtagtccacccttacccattgacatttgacactctgtcccgatataatctcttttgacgaaagtcaggcaaagaaaaaaatgagaatcttcaaataaaaaaaaaagaagagactacggagagtcaaaaacagtgagagctttctttcatcttcagccagatcggagcaatcttctccatagattccgtgaaacgatg

SEQ ID NO: 25210 - DNA, 3003 bp, Unknown; identical to SEQ ID NO: 25209
  misc_feature (1)..( 3003): 2750-1469P.txt file - cDNA_ID_2703998; gDNA_ID_2214649; Annot_ID_136400

SEQ ID NO: 25211 - DNA, 3003 bp, Unknown
  misc_feature (1)..( 3003): 2750-1469P.txt file - cDNA_ID_2704026; gDNA_ID_2214649; Annot_ID_136398
gagcactttcacaattaatagaaaacactgcattatacacttccaattctgtgacatcttgagttaattgttgattcatatccaatgaaacctttgcttgaaaaccattcaaaaaattatcctggcctattggataagaagatgaaaaaagatgctgaaagaacgaagaagcaattttccctttctcactaatcctggtgtgttcttgtccattttcatccagaaggaagctcaaagagttccctaatctagaagatttcaaagaagcatgaaaaaaccaatgtttttatcttcagcaaacagccatttttgactacttttctgtctccaaaagagttcatcatcctcatcagcaagacccaattgatctttaatatatgcaattctaggccaatttggaaactcataacttttcagcaaatccaaatctttcctcaatctttgaatcctactctaagcattagtatcagctgatttttttccatacactaatagctcttcgacattcaataagactaaagatagaggagtgagaaccttgagacattgcattggtccaagagttggaaatcacttgaatacaagaaggatcatcagctattcttttgtcataacaaaactgtccacgaaacaactcgttatcattaataaacttgactaaaacaggacgatggtcagatccaaatctctcagaaaccactggtgagaatttggaaacaaagaaaaccaagaggaattcccaaagcatctatccaatctacactgaatccattgaccatttctagtccctccccaagtaaagccattgcttgtactacctagttcatgcatatcacaagtattcaacatgtcttgaaaagattgaaacgaagaaggtactcttctcggacccctctctttcccgttttcgacttaatatcattgaagtcacctatcatacaccaagcttgcttccgatgtgatccaagactacacaacttatcccaaacctaaggcctaagatatgtcaccagatgcccataaacacaagaaacaaagcatactttatttctagaagaacactgaagatccaaaagatgtttatcatcaaaaagaatctcaatgtccaaatggcttttccaaaagattgctaagccaccacttctcccttgaggttctattgtatacatatagttataaccaagccaatcaataacttttgaaacaaactcgtcaggattcatagtctccatgaagaataaaatgtccgagatatgattttttttcatctccttaaggtgtcgaattgtccaaggattcctcaagccttgacaattccaactaaggacgccttactgatccaacggtggttcacttggaaccaccgtattcttgtctctcttgaaactttgagcttctgtaatgtctgagggttttcttttccttttgaacaccttttcaaaatgaggagaggcaggagactgaataaccttattcttcagagacagctcattaactagtttttctttcctgaactgaaaaggagtgaaatcctgcattatatgatgtttaaaccctgaagtggaggaactagcctcaccaacacatgtggtaaatccagtactaatgtccaaatctagcatctcagctaacaaagtattctctggatgactatcaattgcaacagtagctgatagaggatttgctggcaaagcatctacccttcctttgggagcaattgactgaaagggaaactcagccagcctcggtaaaaacatcttcttctgtttgcctttctcttgtaatgatctcacatcatgtttgatggaatctaagactttggatgggcatctatttttatcatgagttaatctttgacacaagaaacatctctttctaatctgttcatagtcaaaagaaattgtgacaacttcaccagatggaagttgtacctctttattgttacgaagtggattggcgacatgaaacaaaacccgaacacgaacatagtcctgaaactgtgatttttcagagtccatcaccacctccttcacttccccaatacagctcgtgatctctttaattgtgtcctgagtataatagttcaccgaaatattcctcactcgaccccagattggaagaaaattcagataatcaattggaggattctcaatccatctatccatgactacaccccaatttatcttctgtccaaactccaattttcataatttcttctaaatcttcctcagatttgaagaaaaattggaatcgatcctttgagagagcaacacctctaacccgagaagaaattctccaaattcgtggcatatctaatatccaattagacatcctttgattctctagattcaaaaacctacccaactaacgacagttgtttctgttaattgaacaaaagcgcggttgatcagaaagaatcagaggcttattgtcttaaatcgacatattctgaatggctttatccagctccatgatgagatcctgatagagagtaaacaactttcccgaactcgtcaaacctgatttgcaggaaacaaactccaagagaaaaaacagtgaagaaatccgagtaattcagatgataaccaacacagaactgagaatcacaaagcaaactctcgtaacagagaaagagtcagaactaccaaaaatccgaggaagaaaacaacaatttagaccggaccgaacacgtaaatatttctggtagaagctccgttcagaatagaacacctgagagaaaagtctttaggctccaaattaactgggacgactattgttttaacggctagtttcagctactaagagaaagaagagagagaaaaactttttgtcaaactctttttgtgaactccttttcttagatgacaacacttatgagaaaaaaaaaaaaaaattagttttgacgagacacggacataaaaaaaaaaactagggcagagtgactgataccaaaggagaaacaacaaagagacgaactgaagaaaaacctctcggaagaagatg

SEQ ID NO: 25212 - DNA, 3003 bp, Unknown
  misc_feature (1)..( 3003): 2750-1469P.txt file - cDNA_ID_2704034; gDNA_ID_2214650; Annot_ID_188627
attggtactttaactccgaatatttgtccttactgtacccacattaggctttgtcttctccaaataattagtttcactatttaaccgaaaaatctcacccaacataagagacaaataactaaagttgacaaaagaaaagacaaaaaaatgtgaaaataaagagagaaataactaagtttgcttggcatttatagatttttgtttgcaagctttctctggcggaatcctaacttcactgtaatatttactattacacaaaacaaatgtgagctgtgctataacaaaaatttcaataaacccttccaaattgtatagtttttttaattattattctcaaacaatcaataattcaggactgttgagttgtgaattgggtgtgccatgtcgatgataaaatccaaccactagataagtatatgattagatgatatgattagatgatatgattagacacttaatcccagtagcatcctaagggggttaagcacattattaaagtgattttatacctcttttcagtatttaaatctcatttagttttgttttgataaataattctctttgctttctactttatcaatcttaatatataaaacgaataatgtgattattagttaagtacattcctcttctaatagtataaaagtgattatgtttcttcataatcgtatcacgactgtatccagcacgacgttgacttttaatattcagtctcccacacatgcggtattaaattgggagatacagaaacaaatccaaaaaaaacaaaagttttcgtaaagattgttagtttatgtgtctaattctgttttattaagttacccaagcctaattattgagagaagtatatataaactactcccataattatttagatcatatacttaatgatagaatcatggaatttaaattgctacgaataagtcttatggttattgacttactgtataattgcatggaccgtattaaaaatttcattaccctacccaaagttgaaacctattctacttgttgttttctgcccaaccaccttaaatgttatttttctggttctttatgttaggagtttatgtgtcatcttttgtcttttaattccaaaaaattatagagatatatataattcagttaaacaaaaaaaaattaattagacacttacactgtagaaatatatggtaaaagaatttgaataaaaacttatgtatggtaaaatgatacgtatactaattttataaaattattaagcttgatcgttactcgtttataataaaactattttggtaaaacaaaatctaatatataatattgtatatgtatatatatacatataatgatttgcagcttgattagttggtacggggagcgagcaataattatgtttggatgggaatgggatactaaaacaaaagttgttaattaaattaatttaaaaaatagacatctacttttctcgatgaaactggtggagaagagcggtaatgagagagaccatacttttgattagaccaaattggcatctttcttgttattaagaggggtacatagtatcatcatcatccttaattaattagagtccacgcaataacaatagaagactctgtcctccccatttgtggtaaatcctcttctcatgattattgtttggttgagtatatgttttattctattactactcaccagaagaacattttcatatgtgattcgaatacaatgttacatttctaatatgagagataacatatgcacctactttttatacatgcagttgtatattgtgtgatgtatagttatatattttcgtctaatttctgttgagttcatatgtcatacctaatttgctataggattttattgactgaacaaaaaaaaatgtatacatggtctttatcttagaataatggatatatctatttcttttatttgatttgcttcgcaaatgtacgaatattcgatctttctaaatcgaattgaatcaaataacagatcgaaacaaatctaacgaatattttgtccaaccctaatattttttttaaaaaaaatgttagttgtttaattatattactaaaatcatgaaaatataataaatgttgtaaatgatagaaaaaaaaattgaaagaacgtttttctgaagagtttatataccttgtatacaaacatcttttaataaaaaaaacaaataattcatattaatggtgacatagactgcacccaaaaccgcagcgcaacagtgctgtaacagtattaaaatctttacatatacatatgtatctatgtatttttgttactattcgaaccgtatcgcactttttcgtaaaacgcagttactagtcagaaattaaaaatatataattttaaatgaaagcaaaaaattatcgtaaagtttacacttcaccgtcaaaacacagctacttatgtcagtgactcttcttctatcaccactacacgacaccaaagaaaaacactaacacactctctctgataactctcgcgtgactctcctccttcaactctaactggttcgtacccttcacgctccattaccggcaacgcgcttatcgtctggcacactcacccgcaccgtacccgtcgtcggtcttttcgccaatttatcgtatttttccgtgaaagagaataatataatactctaataaagtgttataataaattacaacgttactatttacaacgatttttaaaagaagctgattattatttcttctgtaactctcttctctgttgctctacctgttcttttctctctgttcattctcttttctttagcttaattcagcaaaaaatttatctttgtttctctcttttgtttctttcctctgcaaagtaaagttatgagagcttaataatgtttgtctcatcttcaagcttcagatctgattccttgtttctacaagtaattgtctctttctttttcgattaaccaccatttctgtgaagaaaacctttttgcttgcttcaagattcgagtgaggaaaattttagctgaaaatg

SEQ ID NO: 25213 - DNA, 3003 bp, Unknown; identical to SEQ ID NO: 25212
  misc_feature (1)..( 3003): 2750-1469P.txt file - cDNA_ID_2704034; gDNA_ID_2214650; Annot_ID_136418

SEQ ID NO: 25214 - DNA, 3003 bp, Unknown
  misc_feature (1)..( 3003): 2750-1469P.txt file - cDNA_ID_2704038; gDNA_ID_2214650; Annot_ID_188625
aagaaaaaaacaatcaagctatttataggtttataatcttatcacaataaaacgaatgcagggaataatggacaatttgtccggttgtaatctaaacattaaacaatgaactatgcttctaattatatattgttatatattttgaaacaaataaaaggacgacatgtcgacatgtgcattataatactaaacaacatctattttctttacgacaagaatacaaaatacatagaaacactgaaacgttaacatatacaacttacacacctgaatgtttctacaaggagatgatcttagatcagtggtaaaactatattttctttttttatataattcttaacggttaatccgataaaaatatatagaagtgtttcagaatagacttttctttaatatcagccgcctatatttctgactagcattttaaccaattaggtcaaaaaacaactaatagattttctaaacaaatatgtttttgttttttcttttttttttgaaaaatacaaaatgtttttgttttcttttagtcttagtgaagcaagggttgtctagaaccaatttgccaatttgttgttagtatataattttgatttacatcattgtaactgccacgtgttgcatccttacttagcttgtctaatatgtcctaacaatacaattctaccataattttctcacaccccttaaagaactttttgactatataattcaaaagtatataaaagtatgaaactaattttgaacaataaaagaaaattcatatcgttctttttccttgttaaagtaaaaaaataaaaatccagataatatttctcatcatgtaatgatcaacaagaaaccaatttaagactgctaaacatcgatgattaatgctgaaaaaattcttatcgtgaaactgagactactaacatcgatgattacgctattctaatattcgttgagacaacccaatactaattatattcttgtgttttgtgtatgtatgcactgatacatataacatatattgatatatatagctttcgtggagtcaccattgagaatggttggatccagtgcaagttccatactcgaaacttaatttgttttcatgcaagttgctccataataagatacatttatttgtttaatagggcagcaatatttgctttgtcagatttaaaatattttcaaattcacaacagttaaacaaatattgccgtgataaatagtaattattagattaatttttattttttacttattttagtttgaattgaaatcttgatccatactaccaacaaaaataaaccactaactaacatactacgtgtagttatttttaagttttcatagtttattttgttatgtattaattacttttaattataagtgttgattcgatattttctgaggaaatctatattaaaactcaattatataccatatttatttattttatttaataaaactataaattcttacaattttataaataatacaaacttgtgttttaggaagggatgttaaaactttatggttcttttggaatttttttaaaaatcaatggtagttttagaaaacaaaatttaaatagtactatttgcgacctttgatatatcaccctatatatatatatatatatatatatatatatatatatatatatatatataggtcatttgataagaagcttacgaacaaattatcttctcgtaacagttgccattttagaaagaaaaaaatcaaattccatctctcctactgccaattggaaaattaaaatcttattatgcaagttactaactcctctggttagtacatatacgagttgcataacttactgttattgttctttcttagttaggttagatactattgcagagtcatgtgcttctgtgtactccataatatataatttgagggacctattaaaagactaacaaaataaaactgttgaaatgacttgcaagttacaaacagagcaccaaagtgatacgacgaatatttcccatacaatgtcaccactagccatcattattggtgaattgattagctgctcaaattataagccgaatagagaaattaataatatcgagattaatatatcgttaaacaaataaaagtaagcctttgaataaaaatatgtagaggtccacagtgattagaccgaccaaaaaataacaatatttaatttcactgctataagaaagtttatgacataatgataagattcaaagaccaaaatagtagaattctataattagaggaaaatactattttcttttctcattatactatacttgccagcccattttgtcatttatcatgaaaattaaattgttttacatatcttcatttaaatgtttatagtaacaagttggaccctcctcgttatcaaaggtaatcgccttcagtgtttaataaagtaatacgattgaggacacaaagtgaatggtttaaaattaatttccgtgggatttaaagacgaatacaatgtgatcaaggtggtttgacgtctaactatagctagtctaaactagctagctaggctaacaaccagtaataatagctgaccaatcatcaacattcatttctttggatttaataaagaagctcaataacatcgactgactaattattaaaatgataataaaaactatttagtataataatcgtcgtccacgtcagagtttcacctctttctctccggctttgcatggctctttgtttctccttatctccctcccttacctattatacttcctctacaatttcattgcttcttgataagagctctctcttctttctatctcttgttctttaatttgtctctctctttttctctagcaatgcttggaagctatagagaagtgagtattagtgtctctctctttactttcactatctctgtttagatgtgtgtgtcggatatataaccggactaatatacgtataacttatagttattctatcttgaccattgatatatgcgaatcactctatggtattaataaggttatg

SEQ ID NO: 25215 - DNA, 3003 bp, Unknown; identical to SEQ ID NO: 25214
  misc_feature (1)..( 3003): 2750-1469P.txt file - cDNA_ID_2704038; gDNA_ID_2214650; Annot_ID_136417

SEQ ID NO: 25216 - DNA, 3000 bp, Unknown; identical to SEQ ID NO: 13769
  misc_feature (1)..( 3000): 2750-1469P.txt file - cDNA_ID_2704042; gDNA_ID_2214650; Annot_ID_136416

SEQ ID NO: 25217 - DNA, 3000 bp, Unknown; identical to SEQ ID NO: 13768
  misc_feature (1)..( 3000): 2750-1469P.txt file - cDNA_ID_2704049; gDNA_ID_2214650; Annot_ID_136414

SEQ ID NO: 25218 - DNA, 3000 bp, Unknown; identical to SEQ ID NO: 13766
  misc_feature (1)..( 3000): 2750-1469P.txt file - cDNA_ID_2704057; gDNA_ID_2214650; Annot_ID_136410

SEQ ID NO: 25219 - DNA, 3000 bp, Unknown; identical to SEQ ID NO: 13765
  misc_feature (1)..( 3000): 2750-1469P.txt file - cDNA_ID_2704061; gDNA_ID_2214650; Annot_ID_136409

SEQ ID NO: 25220 - DNA, 3000 bp, Unknown; identical to SEQ ID NO: 13787
  misc_feature (1)..( 3000): 2750-1469P.txt file - cDNA_ID_2704086; gDNA_ID_2214651; Annot_ID_136426

SEQ ID NO: 25221 - DNA, 3000 bp, Unknown; identical to SEQ ID NO: 13784
  misc_feature (1)..( 3000): 2750-1469P.txt file - cDNA_ID_2704102; gDNA_ID_2214651; Annot_ID_136432

SEQ ID NO: 25222 - DNA, 3000 bp, Unknown
  misc_feature (1)..( 3000): 2750-1469P.txt file - cDNA_ID_2704132; gDNA_ID_2214652; Annot_ID_188667
gaactttcgtttggtccaaattatgatcttagaatcatcaacattgcaaacttattttctttgaattctatcattcttgttttaaataattgatgtattcgatgtcttttcatgggatgatatatcatatattatcatgtgactctcgttcaaacaaacctcaaatcataaaaagttgagtaataaattctattgggtcattattagacatttgtatacgtaaaaagaacatgtgaaaggatttttgccctatcgtacacgacacgtttaagtgtgttcacaacttatgaccacaaaaagtttctgattctttcctagccacgggacaaaaagataagaatcacatgtaaaagaacataaaagaagggtcatgtgctttctttgttgacatcttgtgattgaagcaaaacctcatcatataagcctaattaccaatgatacaaaaacaagatgaagatcatgaaagaacagaagatatcaaaacatgaacagttagatcaattacctcagccaaaaacagaggtcttcaaaaaaacagttggagattgatttctgtgtctaaatctcatcactgcatatgagaggacaagaaccctaattcagatgtcatatgttaagcaaccacattgcactcaatcacaacagtcaggagaactgtagacaaagaatttgaagtttttttattcacttgacacaattaaaatcataaagacttaagattactacaacacataacatacatagaattttaaagtaaaagccaaaccagtttatccacagacacatttgcaggtctattctcagcgaacaatggcagagacttcattcttgcaaagacggtctttctctggttcaaagatgaaaatcgattctagttcagctgcacaaccgtacggtgcaagcaacagtttgtgcccaatatttgagtctagcttttacatcatctggatcatcacctgaatcaaaaattgcaacaatcaaacattcaagtcaagaaaatgttcttcataatcacaagactcaaatctatctcagatttagagatttaccagggctagagatcttccaatttgcaattggagcggtcgtggtcggtggtggcgacgaatcatcttcctcctgggacttgtggtggttttgttgcttatcatctaagaacttctggctcatggagtaacaaagctctaacgcaggcaaagtgttgcaaagctcagggatctcatcgtaactaaaaccaaaccctagatctaaacaacctttaagctcctcaagatcatcatccgtcaaactcttggctctcgtcaaatcatcttgatcatccaacgcgtatccctcaagcaacacttggctcttcttcttctccagcttcttcctactctctccggcgaaatagcctcctcctctgccgccagaatctccaatcgcggcccacgtttcttggattcccccgtcgccaccgtcgtggtgttctggtaaggttgtgttcgatatatcatcagcatttgctggtttgttctcttggacagagtgtgtcttccatgcaggtggatgtgatgattcgatgtgaatacaagccattggtttttctctctgtgattgttttttgttatcggatataacatattgagtggtgaggaaagattattatataaaggagatggtttctttcttagaaaagtggcgacgtagaagcatcaattattgcatatatgccatctttgttgtggggccatatgcaaacgaatcaatgattccatgaaacgtgtgttcgagaaacattgggtttccattttgggattcgtctcggtttgtctttcaagtttcaacttctatttaatttatggacatctattttactaataataatgttgcataaacattgaatcacatcgagaaacataaagtattgttgtgaaaatttgtatactacttaattggaaggagaaaacaaagtgtattcaaatgaacatgagaaattatattctgatattaaaaagtgtattgcagaagagatcactagtaatcccatttatttacatgatataaaattgaattgcgacctgagaagacatgaagttgacatcttcttcataacattgtttacaacatcaagcaatgttgtcattggtcatcaagaaatgttaaaatcgtcccattaatttataaaaacttaaaaagtgtaaattttcaaattgtttttttttcaacttatcaatattggatttatctaaagaaaactatgcacggagtcgccgctggccacacgaacagaagaagtatggcctacttcagagagtttgattttggtttcagatattggtataaattatttttctagacacttgttctaactgtctctagattcgtgtttagtaagttaagtatctcatgctggaacatgttatagtatgttgttaaatgttatccatatcatatgaaagaacagaatttattagtttttttttgtggttcaggtatttataaacatgttaatctttttttcttttgggttaatgttaaattttaataaatatagcaatcttaatatgacttgttagcaagaaaacgacaaaacactctcagcttaagtttaggtcattttcttaaaccagaattcagaattggagttcagttggaatcaagatatgttggtttaatttgtttgtttctttatcgatttgttttttcacattatcaattcttaaacgctaaacaaaaacgtttgcttttctattttcctttgctcgaccaacgaaatttattttcttttgaccacattgtttttcagttttgtgaaaagctcatcaatatcttaacaaaatctttatttagactataaggttcaaagctcttgacttcatccatttgttacacactttaaaagaaaaacaacctcacaaagccagcttggtaacaaaaaaaaagtcaccttataaatacaccacaaaaacaacacatttcttcaaatctactaaaaaacaaaaaccaaaacaaaaaatg

SEQ ID NO: 25223 - DNA, 3000 bp, Unknown; identical to SEQ ID NO: 25222
  misc_feature (1)..( 3000): 2750-1469P.txt file - cDNA_ID_2704132; gDNA_ID_2214652; Annot_ID_136441

SEQ ID NO: 25224 - DNA, 3003 bp, Unknown
  misc_feature (1)..( 3003): 2750-1469P.txt file - cDNA_ID_2704136; gDNA_ID_2214652; Annot_ID_136439
taatgattcgacccgggataaaagcagcttgagaatccgaaacaatcgagtttagatgagattttaaacgattcactaagcatttggagatgaccttgtataaaacattgcaaagtgctataggtctatagtcggagagtgttgtagggttagtgatttttggaatcatacatatgttagtatgatttatgctgggtttcataaatgatgtttcaaagaattttttgacttctaatataacatcgtatccgactatatcccaacaattcttataaaatcttgctgttaacccatcaggccctggggctttatcatctcctatttggcagatagcatcatatatttcggtgtcactaaactcttttgtaagatctaaattgactgtattagtgactgtggatttgaagtccgcaaagtctattggtgatacctttataccattggtgctaaagatatttgtaaaaaagtcctgagcgtggtttccaatttctttatctcctgtgaacatccttccttgatcgtccatgattgtgttcactcgattttgagaatatcttgtttttgtacaggcatgaaaatagccggtgttttgatcgccttccttcatccattgattacgactcttctgcttccaataaatctcttcgtcactaaaggccttcgctagtgactcttgaagttgtggaattagttgtctgtcaaccctccttgtactctccattgctctgtttaggctgctttgaagttttttgattcgttgttctgagtttaaattagaagcgtgtttcagtcttgccatggcttgtcgacaactactgatccgttccgtgataggtgtagaacgtgaattccggtttgtcctccagcttgtttgaacaatacgtttgaatgtcggtatgtcaattaagcggttatcaaaacggaaaagctttgatcgacggggaaatgactcgttgaagtgaactaggaccggtttgtggtcagagcccgtgaagtccaggaattctgtttcagcatatggaaatgttgcagtccaggctgaattaataaaaactctgtcaaggcaacatttgactgtgtgtgtatgtctttcccctacccaactgaatctatctccttttgatctcatatcttcaatgtcacaatgagaaaccatgtttctgaaatttctaaaagtccattcctctctcatgggaccaccaattttttcagcgttcgaaagtatctcattgaagtcacccactagcaaccattcagcatttcgattatctgagatatgttcaagagtttgccatagttgatgacgttcagattgagtagggtgaccatacacacaagacaagtagaagctcttattattaaatgttacatgagaatcaatgagtctttcatcctgagaaatcaaggataaagagacattgtttttccacataagagctaagccaccactccttccattagggggctgagttattacattagggaagcctaaatcatatgctagtttacatactttatcacactggtttaaggtttcaactaaaaataaaatatcatagttatacatacggaataagcgaaacaaccgcgattgagtcagcggcataccgatgccctgacagttccatgagatgatcctcatattggatcccttaggggtaccgggccccccgcgcctccgtcacgtccatcatgtatcgaacacgatcctgcagattcagtctttcttcctttcttgcaaagttgactcagaacgcccatttcatctgcagcttccacctgttggtacatttcttctaatcgaaccctctttctcttcatgaagacaaactcattttgtgcattgtcagaggactcaaggagcagatctttctcaaccggtgcgtcagttttaactcctgcaagtttggcgtgaaggtagcggagtctttcaactgtgaggtctgtgtcctcaatgacgcatggaaccgaataaccatctgaaagtttttgtacctggcgttgattcccctttgaaagcgaagattgaaggccgggaataagagtcgctggatccactgtctgaagagtatcagtgtcgcttatgtcatgttctttgttgtcgtcgtgatgatcgtcatcatcatcagcatcatcatcatcacttgtctccaccggatctgcccaataggagactaatattattttggggttctttttgtcagaaattacttggatttgttttttttttcaaaccacacagtaattaaaaataaaactttttacattggcattttggtcttaacagcattgtgattcttctcctgccaacaaaaattcatctaataccatcatcaattatatggattattacaattttgttttgtcatttcattctaaaaaatatgagtgatctaattcttgtaaaattttgatgtgtaacctgaaatattgatacactaatctatagccaattaaaaatgacaaaacataacattgggtaaatagtaacataaaaatatacatgaatcataaattttaaaagtatgctaagtatgtataagatttaaaaaaaaaaagattttaagagagttataacagtaacacacttgaaagccgaagttttgttcttccttgtctcagcgccgcgttttttctctcctcatcctctcgatgaattcctctcaagcttgcttcttccatttttctcttagaccaatctcgctttcgcatccctcctatgccttcctctcgaaacgtaagttttccttccccaaattaagtgcttgggaatcgaaattttaagagattgttgttacctagactagttcaggatacaatcgttagagtttcgttgcttcgaattgattaaaccctaatttcaaaagcacagacctgggtttttcactgttcctgcaaagttgataactttttcactgatactatctcttagactagttctcttaacccggaaattctctcaaagtatccaactttatgaacagaaacaattgttgaggcatg

SEQ ID NO: 25225 - DNA, 806 bp, Unknown
  misc_feature (1)..( 806): 2750-1469P.txt file - cDNA_ID_2704155; gDNA_ID_2214652; Annot_ID_188660
aagcttgaccattaaacaaacagaaccttcttgataaaatgctcgaattcaaaatttaagtaccgattggtcctagaagaatctgtaaattaaacagctcttggtaagaaccaaacctagctttcaaaacatgaaataacaataagaaacctttttcgattgaacggcgaaatatatccattgaagatgttgagagtgagaatcgaagacgaagaggtgcaattactcgcagtttttttttttttgtaagttaattattaatttttgacttcattaaagttaattatttgctgaaaaaaaaaaaaaaaaaagttaattatttagtatcttcaaatataatatttaaaaaaatctagccatcttaatgcattttaatgaaaatcctacccaagttttttaaaggtcaatttaaaaagtatcagttttgatttttaattatattcaatatttgttaaattttgtttcatatgttaatattaaaaacacaatctatttcctaaacatttatatacagatcttttttaaaaaaggttagtcaaaaactgttggaaaagctaatctttttttaacaaaaatagtaaaatactcatatacgtaactttgggcctttcttaaatggctttgggcctttcgtaaatgggcttatgggcttaagtacttcaaatctgatagtatttggtttattgcaacaaaaacaataaatggaaatagcgatctgagctgaccaaccacagtcgcggacagagctaaaaccaccatttgaagaaggagaagaagaagaagacgattcggtgaaagcgaagatg

SEQ ID NO: 25226 - DNA, 806 bp, Unknown; identical to SEQ ID NO: 25225
  misc_feature (1)..( 806): 2750-1469P.txt file - cDNA_ID_2704155; gDNA_ID_2214652; Annot_ID_136435

SEQ ID NO: 25227 - DNA, 3003 bp, Unknown
  misc_feature (1)..( 3003): 2750-1469P.txt file - cDNA_ID_2704179; gDNA_ID_2214653; Annot_ID_136464
aattcgtgtagtattttgactaaggaattgtcttaatagaattaagcagttacaaagttttatttacacaaatattttttcctctcggcacaccttgaatcaaatcaagcatcgtttaaattaaattactgtaatggattagataagtactagtaataagtaaagtatgtttgccgacgggtgaaattgtaaaaaagattggatactttcttttgtttgatatgaaactcgaatctcgtgattaaaaagatggcccgacagtgatttaatgagagtcaacaaaaaagatgtaaaacacattattagcaactaattgtactttatttttataattttcacacgtttcctcttttgtctattttgattggggtcattcatgctcaaacattacagcctgcgcattgtattatgttttgtatgtctccggcggaacaaacaatgtgacatgcgtttgaataatcagtctaattgtatgattggtgtgttcattcgctattaatgcaaatggtgtccaaattattaaattttgagttaaatccgtggagaaataatattcctttcattttaaagcaagtgtcgttttagactgattttttttatttatgtcgtttatgaattaagataataaagaagtattaataaaaatgtgagacataaatatataattctgaaagccaatcttatcttcaaatgcacatttcacttatacgtattcagtattctgccattcaacaaacccataatttattttgtctatggtaaaaaaaacgcatatagtcagtcatattagaattattttacgaatgtaatttttattgctacttatcatgtatgcttaagtgaaaatagtgagtcactatcgtcattcgtcacccatctcatgcttggcgttggcgggctcgaggtcagttttcgaataatccgtcggtgttaacagaataatccgttattgaaaaactaaacgccgttaacggaaactgtgtgcttagctggcagacacagcagagaagtcaataaccagctggcatgatcaccgttttgcaattatccccataattaccgcaacacccttctatttttttatccttttttttctttaattagtatttactatttattatcgttatgttcttaattatcctattattgttttaaatatttttatatagcgaaataatttatttaagaaaaagtcaagagaaaattaattgactatatatggaaaataatttgagggtgcgaggcatgacctagctagagaaaaataaaataaaatgaaggcatgcatggtgcttggttcaatgtaattagtggttccgtaggtctgaacggtacggactggccatgatctactagaaacagtaaatagttaatacaaagtaattaattatgagtttcagcaaattaactactctatatcgaatgaattaaacagtaatccccagaaaagaaaaaaagagaactatgacagccttttcaaaggacacccgaaaaccaaaatgaagattttaaaaatgccagctctgcaatagatattgaactttcatttgtaattttctttatttttgttgcattacacacatttgttatttacatttaaattggctattgcaataaaagattactttatatgcttataatagtacaatatatatggtggcttaaacaaaagtttggctggcttgataaatacatcttacatcgaatgacgattttaccctctatcttgctgtctctgagtacgagggttgaaatccttacgtggcattttttctcatttttcttggtcaaatagtttaaccaaactccaaaagtctgtgatttgttgacatacttctaactaatttttttttataataaaaatctattgtatctgtagaaataatcattagatttactttctagaatataacttcttatttcttagtaatttgtccagatttttttttacaactaactaaacactagttaaaatgttaatgtctaaaaaataccattacaattattcaatttaataaaaattgagtcggccaatttaatgcgagacttctgtacaacgaccctaaaagtgggtttgataaatgaaacatattgcaacaaaaaaatactagtaataatgataaaatagtaacatgtcgtggcgcattgaatatcctacgaaggtttagtgtttacttttaaaaaatcctaatatgatactagtacatatagctagcttgccttgcttatgctattgcatagtctgtattaataaatgatgttatacatttcgatagagtaacattttgggaacatgagtgaacgtgcttgaatcttcgtgcccttgacgtcagaagctagtaattttaaatactaattaacattcatacaaattaacagatacaatgtactatatcataattcgtttccgtaacacaacgcaacaatttgaaagtagatgtactttagtacttagttagtgtgcaccaaaaaaaaaagatgtagttagttagtaaggggttaaatgttttaatttattaagaaaacttaaattcattaaatgttagaaaaagtctaattagtttatattcgaacactgtgctcaaaattaaaaagtcaactattttagactatagagtttattaattaataataaattcgataaatcaccgtattattttcttcaacgacaagtagccgtgaagacacgggagcgaagagagataaacagaagatgaagaagaagatcaatgtcataatcttcagggagataaatccgtaatctttattaatcaaggttaatccttttttttttcttcatcttaattctttgcgtcttccttttctatttatcacgagatctgtctttctttttcctcttctttctctctcttctctctgaagacagtacttgtttctgtccggcgttaaaagcttcggtggtggtctcttgacttctctgagaagaagaaaaggaagctgagtctcattttagattcagctcacgaggaagtgacgacgatg

SEQ ID NO: 25228 - DNA, 3000 bp, Unknown; identical to SEQ ID NO: 13809
  misc_feature (1)..( 3000): 2750-1469P.txt file - cDNA_ID_2704183; gDNA_ID_2214653; Annot_ID_136466

SEQ ID NO: 25229 - DNA, 3003 bp, Unknown
  misc_feature (1)..( 3003): 2750-1469P.txt file - cDNA_ID_2704191; gDNA_ID_2214653; Annot_ID_188709
ccaattttagtttcattgttttggttgtaatttcttcataaaaccattcaagttctaattgttgttgtccaacaaaaaaaataaaaaaatcaagttctaacgaaatagtaatattatgattcttgagtagcaagaacgatcaaaaactcaattttaaaatgtttttgtacgtgagatgaaagaatatttgaacttttggagatctaagttgattcgttatgtgttttgatgtccgtcagttatataatatgtgggtattatgagctatgaagtgcgtttgatgtccaaagtctaaaagaaaaggtgagcaaaaataagacattcttactttataatctgataatatatatataatgtagtcacttatccatacattatatataggattagtaccccctcatcatgcttcaacgtgtgatctctttctccacaaactattttttaagggaccgtgtcttcgtatgtggtttttctgctcgtctaaaaagtcaaaatttctgatggatttattttaccatccattgtttcacgttttccatttcatgatttcatgcgtgctaagtaaaaggtaacttaaagtatgctatataaataattacatattattataatgatcattctagggatttatctaaccaagcatgaattctgataaagtcaattaccttttctgtgaagaaaaaaattactcaactacaagtgcttatagttcatggtttctcgatggtgcaagtgtcactcaagacatcttccttcacaattccctactcacaactaagtgcctttgatccaggaccatgagacgtcttttagtttagcaagtacaaattgtacaacttattccttttttctaataatttaaaatcattctttatggatgtttttgaatatttatatcaactagaaattaatctgtaaaatttttagaaaatattttaatgcatttgacatgacctctaaatagtttgaaacggttgaattgtatacatggttcattgaattatattcactttgataagataatattgtattacattaaccaaatatatgcccaagttaattcagccagtctataagcatgggcacaaaaacatggtataggtcagtggatttgaatatatttagtacatagtcgcgtttatatgttgacgcatgtgtaatcacatgtatatgtatgcgtgtatgtgtttttgtgaccggcaagatgagtaggcaagagataatgcatgccctacaaatcttaaatttctcactttgtaaggaaaaagagaaaaacgaaaaataaaatttagttgcaaatttctcactattgctttcgtgattatgctcactgagttatccattaagctttttaaaagttaaacactattttgaaaatataaattgtatttacgttggagaaataatcaaaacctatattttatttaatttgtaacatgactgagcgccgcttattaagcgggaaacgtatctaattaaatactctttgaactgaatcgattcactgtattggatctatatttctcttaaaatggaaatgaagttcagcttatcttttagttgttgcatgcattcttacgtgattccaattatgaatttggaaaagactcgatattcttacatatatgttatgggtttgggatttatctagatcctgatcttatagtaaaattatctgcagtttaaatacatttctgtacatgacacaaatcagtgtttttgatgctgttttattccgacttcatctcttgttgcagtcagtaacttaatattgggggttttcttaatattttaaggttattgaattctaaatcttgcaaaatagttgtgtttagttttagttattttcctattaaagctcatgtctatcaacaaagaaggttggtattattcttgagggacataaacaaatgttagatgcatgcacgggaaaaaggtggattgttctttacaggaaaaatatgcaattcaagtgggaacataagggagagagagggataggttgattttgactcttgcaatttgattatataatatcaaatatgtatatttgtttaatgattaagaacaattgtcaagttacggcgattccataataatacgaatgatctcacaaacaaaatttgctgtgcctctaccaaatgaagtattggtcaacttgtgacaatggcgatgattcaaatctattatctcatacaatttttttaaagataaggtattttttgtaaaacatttgaaaggagcttaagtaactatgacacatactgcatgtacagtaaagcatacatgtacccgtaattaccaaattcgaagatcaaagtttcgaaatcttttgagtcggttaatgtgtaaatctctctttatcataccaaagtacatgcatagattacaactaaaagctgatgagaacacacgaacgaaatgaaatagtcaggacattacatgcaagcatgcaacttcgtatatcctaaacctttcattttgattagtgatataatgatatttacattcatagagaaaaaagggtatgcaactatgattttggtttctccaaaatagtatatcatcgtataagtacgcataacaatctttttgaccaatgacaacacaatcccattatctattggttatgagtattttgataaagtaaggatttataaagtacaatttgaggatgaatattttgtaggcttaattaaagaatgtatgttctattttttttttttttttttttgacatcgtatgttcttatataattaacctcaaagataatttagatttaatcatttaaatacatatgatttttcaatcaaattacctcaaaaaaggaaagaattatagtactatctatattaaaaagaaaaaaaacataaaagaagagagaagaagaatgtcagtatcatcacgtggctctctctctgcccaacacaaatctcttcttcttccttcttccctctttcttcttctaaaatctcctctcttgtagatttgccgcttctcatg

SEQ ID NO: 25230 - DNA, 3003 bp, Unknown; identical to SEQ ID NO: 25229
  misc_feature (1)..( 3003): 2750-1469P.txt file - cDNA_ID_2704191; gDNA_ID_2214653; Annot_ID_136468

SEQ ID NO: 25231 - DNA, 892 bp, Unknown
  misc_feature (1)..( 892): 2750-1469P.txt file - cDNA_ID_2704210; gDNA_ID_2214654; Annot_ID_136471
atgacatcatggccgttcgattcacgacagttattcacttggtcctcatcggactaactgaacggggcttatgttccaatgacaacaatttttttctttttgagtaatcccggtttactcaacttactcaaccgtaccggtggaagattccttacagtaatactaaagcttttggcttagctcattttggtgatgataacagtaatatcataagtacataataaataattgaaacttttgtaagtatcctcattttttcagaaagtaaataatatcaaatgtattgagaaaacaataaatgatcatttttttattttaattagactcaaaattaaataactggaaattaaaaaaccaaataaactgaaaattattatctaaaatacagtaactaaaaatttgtcttgtcgataagtcggataaaatttattcatataaatatttagtcatatacaagtaaaataatactacaaataatacacaatcagtcgatgttatatacaataaaattatagatttataaaggaaaaaattatccggcgatatatctgatgtcaatctctagtgggttagcatttttattgaaaaattgtattgcttagtttttttattgttatattgttagtgaattaaaatggtactttggtattttcatatatagactttttgaaaataaaatcttagattttttctaacaagagttaccaaaaatattttggaattaaatgagccggcgacatagaagaatagagagggttaaattgaaaattcataaagtaggaaaaaattagggttagactcgatcattcatagctgcgactattctctgctctttctacattttctcattttctcttgggctacttttcgactactaacaaatccaacgatg

SEQ ID NO: 25232 - DNA, 3003 bp, Unknown
  misc_feature (1)..( 3003): 2750-1469P.txt file - cDNA_ID_2704214; gDNA_ID_2214648; Annot_ID_136388
taattgtgaattttatatagtatgtgaaaaagtattgaaaaaataatgaagatggtggttatatatatgttgggatgtgtgtgaaggtggattggacaccagagctacacaggagattcgtggaggcagtggaacagttaggagtggacaaagctgttccttctcgaattctggagcttatgggagtccattgtctcactcgtcacaacgttgctagtcacctccaagttagtatatttcttttcaatttcattctctaatattaaccatccaaattaacatgttgctgttatttggtatactagaaatataggtctcatcggaaacatttgctagctcgtgaggccgaagcggctaattggacacgcaaaaggcatatctatggagtagacaccggtgctaatcttaatggtcggactaaaaatggatggcttgcaccggcacccactctcgggtttccaccaccaccacccgtggctgttgcaccgccacctgtccaccaccatcattttaggcccctgcatgtgtggggacatcccacggttgatcagtccattatgccgcatgtgtggcccaaacacttacctccgccttctaccgccatgcctaatccgccgttttgggtctccgattctccctattggcatccagtaagttcccacatttatgaaacctttactttagctctttatcatatttgttttcatcatagtatttaacattatgaaagctgaatgacaccgagtatttttatcatatgcttgtctttctaaccagcatttttgcatgtagatgcataacgggacgactccgtatttaccgaccgtagctacggtaatgaaccaacatttataagattgtttccgtatgtatacccctttttgtttctatatatatgttttaaatcgtatttttgattggtaattgtatagagatttagagcaccgccagttgccggaatcccgcatgctctgccgccgcatcacacgatgtacaaaccaaatcttggatttggtggtgctcgtcctccggtagacttacatccggtaagaatctaatataatgaattgattgttgtcgagttttgacttttcgcatttgattatgtaattatgtatttttgactttttgtgtatatatattataaatggaacagtcaaaagagagcgtggatgcagccataggagatgtattgacgaggccatggctgccacttccgttgggattaaatccgccggctgttgacggtgttatgacagagcttcaccgtcacggtgtctctgaggttcctccgaccgcgtcttgtgcctgaaacgcacaagatccgtaggcaagcgagaaccaaacaaaaattcgacgacatgtctttcaattattgtacttttatttttccaagggttgtttttgttttgacccttgttgtgttaagagttactctttacttaatcgtcccatgtgactaataaggagacccttttcatatgtatctagggtgctaagtacactctagctctattaacgcaaataaattacctatattttctctaaccattggtgatttagaacttgattgcttatataaagtttttttataaaacataacacaacaaatttccatatcaaatgatcatatggaaattggaagcgttcaaagcaaagtcgcaaacgacgaccaattgattataaagaggacaacctcacgagtatatatacacttataatttataaacataacttatacttaaaaataccagccggttatatatggtgaaaaatgagtaatgaaattgtgtgtttaccatgcatatattaccgtataaaaacgtattgttgggattgagagaacaatggcataaaataataatgaggagagagggagaggaccacgagataagaggagaaggaagtgcatggaggcaacgtaaaatccaacgtaacgacctcttctttctccaattgtgaccactctctctctctctctctcgtctccttcaaatttgaatggtccctctctcttcataattgataattcatatacatgcggatactattactagcatctcattttccactcacacttgtacacatatgctttttataagtacgtatttataggcaaaagtaaatatattcaaaccctacatgcatggtattaaaatccaatataaccaaaatgaatactcggttcaaattcaaaaatttaaaggactttggtcgaagataatgaagacaaatcatttttttttgttctaaccggacattccaaatcgaaatgcacactagtttttggtgcctacatctacattggctaacttttactaaaatcatagtgaaaataacaaaaaaccatggtctctataaactctttggtgaagatttcaactactaaattaccatgagatagatggtcaaaaattgtcaatattgaatttacaaggatcatgagatatttcaacaattttactaatgaccagatccaatgcagtgaattagacgaaactatgacttcactaggttgtgaaagaaaagcttgtcttgcagttttgtctgcgaccggtcgaaaagagaatgaaaatatgtcgaaatcctcttcaaacgtgaaataaattaactgtcataaggataaattatgtttgttcaaccatacagaaatatgatgaataaataattttagacatgtgggcccatgtaagaagaactcactaaatgagcccaatacggttaatgggctgtgacattgaaaaagaggttgtaatgggctgattgattctatagtgtagaaatcttgatcgaggggttatcttctccgattccaatatttagattcttcttcatatattattgtgctttgattagagagttgcagaagagttttttttgttttaattcctgcaatcagagagttttcgatagcacaagcacaagcttctcgattcgtttgagtgttcaaatttcaagctttttacaaggggttccttagattgatctgttactgtagagatg

SEQ ID NO: 25233 - DNA, 1682 bp, Unknown; identical to SEQ ID NO: 13740
  misc_feature (1)..( 1682): 2750-1469P.txt file - cDNA_ID_2704218; gDNA_ID_2214648; Annot_ID_188565

SEQ ID NO: 25234 - DNA, 1682 bp, Unknown; identical to SEQ ID NO: 13740
  misc_feature (1)..( 1682): 2750-1469P.txt file - cDNA_ID_2704218; gDNA_ID_2214648; Annot_ID_136387

SEQ ID NO: 25235 - DNA, 3000 bp, Unknown
  misc_feature (1)..( 3000): 2750-1469P.txt file - cDNA_ID_2704234; gDNA_ID_2214654; Annot_ID_136480
cctttgggaactttgacattcttaaaattcatcttttcacgaacacctgcaaatttggaacccaatcaaaatccaaggcagaaacagataaatagagaaacgaaatgcgtttgtagattagacccaaggaaaacttggatcaacgaaaaagagacaaagataatctgcaaattagctgaaacgaaacaaaaacttagatcacaaaattgaagccgaagaatctgaagctttactcgcttaaactaagaattcgatctataatgaaaatggcgagaggaagtacctgaaaattctggaaatggcgtggagaagagagaagagaggggttagggtttaaagctcagaaatcaggattttgttgacgctttggtcgatcacgcattttctgttactagagatctttgggcccaaaatttgtattcaggcccattagtgaattcactaatttatttatttttcttaatatattttttttttagtaaacgatttttatttatttttcttaatatataaacggccatatttgacatttccttactttctatacaaaagaaataattctcattttgattaatagatagtagattaattattatcacttttcaaaaatgtaactttcaaacccatattttgttgcaaactgcaaaggctctaaacttcttgatgatttactactaaacctaaatgaaatttcttaacttatataaagtgagatatagatgatgtggttattttgttgataacttactttggttcaaaattggtcatcatttaataatacatgtatttaaattcaaaaaaataatacatgtatttttataaaggaaatttcaaaaaagaaatatcaaggcatagatgaatcaaatcaatcatgcaaataaatgtttgtttttcgggaacgtttccctcgcttttagttaaaggttcaagcaatatatataaccgagcaacaaaacaatgcaaagctaacaacaatccctagacttgtcctcttcacgcttgatccggcagatttgtgctcatcatcagcagctggagaatcggcatcagacgatgaagttgaggatttcggggcaggagctccggtgggagtggtctttgttccgaataactcctccggcaacaacacactgtccaccacgtaaactgctagaggaaactgttgccttaatgcattattgatccgagtctcaacaacaccggtggaaacattcacttggttgctttgtgcttgtcctgtgaaatttaacccaaaaacacctccgtcttgtcccgtagcctgagttctaacgggattacttgctaagagaagatcgcttagagagtagtattttggaatgatatggtagagcatgagctggatttgttgttgatatgtcagactgtttagggttccgggtttaagcttgttgaatgcgttatctgttggggcaaatatagtcatcccttggtcagagctattgagttgtacacttacctgaaacccgacttgagttgtgttgaggagttgtattaatgtggtaaattggtgaccagcttcaagaatcgctgtgagattgatgggacttttttcagtggttggagctggagcagtgggctggctttgaatgtatgggatggtgaaaaggaagattaagaggacaacataagagaatagtgacgaggacatggcttaaaatttgttatatttttctctatctctctgtgtgtgcttgtgctagagctaaccctttaggtattatatagaaagattttaaggagagatttaagacgacatgtatgcgtgacttgcaaaagaagttgatccattgtttttaacaacttagtctacattttacgataatgtttataattaagaaatgcaaaacaatactataagaaggttgacaaaatgtatatatatatatagaattgtatcccacatccgataagatcataagagatttgtagggcaatatatatcgtatatagtatacaaactcatggttcaccagttagattacacaacaacaaaaacaacttgaaaatgttagctggtcatggttcatgaatatctttacatttttctgtatttaaaatgatgtggatacgtgtatatagtcgaatatagtctggcattgataggcaacgtgggggtcatatatattataacaacgaaactgctctacatgacattggcatgggcaaaatttgggctggaactggaaaaatcctcgtagggcatgactataagaaaaggcccattaaaaacatgaaaaattaacaaagttggaatcataatcgactgacgaaactaatctgttaaaattatgtgactttcttaatacaaaatagcgttgtactggtttaggattaaaatcgttcggacctcttgtggccttgtgggcacatggtgcgccgtgcgtagctcacgtgaggactgacgatgacatgcagcaaaaataataaaaagaatacgtatttagcagcagattcagacaaactcatgtgcgtttcaaaaatgacgtttatatccccctaataattatattcactctatccactttgacaaaaagatcacgttaatttgaattctaagggtaaaagcgtcaaagtatgtctctttttccgaggtaatagcaataggcaactagaggagaccgataactcaagcaaactcagattcttgatagcgatttaatgaagacccaagagtcccaagaccaagggctgattaattaatgctgttttaaccatatgcatatcatggacacactttgttctccgagtcgactcgttctggtcaccttcttcctcctctgcttctttgccggagattcatcggcgacgaggcctggtttcatctacaccagacacagaggacgatgcacgccgcagtaaatcaatcaatcttgaatttcattttctttacaaaaatctttagctgagtcatatctcaactcgttggtggtgtttttgagcaggtattggagcagccagagggaagcatggccgaggatg

SEQ ID NO: 25236 - DNA, 3000 bp, Unknown; identical to SEQ ID NO: 13820
  misc_feature (1)..( 3000): 2750-1469P.txt file - cDNA_ID_2704240; gDNA_ID_2214654; Annot_ID_188724

SEQ ID NO: 25237 - DNA, 3000 bp, Unknown; identical to SEQ ID NO: 13820
  misc_feature (1)..( 3000): 2750-1469P.txt file - cDNA_ID_2704240; gDNA_ID_2214654; Annot_ID_136476

SEQ ID NO: 25238 - DNA, 3003 bp, Unknown
  misc_feature (1)..( 3003): 2750-1469P.txt file - cDNA_ID_2704281; gDNA_ID_2214656; Annot_ID_136498
ctatacacacaagaatatatatttgtatatttaaccatggtacataacctagactactctccaaaacttgtataaaaaggattttattgtcatcctacaagactacaacgtgtcaacgtctacaatgacctaattaaacagaaccaaaccagtttttaataatgttgggctgaaattcgatttctaacctcttgaccaacaaaacaatcttccatttgaataaactacacgtttttggttcacttgaaaagtttttatcatcgatacgtcaatttatctacatttatcttacgtatgtttggtaaatggtaattgaatatgaacattaaaaaaaaaaaaatcaaacattaaactatgagttacgtcgttaatatgtaattgcttaccaattttttttttgttaaatttaagtcattagagaatacttaagatatactttacgtgtagggttggcggcttgcatgcttcgtgcattagttttagcaatcaaaaagagatctataatgagtatttttgtatgtttgaatgtaagaactaaggaaaaaaaagcgtgtatctatgttttccgtcaaaggccgaatatatatcccgatatagtaatgggccgaaacccaaaactaaaggcacatactaacaaaactacttctatagaaaattatagatgcactcaacacttttgtctatatactattcccaatagtttgttttttatcactaatggtagtagacatgttgatttgcacattgcagctacaaaactacaaaaaaaaaaacgagccatatggatgcttgtcagattgttactgtcacatgaagaaaaccaaagtcttatcttttatttttatacatccaagtagaacacgacacgattggtaaacgaaacctatatagtcaaaaaactcaaaatcaacggattttgtttactgtttgaattatgttcttgttagttagatttattcttttgtatgcatatgtaacaattttgtgtagggaagaaattatagtcataataactcattaactaaaaataaaatatggtctaatgattagactctaatccgaacaataacaaacaattattttcgtttagtgtctctcttattttatccaagaaaaaagaagtgtcaatttataatatcttctggaaagcagccgacagaaaattgtgggctcacatgaaaaaaatttcaatgatgcgtcaaaaagcaaccaaacgactccaaaataaaatcaaatcaaaaatcaaattctctacacgcaactttctttcaaatacaaaaccaatcatctcgattcatccaacccgcgaagacccagaaaccaaaatcgaagacccaacaaaacccacaagtcgaaatctcgaaatccgttgagagtttgttcctttttttgtttgctcggagatggaggctttgccggaggatgaagagtacagtttcagggaagtagtgttgccgtctttgattccggtagtgccggagccggaacttgagagagagagcggagagaggagaagaggaagagatgttatcgtagccgttgatcatggtcccaatagcaaacacgcttttgattgggctcttgttcatttctgtcgtctcgccgatactctccatcttgtccacgccgtctcaagttcgttctctcttcaatgtgaatagtatatagtccgatttcgtgttcatttgcatttccagatctggaatcggagattctaaagctggtttttgattttcttcgcaggtgttaagaacgatgttgtgtatgagacgagccaagccctcatggagaaacttgctgttgaggcgtatcaagttgccatggtaacctttatattgtattatctctttttggtttgcctgataatgttgtttcttgattgctaagttagggtctgagaatccaattcaatcagatgtttcattagtagcatttcctaacaactactagttcttagaattgagatcgttgcttagttcttctcttgaatccaaacactagttctagtctattcatttgtcgcatttgctaccaactgcgtagagacaaaacctctggtgtatgtattcttggaaatcaatattgtgatgattttagatgagaataatcagaaaaatgagtttggtacacactttatagatatattctttgaattcgatgacataacttgatactgattttgttatgtttaggtaaagagtgtggctcgtgttgttgaaggcgatgctggtaaagtaatctgcaaggaagcagagaaagtgaagcctgctgctgtgattgtaggcacacgaggcaggagcttagtaagaaggttggttataacttataatacaaaaacaactactagttgtgtgatctatgtcttgtttttcttctcttttgcctttcctaagtcgatgattctcttttggatacttgtgcagcgtgctacaggggagcgtaagcgagtattgtttccacaattgcaaatctgctcctgtcataatcgttcctggaaaaggtacattactaatcaatcatggtaaaaccggagtgatcatcacattcatttgtatataactagaaaccttttgattgtaatgcagaagctggagacgagtcgatcgtggactggacacgctcagaagatcctaaaccctgaagaaaaagttcaagtgttgtttccacgaagactgttttgtttttcatctttctgtcgctactgttgcagtctttgtttctgtatgtccctaaaaatcttagattgcttcttcttcgtctctctgtgtgtgtatgtgttttgatttgggtttttgtagtttcaaaatttctgtataaaacctttgctcaggaatgaatgtattgtatgcaatggtgtgatgtgtttcagacttttcagtaaacaagcctatagcagacactatttcttttacgcagttgatcgaacacttggtgtgcgtcttggtgaaatatagaaagattacagatttgtttgttgtttactagagaggttagtcaaccatg

SEQ ID NO: 25239 - DNA, 3003 bp, Unknown
  misc_feature (1)..( 3003): 2750-1469P.txt file - cDNA_ID_2704289; gDNA_ID_2214656; Annot_ID_188775
tttttagagaacaagctattatgagctagttgaacaacaacatacttattccagaaaacagttttatgtattggattgctacaaatgttagacaaaaatcaacaaaagcagtggcagtttactgataaaatcactcttaaaaaaaagaacaaaaacaacagttctatggtaacaatgtcagatgagaagaagattaagatcaattcttaaaagaaaatgattaagatctttttccttatatattctctcatcaaccaataaaaacccctgagcatggagattctccatttcctaagttctttattcaaagattccgagaaacaagaaaataaaaagaactctactgttataggctgctactatggctgattttggaccaggcttgtgtctgtggatacttttttccctcaaatgggactagctcttatggattcctggtgataatatgccatttccttcttttgcgtaaagtttgtccgaatccaattttgtaaagggatcattcttttgttgataataatatctcaccactatcctcgaaaatccttcgaaaacattttgagctacagaaacttccattatagagtgattacttcaggttcgggttcttttccaagttgcaaaaggagagcaaccactaggagaggaatcagaatacttagtttttgtttcttgctagatttggggataagggttccaaatatcaacagtaattttgtaacaaattaaaatgcttactcttttaccttccttttcatacagattccttgtaagctactccgggtaaattctcagcaatgatcactcaagacctggagatatcagaataaaaccctcaagcgtttactgatgcaactattcatagtgagaaagtaaaaataaccatcttgctcaacaacaaaataatcgaccttatgaactcaagattatcgttttcacagctaaagaatttacctaaacttatgacttaaatgtggggaaagtgttccttttttaccatttcaatacctaggcaaagaaggtcgctgtgaagcatcgtgacgatgagaatatcagtagtgccccaatgcctactagcagaatttcttggcaacttgcaatctattatctctctggaatatattgtgccccaaggcctcattattgttaagattctttctctgtttaaagttttccttctcgataagaagtttcgccgcccctaccctgaaaccaaaccatgacatcttagaaacagaaccatccattatcataactagaataaaaatatcttaataatataagtgcttatattggcatatatccagaaagagagcaaattaaagtatcataagacctatacacgtaaaggaatatcatcttacttagcaaaactaataacatttagtgaaatggataaacactattatcaagaaagatccgagaagtatggttcttaaatagctttactttaaaaagtgtgtagacaataactttatatagtcttgtggtcttttgataacaaacctgattcaatagtgataagatatgagtatggtcctccatctcccatgggactttgaatcacctgtgtttccgagagagggaaaatcttgagactttaaatcaaaatgtcaactttattatgaactaaaaatcaaacaacaagtggatcattaatgaacaacctttgttgcatgaaaagaaaatcttcaaatcttttaaagaatgaaacaaaatgctcactttctgagataaaaccaaacaacaagtggaccatttatgcatgttgtctttttgccaagtatgtatattattagtcctattgtgcattatttagcaacctaatttagttatatgacaataatctatttgcccatcccaaccctggattcttaccaaacaaggtaattaaagtgttcatgtgaaacattaatgtttgtattttgtaatacgacaacttttggttcccgcccatattcaataatgcagacactaaagaacagaagaaacaatttgaatatccaccaagaaaagtgattatttaacaaattaacaaccaagaatctacattagacaatatatgaccaagaaaaacacagttgcctaacttcaaggagatggacccaacaagccaaggaaaaaaaaaggtaggtaaacaatgttgacgtttatttttttcaacaacaagaaaacacagaaaaatgtcgatgattgtacggaaagatcatcaatacagctagataaattgatatggttttcatggcagagaatctcaaggtaaagctctgcccccacttttctttaagaattcttcttatacaagagaatatatgacttatggtgaacacacgaaaagctccaactttgtgtttgtggatacaaattaatcctcacaatgtttcaaaatcactgagatttttgataagaaggaaatctgattagtcaatgaaaatcatctgtcaatagagacttgtccctaactttcaaccaaagacttgtaattttccgcgagcacgtgagctttgtgctctgattagagaccagactgttccatgaattaagtaccataggtagagagattttcctaactatttattacctaaactgtttctttttgacaagaagcttaatctagagaatgacgtcataaccactaattgggaaagaaaagtaaacatattagttataacatttatagaaaagtgtgtctagggagcatcatatgccaaatatggatggaaaaacgcaatctttggttgattagtttggatctttgatactgatctccacaaaaaaatttgctcatattcttttctagctatagagacaaagacttaaaattctctttgttttggcaaagatatcttttaacaactggccctaccccacaccaaaacctctttataaagagcaaggactctgcgacatctgtgcaacatatcatttcctcagaatctctttcttttctaggtttattactacacaaaaccaaacatcatcaactttagttactaaacaatg

SEQ ID NO: 25240 - DNA, 3003 bp, Unknown; identical to SEQ ID NO: 25239
  misc_feature (1)..( 3003): 2750-1469P.txt file - cDNA_ID_2704289; gDNA_ID_2214656; Annot_ID_136500

SEQ ID NO: 25241 - DNA, 3003 bp, Unknown; identical to SEQ ID NO: 16294
  misc_feature (1)..( 3003): 2750-1469P.txt file - cDNA_ID_2704305; gDNA_ID_2214656; Annot_ID_136497

SEQ ID NO: 25242 - DNA, 3000 bp, Unknown; identical to SEQ ID NO: 13849
  misc_feature (1)..( 3000): 2750-1469P.txt file - cDNA_ID_2704315; gDNA_ID_2214658; Annot_ID_136511
  misc_feature (46)..(46): n is a, c, g, or t

SEQ ID NO: 25243 - DNA, 3000 bp, Unknown; identical to SEQ ID NO: 13850
  misc_feature (1)..( 3000): 2750-1469P.txt file - cDNA_ID_2704325; gDNA_ID_2214658; Annot_ID_188827

SEQ ID NO: 25244 - DNA, 3000 bp, Unknown; identical to SEQ ID NO: 13850
  misc_feature (1)..( 3000): 2750-1469P.txt file - cDNA_ID_2704325; gDNA_ID_2214658; Annot_ID_136509

SEQ ID NO: 25245 - DNA, 3000 bp, Unknown
  misc_feature (1)..( 3000): 2750-1469P.txt file - cDNA_ID_2704393; gDNA_ID_2214659; Annot_ID_188845
ctccgacaagaacgtgctttggatgggtgcaagggctataccaaaggctcaatccgccttggttactgaggctgaagcgttgcgttgggcggtgttgtcactctctcgactcaactaccgaaaggtaatctttgaatctgattcccaacaattggtgtctattcttgttgataacgatgatatgcctactctggaccctattatacaagacatcaagttcttgcttcagcattttgaggaaacaaagtttgtgttcatgcatcgtggaggcaatggagtggcagataggatagcaaaggaatctctttctcttgagaattatgatcctaagttgtattctatagtgccaaattgggtaaaatcgtttgtggaattagacaagttgtaaaactctgttgtttaatgataattattgttgttgagccaaaaaaggaaaaaacatattcattttcaattactttgttatcttttataaaaggaaaaaagatggctaactacacgaaatatagagaattacgctgtcatatataccaagtataatattgtatcttgagctacacgaagtacatgtattgcatgaccatatttatgaactatatgacgtcatctggttaatattatgaacatacaattccggtaaaccgatcagttgacttcggcgttgacaaacaaaaaaatgctaaccatagttcaaagaaaaagaattgttacaaaaacgattctacgataatttttataatttataataaataataaatctagacggtaaaaaataataacttaaaatttacgttttttctgacatagaagtctatattttagtacacagattcttttattttatttatgtagaatgatatgtcagatttgtcatctttgttagagtccaaaattggcctcttccaaatttcttatggttctttttcattttttccccaaatttaaataaattcaataaaaatttgttgattttttgtggccgttgattaaaaccgggaaagcagcagaaacaaatctgaaaatctgagttaagccaaccacaaaacaaatccactccaaacactccaaattacttgtctctcttctcttccccaccaccactaccttacaaaaaccctaaccctaatttctccacccccaaattcttttcctcaatctctgcgatggaagacgaagaaggcatcgggttaattttagccagagccaccgagctcagactcaagatcagcgattgtatcgataactccagtaccaccgtcagcgacaacggcgatggaaacgaggatctttctcccggagaaggaagaaaaagcgagattattgggaatcaagacaaggattttgactcaatcagctctgaggatgtagatgaagcagaagctgaacggcttttgcgtattcgtgatgctcttgaagctcttgagtctcagcttgcttctttacaggtttgaaccaaaccctaaaaatttcctctgcttctcatcaagtttctggcttttagtgtagtattggacattgaaagtgttaggttctggttttaactgaaattgagtctgaatttgcttcaagtctggtctataatgtctgaattgcttctttacaggtttgaaccaaaccctaaaaaattcctctgcttctcatcaagtttctggcttttagtgtagtattgaacattgaaagtgttaggttctggttttaactgaaactgagtctgaattttgcttcaagtctggtctataatgtctgaattgcttcaagtcttggtggtggttaatgtggggatggtttttggtttgtggtgaacagaatctaaggcaaagacaacaatatgagaagcaactggctctctctgagattgattacagtaggaaaatgttgcttgagaagcttaaggagtacaaagggaaagattttgaagtgttacgtgagactacgacttttgctggtgaaagagttgattatgagaatgatcttttacttcctccttatcctgtccatcctcctctctcccttggtttagataataataatggttacctatctcacttaccttcgaagaagaaatcggatgcgaatgggttcggctcaggacatgtgaggaacgaggcagaggcgaaaagtcccaacggaggatctggaggttcgagtcatggggttattcgcttcttaggctctgtcgcaaagatcgtgcttccaatcatcggtgttatctctctattgtctgcatcaggatatggtccagagatgaggaaaagaggcgcttccttgaacctttttggacttctcccgcaccgagctaccagagggaagagaacacctaaccaatgtccaccagggaaagttcttgtgattgaagatggagaagcacggtgccttgttaaggaaagagtcgaaataccatttgactctgttgtagcgaaacgcgatgtaacttacggatacggttgagtttgaaagaaattaaacaccctcctctgtaatgttcattgcctgacattcagtgtgtaaagtttcaaccttttcttacctcttagatatgaaagccacatggtgctacataactctcacaagttttgttcatagttgtgcaaataaattggatgagggagagattcatttgagtagtataatctctgttctgccaatttgatcaatagattcagtgtatcccaacttataccacttggtgtggttggccaatacataaataagtaaattaatgagataaagagatctaaaagacttttctttagtgttttgactaataattggtcaagcctaccattacaaactatgttccattaccagtacagagcacatggtttcactttttaaccaagcaactttatcttaaacttgcttatcaagaactgtctcttcggtaacacaaaagggtcttttatcaaaacctatatataggatacttttcataattggagtaagatctacaaaacagagagttgtatactttaaatcatttagaggttgtgaaatattatg

SEQ ID NO: 25246 - DNA, 3000 bp, Unknown; identical to SEQ ID NO: 25245
  misc_feature (1)..( 3000): 2750-1469P.txt file - cDNA_ID_2704393; gDNA_ID_2214659; Annot_ID_136520

SEQ ID NO: 25247 - DNA, 3003 bp, Unknown
  misc_feature (1)..( 3003): 2750-1469P.txt file - cDNA_ID_2704401; gDNA_ID_2214662; Annot_ID_136536
catgtgaaatcaattgcttacccattaacagaccaaatgaagcctaaatctatacttaaacttctaatgtaggtgctaaaacacaataacccaaatctaattggattgaatctcaaaatcctcaaaatatgtaattcaaagcttttgaagctctctccatacctggacttagtagattgatgcagcttgcaggaggagaaaaacgacaatgcggctcgccggaggaagaagcccgaagaagaacgagctcgagctttttctttttctttttccgtttttttttttcaaaatgtttagaaatacaggggtaaattcgtcttaacacaattccttaacacaaaggggatatgaagactctaaagtggttttgcagattagttgtcccacaaaagggacacaagagatgatcattcgattataagagggaggaaggaagaagacgaaggagatgtatatttatttttaattcttttcatcgtttttaaataattatttaaattagattatattattaatattaaataataacattgtatttattttgggttgtgataatcaggttttaattcggtttagtctattgggttttggtttgacatgggtttggcacagtaaatcaaagataaaccgtgaaactcaaatttatggggacctaggattcgaactttcgatttagggagaaattggactttaacttccattttgtggagactgagatagaggttcgaattctgtgtagttatggtgttatatgaaactttgtagggagacacaagtcgtttacccaaataaaaacaattaaaaattacacaaaaatattacgaggatacgcatacccgttaatgtcttctaataaaatcagcaaaacaaactctatgttcaatgcaaagcctcctcgcaaattcccgtccccatctcgtagcactcctcccgccgatgcaagtcatggattacccttagaaacactgtccgtattaagtttagtccagcccacataaggtggagaccgtgcaatcaaccttgttacccacgcaggtttgatcacccttcccatcattacgaagctccattatgtggtaacctacatctttaaggatattcatgaaactcttcgattgaggaataacggcattatgacccgtcttcaaagagcagtggttaccgaaactttctctttcattctctccaaccacatccgactatagttccgtagtcacccttctccttgttgatgagcaaattcaagtagctcttctcgtgccagcgagtatctcggccatggaacctcatcaacgtcacttaatctattgactatgactattgtatcgtctaccgctttacccgtggatgatgtgtcgacaaaccgtgttatcacttgtgccaattagcttcttagagttggcttccaagctttcatggatcctttctcgatttcttctagctatccttttgtagcttttgcttgtcccttgttcttatgttgtttctgccttgttcctagccttataacccttgcatttgtggtagttctggttcttcttatattatgatgaatgaaacaagtattttgacccagaaattttctttcataaaccgtttttattaatatgaattatatttggttatcctaaattatttttggttatattaaaattaacgcgacttgattatatatttgtatgttatatttaaatatggttatattaagtatgttaaacatgaaacttgatgagtatatattaatatcacccataaatttgcaatttgtaccccaaggtggtgcatatatcaaatacttttgattatctttaaactgcacaaactttttcgatttccagactaatacaccaattaataggctattatatgcctcaaaccgaccattttcatggtgcctccaacgttcacatttggataaatcggaaagaaatagaaaaccagaccataaattttagtcaaaccaaaaattagaaaattggcaattgataccagacaaaaaaagatatgttacctctgtgtctaacgctatattctctcctttgttatttatctacttggattgtaaatttggctcctagttctatatatgaaggaacatatccaaggtatgtgttatttgttaacttaatcattcactagttgtttcgtatccaaaacaagagttgttgaaatcttcagacacactaactattcggctccgggttctatcaagatccaaagtatgtggtataaactctgtcattccacactaattatttaatgctataaatagctttgatcttctccatatttctttatttaaagatttggcttttttacctttgctttcacttctattcattgtcttcctctgttccattggtaacttccttgttctttcatctaagtgttcttttatcatagttcttttactgacactttatacttatctagtgctctcatttccttacgcagctccaaattcaaacacaagtgattttgtcttagactgtctcatgcgataaggtaacactactatatattttggtgtatttcatagattgccataagattatatattttaggattaaaagcttaacaatatttgatagaagtacgtgggaattagaatttcaatatccttacgtagattcgtttaaagaataactaattctaggcttttgcatggtgtatttttatttttagtgtgtttgactgtttgttattttgtaaatcaattataataaccaactttggattcagtgttggagctagttatcttcgatgcataattttgttttaaactttctcttaaatttttcaaagtttttaattttcttttcaattaccgaagcacaagttgtaaaaaaagtttatatttttttttctgaatataatttaactttatattaaaaaaaaaaatgattataattaacttttcgccatcatgattttttttcgcagggtttatttcttttgaactctttgctcttaaaccggtggaaaaaaaaatataaagaaatg

SEQ ID NO: 25248 - DNA, 3000 bp, Unknown; identical to SEQ ID NO: 13871
  misc_feature (1)..( 3000): 2750-1469P.txt file - cDNA_ID_2704409; gDNA_ID_2214663; Annot_ID_136544

SEQ ID NO: 25249 - DNA, 3000 bp, Unknown; identical to SEQ ID NO: 13883
  misc_feature (1)..( 3000): 2750-1469P.txt file - cDNA_ID_2704443; gDNA_ID_2214664; Annot_ID_188961

SEQ ID NO: 25250 - DNA, 3000 bp, Unknown; identical to SEQ ID NO: 13883
  misc_feature (1)..( 3000): 2750-1469P.txt file - cDNA_ID_2704443; gDNA_ID_2214664; Annot_ID_136562

SEQ ID NO: 25251 - DNA, 3003 bp, Unknown
  misc_feature (1)..( 3003): 2750-1469P.txt file - cDNA_ID_2704455; gDNA_ID_2214664; Annot_ID_188955
aaagaatgatgaagatgaagaagaagaagattcgtataagacagctcagttatggcatctgcctgaaccgcgaggaatattagtgcaaccgttccgaccagaaccacggaccggtcctctttgcaacgcctgaaacagaagccggatctcatctacgggatctgggaaaggcctcatggcttcaacttgcgtagcgtccaagaaaacaacgaacataacaactaacataactacgaccaccaattgttttttcatcatgtttagaattttagtttttcgaatgagaaacaaaaacaaaattgagcttttttattggtgaatgtagagttttttttgtttttgttttgtatgtgtaataaattcgataatgactcatatatatagggtttttgagatgtcattgtttgacttgtgctagtttggtctcactatcttatgtttatgtatacacacacatacatgaaatttgactttgactttactacaaaagaattcgttttcaacattttgaaccaaatttgaaggattttgaaatataaaattcacttagacacggtttgtccaagtccacacaggcttttgctaaaaatatacaagacctggccctagcagcctcattctaaaccgaattctggtttcggttcagattggtttcatttggcttcgtagtcagatacaactttctcttttcgtgacagagtgtggaaatggattctcttttgctaattgaaagatattaatagacactcaactaaaatatatatcatctcttacaaaagcaaagtgttttctttttttaataagttggatagcttttggtgaagctttgttctgaaagagagtaagagatcattgttaataatatggtagtacttacgatactagagatcttatgataaaataatgcgaaaataaagatacaagcatgcatgcgtcaaaaagtgttatgatgacaaatgaatgtactctaattttcatatctaaatttttactaatattctgaaggtattaattttcgagttattaaatcgctgtaatatgtttatattttgtaagagaaaaatttggggtactaataaatttgtctttagccctttttcgtctaaatgtacgaaattaaatgatctatggacgataatttctagtttgattcatcgtatatactagtccaaattgtaaaccaaggcataagattcgtcgagaatgacaaccagaagagatgaggagtgctaattagaggtgataaatcataaatataccgccactcttggtttgagtttctcttgtacgtagctacaacttgacaactatgccgccacttttttttattgatccgtaccatttgtattgtatgcaactttggtatcattttgttgttgacaaagttggtaatccatattgtatatcacattggtaaaaagttgctaaaaaagagtctatgcttattcatcaaaattttcaaaggattgatttatcaaagtttataaacacgtggaccatatatcaaatcaaaattccaattcaattcggtaagttatactgtagttattaacgaaatttatgtttgaaattagttaaatatgattatttgtttacgtttgcattgaacatgtaagaataccacacatattttaagatggtaaacacaatatgtataaaactcaaacgaaactttaaagtcgccttattttatgatacacctgatcagtaaataccacaatactattacgttcataaatatacatgtgtttcactttcattaggagcagtaaagtaaacaatatgcgtggagattagagatttttcttttatttttatatttagcttgattataacttaataaaaatgtgtatgtgtttatagataaaatcagggtttgtttgtttatttgactcgggaattttggtctcttaggaatttcatgagatatgacttttatttgggaagaaactcggcttgaaaacatttgaacaacacaattaatattggaattaatcaaacacccgactcggttcgcctttacaccacgagttctttattcacacgcaaaaaaattctgaaaaccggatcataatcccggtttagttggccgagcatattcctaggtaggtccttacgatttatgctcttaaacaaggcttatcacttatgttaattgttacatacttgcatgcgtgtataggactataggtccacctaacgaaatactacaattgagaaaacaagttttctttaatatacaagtttaattacatatatgctcgcgtcatgtcatcgatcatgtgagttcatgtttcttcttctttttctttaatttattttatagtataaagcatgcatgattcatgttgtaacttatttcaaaacattgattatataataatctcttataagattaaaaggataattctcttacttttctgaaacgttctccgacattgctttctatagtaaaatcaggtgaatgtaaaaaaattgaacattactaaatcatcaagtcaatttgaattttaaaattacatgaaaaagtgccttttgtcggcaaagtttaaataatatgatcaaatcttgtatttaagcacaacaattaagttcattttcattcctaccataaaaaaacaatattaagtttcattttcattaaaaaaaatttgaaataaatcaaaagtttaattaaattaaaattttgatgcacattttgtagtcgtgaaaacacgtcttacctaaattcagagatgcctcgctgtttaatattttggtttagtattcggcaccacttgtcccggtccggttcgttccggtttaggatgttctaggaggcgacacattgctctctctctgtacggcttcttcttcttctcgctgacgctctttctccgtcaattctcttcgaagatcgttttgatccaagagagaattctctgagagattgagaggggaagagaaattcttcgatccatagagagataattctctttgaacatcgatccatagagagatatg

SEQ ID NO: 25252 - DNA, 3003 bp, Unknown; identical to SEQ ID NO: 25251
  misc_feature (1)..( 3003): 2750-1469P.txt file - cDNA_ID_2704455; gDNA_ID_2214664; Annot_ID_136557

SEQ ID NO: 25253 - DNA, 3000 bp, Unknown; identical to SEQ ID NO: 13885
  misc_feature (1)..( 3000): 2750-1469P.txt file - cDNA_ID_2704459; gDNA_ID_2214664; Annot_ID_136558

SEQ ID NO: 25254 - DNA, 3003 bp, Unknown
  misc_feature (1)..( 3003): 2750-1469P.txt file - cDNA_ID_2704461; gDNA_ID_2214664; Annot_ID_136560
caaaagcatttaactttaaccggaaaaatcttacatttttttcctcctggatctctctctctatatctgcagattcacactacagctgatttagatctatttcgtaagtgggtctttcaaagtcgtctcctttgatctactttgattcagggttaggattaaaaacttctcctttttctatagttgcttcactgtttctattccatggagaaagttgctagctttaatttgccaacttactattcttatgtgtaataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggtaattggttttcgtttttcttctgtgattctctggtttcttaaatcctgtttatagtgtggatggacacggtgactatttgtgtgcttttggtttgaaccttaatgccaccagtcatttagttgcttcagctgttcccacataacttcagctttttaatgagtggagcaagtgtataatttgtttttgtttcatacaataggatatgggcaaacaggcagtccgcagcacgatcaaaagaaaggaagacgagatacatatttgagcttgagagaaaagtacagactttgcaaacagaggctacaactctctcagcccagttgaccctcttacaggttagttttgactcattgtacggttgttctttcttcatgctaaatgaaactaaatctagccttacaacgtttgttcgtgcattgtgattttttatgggttgaaaacttgtgctcttttcttcctgtttgtatagagagacacaaatggcttgactgttgaaaacaatgagctgaagctgcggttacaaacaatggagcagcaggttcacttgcaggatggtgagtctctcttttatcacaaacaatatccctctgtgccaagactgctatagttggttcatatcatcgaattgaatcttctctattaacagaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggattttagggttttagctaacacagcttaacgggtgccttggcctacagggtattggcgttttggtacgtagaagaaaccttttggtaaggtcattgaagataaacatttgggtaagcccaaagaaacagagttccgtgcattgcaaatatgcaatgcactgcaattattagttgtttggatttgatatagagactgagtctcgaaaccatagtatgtaaaaatataatcacgttcaaaagctgttaatttgttataatcttataacaattgtgttttaagatacaaacctactttgtgttatgatatttgttcactattggttttggtatatatccaaatcatttttcagggaattaaatactgactttattctctaaaagaaagaaggaaggccacaagatgtcaagattagtccacacaaatgccaacaaacttgtattgatgttaaagaaaattaatgtctcctccaatgtgtaatacagaccgcaaaaacatttcagccgacgaaattgttgtgcaacattgtccacaagattttacggctacactgtatacagactcacgaaaaagaaaacattaatagtcttttcagtttccataagatcgctttacaataatatcaaaataaaagtgaaaaagacagagaagaagagaaacaacgagagccgcagaagttgaagaaatgaggacctacaaggcattgatgtaagaagcaaggatgtggttccttttgattcccaaaatcctcttaaaatctcataaagcccttcttatcttcttctcttctcctcaacttgaatacacagaaacaaaactgcttttgtctctcaagtcatttgtcttataaaaaggttctgttcttgaacaagggaaagaaacaaaaggctgataactcctgttttgtagattcctctgatattcagattcttacttctcaggaaaaccctaaagaaaatttctgtttttttttgagaaatatg

SEQ ID NO: 25255 - DNA, 3003 bp, Unknown
  misc_feature (1)..( 3003): 2750-1469P.txt file - cDNA_ID_2704467; gDNA_ID_2214664; Annot_ID_188965
atcaataaaccataaaaaataatgaaaaacaaattcctaaagttacttgggtctcaagcaacattgtgacattatgaggaatgaccagagctgcttctaccacaacgggttggagaagagagagcaaagcaaagttttccacttccatctcgaaaggaccagatttcaatcacgtcattgactttgaagatttttttatcaatcacattgttccaaccatgacttaacacatatttccaaactgtattaccattccacttctttaaataaacgacatgcttatccgattcaggatccaccaaaaacactttcaaaccatcccttttagcctttaaaaagtcttcatctaagaatctggtttcgtcctctgtcaaaaaatctgacttctctaatttgctgagatgcattgagagacacccctggtttttacggagatcagtcgtacacagcaccctcctctttatgatcagctttggatcgtatccattctcttttctcatcactttcacgagccagtctggtatcgaagaattgcatgtttcgggactatcagcaggacataacgaaacgatgtcgcttttgttctgctgagaggggctcgggatgtcgaggatgattttcttttttcctttgagaactatttgagaaaattcttccaacatatccagcttccaaaacttacaaatatcataagcctccattgtgcggccagagaactacaagaaattaaggaagaggtttaataacaagcttaagagagagatagagaatattatataacagaatttttaattacgttcttactaaggatttgctcttgtttttttcccaatcttccttaaataagttatatatatatatatatatatatattctagtaataaattcttattttaataattttctagtgataaatttttattttagttctcactattttaatttttaattttaataattaggtgaaatccagttaattaacgttttttaatcaaatttttgttttatttcatttatttttcccctaacataaataggttttagtttccaaaagtaaaaaaaaattggattagtttatttgtttatcttgatgaattttatttttttgtgaaagattagtttctttatttcccaaagcaaaacatgtttatcttttgtcatccatgacccaagagaaaaaaagttttgtgtacaaaaattaaaattaggagataatggaatggtctagtggaaaccgaaacattaaactgccattagtattttcatggttattaatgattgttaattactattttgatgaactaccgttcaaagtctttgactttcctaaaaatttcaggaatctcattctcatccgtatattatcatcacctattttagctttgaatttaactataaataaaatgtttgaaacacaacaacggaaacaaaattaattaagaaagaccttctttgttcacaatatggccaaaatgacaataacacacatgaagtttcttcaactgttgttatctttagtgctctttgtattctcaatgtcaaatgcaatgccaatctcagacgtacataatttttgcaaggaaacgtttgaagtagaattctgcatgaaatacattgggtcggaccaacgtctcgtagccgcacgcgacttcagtgacatgcttttaattccggtaacgttatttaatgtgacaattttgattagtgatatgtcagattagttgatcacatatattaccaaaaaaggcaagatatttgttcagtgttggtaaaattagggataatagtatagattagttgaaaattttcaccacaccagttcttgtaagattacatggcctccaaaatactaaatagaagttatagaaatctgtggtttattcatattctacaaaagaagtattatttttggtttgtgattgagaccttcttatcagatatctgagactcaaattcaagtgaccaatgcaatcacacaaatcaacaatatccgccaaaggtttaatgacacgcttggaaagaatcggatcgctctatgcgaggaaaaatacgagagcgcgggcactagttttcacaaggcttgggaagtcggacagaaaaagtcaaattcatcgacggaccatatggaaataacccgaaacacgcaagctggctttgatgctgtgtgcgagtgcgaagacgaatgggcaaagcatggtccgaaacaagagtctcctctcactttctattaccataacgttctgaaactatgccaaattactcgtcttattatcagcaagctttaggcttaagtacgtcgtattggaatttgatttatttacgatattaactggtttagcttattcactcacacgtttattaacaccgattgttctctgcttctagttgtaaacccgatttttgaaactatatgtatttattggtttaaatgaataaaacctttgtgatgtttttgataatttatcatcattccgtgaaaaacatgacgttttaaaatctcgagtttcgacgcaatttgtggtatacacctgaatgagagtttcaagcaaaaactaagtccggaaaaatgctaaagatgtatgctaaattagcacaaattcgaaagcaaaaatagttgtctatgatgtctttttggagatgcatgatgcaaatatagagtattctagatttagtaaggaatctcttgaagagattctcttccatacattatcaagagtttccttttttatatatgaggaaaagaaagcatgaagacagaggacaatttcctatccataaaaaaaggaaattatctattgctattagtacgagaataggaaattggcttattgtatagccacaacctatttagtataaatatggtgctaaagttttggaaaagtttagcacaaaagaataagaaaattctaatacattaaggttataaagtttcttgtaagaaagaataacgcttaacagggctaagaaaaaaacacaagaaaacacttcttgtttctcaaaatg

SEQ ID NO: 25256 - DNA, 3003 bp, Unknown; identical to SEQ ID NO: 25255
  misc_feature (1)..( 3003): 2750-1469P.txt file - cDNA_ID_2704467; gDNA_ID_2214664; Annot_ID_136565

SEQ ID NO: 25257 - DNA, 3000 bp, Unknown; identical to SEQ ID NO: 13890
  misc_feature (1)..( 3000): 2750-1469P.txt file - cDNA_ID_2704475; gDNA_ID_2214664; Annot_ID_136567

SEQ ID NO: 25258 - DNA, 2762 bp, Unknown; identical to SEQ ID NO: 13790
  misc_feature (1)..( 2762): 2750-1469P.txt file - cDNA_ID_2704491; gDNA_ID_2214652; Annot_ID_188662

SEQ ID NO: 25259 - DNA, 2762 bp, Unknown; identical to SEQ ID NO: 13790
  misc_feature (1)..( 2762): 2750-1469P.txt file - cDNA_ID_2704491; gDNA_ID_2214652; Annot_ID_136436

SEQ ID NO: 25260 - DNA, 3003 bp, Unknown
  misc_feature (1)..( 3003): 2750-1469P.txt file - cDNA_ID_2704499; gDNA_ID_2214665; Annot_ID_188988
ttgagacttatttacagtggctgccaccggcatttaataattgtttttgataattagaaagtaaatcttcgaattaaatatttgcatttaactacctttccaaaatctctctgcattaactatacgattaattactaaaataaaatttccaaaatatttaatatcatttaaatactacaaaattatcatttttgatattgctttttttttatgactataacaattcgattataagcagcaaaccgtaaagatatttgatagcaattaattactacaaaattataaaatatttagacaatgattcataaacatatcataaataagatcaacattaataaaataaatagttttttttacgagacgggttggcgggacgggtttggcaggaagctacttaataacaattgtaaactataaaataaaaatattttatagatagataaaatttgtaaacttttatatatactaactttaaggaaataaattgtctccgcggtataccgcgggttaaaatctagttaattagtgttatcgactcatgattaaatatatagaattgatataaactgaacaagatttcaaaagtattcatatgaaaagaattaaaaaaaaaagcataaattaaagcagtatttaagtcaatacttttagatcttctctcattgcatatatcaatataagagaaatgatcgtgtattaaattatttggtaagtctaacgttttaaaggtttattatttgaaaaaacttgagtgtcaatgttatcaaagactcaaaataaaattactaaactaataagaggttaggtaacgaacaagtacaacacaaaaaaattagtaaaataaaaagagtataataaaagtagtgcttaatttattaacataattttttattttatttttatcttgaaaaaatcaattaagagtaggattgatgatacatttaatttgcttatttaatatgattaatattttaatttaaaaaatatagaatgacacatgtcatttttttgtgtgatgatgtgtcattcatatggaaagagttggccaactttcatatatatgattagatttctaaatgatcattgccgtaatattagtaaagatgtgtccagtgttttagcaatttttaccaaactaattttgatttacatctttaattaaatatttcatttattaataattaatgtcaatagcatgacattgtaaataagttcaagtacaagatttatttgttaaagtagctgaaaaatgtatatgtagattttagatctctaaataagattaacataagaaatctgtatcggtctaactaatgatgaatcgcgaaggacaacgttagaaaactaatgacgaaaatatgttcatgagaataatatatactaaactaataagaggtttggtagcaaacaactacaacacaaaaaaaagtcattatctagtagtgattattgataataaaaatttaataaaataaagagtataatgaaagtagtgcttaatttattaacataatttttttttattttattttgaatcaattaagaataggattaatcatacatttaattttagagtatttataataaatgactatagatttgaaaagaatgtacaaactaaccttgagtcacagtatcttgtcggaaacatgttggagaacacttgttattttctcttattacatagtatttataaaaagcacatgctattttttggaaaaaacattgtattcagtttaatatatctttttatcatgatattttgtagtaatacacgttttttattgagatcacacgtgatttctttaaaaatattcttattttttagtaatacatggtttttattaaaatcacatataatttttgttttaagattctgttcatgtaaaagaatttcataataatgttttaaaaaaaaaaattcataacgtattatgaaatagcatgtttttaaactaaatataacatgtgaaattttaatgttacatgatattttgaaaaattacacggatgtgtttcgtttacttttcatcttacaacaaataaaggatagctttattatttcctttcttccgacaacgtgggtccatggttattttgtaacaaaaaactttatctctgctagtttcttaatttgtatgttttatttggttatctactaatattacctttaattttattattttttaaatttaaaaatatagaatgatatatgtcaaacttttgtgtgatgcttttgtgtgatggtgtgtcattcatatggagagtgttgaccaattttcatatatatatgattatatattaagaaactatatattacgttgtctttttcaaacaggtaaaaatgttatgagatttatttgatttttaagtaattatttaaattaaaataaataaaaatatatattattttaataataggggctaaatagaaattatgtggaggagaggggctgcgtagattaaaatccaaaaaataccgtaaacaaaaaaaaatattcccttgcgagagagggaagattgacttattggcacgcagccctaggcattttcgtttcgtctccacacgcctctctctctctctcgcttcttcaatcattcatcactccgacgtcagattcaaaatcctccatgatcgatcccaattgatcaatcaataaccttatcttcttcatcttctctgtcagtatctgaatctgcatctggaagcgtgatttcatcatcatgtatttaaccgcttcatcttccgcttcttcctccatcatccgagctgcttcttctcgctcttcttctcttttctctttccgatcggttttatctccctccgtttcatctacttctccgtcgtctcttctcgctcgtagatcttttggtaccatttcccctgctttccgtcgctggagccattcctttcactcgaaaccatctccgtttcgcttcacctctcagatcagagctgtttctccagtcttagatcgtctccagagaaccttctcttccatg

SEQ ID NO: 25261 - DNA, 3003 bp, Unknown; identical to SEQ ID NO: 25260
  misc_feature (1)..( 3003): 2750-1469P.txt file - cDNA_ID_2704499; gDNA_ID_2214665; Annot_ID_136572

SEQ ID NO: 25262 - DNA, 3000 bp, Unknown; identical to SEQ ID NO: 13898
  misc_feature (1)..( 3000): 2750-1469P.txt file - cDNA_ID_2704510; gDNA_ID_2214666; Annot_ID_189003

SEQ ID NO: 25263 - DNA, 3000 bp, Unknown; identical to SEQ ID NO: 13898
  misc_feature (1)..( 3000): 2750-1469P.txt file - cDNA_ID_2704510; gDNA_ID_2214666; Annot_ID_136580

SEQ ID NO: 25264 - DNA, 3000 bp, Unknown; identical to SEQ ID NO: 13899
  misc_feature (1)..( 3000): 2750-1469P.txt file - cDNA_ID_2704518; gDNA_ID_2214666; Annot_ID_189008

SEQ ID NO: 25265 - DNA, 3000 bp, Unknown; identical to SEQ ID NO: 13899
  misc_feature (1)..( 3000): 2750-1469P.txt file - cDNA_ID_2704518; gDNA_ID_2214666; Annot_ID_136584

SEQ ID NO: 25266 - DNA, 3003 bp, Unknown
  misc_feature (1)..( 3003): 2750-1469P.txt file - cDNA_ID_2704529; gDNA_ID_2214666; Annot_ID_188995
aaaacttataaatggtccatcaaaaatcagaaatttttaatatttggtcagctttatgtgttgtttagtcgtacctcttaaagcaataagagttttgtaagatggattatgctctaaacatggccttatagaaaataacaaccacaccagtttttatgtccgtcaattcttcatacataagcttcctttccaattccatcaactccaaaaataatcttagaatgacaacatttaaccattttgactctccacaatgtaaatcaattcacgtgaactttgtgatttatcttttaaaagacacaacatagaaaaaaatctcttccaaaatttggatatattaccactcgaagtggttaaccatgccttaatcaaatggatagacctggtttcgtcccattagaaatgatcttcatcttccatcgttataagatacatgccatcaaaagctacatgatcctcctgatgatgaagtgtcgacgatatggttcatgaaacgcttccaagacattcaagcaatgaagaatgggcgtgatagatacatgaggactctctagtcctttgacaacgtatatcttctcataatttcgtgattggtgagctttaagaaagattagctaattttatgacaaatatcttgacatacaaaaaagttttgacctagcagctcccacaaagtcacatctcactttgacttactccacaagacccaaatttaactacacgcaccttattggtcactattaataacccttataatacaccttcccgtagacaataacttacgtttcttcttcttcttcctttaaaaaagttcaaattaagcatctcttctctcactttaccctcttctctctctctgtctctctttctttttccgtaactcttcatcttcttttcccagatttttccgttttccaattctctgtgtctaattccaaacttcctaggggttttttctccaacgtgagaaaaaagcttctagctttagcgatgggatgtttcggacgcactccgaaatcgaacaaacgatcagataccaaaaccacgaagaacaacgatttcaccccaaaaaaactcaccgtcaatgcaaatcgagataagctgacacaacccagctcaggtatcgacttgatttcgcataaaaaatcgatttttatttcgaaatttagaatcttgcgataattaggttttgtgttcttaatgttgcatttatggattcgttctgatgtgtttgttgttatgtctttgttgcgtagattgtttaaaagttagtatatgtggagatgtaagcaaggagatagttactaagaaggatcaattagctttggatgctaaagatactaatgttgaagatgaagttatagtgaagaaagcacagacttttacatttgaagaactctctgtttctactggaaactttaagtcggattgttttctaggagaaggaggttttggaaaagtttacaaaggtttcattgagaaaatcaatcaggtttagtatttgtatcttgatctaatgagttacagtgtattgtggctagtttggttagaggttttaagagtttgtgaatggtgtttcgataggttgttgcaattaagcaacttgatcggaatggtgctcaaggaatcagggagtttgttgttgaagtgttgacattaagtctcgctgatcatccaaatctcgtcaagcttataggattttgcgctgagggtgttcagagactgttggtttacgagtatatgcctctaggatctctggataatcaccttcatggtatgttatattggtattgcatcacattgctttattgattatgttaacttgttttcgtgtattctgtttggttttagatcttccttctggtaaaaacccgcttgcttggaacactcgaatgaaaatagcggctggtgcagcaagaggactagagtatctccacgatacaatgaaacctcctgtgatataccgtgatcttaagtgttcgaatatcttgatcgatgaaggatatcacgcaaaactctcagactttggattagctaaagtaggaccaagaggaagtgaaactcatgtttccacaagagttatgggaacatacggttactgtgctcctgattacgcattaactggacaactcacattcaaatcagatgtatacagtttcggagttgttcttttggagcttattactggaaggaaagcttacgataacacgagaacacgtaatcaccagagtcttgttgaatgggtaaagactaaaaacatctctttctcctttttctaattgagcatcataattcacagttttgactgtaatgttacaggcaaatcccttgtttaaagataggaagaatttcaagaaaatggttgatccgttactcgaaggagattatccggttagaggattgtatcaagcacttgcaatagctgcaatgtgtgttcaagaacagcctagtatgagaccggtgatagctgatgtagtaatggctttggatcacttagcttcttctaaatatgatcgtagtcaccgtcaaaagcaggataatgtgaccgagactaaagtcgatgaagagaaaacacttaccacagaatctaatgtttgtgtggaggagaaacaagagatcaagatatgctcagatcaagcaacttaatcatcaatgaggattcttaaaattttgatattttcttgatttgtagaatgcttcgtttacgtaagcaacagttttgttcgaatttcgactcatacttatatagtaaactgtagcaaaagttcggtttatcagaatcttaaaccattacgtatgggaaagtccggtttatcaccaaaccagtttatggaaacgaatttgtatgatgttctaaataacgattttaacctcaaagcttctgttaaattacgattgtgccataactatataaaggagagacccgaacaaacaatccggaagcggaagctaaagttaagcaacggccgccgcgaagctaacctccaaagaaggggaaaaatg

SEQ ID NO: 25267 - DNA, 3003 bp, Unknown; identical to SEQ ID NO: 25266
  misc_feature (1)..( 3003): 2750-1469P.txt file - cDNA_ID_2704529; gDNA_ID_2214666; Annot_ID_136576

SEQ ID NO: 25268 - DNA, 3000 bp, Unknown; identical to SEQ ID NO: 13902
  misc_feature (1)..( 3000): 2750-1469P.txt file - cDNA_ID_2704537; gDNA_ID_2214666; Annot_ID_136578

SEQ ID NO: 25269 - DNA, 3000 bp, Unknown; identical to SEQ ID NO: 10017
  misc_feature (1)..( 3000): 2750-1469P.txt file - cDNA_ID_2704544; gDNA_ID_2213619; Annot_ID_131932

SEQ ID NO: 25270 - DNA, 3000 bp, Unknown
  misc_feature (1)..( 3000): 2750-1469P.txt file - cDNA_ID_2704555; gDNA_ID_2213619; Annot_ID_180878
caataattataattgttttccaagaatatcccataacggaccaagagatatatcaattaagtcactctctgtcatatttttagatgaattttcatgtaactttagatttttaaattagcttctattgtaggtggcaaattttatgtatatctaaatcatggatataaagccaactaatgttttgtagttgatgctaaatcctcttaaataagcaacgaattggtgatatcagtggaaatccgaaattttgttgctgtcaatattcaacaattatttgtaagaaaatgtgtaaaatgcatgattaaaggccaacttatcattagaatttccttaagtttctcggcttgaacctatataaaagagtatcagtagtattcagtacaggttcttctcctcctcaaacctaaaagttattgttcttctcttccagtctttttttaacagccgttttaccgacctctattagaactaaaatatgattgatgtactagcgatgaaattgtccttatcgttatctaatgataaaacttgttgaactatatggagccgtcctcaaactttagaaacaaatattctcgtcttcaattatggcgatttagccataccttatatatttggtaatgtgtaacgtaactacttacgtagatcgttttatcaacaaagtttaggtaatggaaaaagggctggatagttaatctttctttattactattttttttttttttgtattgtatgtctaaatctatctcgcagttgttacatgagactcctcatagtaaaagttttgagtgagtgaaacaaaggccattgtaagtggaggaggataaagtaattaagtacgtcgcaagctgatccatcgttatctgtgagaactgagaattaaaagaaagaaacaaaaacaaaacaacatgtggtggaaaaaaaatagtatgcaaaaacgtaaaacgctaggtgtcatgatttttgtggtgtgaataaattccattttcggcagaaggacctgtttctgcggctgcgattcggagccgcgtcaaatatcgcctgtttatattccgggtcaacaaccgtctctccttatttgaccagagtccttctgtttttttttgttttttttttgtggataaataaacagaataaattagggctcgaaatacttatgatatgtattccaaaagacatagctttgatcacttaaacaagccacgcctagctgagaaagaaaaggctttggctggtttataagaaattaataataactttctggcctttaatttagataaatagaacatttaatttgtaattatatattttaatcatgcaaataataaattatctcaaccaacattataattttatatatctttgaggtcattatttttgtaaagaaaaacgctagaattgaaatatttattaatttagacgaatataagttggacaatttaatccatgtaagattaagattttgtatgccatcaatctaacaacttgtctagacaactaatgtttaacaataatttttgatactgcaaaatttgtttatgtgaagttacagaacttgtaggagttagattgttaacgttacaatactatatatagttgattcacgtgtttataggcaacatatcaaattaacatgtttgctttgcagttaaaaattgttcaagaaataagccaaaattcatcgacaaatttggagctaggggagattcggtaggtacaaattaaacaaaacttattcaagtaattaacaagtaaaataaataatcgtttaccacgtgcccatccagctgtgattccacttcaacttctgactaaggaacggaaaggcattccaagtttcctcaattaggctcaacttttcagagatgaaaagaattagtatgtgcaaaataacgtatagattcacaggatgatacaaaatctttcaatgacatggttagtcaacgtaaacaaatttgttttggaagggtccatagagatttttactaaagcaacgtggagttttcatgtgtttgcaaccgttaccaaaacccaacagttagttaacaactttattataatgaataaaaataacacacgagaattaatgacatagtgtcaaaaagaagaagaacaagcatgatattttatgccgactaaagtattgtgaccatttgttgttgctgaatcgtcatctccaactcctaacgttaggcacgttcttgaaaaatatcccataacgcaaattctagattaagcccggtaaagtaaacttgaaaaaattataatatacaggttctttatttaaaggaaaatgtgacatggcagtgaggagaaactaacccatcttcctaatggacaaatgtcagcagagccatacatttataaagtattttaatgattaaggggacgatgatgatgtcatcagtagttgagttgggggtagaataggtaattcaagaaatatgtgattgaaagtggaaacgtaagctttctggcttttgtgtcctctctgagtctcagtgtcgggacaagacatgcatcagcatcacacatccgtgaatcggtgctttatcctcttctatcttttttaacttcacgactagaaaattgatttttaaattttgttttacacaaactgatattaactacaaattaagaataacatagaaattaagaataagtttctagaaatgtacatcaagtattggccgttaagtttcaacatatttataccatctggcctcaattacaatcataattcataaataatcttctgacacttaataagataacttttcaccgagtgatatattcctgaaagtaaattcaacgctttagaataatgttcttatatatttaattatttaccaaatacacactatgcttcaaactccctataaaaagaagaaaccaccttatagcacttctcctcattcctcacttccaaccgccaaagaaaaaaatcaaaaactccaacaaaaaaaacctcccaaaccctacccgagcagtcgccagatg

SEQ ID NO: 25271 - DNA, 3000 bp, Unknown; identical to SEQ ID NO: 25270
  misc_feature (1)..( 3000): 2750-1469P.txt file - cDNA_ID_2704555; gDNA_ID_2213619; Annot_ID_131927

SEQ ID NO: 25272 - DNA, 3003 bp, Unknown
  misc_feature (1)..( 3003): 2750-1469P.txt file - cDNA_ID_2704559; gDNA_ID_2213619; Annot_ID_131958
agaagcaaccatcaaaggagaccccgtctaaatcctcctccacatcgaagccttctgtgacacagtcagataataattatgaagattttccaaatagtcaaattcgcaaggtaaattaacatatttattactctctatgtagaatgatgaaatatgtcctgctgcattctgttttactttccccacttggcagattatagcaaaacgtttattggaatcaaaacagaagataccccatttgtatttacaatcaggttggtgactcacaacctttgtattttctttgtgtattttatttgctgtttaagcattttattttgcctgcagatgttgtattggatcctcttcttgcatttagaaaagaacttcaaggtttgtagactgctcttatcacacatcctggtatttattaacaacttgagaggctcagagtgaactgtactttcatgatctacagaaaaccatggcgttaaagtgtctgtcaatgacatagttattaaagcagtggcagtcgcactgaggaatgtacgacaagctaatggtgagaaattattttctcctcgtaaatgatttcattaaaaataactaaactatggtttgttcccatccctaactatgcgctagattaaaaccttagttcatcctctttaaggaaactcggcttccatgttggattattcttgcaatgccgtttacctccgttgagagtatttagtaaagatgttttgagattgtaatactgtaacattcaatatgactggtaatgcattttagactcggttttagtcgttacaagtaggacattttttggtgtgagtttgatgtaatgatttgtggattggaatcgtgtggttgttttttctcttctgctttctcaaacctttcttatggttgcttaaagttctctttctcaatgtctggcagctttctgggatgctgagaaaggagatatcgttatgtgtgacagtgttgacatatcaattgcagttgcaactgagaaggtacacttgtgtgtttgattttctgatcatttcaacagtttatccctcatcatcttggcattttttgcagggcttaatgactccaattatcaagaatgcagaccagaaatctatttctgctatttccttagaggtaattttattctctctgaagttaaacgaatatggaaggctatagaggcacatatgtttgatcagttcttaccatattccatgtgttgttgatcgctatagttatgaattttaatatgtcaaatgatttttggatcaggttaaggagctggcacaaaaggctcgatctggaaagcttgctcctcatgagtttcaaggagggacattcaggtattcatcatttttaagttattaagcatagtacggaattatcaatcatgtgtaacttttcctacttaacgagaaaaccatactttatcgttttgcagcatatcaaatctaggaatgtatcctgtggataatttctgcgcaatcattaacccccctcaggtaatcatagccttaacgatgcaccctgaatcacagattgaagattaagttttgctgtttgtaatttgtggtgtagaggatttagtttaatatttatagagatgcagatgtgtttttttggataataaacttcaggactatcaattgtcttgcaggctgggattctagcagttggtagaggaaacaaagtggttgagccagttattggactagatggtgagctagtagaatccttttgggttttcaactagggttgctattctgatcatggtatgacaagttttcgtcattgtttcaggaattgagaagccttctgttgtgacaaaaatgaatgtaacgttatccgctgatcatcggatctttgatggacaagttggaggtaatggaacattcataaatcccttcgtttcgagttttatgttatgctgctgccatatttcactgtgtttctcctttgttactcattgctttttctatgaaaccggctttgtttcagcttcgtttatgtctgaattgcgttcaaactttgaggatgttcgaagacttcttctgtgagaaagatccaactgtttaccaaatgaatcttggattactacataataaacctcggaccaacccacgtgcacatccagaaccagaactgctggtctacattgttaactctgatcacatgtttcatttttttccatttggttcatatacttaccaaaatttgttttggtctttaacaattcgtcttatagattggtaacttcctgaggtattttttgtctggtctgtcctctgcaaaataaataatttcagctgtcaatccgcaactggtgaaataatttaaaaagtattttaccctcatcaaaatttttaaaatgagattattgccatctctgttctaccagatcttattgttgagctccaagaaacgatttatagacttatagtggttagtgttgaattcatccgttaagtctttaaccaagagattacaaaatttctatccaaaatttagggtttaagtaccattacaaaagaaggaaatatcagagatttgaaggtgatgtaggttaatcatctgaagtagtctaatgtcttgcaaattgtgttgtaatttgttctatatataaagtttttgcattttcggagaaataaagaaaaaaatgatcacaatacatccgaattgatagcatcgcattcgcataataaaaacttgtagaatgaaaaaatgaaaaatcacataatgaaacaagaaactatacgcttacttattagcataatatgcttttatttatatttttagacgtaagatctacattttcatgaatcttatgcatattttctcgattggttcttgcataatcgtattaaaaacccgttattcaaccattatccgtgttacgaataaagtatgaaatataaatgaaatatggaggcaacagaagaagaaaagtttaaatgtgtgtcaaaattgtaattttcagaacttcagccggagaagaaagacatg

SEQ ID NO: 25273 - DNA, 3000 bp, Unknown; identical to SEQ ID NO: 9740
  misc_feature (1)..( 3000): 2750-1469P.txt file - cDNA_ID_2704562; gDNA_ID_2213619; Annot_ID_131955

SEQ ID NO: 25274 - DNA, 3003 bp, Unknown
  misc_feature (1)..( 3003): 2750-1469P.txt file - cDNA_ID_2704570; gDNA_ID_2213619; Annot_ID_131952
cagtttgagttgcccgagctatcaagaactaccgctaaaaaagtatctgttcttcgtaatctttgccaaaaggtaaataattatagacacattttcattcagaatttatttaccagggaatcctgattatgtcagttcataattgttattaatcacttcatttccctgttaacaggttggtgtcagtattgctgctcgcaaatacgacttcagtgcaaacacgccttttgagacgtcagatattttggatcttcggcccgtaattaagcactccgtccctgtatgctctgaggctaaagatcttgttgagatggggaaggtccaactggctgaggtaccttttgttatttcacactagctaacttttgcttgctaatttttgccaatatgtttgtactggataagatcaggagaaccttattgtgatatggattggcattcaactcttcaataagcatctcgttttagtttgcgaaagttgcattatgaatggttcttggtttagttttttatgtatgaaaatgattaaacttttgtagggcatgcttagtgaatcctacacgttcttttcagaggcattttcgatacttcaacaggtaagtaatctgtatacgcatctcgtcctgtcaaaataatttaacaccgaagtagctcatcatattctgattttaggtgactggtccaatgcacagggaagttgcaaactgctgcaggtatgcgtccgactgattttttgtttttctggaaaaatatccatgggctttcgttttagttgccttaagttttttgtcgtcttttgcttttcaggtacctggctatggttttgtaccatgcaggagatatggctggggccataatgcagcaacacaaggaactcattattaatgagcgatgccttggtttggaccatcctgatactgcccataggtatcaactatctttcttttatattaatgtactgtgatattgtactctcagctattgacttgcttcaaatgttttgatactgcagctatggcaatatggctcttttctaccatggactgaatcagacagaacttgctctacaaaacatgggtcgagccttgcttctacttggcctttcatctggccctgaccatccagatgttgcagctacatttataaatgttgccatgatgtatcaagacatgggcaaaatggacacagctctacgttatcttcaagaggctttgaagaaaaatgagagacttcttggtcctgaacacattcagactgcagtatgctaccacgctcttgccattgcgttcaactgtatgggtgcattcaagctctcacaccaggtactaaaactttcgtaaagtcttctagatcccacctttcgactctgttcttgtcaacatgagaactatatgtctcacctttcgacttaattgttctgttcttgtcagcatgagaagaaaacatacgacatacttgttaaacaattgggagacgatgattctaggacacgagactctctaaattggatgaagacgtttaagatgcgtgagcttcaggtttggtgcactgataatgactgaggagaacctcatttatctagtatacattttgtttggatttctcaaattttctggttgggttttgaatcagatgactgcacaaaagcagaaaggacaggcagctaatgcagccaacacgcaaaaggctatcgatctcctaaaggtatacttgcagctttagatttcggcatattttgctgaaaaggaataactcctctatctttgatgttgtagagttgaaataataatgaaatcgttttcctgattggtatacaataggcacatccagacctgatacatgcgttccaaaacgcagctgctactgggaggacaaatgcactgaactctgctgtccttggggagactcaaccacggggcagaggttttgatgaaagagcagctcgtgctgcagctgaagttaggaagaaagcagctgcaaaggggctactggttcgcccccagggtggtgttccagttcaagccatgccaccgctctctcagctccaaaacatgatcaataccgccacagtttcgtctgagaaaggtggagaaaacggggaggcaaaggtacaagagaagaaagaatcctctgaaaatgggaaaacagaaaacctggctcctgcaggattaggtgctggtttaacatctttggataagaagaagcaaaaagccaaaaaataagaaacagtaggatcttgaaggaaaatggtgctcaaagaaagtgcacgattctaagtagtgaagttggtttttgtctctggaagtcgataaaccacttgctgatttcattacatgacaacaacgcttttgtacgttaagctttgtttttcttcccattatgtcacaacgatttgggtaagtcccgcttccaggcatgtctggcttttttcttttttcttttcccctcacttttctgcgggtgtaattttataccacaaaaacgtcattgattttctagtaactccaataagctcacagttcacgcttatacctaaccttgcagccttactatttttttgtgctctatacaaaaatcttttacttggcttcttgtgtctctagagtctagactttagagggacactagattgaactcgactaacaacgaagaatcatggagtggatacatcaatttcgatcaaccattaatgatcatcacatacttcatttatgttcatcttccatcaatgatgaagatgaacagtggcctgtagtgatgttgtcactggccaaaacagtggtcaggcgtaacccgaacaagtacctaagtgtatatcaacccatttaagtttaagtctgcggcgtgagagacgggtaaatgggtaatgtttctaggcccaaattataggccttaataaggcccaattatccacacaggttagaagtgaggacggctaatggataatgttgacgacactcgcaacttcttccttatcgacacctacactctcctgctacaatg

SEQ ID NO: 25275 - DNA, 3003 bp, Unknown
  misc_feature (1)..( 3003): 2750-1469P.txt file - cDNA_ID_2704574; gDNA_ID_2213619; Annot_ID_131951
aagtatgtatttccttgtttcggagctgtttaacgtttctggattctctcttttatacacatactatgttggtacttgggttttattggcggtgttttttgaccttatgtatcttgtgtccatttttccaaccagatttctttttgacgagaactgtgcggactacaagtactatgtattcaggctggctgaagaggaaaaattaatttcacaaaccaaggattctggtgtacttcacagtggtaagtattagacaccatataattattttcagaatatgcttagccaagcatgtgcaaggaatatttggctcatttctttttactctccgaaaaatttctatcctacaatacgaatttatatgtgttctgtagtgtgagtgataatgtgaggctgctcttcctgctaccatattcttagcttcgatttccttcatttgtctttccaggtgatgcaggctcgcgaacgtccacagcagcaatccctttgcaaaagccagcttatcaacaaacaggatatcagatccctgcctcagctctctatgatactcctgtggaacctggagcttcttctagatctgctcaggcatcaattacaagacccagcgacagtatgttcattagccttatatcgatctaggttccttcctattactgatatctagttttgattgtgggttatatatgtctgatctgcaggtgactcctttagtgggccgaggggtgcagaccctctatcaatgatggagttttacatgaagaaggctgcccaagaagagaaaatgagacgtcctaggcagtcaaaagacgaaatgcctccaccagcttcccttcaaggcccatctggtgagaatgaatcctagtgctatttatggttttaggcagctgtaaggtcttatcgctcaaccatgtttgatttcagaaacttcctccacagaccctggaaagagaggtcatcacatgggtgattatatcccacttgaggagctagataagttcctttcaaagtgcaatgacgcagctgcacaaaaagccacaaaggaggctgctgagaaagcgaagatccaagcagataatgttggacataaactcttgtcaaaaatgggttggaaagaaggtgcttacttgcatcactctatctgtaaattggtgcccttgtttctttctgtatcttgtgcctttatggagacaaagagcttagaaaattggaggagtggattacaggtgaaggtataggaagctccagaaagggtatggcagaccctataatggcaggcgatgtaaagacaaacaacttgggagttggtgcttccgctccaggagaagtcaagcctgaggatgatatatacgagcagtacaagaagcggatgatgctgggttacaaacacagacccaatccactggtattttatccatctttagctccattctttttgtgatagcacttcttttactcaccatctgtctcaattgtactacagggaaatcccaggaaggcgtattactaaggatcaaatcaatgtgttatgcgcaattattatctttggttcacctcagcaccgtctgagctttgcttttctattataaagaatgttcaagcttttagattactgatatattgaagtgttggtatgcattgaatttgcgtttcagtgtgcaaatagatctctttgacagacatatcagttgaaatacaatggatttgttattgctaatgactgagattttgattcgattgtcataactttattaatgttttggaagtctgggacataatacactaagcagcaaggttattaaagagaaaggtaaatgaaaaaagaaaagaaaagaaagatgatatgtccttcctagttgatgatatcgcagggagggaaattagcagagcatctctgagggagctgaagagccatggagcggtcaatgccagagagtggaggtccattggcaaggaggcaaagacaaggacgaccaagtgtgacaacggcagagcaacatatctcggtcggtgggatcgggctaaaaggagcaactgctgctctacatggtatgagctgtaccagcgcggagaaaaatgtcctgctgcatcctcccacttcctcctcgggcaacattggtggtggaggtggttgttgcaggccctcttgctgcgctgcaacaatggtaagaacggttatggtcatgagcagcgtcattgccaacccaactctcatagctttcatcatcatgtaaacagcgatggtaatgagatgacgcaacaacgagatgctgctggtttatataccataccatataatgaaaggggtaacaatgtcatgccgtttcacacctctctcctacctcacaaccaaatagcctcacgattactccgtgtgtgtgtctccactgtccagagctttaatcttcgatcaaactcacaaaaattataacatatcaccggttcctcctagctacaaatattaaacccataataataatattgtggtcagtgattattctcacctactgtgggtatctaaaaacttgcttaaaattctgatgatttgcaataaatttcgcatctttcccgctttaaaaaagcccaaacaaagcccattagaaacccaaaaaggagggattggtttgttattctctgtatctctctcctagtattcagctctaacacatagagaggagtcagaatatcatcagccgcctctttcacttcaaccctccttaaacctcatctctttcctactccgccgctctctccgtcgtctctcccgttactccatttctctcgacccctccaggtaattccttttcagatcctctactagaccctttacttattttagtgaattggtctttctccatttccatctatcccttacgtatctgtgactttttccccccttttggattgtattcctcatcttcctctgtttccgtcaaatgaatgatctttctgaaattcaatcacttttgtatcgtttctgaatctttcctctaataggtgaaaatg

SEQ ID NO: 25276 - DNA, 3003 bp, Unknown
  misc_feature (1)..( 3003): 2750-1469P.txt file - cDNA_ID_2704578; gDNA_ID_2213619; Annot_ID_131945
gattgaaatgaatgagttagaaaaaattctgatgtgacaataaaaaggaaaaaggggaataatgacgtcagcaaaatggggacacgtgaaattatttttaaaattatttgggacaatcgacacagttgctctatcgctatttgtttacgtggggctgttctctctctatttatataataatgagatacggttttttcagcaaccagattttaaagttatctgattaaatctaataataggatagagatagagtcacagagacatgttgttgactttatgacattattttattctttgcttatccactcagtcatcatttatctcaccagtcagacataatgtgttgttgttgtgaatttgtagatgcttccgactatacctgattacctggccattcagaatcggtttggatcaaaaaatttgggttttcggtttagaaatcgaaacaaaccgaattagttgaaacgaaccgaatagaaattcggccaatttggttttgcattggcgtgtaccttgtgactacatgtgtgtgtgttagatgagatctatccacccatttttcaaatcatttttgtcgttaagctatcaagattctgatattttcctgctcacttttgattcccaaaacaaaaaactttcttcaattattctattcatcttctcatggcggctctctccaccaccttctactaccacccactctgcactaaccaccgtacaaagagacaagcctcaagcagacacggagttagatctatgagagtgatgtcttgtcggaagcagaaattaccagaagagaatgaaggagtgatccagagaacattgagaaggatgatttcagaggctgggaagattgggaagaatctgaagccagagaagaagaaaggagacgtcaaggacctgatgcttatgagtctctcttttgctgtttatgtttatatctctcaactattggtttgtgcttacttctcctggcaacatctcagcttccccaaatcttcatggtagtagctaagctagctcctccttgtaaattctgcacaaatcagtaataagataagaaattcaattccgacataggagaattgagagttgtgatctttcactttggtcttatataattgaattgttaagcttctcatacctctttatctgctttaactccggcagaaaaggcaaaccaaccattgcgataacactatcaaccagttaaggctctttgttttagagccgaaaggagatgcaagagcctcgggcagagtcgctgagtatgccttgaaaaccaaaactttgaccgtaattgttagaaagaaagagagattcctaaccatttcgtattggcctcctccaatttatcctccttaaacagagagccccatccattttccttctgtgtgctgcaccaaacctttcctccatagtcatatcactgcgagcttttccctgtacaatccaacctctaagtcagctataagcaaagagcttgggataaaagcttggttgtggagtgttcaggtaaggaaacaagaatcagcaaatgatcttaaagaaaaaacgttcctcctttgtttcatcaaatccaacaacttcagcgtcatctaacaattccgctatagatggaacattgggaaaaagaagagtttccatctctcctatatgctaaattcccagcaaacatgcaagagcgcacgttcaccagacttgatgctggaaacaccaatagctaaaccggccattacttgtatctctgttcatagaggacatttcactccttagtttttaatcttgtttaaagctctgtatactaacataaacatgcatgaatcagctttaaagcaacaaaagaaagaaaggaaaactcaatttctttcctcccaaatattctttttcattaggttcacatgaaacgcaagatttaagacctcagctttactatcaactttaggtaggtaagactacctaccattttgagaaggctcacaatgcaaaaatggaactcaccatccttgactgattcggtttcagctccagcaaaccaaagtgtttctaataaacttggccgtgcattgaaccacggagttccaaaatcaatgtctgtttaaatcattggccccagaatttgaactacacacagagtcacagacattcattacgatggttgaatgaaatggtcttgactaagaagtaagaacaactatgcacaattgagaaactattagctcgatttccagaaactatcactatcgtaatataaaagtcccaggatcgaccaaatcggacgagaaagactcaatgaagaaaccccataaaaacatggtcgaagtcagtataaacaaaatcaagagtttggtcgtcgttgtggatttggaggagaggagagtgagcttacagagtatgagaagcgagaagctcaggggaagtgtgactcgtcgtcgtcgtcttcgaagtcactcacgaccatcgagagatctgatgattttggtaaaatatcaaaaaaggacttcaacttttcacttaagtcaaaacaagcccctataaataaattctgttatttaagccttgaggcttgagctgcgtctttgttgttcactaggagagttatttgagcggataatttactaaaactgaatgtccatctcccaaacaaacattttacgttttcatgttatataaaagaatactatatcgttagctagaatattgtagttaaatattaaagtagtgtattttacattttgtctgaactttgtcatctttgtttcatgaatggtcaatggtgaataatggggagagaaggaacgtgaataaagggatccacaagtgtctccaccattttctgagtaaaaacaatcacatcctttcattttcaaacccctaaaccaaattgtaaagtcagaaaaaaagaaaaaaagaaacacacatacaaatcgaaaagcttttcttcatctcccacgttacaataagccctaagaacgaataaggcaactacagagagaaaagatg

SEQ ID NO: 25277 - DNA, 3000 bp, Unknown; identical to SEQ ID NO: 10018
  misc_feature (1)..( 3000): 2750-1469P.txt file - cDNA_ID_2704585; gDNA_ID_2213619; Annot_ID_180886

SEQ ID NO: 25278 - DNA, 3000 bp, Unknown; identical to SEQ ID NO: 10018
  misc_feature (1)..( 3000): 2750-1469P.txt file - cDNA_ID_2704585; gDNA_ID_2213619; Annot_ID_131935

SEQ ID NO: 25279 - DNA, 3000 bp, Unknown; identical to SEQ ID NO: 10016
  misc_feature (1)..( 3000): 2750-1469P.txt file - cDNA_ID_2704594; gDNA_ID_2213619; Annot_ID_131931

SEQ ID NO: 25280 - DNA, 3000 bp, Unknown; identical to SEQ ID NO: 10015
  misc_feature (1)..( 3000): 2750-1469P.txt file - cDNA_ID_2704602; gDNA_ID_2213619; Annot_ID_180880

SEQ ID NO: 25281 - DNA, 3000 bp, Unknown; identical to SEQ ID NO: 10015
  misc_feature (1)..( 3000): 2750-1469P.txt file - cDNA_ID_2704602; gDNA_ID_2213619; Annot_ID_131929

SEQ ID NO: 25282 - DNA, 3000 bp, Unknown; identical to SEQ ID NO: 10519
  misc_feature (1)..( 3000): 2750-1469P.txt file - cDNA_ID_2704610; gDNA_ID_2213659; Annot_ID_132500

SEQ ID NO: 25283 - DNA, 3000 bp, Unknown; identical to SEQ ID NO: 10519
  misc_feature (1)..( 3000): 2750-1469P.txt file - cDNA_ID_2704610; gDNA_ID_2213659; Annot_ID_181799

SEQ ID NO: 25284 - DNA, 3000 bp, Unknown; identical to SEQ ID NO: 10337
  misc_feature (1)..( 3000): 2750-1469P.txt file - cDNA_ID_2704628; gDNA_ID_2213643; Annot_ID_132333

SEQ ID NO: 25285 - DNA, 3000 bp, Unknown; identical to SEQ ID NO: 10337
  misc_feature (1)..( 3000): 2750-1469P.txt file - cDNA_ID_2704628; gDNA_ID_2213643; Annot_ID_181363

SEQ ID NO: 25286 - DNA, 3000 bp, Unknown; identical to SEQ ID NO: 10335
  misc_feature (1)..( 3000): 2750-1469P.txt file - cDNA_ID_2704644; gDNA_ID_2213643; Annot_ID_132329

SEQ ID NO: 25287 - DNA, 3003 bp, Unknown
  misc_feature (1)..( 3003): 2750-1469P.txt file - cDNA_ID_2704652; gDNA_ID_2213643; Annot_ID_132327
tgatagagtttgtcatccttcgaccaaagaatacaaaagaaaattgagatgtatcaattagtgtgcgaggaacctataaatttaatctttggaaacgcctggacatcgaagcaccagtggtctagtggtagaatagtaccctgccacggtacagacccgggttcaattcccggctggtgcaatttttttaacaaaccaacgcccaacatcgtaatgaacctatgtgggctttaacggcccattttgcttttcagtccgtaaacactaggccttttttatgtgttatgttgtccttcctcccaaccacatgattacactccttgagttcaaaaatttctcttatgtttcttttaccgattgtttcatttagttattcttaccaacatctactggttaaaatttgcatatagccatgggaattcaaatatctggaactgaaattcgaaagcgacgatgcaatgcaaataaaatataggatttatttgtgaactaaaaaagtattttaatgatatttggaaaaatcgagaaagtccgaatgggaattgtaagttttaaacacaaagagacatttttgctttagtcaggcgtgatggagaaaactcccaagggatttagttttccctcgagttaagttattatgtcattaaacattcttctgtaatttatgatctaaaccggaaaagaaaaacgggttagcgcaaactgcaattatctcaactaattcttaaataacagtaattatgatcccattgctcaagtgttttagtagtcttttaacgtttagttatgttacttcactgttccagtaatacgtcctaaattatctcgtacttcaatttagattaccatgaactacaatgttaaattgggattatgggaacataattactaagatgttttgagacaattaaaacttttaaaatattgacaaataattagtatattctttcagccgatattgatttgaatttatctttttttttttctggaacatccaataaaattaaaacgattagaaaatggcttagcatggttcatgcacataaatgaaatacataaaaatgattttatttcactaaatataattcagctaactcatttgcaagtttgataacatgactgtagttgagaaaaaaaatgaaactatagttaatttggtcttgtttctcaaattttcggttgcttatttgatttttttttatttacatgataacaaacttaccaactataaccatatccgagtaacttttaaagtacacgagcactaagtgaagaaagtcacatgcgtacactaatcctaattgaatcacacgatttctctcgtgtgcaaaatccgtaagtacataatattaatacttttttttgtaacatattaaattctaataatctcctcaggtgatttgaatcctagtctgtaccagctacatactcactccatgtaaccaaatattcctaagccacctaagcagatccagcacgatcaatcaatattacgagctttagtgtttgttttgtcataaagggagtttaattagcttataattacgcatttaacaattatacttacataaatgggcttcaaatacattcatggcattagcatttgtcggtacatctttaccggcatttgccggttcatccggtccccacacttcacgacaaacagcagcagttccgatgtccggcgttcggcggaagaacttataaaataacttttctaaaattaaaataaaaataaagaatgaatgaaagaagatagacaaaattgattattaattgagtttgctttgaagctccaagaaccaaacgtatccgggtataaaataatacgagataaagtgatagaagacctaagactacctcattactaaaaatatggatatttttctatacaaatccacgaatgaaaagaaaaagaagttggactaattaaattgaaatccaataattgtaaatataatattaaaacccaataaattagaagtctcatgttgcagtctccattattgattgtctccttagaatccaacatgtgaccctccattgtctaccattcacaccctttggctcactcgataaatttggacattaattgcattcattttatttgtaagaaccagaatctcagtagatgttatttgtgttgagtaaactgttgttatttatagactaggctattcttcgtatacactttgatactgatttttagttcatcatctatctaccgactaaatatagtgtttctatgtggcttctcctcaaatgtcaaatttatttctttaatgttgtttgagtttcaaacttgcaaagtgcaaaccaattttggttgttatactaaaaccacacatataattaaagacacccactatagcataaaattcgtcgtgtaagcaattttactatagtctaaactccataaaaggacgtcgaaaaatattgtgatattggaattatagtgtcagtttgtttttctttgggcaaatggattgtagtttcattatatattacaatttataaacgaaacgataagtatggctcatactttagtgatggagaattaaagtattttatattcagagatgacacaatatggtagaccaaaaataactaattaaaatagtatcatattagatatttatatgtgattgtaaatttgatcattgagtgaacattttaaattagtatgcccaagaaagaaaagaaaaaaaaaaaactctttctctctcatgataatgttccttttataaaatccacccaaagacaccaaacacttctccatcatcatttcatttcttgttctttttccaccatcaccatttcctagttcgctcgtgcacatctccgacgatcccaattctaaaatcatcacttcttccaatcttttcaacatctcttcaaaatatccagtcaacaaaaaaaaaagtacttaaaacaaggaaaccccttctttctttttgtacatataacataaaaatcatcacttttttgttcgtttcgccgatg

SEQ ID NO: 25288 - DNA, 3003 bp, Unknown; identical to SEQ ID NO: 25287
  misc_feature (1)..( 3003): 2750-1469P.txt file - cDNA_ID_2704652; gDNA_ID_2213643; Annot_ID_181355

SEQ ID NO: 25289 - DNA, 3000 bp, Unknown
  misc_feature (1)..( 3000): 2750-1469P.txt file - cDNA_ID_2704659; gDNA_ID_2213643; Annot_ID_132324
attgacaactttgctgaattttctactccatcaagtgtccgtgtgcctccatctgcttttctgggacctaagtgtgcactatgggattgcacaaggcctgctcagggctccgagtggtacctggattactgcagtaactaccatgggactctagctctgaatgaagattcgcctggcacagcacctgtattgaggccagggggcatcagtttgaaagataatctattgattgatgctcttcgtgcaaagactcagggtaagaatgttgggatcccagtgtgtgaaggagctgttaacacaaaatgcccatggaacgcagcaggtgagagcattgtcccactagagcccagttttgcttctctctttgttttagttcaacatttcgttgcctctttgaaaacagaagccttatgtgagtttcttacttttgcctgacccttaattttttgtacttgcagagctatttcatcttgaactggttgaaggcgaaacaattagagagtggctcttctttgacaaacctagaagagcatatgatagcggaaaccgaaagcaaagatcacttccagattacagtggaagaggttggcatgaatcaagaaaacaactgatgaaggaacaagaaggccagaagagatcttactatatggatccacaacctccaggtccctttgagtggcatctctttgaataccaaatcaatgaatctgacgcatgtgcgttatatcgcctagaacttaaagtaggaaatggaaagaagagtcctaagggaaagatttcaaaagaccctctggctgatctgcagaagaagatgggacagtttaaagtggcttcagacaaaccctctcctccaaccaaaggtcgtaaggagtgaagttagctattggtaatctaactcaagactcctgcaacaatagctccaagttgtctccagcattctacaaaagagccatcgccacctctgttttctttttttttttctttctgactgtattatgaagagataggatctttgatgtgttgtgttaatatggacaagtctggtctttgccctttttcttgatagaatcgtagatgggtttgtaaatttttgcattttatttttctcctttaaaaccacaaggattttgttaacgaagtggtgtattcatatttcaaaggtacatttgcaacaccattgattctttattccaattcttatctacgtgtgtgtgtgaatgaaacttgaaaccaatacaagtcactaatgctctcagattatgtaattgggctttactgggccgtttataaaattgggctagaaaaagggagacagcagacgacaagagcatccttgttctctttaaaccctaaattacaagcaaatcaccaacagagagagtaatggcgaaaaattctggtagctcgtttgaagcagagaaatcagagggaaagtgtgttacgacgactactgaagcacaagtaattcaaaattctggctgatgaattatgtatttgattttacgtatttgtaattcactaattctcactgattcatacaatttgtgtcgtaaatgaacagcaaagtagtcaacctgttttgagcaaggaagaggagaaagtgagagatagctacttgttctgctgtgaaaatttctacactcttcctgagatgatcaatttcatgaaggagattcatggtgtagaacaaaccactgtgacaaaggttttcagggaacttttaaaaggtagaaaagctgaagcatatctcagagaatctcagaaaagaatgaaggcaagaacaacaacaacaacttgaacagaggaggatgaggcttaggttgctctaatttgaaattctttggtttggtttactggttagtaagaaatagacttgtattgtcacatttttttatcatattttgaggtccattgctttgggtgtatggaccagactaggacaaatgaataggagatgcaaaagggtaataatggagaagtcagtcttgttggtctattcttgtccgagtccatgatttttagagggagaactagaaggaggaactaaaagttgtttaggttaatggtttaggtgctaagtgttggctctgtgtgttacttatgactcgtgggatctaatgtcttgtgaaaaatcacttgtgagataaaatggacatagtctagagaagaaggtatataagaagaaaagcagtcaacttaactacaaaatcacaacggctcacaactgttttatgttgtagaagttggttgcttcttagagtggttcattcttcattaccagctaaccgcaaataaccgtgacttgaagtctttcgaattacacttctttcactcgtggttcaaacttcttctgttcaagttgttatgccttctccagccattacttgatttcaaaatggtgttgatggtctcattcttgaaggcttggatgtttctcaactttttgctcttgaacaagagccaagaggtgatgggactccgtagtacaaacacaatttaagaacgtttgagtaagagttttgattcacattgaaaaaaaaacttagaagaaaaaatgaaccaaactaaaataatcaaattaatttagtttattaatcaagaattaaatcaagttttaataataacctgaattgtagattttttttcttttcttaatagtcgaatactgaacactgtagtattaaatgaaaactcaaagcccaatataattcaaagcccatcgaatcaaatatctggccactccacttattcttaacttgaaacttaaaagccgaaatcgtaaagagagaatctggtcggaataatccactcgaatcttaaaacgacgtcggtttaaccaaatgcgagtcaacggatgctgctgcaatgcgtcgtgttgtgttcgtcactcgccgtcgtcgtcatctccgtcgcttcgacctctcccctcgttggtgttcaccctttaggttacttcttcgatgactcttatctttattatatcgacaaatctgaaaaatg

SEQ ID NO: 25290 - DNA, 3000 bp, Unknown
  misc_feature (1)..( 3000): 2750-1469P.txt file - cDNA_ID_2704661; gDNA_ID_2213643; Annot_ID_132323
ggtcaagaatctacaaggttttgcaacttttcttgggaagcttatttgttttgtttgattgtctagcaaactgatacaaaaacaattgttgttgttgttgtttccaggtatgaagcttgttttcgctcttcagatggtttttatcggtttcttagtgatcttatggatgcttaggagtcgtgctcggtctaagagacgacgctatctgctgaagaatgtacctcccattaatagatcagctaactaactccctggaacttgtattatacttttgtgaagcttttacgtggaacctgagtgttaaagccacatatgtcaagtgtcattactagctatacttattcagtgtgagattgtttgttcctagttacataattgtcttggtcttcatgtttattaagccttcagatcctcagaccatagtaggtaccgatgagtcttatcacaagtaagatagtcacatgatctgcagattttctagaaaatggatggattcacaatttgaatgatctcatggtgaattattcgactgatataaggttttatgaaaatgaactcttgtttgtttctcacagacaaaatcaatatacaaaaaacattacaagccattgaagagaagagagaaatttacagttaaaaaatcctgaaaaaatgatttgtaaactcaagattggaaacatccacaagttgcctttggaacaattctaatggcccagtattttagcagccgtttcttcttgcttctccacgcttaccttcaatcattgcacttctttcttctgcttccttgtgagtcactgaaacctaattcatcctctctgcatactcctgctttcttcttctctagttcctcctgcagtgaaacaaattcacaaacacttcacttctcattgttctcaatcacattgaaacagtatcagctctctattgctaagtttattttacctccattttcttgagttgcacttcgacagctgctttcttcacttctcaacggaaaactagtcacatagtttagtttaaggtcacctctaacgagtgaagcagaccaagatttcgccagtgcagattctgtaagaattttcattctactaaaacataaacagcaatatgccaagccttaacacaaagagtgtcacaggtaaacacatacagagcaaatgcatgattctgtcataaagcttcaaatttagctgtaatatattacctccatggatgtgtattgaatcgtaaataggccgcttctctctcgaaacaagaactagcaatggtagcctgatgtcaacgtatgttgtatgaatcaagtccccagtgcaacttgaaggtaaaagaacttcttcacactgttaggtcgaaaggtgaaacttaaagcttatgtactagacaaggcgatggaacttcttcacactgttaaggacagacttagaggtaaaagaaaaacttgagtagctcatggagtttagctagaggttggtcgctaagatatttgtaaactgaagatgctaatggttatattagggatgatgatcttgaaggaattatttggaaatgacataacagatgatgtgtgatttcctcctttaaaacaaaatcgtttggttttgataatcatgaaaatatttctatgagattactgtccgacacacatttagagaaataattcactgactatatattccgtaaatacatgtacatataactttctcaagtttgatttataattttaacatttcaacaaaacaaaaaaatatagattccgttaaatattcctatcgatccggaaaagtaaaaaattggacagacaaaatatccaaaattatacgatttaagagagaaaaaaaaagtagcaagtgtcctacatgtgggtgtggtctgggacaaagcaaatatagaggggaaaaaaagagtacagaaaacaaatcacatggactcacacatcaacattatactcttcactctctctccactcgtccactaccctactttctccatgcattgtttagccctcctcatagcagtgatggtaacaagataatccattaccatggtgaaagatatgtgataaataagctaagtcgtcggatttgttttccaataaattaagtcatgtttatcaactcgacttaattctattattctatatatagatgatactgtgtgctattaactcatgtattcattgtacttgcttgacgtaggtttacatgtaccaaaattattaattgacacatatgatttgcaacaaatacgagatattgcatttacatgaacctatcgaaaaaccattcataagaaagaaacgtattaaccattcaacaaaagaaaggtcacaagaacacgtgcttgcttgattcctcctccaaatctctttacatagattaaaaagaaaaaaaccagtggaggagaatttccagttataccgttgagacctttagcctcacttctcaagacagctgtttcatagctgtccgatctcaatatctccctccatgtggccctactcagagagataaattaaacactttgatcacatcgaatttattatgttctttcataagattttacataatatatatctcatgtatatatatatatatctctatttatctccttcattaattctgtttttttacttccttctatttatataactatcatttgttaaacatagccattttggttactcttgttccgttttcttctttcttcctctccttccttttttcttttctctatcttcttcatatggttcatgacattgatctaattccacttcccatttgtctccacatttcgtttctttcctttgttttttcatctaggtttttggttttctgaattggatttacgttagtttatcttgtacttattaattaaggttttttttttttccttcctcaatcctgtaaattcagatttgctttctttggtaatcttttggatcaagatccatctattttttcttcaatggcacaactccctcctaaaatccccaacatg

SEQ ID NO: 25291 - DNA, 3003 bp, Unknown
  misc_feature (1)..( 3003): 2750-1469P.txt file - cDNA_ID_2704665; gDNA_ID_2213643; Annot_ID_132322
aataaattgtattatcatattttaaaattttgatagcagtatcatatgtaactctaacattctatgtttagagatgaatttatctatatatatctacttggataaaccaatttgcaccatactatttgcagcatatgagactaactaactcttgatacactgaaatgatggtagacaattcagtctatatatgcgagttaactcctaataccgtgaaatcataataggcaaattcagtccacaaattttttacgtaggattttgatattttccactctttatatatacagtctataatcttcaaacctatcacctataaataatctacaatctaccatttagtcaacaatggtgaaatttctaaaccctcgtgaaagtctacctatctcccaaagtttctaattctatctacttcacatttttctccacccaccaactaaagtataagccttggaaaaacaatcaaaataagaaattctataagtcctttattccttatataataaatcataagttagtaaactcttttgttcacttttcttttgcatccaccgaagaaaaaccagcttcacaatgagctccaacgacagagatcatcgcaggttcaactctgaccaccactcattctggcctaatccgtctacttacgatcttaacagcaagatcatgcttgccgcagtggcttctttatctggagttatcctcatcgtcttcgctcttcatctttacgcaagattcgttctccgacgccgtagagaagctttccgtggcctccccgtcattttccgccacccttttgagatgcctaagcgtggcctcaatcccacagtcatcgcttctctccctactttcactgttggagccactgatggcgtggctgcctccgctactgaatgcgcagtgtgtctaagcgtgttaaaggagcaagacaaggcgagagagttgcccaactgcaagcacatcttccacgtcgactgtgttgacacgtggctcaccacttgctccacttgtcctgtttgtcggactgaagttgagccaagaccgagacttgagcctgagccaagggaaggaccagtcggtactgcaccgcagttgttggtggaaaccaggctgaacttgactgtagaagccgcatcctcttcttcctcagataacaaaacagttgtatccccggcttcgcgattaaattcgtttaggaaaatcttgacgagggaaagatcttcgaacaggatcaaccattcttgtcctgaccaagatcgtgtggcagatcttgagagacattgagtcgacatatagatacatattatgcatataaatcatatacacatatcgataatctttaatttatacaatatcctcctttcttttttactatatcatgctctgtttttggttttagatagttttgtgtaacggaacactaaatatatgttagtcaaaagatacatctggtgcagttcatgccattcaagttaactattcacagtggtagacagtacatatcagggctccataaaagatgcagaaccattttagttacataaaactgagggagaagagagatcataaaagggttaccttcaatcaccaatcggaagctaaacctgttggataatcagtgtcattgtcacaatgtggcctaaaatgacgaagggtgacaaccagctgctaaacatccgccttgctcggctcaatctgagaattctggtgcagttgctccctgcattgaagtggcatctgcgatacttccattgctcactcccttactgcacaccagatttcaacagcatgagtgtaactattactatactcaatgaaacgaagcctcatggagaatgagaacattttcaaaaaaattgctttaatagtttttgaaacttcttctatgttctgcagtaactgcatcatattgataatatgaacaatataatcaccaagatcaaaatcaattgtcgaggagaagtgaagtaacttcatccttctaagccagaagctaatgaaaaaaacaaaaaaaagatttcatttcactcaaaagttcaaaacccatcaaactagaaatcattttctaaaagaacctatgatggatcaaaattgctccaaacagactataaatgagacacacacacaaacgctaattggcaatacaaatgtggattacttaattaccttgaaggaaacttgcatgttccttgacctgaaaacgaaaaattgcagaaaaagcatcaaactttcaacattttcaattagcaaaagtcataactatctgctagacattgatcctgaaagaaaatgtgaacttactaggattgagagaagtaacagctgcgttgttactaaagttgcaagcttcatctgcgagaccattccatcagataatagttattgaatacatacgaagccatcttcactatatccaatggatcgtagcaggatccaccttgctgaatctagacgcaatcagctcctctgggaccacaagcccagtcaatggccgtttaaagtgttgaatcctcaacgttgttcttcgccacgcaccaaagctccgtctctaatacctccccaccaaactccgcagtagcagcaaccgtaatgaggagaaatagagagattcattaggaagcagtgaggctgagagagagaatacacgatcattttccgagagattgatcgattttgtactcggagatttcgaagaggaggaagagtgtgaatttgaaagagtcgaatagatgttggagtttgttgtgattaatgtaaagatttgggtgaataatgtaaaatattttaattcttaccggttattgaactcggttatactgatttgggccgtattaaactccggcccatatacatatgggcctctaatgaagtgtttttagctgctctgtttttgatgacggagcatattaattatggttaattagtaaacaaaaagactctttagctccttaaccttttcaatttctgaaagaggaggagatcggaaaacaaaacccagtcatg

SEQ ID NO: 25292 - DNA, 3003 bp, Unknown; identical to SEQ ID NO: 25291
  misc_feature (1)..( 3003): 2750-1469P.txt file - cDNA_ID_2704665; gDNA_ID_2213643; Annot_ID_181346

SEQ ID NO: 25293 - DNA, 3003 bp, Unknown
  misc_feature (1)..( 3003): 2750-1469P.txt file - cDNA_ID_2704702; gDNA_ID_2213670; Annot_ID_132766
atcattgtaacttatgtatacatctacatttgtatattaaaagagaaaaataaataattaaaagaaacaagaaaaaaaagaggaatcaagaaagagttttacgtagtcaacattagaaatttatatctacatgtgttcgaaacttggcaattgataattgagattctaggtaaacgttgccagtagaatgattttaactctcttggcatatataaattattgcacttgtattgtttttaagaaacaatatagccgtttttgtcagtaagaaaccatataaaaatgttaagtctcatggctgcttaaaatgtttcgaaacttttaaagttattaatagtcaactgcaagcagtagatggttggaattggatctactagtccatgataaataaataaataaagtaattccggttttcaaattggtttggaatagaaagttaattaatcaatataaaatccccaaaccttgaaaatcaacctcgttgacccatctttatttcacccgtcgatggtaatttgtcgcgtatcggttatagacaacaattactaatattcttccaccatatgcaatgtcaacaaagttactatgaatgattgatttagcgttagttttttttaaatcgtcgtcgtattcatcggtttggcatagacactatatgattctcgaaccaatgaactcgttatgtaatgtatatttgtctcgattatgattatctaatttttgttcaaatcaacaaagtactagtctattgttagaagcgttagttacgttagttgatatcatagccatgttaagctagtatcatcctcgacaaaagtaatattatcatcgatgttcccgttacattagactcttaatacatgttaattatgaatatccatatattaatatgattgtatgcttcaagaaaataaaaagatcatgatttgataattgatactacacttaaagtaattatagttttttttatttttttttattttcacatttccaaacatatgtgatcgaatacgaatggcgatgtttaagatgctaaatcaacaagatccttacacaaaatcgaagcaatttttgaggagtatgtaaacagtgaccgacttgaataccttcagtgccacgtttttcctcacttggacaaacttgttcttcatttttatttgtttggaccaagataactcgttattcattacgagggctttccacggaagaaaatgcactacctacaaaagaaatggaataatataaacttgaatgggccctgcttgggatatcaagacttcggcccagcaatgtccgtgcatgcaaatattttgttaatcactttttaaagtagcatttggattatcgcttagtatatttgcattcccatctattactaatactacaatactaggagcaaaagttattagttctttaatttgattgctagatagtgctggaaactttatttcaggaaatggaatttctaggctggctaaatagtgttctggattcttgagggaccctgttacgcctaaaaataatgttgtttttttgaaggtcatcaaaataaacattttataagacagtaaaaaaagaaataagacaattatatttatgtagtcaaacgcttgtttttgctggatatataattacataaaagttgcatttatcctttaatcaattgccaaaaagcaagaaataatatcaatccaatcttataaacaactatattatgaaaaagatgataattattgtacgcaagatgttatacgacacacgtaatttgtagatacacaaaaaggtcaaggtcaacaaataacacgatcaattgcattaaatgtgtactagcatggttatcagaaatttttattgataccatggaatcgatagacgacaaaaccaaccgtaatttcaaaatttccgtaattgtttctcttctcttttcttgttttatcgacgattatggaaattttttttttttaacggagatgtttggtccgacaacgtgacggtaaatcctccactgtcttcgcttaaagacaaacgacaattaatctttttaactcctcgtttcacttgcaaagttatttcatcattttagtagtttactctcattctactaaatttgtatttttattgtaacataacggtcatatcagtatttggttagttgattatgtgacatgactatggataataagacttgatatgaattcccatatataagaaatcgtcgatgacataaaactactttatctactaacttcataaggcaaaaatgagtagataattagattattagaaagagagagacaatgagattgatattttttatatgggagtccaaaatcaagatagatatacttgaaaacactcgaaccccacaaggatcgacaaaatatttctttttaaatagctcaaaaaaattatttaaaaaaattcaaaatctttttaaaatatccaaaatgttgaaaagttgtaaatcgataaaagagaaaaataataataattgtgccaatagagagaaagagagagacagaagaagaaagaaaggttcctttgtctcggaacaaccaaagagccaccacccaaaaaaaaaaaggttcttagctttttttctttctttcacacgaaatctcacgagacgccttatttcttcttctctgtctctttccgacggcgtaactctccggtggaatctcagctctcttatcagtagaagaagttttggtctttaaatgtaatttttttggttttgctttaaatttcaatcgttgttatcagaaaaagtaggtagcaaaaaaagagattttttacgaaaagcagattgactggtagctgaaacaacggaggagaattatagaaacgagtaaaaaacaaaaccctaaaggttgaaacttggttgacgaaaaaaatgagctgatttttttttcttcatttatttcattcttaactctttttcacatatttaagaatcagtaagaaacaaaaaaaaacagagtgagactaaaaaaaaagatg

SEQ ID NO: 25294 - DNA, 3003 bp, Unknown; identical to SEQ ID NO: 25293
  misc_feature (1)..( 3003): 2750-1469P.txt file - cDNA_ID_2704702; gDNA_ID_2213670; Annot_ID_182273

SEQ ID NO: 25295 - DNA, 3000 bp, Unknown; identical to SEQ ID NO: 10219
  misc_feature (1)..( 3000): 2750-1469P.txt file - cDNA_ID_2704713; gDNA_ID_2213638; Annot_ID_132190

SEQ ID NO: 25296 - DNA, 3000 bp, Unknown; identical to SEQ ID NO: 10219
  misc_feature (1)..( 3000): 2750-1469P.txt file - cDNA_ID_2704713; gDNA_ID_2213638; Annot_ID_181094

SEQ ID NO: 25297 - DNA, 3000 bp, Unknown; identical to SEQ ID NO: 10234
  misc_feature (1)..( 3000): 2750-1469P.txt file - cDNA_ID_2704717; gDNA_ID_2213638; Annot_ID_132208

SEQ ID NO: 25298 - DNA, 3000 bp, Unknown; identical to SEQ ID NO: 10234
  misc_feature (1)..( 3000): 2750-1469P.txt file - cDNA_ID_2704717; gDNA_ID_2213638; Annot_ID_181111

SEQ ID NO: 25299 - DNA, 3000 bp, Unknown; identical to SEQ ID NO: 10239
  misc_feature (1)..( 3000): 2750-1469P.txt file - cDNA_ID_2704725; gDNA_ID_2213638; Annot_ID_132204

SEQ ID NO: 25300 - DNA, 3003 bp, Unknown
  misc_feature (1)..( 3003): 2750-1469P.txt file - cDNA_ID_2704737; gDNA_ID_2213638; Annot_ID_132194
tgaagtaaaatgtataaatgcggtattaattgtgtttcaaggacacacaaataattgccagtttttgtcaaaaggaaactatagttgtagaatattcgtctcttttcttctttttctgttatctgttctattagaaagctaaagaaatacatcaaagtcaggtctcaacggtaaaatgaaaacaagcttctttttcactaaagagtaaaagagattcctctcaacattggtctttcatatttttcctagctcatattctggtgtggttgatcgaatcttaatgaaccggagaaaataaaagatttgattatgtaatttatcataatcaagagcttgtttgtgaacacatgaaaaagtaaaggaaagaagaagaactctctctgcctgaggagttgtaatttttggcagaagctggtgtcgttttaaagagaaattagaagtgaatctatgtagttgtgttggttggtaagatcgatttagttacattaaataaaaaatattcctttgagcaaaaacaattaaaaaagataggtttcgtcacaaggtggaccatttcgaagaagaattaagagacgagcccacttgaaagagacatagcgaggggaccccatgtgaatctgcaagcagagacagaggctttgaccgttctcattcatcaaccatcctccattattagccagagtcataaaccatgtgattcatcatcacaaggcttcattggactctctcatgcatattcacaatctccacttccatcttatacaattccagttcctacccgcaacaaatccaacacctgaagatgatactgatgcttttgaaagtataactaggaatgagagaagtactaggatgagccatctttccagatattcatttattcactcacacagcaagagagtagttcagtgtatcatgcaacttaaaagcatacaaaatatcacgaatagagaaatattgataaaccaaatgttattgaggtctgatttctgaaagctttaatatgtccaaggaaaatcaaatgggaatgaaagtactagatcccccagcttcttcttcttctggaatgcactttatttgtcaccacaagtggtcaccttaagcccctacatcacatcaccatattactctcagagttaacatcgcaagccagaggagaagaaaagaaagtagtgagaggatttcgcatgcagagaagaaagaacatcactgtcctagagcttcacattacaaaaaataaaaacagctccaaaagattatcaataaaccaaccataaccaggacctcaatcattcctagacagggcaaaaacaaataaaacaaaccaccatccagaagcttccagtggtaaaacaaaaactaagcagaagtgcctaggataatttatcgagtacccaaaactcaggatatgattcatttctctacacagaatagcaaccaaaccaggaaccctgaagcctcaaactgacagagaagagaactaagtagtaacaaatctgcttgttgcttaagaatacttatacactagctatatccacagggcctctcttataaagctctgaaagcatatccattttcaaatttcaagaaccaaaaacacaaatgatcacacatttgaacctttaccggcacactaattagcttatgaaacaacaaaaccaatatactgatttgcatatgaaatttgactcgtgggagcaacaaaagaaggtgtctttgggggattttccaatatacaagcagtatcatggctatcgaagaggactaaactaagaaagagctcagagaaagcggaacgaataattaaggagagaatgagcacacacctgaggaacacaaaagagataaagcgaatcatgaggaaggagctgcagctttctcgacgactttcttgtcgcgtctttccatagcaacatcccattcatcgtggccgatgtgcttaggctgcccaatcacaaattcaaatcaaatcatcaaccaaatgttcaatagagtacccaaatttgtataaaccggatcaaatcgagcaaaccctaggagagagagagagcaatgaatcgaaaaggggggaaattcatacacggccatgataagctttgtggatgtagtactgagaattgcccatgatacagagcatcccaccgatgattccgagaggcaacatcgcttccaaccataccaacgacatcttcgtcttctcctttcttccgattgtgcttcttctctgtgttaagatccaagttaaagatttgggatcagagaccactctagtcaattggataataatgggcttttgggcttcatttttaatgaaacgtaaatctcaaagcccaatacatccaaatgaaatgtttttgactttttcatggattggatggatacatggtcacggacggtggtaataactagataacctacttggtagtactagtgttatgacttatgaccccaagttagtacatgtaagctttccctagtaatcaaattttatcccacaaccgtatgaagctggatgatgaagacagtatacacttggaagtaatgttttcttatagaagatattaaacacgatcgattaaaaggcgagtaccgagtaagaaatgaaatatgtcaaactaagcaagtaaacgagaatctacggatatttaagacacgagatacacaaataaattagtaaataaagaaaatctacggacagttatatcagattgacacgttacaaattaaaatctctgtttattaatgatatattttcttgtttgacacgatttatatatatcagacgttaaaacttatatttagtacgataaagtaacaccgtgaaccggaagttacggccataaaaacgcaaaaaggaaatgtagggttttagttgctaaaaaagatacttaaaggttagattttttttttaaagtaattaaaagggagtaaaaaggttaaatgataagtctcatatttaccctagcattctactaaacactaaagactttaactgataaaatg

SEQ ID NO: 25301 - DNA, 3003 bp, Unknown; identical to SEQ ID NO: 25300
  misc_feature (1)..( 3003): 2750-1469P.txt file - cDNA_ID_2704737; gDNA_ID_2213638; Annot_ID_181099

SEQ ID NO: 25302 - DNA, 3000 bp, Unknown; identical to SEQ ID NO: 10351
  misc_feature (1)..( 3000): 2750-1469P.txt file - cDNA_ID_2704766; gDNA_ID_2213644; Annot_ID_132339

SEQ ID NO: 25303 - DNA, 3000 bp, Unknown; identical to SEQ ID NO: 10351
  misc_feature (1)..( 3000): 2750-1469P.txt file - cDNA_ID_2704766; gDNA_ID_2213644; Annot_ID_181376

SEQ ID NO: 25304 - DNA, 3000 bp, Unknown; identical to SEQ ID NO: 10353
  misc_feature (1)..( 3000): 2750-1469P.txt file - cDNA_ID_2704774; gDNA_ID_2213644; Annot_ID_132342

SEQ ID NO: 25305 - DNA, 3000 bp, Unknown; identical to SEQ ID NO: 10353
  misc_feature (1)..( 3000): 2750-1469P.txt file - cDNA_ID_2704774; gDNA_ID_2213644; Annot_ID_181379

SEQ ID NO: 25306 - DNA, 3003 bp, Unknown
  misc_feature (1)..( 3003): 2750-1469P.txt file - cDNA_ID_2704778; gDNA_ID_2213644; Annot_ID_132343
aagaatttgagtatgcccagaatttgattcttgcttgatgttaaagaatgaatgattttgaagaaagaaaaaaagtaaaaccagacggcgacaacaaaaaaatgaaagagaagacttgagaaaggtgttgtctttggtaccaaatgcacatgtttttattttatttgtatatttttcaggagaagaaaatttaatcaatagtagaagagagattagggattgtgaatatgtctgggcaccaagcggatatccagaaaaattgtgatatttgttattcgattcgttttaaccgaatacttaattttgttatttgctttgattcgaaaatttctagatatccgaaatttcgaatatccggatttttttgtgatatttgcggatatccgctttgatacatataaatattaaaaaaatttgtaaactatataaccatataatatatttaaagttattatttaacatgcttacaaaataagttctaaataccaaacataaccgttgttattatcaccggtcaacaaaatgttatcaaactaattccaaaaactaaaacccgatagtttaagatgttattgatcaagatataacatgagagaaaaatgatcaaataaatattttaacataaaaatataagatagcaacaatacataaactatttatgatatctatatatagatataactatatatttaaatatatatcgatagatacggatcgaagcggatattcgattatcttaaaaacattatttgttatttgcttcggtttttacgaatactacatttttctatttgatttggtccaaaatcttacggatattcgaatttttcgaatcaaatcaaatcgaataccgaatcgaagcggatcgaacgaatattttgtccagccctcattaatgtctaaatgttataatgggaaatcaaaattaactcaaatttggaagagatcaaatatgttttcatttaattgcaaattgatatttgacctataaattaagtttttgttaatccgctaagttggagactgagatgcgtaagtttgtgatttggagcaagctttgtgattcgaactagaagacctatgtagcatcatatcctttggatgttactagatctagagttgaaaagttttcgataatgttgttatttgaagacaatttcaatagttgttttgttctctgccaagagtcgaagactttctaccattatgggttctagagttcatattgattgaatttttcacacggcaaatttatttagcattgacaacatttctttcccacacacggcaataccaagtaccgattcaactaaatacatttaagctatttttattttttttggtcaagtactacgagatattctttaatattatcatgtggtgaggccgttgttgaccattgtttaattattcttctaatcaatatatttgttccttcattttcaaataaccataattaaagaattatacaagacaaaatataatcattggattgaatgagatcatttgaattcttcaattttacgtaaacagtagtacttattatattatatatgaatcaccaaaactattttttgatatcagatttcgtattcgaactaggtccctaaagccaactagtaaaagaatctgcatttggcctagtgaccgaacctgtttttgccaattgtgtttacgtgcttggaacaaatctcctgtaagtctagaaaacacatggggatgaaagaaaaaattacatcggggaggaatttacatgagatcataatattgaaaactgaaaagattcaactcgtgaagtctctcgatgagttgtataatctttttcaaattccttataaagaataaaacaacttctaaaagacaaatgaacatatatgtagacattgcatcatcaatattttttaccactgtttttaaaaccaaattgatgaaagtgatctgtagatcaaatttgttaagtgacaattttactgtcttgataattaagaaaatcaaaaagcaaggattcatataaatttttaccaaaaaataattagggagaaaataaaaatctatgaaaaatatgcattttggttaatgatattgtttaccatatttacatgtttcatcgaaatcttcaaattattgtttatctaatcttcgatttgcttttaatcgacgatagtttgaagatttttgttcttctattgatgttctcctccgtctgtcaactttaacgaaacgatgccgcagagactgagaggaggaggaaatattctgcgattcttctacacggcaacgattctggtcagtttctacacgacaatgattctggttagtttatacacggcaacgattccggtcatttcgttaatatctctgtatagtcccacctattatttctccttattgtatatgaaacaaaaagagattccaaaagtagcaaaaaatatgtcgtcatctcctccgaacaaaaccgatccaccaaacaaaattgaaacacaaaaaaataactgccaatacataaatgtgcgataaaaaaacaaaaaaaaatcattaatattttaacacaaagttacgtcaaataaacacaattgttcataagtgcaaataacatttattaaaattgtttagctaagaaagtttgggctcgtaaatacttattatcttatgtataaacgaatttgttctaatgactatatataaaaaaatcaatttcagataattttaatataaatagtattgccaaaaaaaaaaaaaaactgtaaagtttctcatgtaaatatttttcctccgctaccaatgggctttaaaccaggctgattgtcttacgaagtcagctaataatggggtttgaaaacaaatgggctttaaaacaggtgggcttatgcgacccattatgtttgtttttctcacaaattcgtccccatagtttcaatcctcctccacaccaagtcaccaactgtggatgagtctctctaaaaccttggcttccttcgacttcttctgttttctccggcaatg

SEQ ID NO: 25307 - DNA, 3003 bp, Unknown
  misc_feature (1)..( 3003): 2750-1469P.txt file - cDNA_ID_2704788; gDNA_ID_2213644; Annot_ID_132347
taagatgtttcaatgattgaaaactcaacaaagaagacatagaaaaccaatataactaactagataaacatataatacaagtagttatttctaatatttgagtgactgcaaccgatatacagaagcgttctaaattttattaagacaatcatgtttgaaatgatgtcaataagaatcatgattcaaactttacaacgtaacaatattgcatgcaaaaaacaatttagttacgaatgaaccatatagtctcgaatattagtttatgttattataaattatttagaccaatattggttatatttattacataaattcactagaagtctgaaactgattatttatttttatagtgtgtttttatctaatttttatttttagtgttggttatatacaatataatttatatagagaaaaattggtaccggtggaaagtccaccatcgataaaaactgtctgatgtccatccaaaaactaagccgacatagagttgtatttggtcggtatattagacgtacatgtatatttatctttccataaggtttcttttgaatataaagttgtgtatccaaatgcagattcttttatgctttatcttaagtcatcttcgcattttattttggtcaaaagaaagttagaagataagagaaagtttttgggtcacacatacgaaagaaacgtaaatggcttctcatgcctaatagcgctttctacgcttgtggggtatttgattggatatacgtcacaactcataatacgtagttgtttactagcttatctgtacatggactccacttctatatgatatatatagaaatgccactaatatacgtacgtatccacaataagagaattataatgaatgtgagattggtaagtagtatcacataatttaagggtgtgaaggttaattaacggtaggttgttctatattatatatggttactcacgtaaagtttttaacaaaatatacaaattttaaaatgtattacttaaccaatctctgttctcatgagagtagtttcgcttattcaaactgctaccaaatattatctagtagccttttctaattggtatacaaatacaaattacacgatgtgatagacactttattgtttgtgcatactacctttagagtaggcactagccaatcatgataaaaatggcaaatctaaaaaatattaagcaacatggtaaatataaaagatttaggtgacaaaactgaaaacagaagaaaaaacttacgttttaacaagtgttattaaatgctggttttggactaaaagaggatatgggtttaatgaaaaaacttaatttttaggaaaaaaaaaaaggtggaatttgagtagaatacaacaaaaagtcttagagtttgattggtaacacaaaactttagctgttacggaataatgtaaaactgtacaaaagagctgtaaaaaaaaattgtatcaaaaagctgagagtaaagcttttcgtaacgcttttgataaagtttttgtaaatggtaattgtcaaagctgtacaaactgtactgttttgataatgggttaccattcaaagctttaaattttaaatcgcatgataacctgtaaataattattttgaatatatgttagactttattattattggttaactatgttctcttgattgaaaaaaaaatagatttgtaactcattgctgttttttttttttaagaaacaaatagagaactatataaaaatataagaaaacgttggttttgtccaagaaaaaaattgttgggttttggtgggtggcaatagaagatgccatgtacatagtgggaacaagtagccttacgcccataacatgtcggaacatcaccaataaatttctatgttcaaaaatatcattgtaacaaaaagtttttcgaatttcttctcccaacccaccataaaaacccaatcaaatgcatgtgaatgttcttgttcatttgatgaggtcaagatcaagaagccatgtaatctagaatacaacagtacacatgtgacttgttacagttttgaactctcgttcacagttttgcaagttcttaccaaagctatagatgcctctcatcccatgagccttcatcacctgatgggcttattaggtttacaggcttgactaaactctagagcctatacgtatagaagaggcctgactaaacgaagataatgaaataagcccacaaggcccaaataattaatatcttttattctttttggcaaaatgaaaaatctgacttatgggctttttaacatttacacatttaacttcatgacccaatgaagacccgacccgtctggtaatgacccgatccaacacatgagtaaaccttcactgaaacctcgaaactcctccagaagcctaaaaccttcaccaccaaatcggtgcctccttgaatagtcgccgccgtcgtctatcatcgccgcttgtgactccggtgagtattcttctgctctattgagtttattttggttgaagctctatgagatgtacgtgggtctggttttcatttctgtttcttaatcgctcgaattagcatttgatagctactgagattttgagttttctgatctgccgaataatcttcgccattgtagtgtagatgttgtgtgccttttgattagattacactgagaaattggattgttttcgtgtttgtagatgagaagctaggttattgaatcagagattatggctgcttcaatttcaagaaggatttttcgcacttttggatccttttcagctctaggacgttcctcttcaccaagtattatctcattttccaagcttcttataaaatatgtttgtttcctggatctctgattgtttctctcaacagatttgtctgcgaatacatctggaaatggtttagcttctcttactaatgatctaaaggttggtgtgtttagttaatgtcactttctcctttccttcatctgcatattattgagttctacttactactacttgagtggtcatcttcctgattttgagatg

SEQ ID NO: 25308 - DNA, 3003 bp, Unknown
  misc_feature (1)..( 3003): 2750-1469P.txt file - cDNA_ID_2704816; gDNA_ID_2213645; Annot_ID_132362
ccacctatagtttatgtaccatctaagttactagggatgtgtctatattcatttggtatatagcaaatgttttttccacaagaaacatagacgaaacaaattttcaataaatgttatgtgtgttctcacatggtatcaacgttacacattaagaaaaaaaaaatcaacgttacaaaactttgagtgtttgtttatttgtctttatttgaccatggacgagaatggcatcacatgaaatgtctctaccaatggttatgtgctatataccaccaatattcataaatatgatttatcagaactttacataaaattctgctatcagtattttttatttatttaatggtaataactatgctgattaaattttaaaatcagtatcaattaagaaaaacagtgattttgtggactgatatattggtcgacaaccgataaattgatcgttcgtgattgatgacatgtgaactattttgtatttttgttagtttcgtggatcatgaacacaaataatatgtttttcactacaaaatctcactcagtcggatttttctttttaaacttgtaaattgtacaaaccatacaataagaggctatctacggtccatcttcccgcagaactttcattatccttttgtaacatactggcagttacatttaaaaaaactgtcaagattacttgaaatcattcggtgtggtgccttctaaaaacctcccaatgctcaaattatatctttattttattttattgtggtcaaagtattacgatgttcttttagtgattcagtataatgttcatagtttttctgttaaaaatatcatagtaattatagatcgtttttatggggaaaaaaaaacttagtacatagtaaaagtagttaataatctattaaaaaataatatggtttggacctttttgcacccactaaaatatcagtatataactaagttaaatctttaaattagtaattacgaattgcttgatgttaaattaaagtgttaatgagtttttcagaatttaatttaacatgataaataataaaataatctaaatattaaagagtttattagaaaataggcatttgtcttggttatatatttattttaaggtatttccttacatgattttcgaaagaggtacttttctcttgtgaaaagtcatccttatcctcctctcatttgcattatcttttacccaattgaagcaataagtcgtgtctgtttcctatattcgatatttgcatcaccaattgaagcaataaatcgtgtgtgttccctatattcaattgaaacaatggcgatatatgcatcatcttctaaatcgccactcctgcaaagacaacaactcggattttcaagaatccaagtttttatatggaaaatcactgagagagagatcattgtgagggatttaaaccggtttcatcatttcaagaatggacttgtggtgattactggtaatttgaaaaagacaggtgagacgatattcaaaaaccggtttcaactcattgttatttgtgaaccgatttattcttggtataggaagactctgggtgggaaaagattccaactttgcttacgaaggttaagtcgcaacaaagaaagcttctttatttccgccatggacacagcctatcgtagtcatgtggacagaactgaaattctctaaaatcagaaccgaaattccacaaaatcagaactaaagttccataaaatctataaattttttcgattgggttccctatatattatcttagggtttagtattgtgtaattaaaaagaaaaattaagtttgcttgaaaaacaaagaagaaatcgatttaatcagattttgcaactatgttcgataaagaagaagaagaaagaagacgatgaagaagaagagaaggaaaaaaagacagggacaaaattgtcccgattgaagcaataaatcgacactgttgtattcaactgtggaaaatacctattttgaaataactttatttaaaatgcctattttaaatataagctcaatattaaacaccttgaacttatgtgtatttattatttgtgtgtacgggaagcaataccagaaaatgaaaatctcttttatttattgacaatccataatcctacaaatcctctaacttctagacttatgccgttattaaatattttaatatatatatatacatatatatttttaataattatatttaggaacgtcttttaatttatctccgagggtacactttttttctttatctcttttgtttttatctaaaaacaaacttttaggatattacctcacgaaaaaaacaataaattattcgtctagcaccatcggaaaaagacaaaagacttcgactaccccactcagtggcacaatcctgtaatttctactaaacattgataccctttctcgaattcatcgtgttctttgtttttaataagatggtactttttcctcatttttcaatctttttttcaccaagaagcagagaaaagaaacattaaagcagagaaaaaacaaagacaaataatctccatttgctttcttctccatcttcttctaattttcttcaagttttatcaatggctggtgttactggaatcttaaagcttgaagcttggagcatcttgtgaagaagattaactagtttcttgtatttttcttttctggggttttgagtttttttttctcttccttattaccggaagtaatggcatgtcggagtatgatcgcttttagtttagatcctgaaagaaaacaaagtggaggacttaggacaaaacaagctggaagaggatcttgccgtggaagttagtctttgttcaaatccattttcctcttaaagaatgtaataatgggtttttattgattgttgtagatttgttaaaaagttttgtttttagacctaaagtttcgatttttttcttctgggcagtttgaaattgcactgttgcaagtgaaaaagtttgttcttgttggagcttaaagaagagagaagagaaagagaaaagctatg

SEQ ID NO: 25309 - DNA, 3003 bp, Unknown; identical to SEQ ID NO: 25308
  misc_feature (1)..( 3003): 2750-1469P.txt file - cDNA_ID_2704816; gDNA_ID_2213645; Annot_ID_181403

SEQ ID NO: 25310 - DNA, 3003 bp, Unknown
  misc_feature (1)..( 3003): 2750-1469P.txt file - cDNA_ID_2704844; gDNA_ID_2213645; Annot_ID_132373
aatacatttccatctccggacggatttagtcccccaatgggaaatggatattttccgtctcacgatttttataaaagttcacatttttcaaaggtcaaagttaagaattcgaactatgaaaccattgattttgaaaaacagagaacaagacgttatgcagattcttaccaatttatagactaacgtattggggttataaccagcataatagagtatccttctcttatggaggaccaggtggacaatgtggtacttgatgatcaataaatcaaatatgtatcaaccaaagctatatcaaatttgcaagagaaataaactatatccatgttgttgtgtatgacaagtattttaaatatttataaggcattcaggtggacaaagatatataaactacctcttccaatacaaatcttaggctaatttcgttttcttacaaacatctttgttttatcattccaattttatgaaatcttcagaaataaaatgtggttcttccatagatgtatatagaaaattagagtcatgctatgaacacaactaatgccctaaacggcgaattccacataagtaaataagctttagatagttcttaagcgatcttttggttagaagtagataccaaagacatgaagaaactagtgaatagatcaagagaacaatgggttagtatgtgaaggcaaagaagaagaggcataatcatccaaaagactcaaagactctcaagtcacgtgacttgtatacatgatcaaacgcaaaacgcaaaactggtctatgatgactcaaagctcctaactctaggtgttcgatacaactaactccccaaatccaaataacctcgaaactggtttgaaggttttctgagtctcataatttaacctaacaagttgacaaaagagaagtatcagctatcaccacctgcatgatttggcttggtgtctggtggattgtgttttgcagcttttgttgtgtcaaggatcacgacccgcccgtcaaccaactgtgatccatataacaagacttcatgaagactaagtaacataaccagttccaagagttgacgattttagattatctcaagacaatagttccattatctaacatatcttgttctaatgctccaccaggggattcacaagtaaattatcaaatctttttcttcataacaggagaaagctataagtttgaaagatcaatactgtgaaagggtttatacgaaaatcgattcgaatggagtctttagacttatctgagatatagaatttcaagcaatgaattctcaaatggagaagggagtttatacctgggcgttgagttctaataaagctttctcggcttcttctttagatgagaatgtgacataagcaaacccttttggtctgcatctgattttgtccattataacatccactaaagcaaccaaaagttgaagaagacaatcagaatgaatgaaaatactgaaaaccttatgtacaagtgtatagactcttaactatctcaaactaactctgataaagataaagagatatgtaagtgaaggtgtacaactaaattgctgttgggattagagactgacctttgagaacttgaccatattgagaaaatgcttgggttaatgtttcttcagtgcttgagaaagatatgcctgcagcaaaaatcttcagttcagtgacagtaatacaagtcacacacagatcaaacaaagacacaaagcttttacatctaaagttcgaaacttttagattggtaagacactatgtggtagttaagcagtaaattcacacataccctattgttgtttctatcaaaataagaagaattggtacaatcacagcatacatacacaatagctatctctaaccaaattggcacagtcaaagtcacaacctttaagacctcaaaaaccaattgaggacatacccgattcaaggaattagaaatcaggaaatgggtagttagattcgtgaaagaaggattaagaatcagaaaagtcgcagataataacagaggaagagggagagagagagagagagagagacctttaacgaaaagcgtagaggagaaagatctggagaagaggagaggagtgaaggagcgataaaggaactgggtgagcatttcttttgaagccgtggctgttgccgcgatctcaccgccggcgaaatcacactctatgaactttattctcgctgttgttcttccgttccatttaccatataataaaccaaatttaagtccacgtcagcaattctaaccacactgtaaaaaaacaaaacatcatcgctccctgagagcaaaaccctaatcgtcgattctgctacattcttccggattctcagctgctgaaatctccggtgagtgttcccacactctgtcaattttggttattaaaattttgtttcatttcttttgattgatttttagtttaaaaatgtcaaattgaatgctttttctcgagaatttgagctaaattactgcaattttgtttcagttttcatgggcttctacagccatcacgtccttcctcattcttgccatcgatcaagctcttactttctcagttctcagtgtcgatagattctcttctttggtttagctgttccactctctgattttacttagcttgatccttccgaatgtgaaaatgtttctgttatgtttatctgaaatgtggactcatgaatctggaatttgagcaaacaagggtttcttccgaatgtgagcttgaatgcttacaaattttgaatctttttgtttatttgtttgctctcttcattttttaattgatctggtcacctgaaatgagttaagttcgacttatatagaagctatgttctgcaaatccacattgatgattttaccattttgttaatttggatgaagttgatccatcaagaaacactttaagacttataattgttggacttgatctgactttctttttgggtactgaccatttatgctgacaattttgtattgattcaatatcatttatggtgtcagatg

SEQ ID NO: 25311 - DNA, 3000 bp, Unknown
  misc_feature (1)..( 3000): 2750-1469P.txt file - cDNA_ID_2704848; gDNA_ID_2213645; Annot_ID_132374
ttatacatcagcatcctaaatccgtgattttctttaaaaactcttataatgaaggagaatatgtataataaaataaattaaaatgacatttttgtgaaacggaagaagtattcagtaaaatacaccctaaaaatagactacctaatctatttaaaactacatttgacttagtatgtgatcgggtagatatgattttttgggattttttaaaaaaacattattttattattaaatcattgccaacaacttcttttttcagtattgttttttattatttgaccatacttaccatgttttcatacacctggagtcgaggctaaaattttaaattttagaagtaattactctaaataattgaaaattattttaatgctcttgtcctaaataggcaattatcatttgccatgcattacaatgtcaattagtatcttattaccagctcgagtcgtggccgtcttctgattatagagtgccccatttattattttgtcggtccactacccttgtattatttttgctgccagaggctgcaggccttgcatttttaattctctcttgagaaagagacttatcgattggcaaaatgtcgtcactttaaattgtatgcaaagtaacctatcttgttagtaaaaaatgcaacaaatttttgtttatacatatgatagacgataatgttttggatttcacaaaatgaaagagaaaagaaatggaggcacacgacccccttagggtttctagattttgaagggattttttggagatgaatcgaagaaccggtgtttaaaattaaaatgaatgataaactcatgaacactagattttttttggtttctctttgttgaagtaaaaagtttgaagtttttagggaactttctttttatttttaacatgttacctagtggccaattagagtcacattgatcgagcttaaatttggtgggatgtcaacaaaggtaaaagcaccagtgcaccactagcctacttgttaaagcaccattagcctccttgtttcttccaagatttttagggaattcatttttcttcaatttgtttcatagagtcaaagtttgtgatagtcgacgaaaaaaatctttgtaaaaagatccaaaaaacgaatttggcgtatatttttgaagatgatatacaatcaaagactcaaagtaaggaaggtaaaaattgtagaaaaccaagatgataataatatcttagatgtgtagaggatcaaaatgatatcacgaagatgtaaatatttgttttgtatttatgtagtttaaaatgatataactatggattttatgaatttgggcttttaaagttttgaacccaacgattaaaatgaaaatccataaaatctaaaacacatacaaaaacaatatccgcaatgatgagaacacgtgtcaacgcactgacgaaacatagtcgctgagtccacgtcagcatcttcgccgtctcttccaaccccaacgacggtttaaaaaaaaaaaaaacatttcctctcaatttttttttcaatcaaacaaaaaaaaatcatcgctcccaattttacattcttcttctcgccaaaccctaattgtttcgatttctgctacattcttccggaaacttgttctatctctgacggatctcgaatcggtattctcagctgctgaaatctccggtgagcttttccatactgtggtcaacttctagggtttcgattatcgccatttaatgatcgttttatttcatttcgatccctttcttttgattgatttttaggctaaaaatgtcaaattgatttgggttttgtgtgttatgtggtcaagtttatagctttttttttcccggtatcgtttccaagaaaatagaggaatttgagctaaattactctgcaactttgtttcagttttcatgtgtgtttcgatattggttcgatattggttaagtagagatagtaaaggtgttgtctttagggaatgtttcggatctaatttgctagaaactagaaagtgttgttagattgtctaagaacttggaaaaatcttgatgattgctagcggaatgcagagaacgttgttgtgtttttgtatcagaaggttaagtagagatagtaaaggtgttgtctttgggaaatgtttccgatctaatttgcaacaaactagaaagtgttgttagattgtctaagaacttgggaatcttgatgattgctagcggaatgcagagaacgttgttgtgtttttgtatcagaaggttaagtagagatagtaaaggtgttgtctttggagaatgttttggatctaatttgcaacaaactagaaagtgttgttagattgtctaagaacttgggaatcttgatgattgctagcggaatgcagagaacgttgttgtgtttttgtatcagaaggttaagtagagatagtaaaggtgttgtctttggagaatgttttggatctaatttgcaacaaactagaaagtgttgttagattgtctaagaacttgggaatcttgatgattgctagcggaatgcagagaacgttgttgtgtttttgtatcagaaggttaagtagagatagtaaaggtgttgtctttggagaatgttttggatctaatttgcaacaaactcgaaactgttgttagattgtctaagaacttgggaatcttgatgattgctagcggaatgcagagaacgttgttgtgtttttgtattgtgttgtcaatttgattggtcaatcttgtagttttttccgatatgggttcgaagaaaagaagggaatttgagctaaattactgcaactctgtttaagttttcgatattgattcacaacggtcaagtagagagatagtaaaggtggtgtctttggggaatgtttcggatgtaatttgctaagaaaatcagaaggtgttgtttgattgtttaaaaacttgggattcttgatggttgccagcggaatgcagagaatgttgtcgtgttgttttttgttgtgtggtcaatttgattggtttttgtgttgtttggtcatg

SEQ ID NO: 25312 - DNA, 3000 bp, Unknown; identical to SEQ ID NO: 13296
  misc_feature (1)..( 3000): 2750-1469P.txt file - cDNA_ID_2704852; gDNA_ID_2214613; Annot_ID_135786

SEQ ID NO: 25313 - DNA, 3003 bp, Unknown
  misc_feature (1)..( 3003): 2750-1469P.txt file - cDNA_ID_2704856; gDNA_ID_2213646; Annot_ID_132393
caactgtgcatgatggatggctactatatgtatataggtgtgtggggctttttggtatttgagttcaatagaaaggaaaagcacatgttggcgtgccgcgtgtgctaggacatccgactgcaatctcacggtcacggatctgctttgtaaacgagctggtagtgacaacattcgttttctcaacacctcatgcccattaatcgaccctgcccaaatcacaaactccacagacttcgactttggtatgtatattgatgcgttgaagtcaggggtcctagaggtgaaaccaaaggattttcccaggaaattcgtctattgcttttggtggggtctccgtaatattaggtactaaattgtattatgctaaactctctgccgtgagacatatatcaatccacttgatagattaatccgctctacagtgctttgggccaaaacctggagacaagcaactctgcaggggagattttctttgctatcatcatatgtgtctctggtttactcttgtttgctgtgctcattggaaacgttcaggtaatgttcataccttagaactagagtttgatctcataaagctgattcttaatagatgtttgtttttggtgatcgcagaagtacttgcaatcatctacgactagagtagatgaaatggaagagaaaaagagagacacagaaaaatggatgtcctatcgggagataccagagtatttgaaggaacgcattaggagatttgaagattacaaatggagaagaaccaaaggcaccgaagaggaagctcttcttcgtagtcttccaaaagacctcagactcgaaaccaaacgctatctttttctcaagttgctcaaaaaggtaaccttttattttgtcccatcataacttaaccaactcctcttgaattcactgttttgttttgtttcaggtgcctttgctccaagctatggatgatcagttactagatgctctatgtgctcgtctcaaaacggttcattatacagagaagagttacattgtgcgtgaaggtgaaccagtggaggatatgttgtttataatgagaggaaatttaatcagcaccactacttatggtggcagaactggtttcttcaattctgttgacttaattgctggtgattcctgtggagatcttctcacttgggcattatattctcttagttcccagttccctatctctagtagaaccgttcaagcgttgacagaagtcgaaggctttgttatctcagctgatgatctcaagtttgtcgctactcagtatcgtcgcctccatagcaagcaactccaacacatgttcaggtaatattttcaattgaaaaaatgcatgttgagttaatcatattggataatgatgacatatcgtatacctatctcgtttctcaagttaccttcaacataataacccaaaatctttttatcacctaccttgtatcttgtttctcaagttacctttaatattataatctaaacaactttttgtctccaggttttattcattgcaatggcagacatgggcagcatgttttatacaagcagcatggaagagacattgtagaaggaagctctcaaaggctttacgtgaagaagaaggcaaactacataacactcttcagaacgatgattcaggaggcaataaacttaacttaggtgctgcgatttatgcgtagaggtttgcttctcatgctctgaggaatctaagagcaaatgcagcagcccgaaattctagattcccacacatgttaattttgttgcctcagaaaccagccgatccttagtttcctatggatgaaacctagttttgtatagttgttgactctatctctctgtaatgtgatcgctagtgatttcttgcaaataacttttgtgtaaaccagtaaagatatttttatgtgaaataataatcaataggaaaatttcttatagagtttagtaaaaaaacaattttaatggagacgttttagcgaatactcaccacctcaaccactgtaaatgttttgttatccaaaaacttctaattcctaagcttttaacttttaaagcatctctcgttaaacaatttgtatttttttgcaaaacaaaaataaaacgctgtatttttaaattagaatccttaaggttgggtatttttaagtgaatcaaaaattccaaccaaagtaatggaactaaataactgttttttattagaaaactgaatacgtacatataccaaagtacataataaaactagttctattattgatatatataaattaaacacagatttagattatatttaaacacatagctaagattgtttactagagagacttaattaggtctctctattggtggtctagcttggcttcactctcgaattgaagaggaacaacgtgtttgtttagtctttttaggacttacaattacgtctctgttgtttagtaacgatggcaaataaaaataatgatttagtatatttgaacatggtcccaaatgggcaagttgtaaaaagaagacaagtagagaaaattcaaaattggatttcgtggatattattgtaagttgcagggaaaaaagagtgagactgccccaccgtagactaaaatgatttagcttaccactctcactctgcatccacagtttaataattacccctttaatattttaatcattattttagtagaccaaaactgtttagtgttgaaacttgtgcatccacatgagtgttggttaaaggttgagaacatcgatttgccaaccatatctcacagccacagccatttttattctctctcggtctctcttctcagtctctcactaccacagccttaagttcgagaagaccgaagtggacttcattttcttgtacgggaattaaaatattgcagattgacgacatatactaacatgaatcatcggaggagtaaatttgccaggtacttcttcgaagttttgattaactactatttcatatttggttgtgatagtgatcattgttgatacaggatagatagtatg

SEQ ID NO: 25314 - DNA, 3003 bp, Unknown
  misc_feature (1)..( 3003): 2750-1469P.txt file - cDNA_ID_2704860; gDNA_ID_2213646; Annot_ID_132391
tacaatcacttttgtttatttccatatcaaagtaacattgtgttagtaacttaccctttatgataacgttcttttgaattttagtatggcaaaaactggaagaagaaaacgcagagtttttcagggcatattacatcagactgaaactgaagaagcaaatagttgtattcaatcatttgcttgagcatcagtatcacctcacgaagtataatgtacattcaaaagttcctctggtcccaatgcagaacggtattcatcctatggcatctggtaagtctgactccttatatcacttgttggtgtagatggttcaatgatttgtttgtggtttcactattattataacactaaatgtttgcagcgcagtgaacaacatgcccatgggatacccagtactacaacatcctcagatgcatgctcaaggtcatccccatcttgatcctatgagctgtggaatgtcaagctgccatgtggttaatggagtccctgcacctgctaatttccaaccaatgaggatcaactcagggaatgagtaagaactaacttggattgagttttgtttttgcatttttggtgctttagacttaagaactaattcctactgttgtttccggtgcttggtgtagtatggtaatagatacaaccatggctgaaccaactccaatgattccaccaaatagtggtatgtcggatatgccagtaagtccagcttctgtggcgtcaagcggacactttccatttgctgcttcagacatgtcagggatgggaatggacacgtcagctcttgactctgctttcacatctgatgtcggaacttcagtagggttacaacttggatcagatggaggagctggaaattctagagaccctctcaggccatttgatcagataccttggaactttagtctctctgacctcactgcagatttgtcaaatcttggaggtaagctctttttatcaaatgccattgcgagtttagctcgaaaaactttataacatacgttggtagatgctccatgtacaggtgtactccatagaatgttgcatatcaatgatcttttactttgcagatttaggggctttaggaaactatcccggttctccttttctgccatctgattcagagattttacttgactctcccgaacaagaggacataggtaaacattagctctcactctccatctaaaaggtgcaatcttataagaatggtttgaacatggatgttatagatttaaaagtttcatgtcctatgatcactaaccaatatcttcgtttctgtatcccgtagatgaattctttgtggattcgattccaggacctccatgttctcagtcagaagaagacaagtcttaatcaagcttatgatatttgatcaatagaaacagtcttattatctagcaagcaagcattgtttgtgccgtttctctatattagagaaaacctcccaaaaggatttaaaatcttcttcttttttcctcttctaagggtaatgatcgatcatagattcatagacttagattaattgctcagttgtttgtttattgtacacctttattttgggactttgctaagcattgtataatatctcccaataatctattttcttgttggatagttcatcaatatgcatgggaatatctcatttttttccttctaataaatactccctattatagaaatctataaaagtgttcataattataactcgtggaaattaatttgagctttaaggaatgattgatatctttttgtgaaacaaaaaatcacaaaaagaaaatcattgatttttttttttttggttggaaaatgattgattcttttgtttttttgggtaggaaaatgattgattatttttgtagaggagaaaatgacgtactctaaaattcagaaaaaagaaatgacgtacgccaaaaaaagtatgaaagtctcttcaagactaaccactaaacaccaaacaagatataattttcttttttttttttgtatgtggagtagaaaaatcattgatttcgtatataggtagactaatcaacgtttgtggattcagaatttcaaatacaagtgtccgtgaattaaatccaagaccgtgaatgcataaaaaaaactaggtctataaagtgaaaaaaaatacaaatattaagggagtaactgagtcatcataactatgaaaaatatgattgtttgttatacataaaaaaattatgaccatacatatatattttctttttaaaaataatgaacatattgaggtaaataaataaacaacagattaaaatattatatatcatggtaagaaccacaacatatatatataagttgaattagtaaattaaaaatgttggatggaatttgctcattcactagaaaaattattttcatatttcgtctcaagaaaaaccaaattggaattgtaatttttttgggttgactgactcagtcttcgtcaaaagtcaactcaactttattccctttccaaaatttattattattgaaaacttgtctttttcatgtgtgttccaggctcgtttcttcttcacttagtttcaattcaaagttgtactaaatcactacttcgccaaaattagaacatcattatcttcgagggtctcttctctcttcatactacttcaagaaataattaaacctttttttcccttttaatctttcctgtcgggaagacttttaagtaccatttcttttccgggaaacaaattctcgaataatcacagaaaaataccttggttcactttttttactgtatagatcgtccattgaaatcaaggttttattctttaaaactttggtctttatttcacaacttctttgaacttcaaatagtttaaaatttactctgtttcatcaaattactctgtttcgtcaaattactctgttttgtcagcttgctcttttctaaaacgtggaagtaaataaaattttgacataagtatattttctcccacaggttcaagaatctgtggaagaaaacaatcagcgatgatg

SEQ ID NO: 25315 - DNA, 3000 bp, Unknown; identical to SEQ ID NO: 10382
  misc_feature (1)..( 3000): 2750-1469P.txt file - cDNA_ID_2704868; gDNA_ID_2213646; Annot_ID_132383

SEQ ID NO: 25316 - DNA, 3000 bp, Unknown; identical to SEQ ID NO: 10408
  misc_feature (1)..( 3000): 2750-1469P.txt file - cDNA_ID_2704876; gDNA_ID_2213647; Annot_ID_132405

SEQ ID NO: 25317 - DNA, 3000 bp, Unknown
  misc_feature (1)..( 3000): 2750-1469P.txt file - cDNA_ID_2704880; gDNA_ID_2213647; Annot_ID_132422
cagtttcttctcacctaaactgcctctcgaatttaattattttttaatagtagtagatttttgttatagagaagtttgtatttgcaccgctatttaatgagaccccaactgttacattcgtttttatctgtgagccccacactttattttctttcaatctaccccccaaattgacggtggtacagtattttgtgtcaggaatttttaatgttttggaaattaaattacacctagaacaaaaatatcatgttactttcattcttcatattatagtgtgtgacaaaacaaaaaatatgaaagtctcccacatttagtgaataatgtgtgatatcgagtattgcatttgatatatattaaaacttggtttacggaaattgaggttaattctgtcactagaactagtttttgatcaaatatgcaaaaagaagcataattatggggtgtgaatttggagtaatattaaaagtagttaaataaggagaaaccgagaaagtgcagagatagttggtcctcgtcatcatcaacaaaggaagatcggacggtcattaatggccgtaggtaaaacttttaacggatctatggacagtagacctgtatacctgtaagatttttataacaaaattcaactgagagaattccgccaactaaacgacaaacactatttaattgcttttgttttttttgttggaaaaaaaagaagagaaacgtcaaaacaggaggtggaaaatgaaatattctttacaatatgaccccacttaattttggatattttattataactattgtcaatttagatttcaacaattttttgcaaatgttatttcggaaaattttactccactttgattaatcacataggttagtgacttaagatgatttttatttgattttttgaaatacagatttgaaaaatgtatatagcttgttttaaatgaccatgattgttagttttgagttttgacaattagaagatgttgtgtagcaaaatgtgaattattaattaaaatagggagcaaagtgtagtttctctcattgcccgtaccgtgggacccatacaacacgtggcggatagcggaggatgataacaagattagaagaaaaatcaattaaatacggagcaattaaagggagggtcaacggtcgttaggccttcccatttctagttcgaatatatttattacttaatttgttttactttcacaatatatatccatttttatattacagaaatcaacagatagtgaattttgacaaaagaaaattagacaagtttcattaattgaatctgaacagcacgaaatattgactttcggtttagacttcgtaatgatcagttgtgttatgattggttagtacgttcgttctggtagtagaatttttaatcaatcattgctctaatcatttttcaacataaccacactatattttatttcaatacaataatgtaacccacaaaatgcatccagttggacaaaaaatagtaattacattctagatcaagtcttgaaaatcagaatttgtcttgctaaataatcaaaaagaagcccagaatttgtcttgctaaataatccaccgttggaactctgtacggtctgatcttggaccgttctcggtttctacttgagcaacacacctcgcacctgcgtttcctcgcatttcgcctgcaagaaccacaacatttaaatgatcattttctgaaatgaattttgagtaaactaatccagttggttgaaacaaaaccaggccaaaaaatcaaattttcaggttaaatcgacaaatcgtagttgctgaatatacatgcacaaacagaaccggacaaacaaatatgattttacaaaaaggaggttcatcactaaagcatatgataaaatgagcaaagcagtgacttcttacattacccgcagtttcagcttcttcatcagctttctatgcatcagcctcttgttgaaacttctagatcacgttatggtaataagtatgatttgcagaggagtaagaaaccgaacaattaagatgaatgatcgcatgcagcttttcaaacaaacaatactgcaagtaggtttgatagttaaccggtgagtctggtttaactctgctactttcttggttttctctgtactcatctgactcgaagttctctgtgtcatcttgagaataatgtttgcactgcgtgaaaaaattgagtaaatgaagaacaatataaaacatctagaagactagaactctcacttttcttccaaatacaaacaagataagttgaaaaatgaatacattaccttccttggctcttagatgtattctgggtttaccctcgcaaagaaactagggtttcaacttccgatggtcgaagagatcagatctaagcaaagagttgatttttaaattgcaaaaagttactcacagcctagtggttcagacactattcttttggctctgaagagcagggttcgatactccatggactcgctccctaaaaagatatatatattttttttcttccctcgaacacggttgagtcgtaacattctcggacacgtgtgtattaattatatagagagatgtgtacgtcacggacacggtcacacgtttcgactatctctatcaaatctacttcgttgtgatgctggtatcaaaaaccaaaaccgtaaactcttgcgcgtcgtataaaacaacaaacctgaagtagaatcgagagatattgttgcccccatttacatttctgcacgatcatcagtacgtttctctgccttttctctctgttttcttatgtctagattgtagattcatgatcttgccactcaaatctgtttctcttcttttcttttttttatccccaattctggtttatctggaaaatcgatctttgatcccttttcgatgatctcaagaaaattggggaaataaatcgtaaaacatttccgcatacattggtatcatgatcaaatctgcaatcttggtgttgatttgtgttttgtttcacattggttgacaaaagtcatg

SEQ ID NO: 25318 - DNA, 3000 bp, Unknown; identical to SEQ ID NO: 25317
  misc_feature (1)..( 3000): 2750-1469P.txt file - cDNA_ID_2704880; gDNA_ID_2213647; Annot_ID_181498

SEQ ID NO: 25319 - DNA, 3000 bp, Unknown; identical to SEQ ID NO: 10410
  misc_feature (1)..( 3000): 2750-1469P.txt file - cDNA_ID_2704891; gDNA_ID_2213647; Annot_ID_132402

SEQ ID NO: 25320 - DNA, 3000 bp, Unknown; identical to SEQ ID NO: 10412
  misc_feature (1)..( 3000): 2750-1469P.txt file - cDNA_ID_2704895; gDNA_ID_2213647; Annot_ID_132400

SEQ ID NO: 25321 - DNA, 3003 bp, Unknown
  misc_feature (1)..( 3003): 2750-1469P.txt file - cDNA_ID_2704913; gDNA_ID_2213649; Annot_ID_132452
ttgtttggaaaacttttcttttctttttaccgtttcctaattaatatgtggctgtcccaattaatagaaaatatataaattaaattttgaagtttcactgtgtatgtatatgttgtctgtacatacagagataatataagaaggtaaacaaaatcgatattttgtctatctatgtaaaatttagtttttcttttctgtagatgttatctatagatatggataataagaaagaaaactttttttatatataattaatttcatattaaaaagaacttagtttagattttcgcttaaaactttatgattctagttattaaccattgttaacggtttaaataccgttattttgtaatgctagctagtgaccgttgtaaatggtttttataacgtttaaaacttataattctattttagatgtgttggaaagactagtaatttcaacattttcatatttttttagtgatttgtaacagacttctaaaatgaacaaacttacttatatacaaatgaatattatattatataataatataaacaattagaccttatattaatataatttatattcaatggatattaagtttcaaatatcaaataatttagattaaaatgcaaaaaagaacaaaaaagtcatgatttgaatttggccgaattaaatcatttcaatgtagctgtcttttaaaaatgttatttttttgtttttaatggaaacagtaattaagtgttacatagaaagtattttattttgactaacatacaatgctaagacagatttgttttagtatacgataattatatattttaaaagtaaaagttgggaatttgaattggcttggccagttataccactaaaaaacaaatttcttaaatggaaaacgccagcgggaagcaaagaacacgagtcaaacctttatagttttttccacttctagatattatataattaaagtacaaatggaaagaaatatagattttgaccaatttaaaataagttcacggaatttgtttttgatgttcagaaagaaagaaaattatgtatatttggaaaacatcaacggaaaaaaaagtagtatttgctaaaacaaaatctacaacaattgcaaatcatcaagtccggtaatttttttttatttttgtatttttcttcagtcaaaccgatgatgtgttgtaacgtaaatggcatctttttccaaactcagattctttttttttgtgttgataacattataatttcgaccactttaagcccaaggcctaaggcccaactgtatagcataacgtttaccgtcaatgcttgggccaacataataaaaccaagcgcgcacacacacatcaagccgacacattcggaaagactaaaagagcgacccaaagggaactgtgttttttttttttttttttctttctttcaaagagaagcaacgaacattatcaattcaatatgttgttatctccctgtttaaagtttcaggttgattcaagttcttcgtagcagagaattagatcaaacgtaatctacgtgaaatgcaaatgcatggccacatcgtagcagaatacaacatcactacatgagtcgttccttctccaatgtttaacaaaatattcaacaagtatacaaagctgacactctagtcaaaaatttgtaatggttatagtcgtagttgttacttgtatgtatattacttagtaaatcaaacattcttaagatagttgttttaagtagaatacaaaaacaacctaaaactgtaaattttttgtttaaactttggtagtatgaaggtgtaaaaactttagtaaattttattcaaaagataaaaaaactttggtaaattttctgattagcatttgaatggaaaaaggggatgggaatcacaacgccaattgcgcatttctttcctccttttataatttacattttaaattggttaaaggggtctcgaaaatgtcgggttggtaaaaaataagagtgagattagctacaagaaagctgactttgtttttcaagcaaatcatcaactgtcgcgtcgtaccaatcatggatccaccatgttatttgttatttttttgtcggcacactagtgttaatttgaattatttgatatattaatagcagaaataaaatacttcttacttgaagagcttaaacatattttcattacccgagaatgttggtttatcaaatgtgtatattagtggaaatgacaaatacgagtccaatagttaacgtaataactacccttcttttggggttcaaaagaactaattatgttgtttggagatttcgggaatacgagatcgaaaaatctatcttatttggatttgctttgattcattcttagtgtaaaaaccaaaaggaaagctaacctgttataaattttgatttactcaatatctaaacagaaaagcaatttgcacaagtaactttaactaatcttgtaacaaaaagacacaagttaaagcaatgatatactgtggatacctttttcaaacattgggtaaactttttgggcgtagggttatgttcacccacactatggagtggaaaacagcaatcattcacacaaccaccaccattcctactttttgtgcgtagggttatgttcagaaatatgatttaccattatctccttttttacatctatcaaagtatattattaactgattaatggaaatttcagttgatattactcgataaccttatgtcattactcagttcaatccttatgttatatatgcaattttaacatagaacgtacattattcttcatgagttctgttcctaatcagtgctatgtacgtaacttttgtttttactttgttcagtttttgttttgtctctttttttcttgactatgacactgcattcaaaaacataagaaaacagattaaagaaaagagaaaaaagataaaattgaaagattcgtttttctcaaatttcaataaaaagaaagatacatttctctcttcacacttcactcttctctttcccgcctctccgccatg

SEQ ID NO: 25322 - DNA, 3003 bp, Unknown; identical to SEQ ID NO: 25321
  misc_feature (1)..( 3003): 2750-1469P.txt file - cDNA_ID_2704913; gDNA_ID_2213649; Annot_ID_181570

SEQ ID NO: 25323 - DNA, 3000 bp, Unknown; identical to SEQ ID NO: 10440
  misc_feature (1)..( 3000): 2750-1469P.txt file - cDNA_ID_2704924; gDNA_ID_2213649; Annot_ID_132448

SEQ ID NO: 25324 - DNA, 3000 bp, Unknown; identical to SEQ ID NO: 10440
  misc_feature (1)..( 3000): 2750-1469P.txt file - cDNA_ID_2704924; gDNA_ID_2213649; Annot_ID_181565

SEQ ID NO: 25325 - DNA, 3000 bp, Unknown
  misc_feature (1)..( 3000): 2750-1469P.txt file - cDNA_ID_2704928; gDNA_ID_2213649; Annot_ID_132454
gtatcaagtcattggattgaataaaaataaaagattttcaaagaaaaaaatcttaaccggtgatcctaatttttttaaactgacttttttttaataatttatttctcccttgtgtattagtttatacatctttaccagaaacaaaactgtatctaaatcattattaatttttcataagcatttggaaatattgttaattatatatattttttatataacatgtggtatcgaaaacacgtataagttgggaaacggaaaaagagccactagtcccatatgattttgcttaaaataaaacaatgtaaaccaaataaatttgtaatagattataatcataaaaattggtttaacttttcgtgttcacatatgttaatgaaagcgaacaaaaatcctacaaacgctagaagataagagtaattagttaaaggctcttttgaatcccgatcgaagatatatttgatcatcaatgttggaagggatcaataatgagaatgtaactacaataaaagttacatataaacagaataattaaccatcaggagcatgatggataatcaaagatgccaaagagatctacttattatctgctagttctaagctaaatcaagaagcatctctgttagaagctgaaggtataaagcctgttaaaatctattgaattcaacactttgggatcgagatacgtaactattattgtcacaatccaatgaatagagagagtgtagaagtgataaattgagtgagtaaatactaaatagtactacgaagaaagctatattatgataatctaaaaacgaggaccatatagtataaagttacagagaaataaagctcaagagagcagcgtgttgtgtcatttactgaatgttttcgtataaagaagaagctcactagaattgtttccttctttataggtcaaaattccatgttagttaaacaccaaaaccaacggttaatgttttcagtatattacgtacttgctaaacagagagcatggtgaaatctagtataagaattctttttacagacaaatttgacaataacatctttctgacatgtactttggcactgccaaatgccaacaagtggaaggcagaagtcacagaacctgactttccatttgccattattacctttttggtaatttaagtcgaaactgtcacgtgtctccccgtcgtgaaaacgaaatcaacattcaatacgaaaatagacattggaataacaacttaaactacgttttaacaattaccctaacattaaaatggtcccttttaaagaatggtccttacgtttgaacaagacccttttctttcaagttacaattgtcaaagcctatctattttcattttttttaagtaatcacaatttgtacccactttacatgttcatattgaatcgactggtgatatgaaatggtacaagtttttaactatagtatgagatacaagcaaaaaatggactttgaaccggaataattgtggtgtgatacttttttttgttaacacaaggaacatatggaaactttcaatccttatttgatctgccagagagagaattgttctaaaagattcacaaaactgagagccaaagatcaacagtttacgaaaaacaggtcaaataacatgatcacaaaccaagtattgcaatgctcttgatcatctacttctgtgttaacactttgatatctacttgctaattctacttaagttcaatgagtttcggaaatattgtaccttcattcttctgtttcaatccaattccagtatctgtgatcttcgattccagttatcgccattcctcttgccgaaatcgccatacaaaaccgtcctgtcgatctatcagcaatggaaacaataactaacattcgaagtataattgggccgaccactgtcaacaatgggccgatttatagatggacaaaaatagaattggcacgcccggtgggactcgaacccacaatcgtttgattagaagtcaaacgccttatccattaggccacgggcgcttttgtactatcacctacttacatttatatatatactaaaacgataaatctctttgaaaaagattaacatacaattactagaaataacagaggcaaatcatgtgtataacggggacataaccttaaagaatagatttggacaaagttttgatttaatttcttacaagatcaaaattgttgcaactcttcattagatctctaaagctagctttcaatttcaatttcagtgttatgtatactctaaaaaagaaaaagtgttatttcagttttagcggatgttgatatatcgtattgtgatgtcacatttgaaaagaatggttttaagtattcaaccaaaaaattggtctaacataaatgtgttgatagaggtcccggccggccactttttaaataaatcaaacaataaaaagtcaaaactctaagagaatttagtacactataaacttttggcctatttattatctttcgtgtcacgttacatattttcgtatctagtcttattcagcctaacaacaagacggcagaaatgtccaaaaaatctttaaggatcaagctgcgtacactcatttcccaacaacacttcaacggtctaaagaaacatttaagtgtctttccaaattcacagccacatacatttcagagttgatgttttttttgttttggattgttttgtgataagtctaacactatcatttgtacaatttgttcatatattatcccaattttgcagtaaatgattgtgtctagatctgaaccactcaattccaaagaaatttcttcattcaccacattttaattgtgcttgcttcgtaattcgtatataatgaaagaaactgttcaacaacttctgatttctaaaatcttttaaaaatctctccgccacttctagttggacttgatttctcaccatagtctgtcccgttgttaccgaccatctattatatagggaaagtctcttagctacagagacacaataaccatttggagaggtcatg

SEQ ID NO: 25326 - DNA, 3003 bp, Unknown
  misc_feature (1)..( 3003): 2750-1469P.txt file - cDNA_ID_2704949; gDNA_ID_2213649; Annot_ID_132438
aatgatataactatcaatatttttcgtaagaaaacacaagtttccttattcttttcttacgtcggcgataaaagttaatgtcgtactttgatttatgaaattgtgatggaaaattgttttaattaattaagaagagaaacgagttatttgtacaaacaaatctgaaaatatagaaatagagcaaaggacagagaataagaagaagaggcaaaggagggcgagagttcacatgttcaagagaagacaaatacgtttctctgacacaaatctgtcagaccaatatttttaaatattttattgtatagtttttattttgttttgttgtatgagaaagaaacgtatattatgtctttattaccaccacaaggggtcaggctccgtccacttggggtcccaattttttctttgttacgagtttttttttgtagtaaaaggcaagtcacgccggcacgcgagccctcacgtgatcccacgtgctttatttattctctccataccaaaatttcttttcctttgttgtttggtaaggttttttcttttttggccaaaatatgatattggcgagattgaaaacatgtatatttttaaaaaaaatgtaggcgtaaaaattatgttactaacacttcattaagcatatgccaagatttttaaattaaaatttatatatcactattggtcgtttttttttttgtgtgtgacagcagctcactattggttgtttatattaaccacatactaaataaggctagctactaccaaacttggaccagaacctaacacatgatgttatttttagtaatatgaaaaaaaagaaacgaaaaggaaaaaggaaagaatagatctttctggtgagagagcatacacaacacattggtgacacaaggtatctaagggcatgaccgcacgtgtcaacatgcatcaaacatgcgatctttcaatattagtattatatatttagcaaagacgcaaaagaatccaaggcaaagactacttcgcctgcatgtcatgccaatctctctctatatgttttctaatcaatatactagattactagacaagttgttttctaataagatctctcacatatgagccaatttgagccaaaacatgatatgatggataaagcttatttgggtattgaaagtatagagactgtcaatgagaaagtagtcatttgggcccaagtacagagatttaaaccttatcaggaaaagcccaatccagtacaaacttgaagaaaaagattgatctccttgtaagttgcaactggtaaagaataggacctttgttcaaggtctactgtattgagatactgaattagtataaacggccacttaaaactactttgtatttgtttaggcccaaaacattggactatcatgttgagaaaataaacacgaacgcaacagaagtttcctacttattatatagcccaacaaatattgatctctttgcttccaatgaatctttgttaaggcccaaaaaatacaaagccgaaactacttccatcttgtactatttttaagtttattttttggaaattttaccatgtatgattcagatcgttggtttaaatttttacaactagaaaatagtatatactctattagcctattatgatattaattaatgggcaatatttcgattagtttacgtgtagagtgtagtgataatgtatttaggttttgaccggcaataatgcatttgtaagaaaagtctttggacaataatagctttggtcaagtcaatgtagaacagaagactaatttctcttgacaaaatattaaaccttaaaaacaaatcctgtcagaccaaaaggtgatacgattgtaacttacaaatgatactatatatttttatagttaacagtctagtatttaaaattttgaaatattgatgatcattgattggttcatataagtaatccattaggttttcatgttggtcaatacagatgtacatgttttcaggattaatataggttccgtcctatgaatttatccgaccatgcataagagtaactctttaatctactattacaagttttcaggatttgaaagctctatacaagtttaactttatgtgtatattagttaacgtttgtaaccacagattcataatatttaccgtcgaactcttagccataaaattcggactaaaagactcgattcaaaaaggtatcgatgagatggaaagttgttgaacttattgtataaaagcttagagaggatattgataagtcgtcttttgcttttgtatctacagctatgacgtatattgtttaatccaaatcaaagtgttttaaagatattttggtttctggtggaggtggtatactaaagattcacatatagatagagatatttatgaatacattgatatgaaaatcatatacaatatgctaaagaacaataaatggtacacatatggattggttggatatggttggcacttggcagttaggtcattttcgttgctttactaaactttaataaacagtctgtaacatttacatttatatacgccaatgccaaaaaattctttattttatgcaatggcacattttctgcttttcctttacaggcaaaaactctttctttcctaaagatgcattatttttccatttgataaaataaaaaaaacttgacggtacaaaaatacacagaagacaatcgaattaagtaatgactaagtattaagattaggtgaaatggtgtaattaaaccgatgggaataatataattattatttaaatacagaaacagagcttgctttaccaaataccaccgaaacccactaagaatacagcaaatcgtctcttcgccattaaaacaccttcctttgcaaacaaagcttcaaactttctcttaaaacacccccaaatcagcaaagatagggttaatcgaagaacctcaccgtaagtccactgaggattcaagttcttgctttggtttaaggaagaagaacagcaaaaacctcaaggagaagaagaagtcaaagatg

SEQ ID NO: 25327 - DNA, 3003 bp, Unknown
  misc_feature (1)..( 3003): 2750-1469P.txt file - cDNA_ID_2704957; gDNA_ID_2213649; Annot_ID_132435
caaatttttacctattaaaattttaaaataattaaacattttgggaactctctaaatcttaaaaaaagatcgtatttgattattaaggtattattaattaatgattgtggttatgatgatgccacacaccattcattatcgtattaatggaatgcatagggaatagctaaattgatgactgttgtcatgtgatgaaaatcccttacttcgtgggttgcgatatctcttccgtttatttctgaccgtccgatattctcattcaaacatgtgtagctctactcacgttcattgattatctcacaatcatctatatggtactatatatagatcgccctatgaatgatttttactcaaaatagtctttagaatttatttctgttaaaaatagccttcaaattttcaactaccagcttctattaaagcaccatatacttataagtgaattatattatgcatatgtatttctactgttagagtgtgcccatgttaacataaatctcattttgtatgttatatgaaattcaaacttcaatagcaaaagagtaagagacgttccaaattgtacgcaaagataaaaaaaaaacaaaagtaagttcaacattatcgaataataatatggatacccttcaaagtttggaatcttcaaagatatgctttgtctcagtttagtgctttgtatttgaaagcagattatagcatctgtatatattatttctgatcgcatagtttcctaggggtgtccagtgtccaatgtactggaaaaaggtatcgttgccaaaatttgatacagaattaggaatattttaaatcgaaaccgtaactaatttttggaacctagtttagaattagaagaggatttatattttcgtattgcaaagggtaaaaagaattaaactcatataagaattgaactttcctaatcgaagtcagtgcagcctttaaactcagaagttcaacgtgcgatatttgcaagcctgacacctcaaacttattcacactgagaatgcatggtcgaccatctgaggtcatgttttgtcattgttcggctaacgaaagcactatcaaacaaacaacaatttgtaaagagaaccagaactaaccaaaaatatcaaacgtaatgctgttaaaagacaaaacaaaaaaattcgattgcatttggtgtccaattaagatgaaacttgagagtaccttcccgatgaatttagctctatctatgcatcgtagtttatactgttaaaatgaaattgtggtagtttcatgtatttgttaaagtggaaataaccctattaaaaatgcccaacaatattacatgtcgtcatgcgcaaagactttaatctttttttttcaactgaattttctaaatttcccttaaaaaatattttagttttcccccccattttattatgatatttatgacacaagcaattacatcactacgaatagacacgagagacacgttcaatccgtaatattagtatattactttgtttaaattagacacactacctacaatatcaacaaaattaaactaatcaaatcatcacagaatttgtaaaattgtaactcaacgagataatgctataagaatccaccgtttgcggcaaaatcactaatttttttttttttttttaattgaaattgaaagcataacttcgttggaagaaattatgcgatggaatttaattattttttacaattcacacacattccaaatcctcaatttgaattttaaaacgacagaaaacaaaaattaataggcaacaattttgatttagtacaaaataattccgttggaggaatttcagttgatacttaagtaaaagatcatgcatgtgttagattttaatgcaattttattaaaaaagcaccttgaaaacttttaatagtatggacgacttaccatttacttacgattatgaacatagcaaacagttagacggattatgttgaatgttgatcgtctgatcaccatacaatgtagatttcttacacctaataacacgactgtactatgtagcaataaacgtctgaacagtaggtgacaatccatcaactcatttggacatccattatcaaaactaaatatatgtaaagcagactaaatattggactaactaattttactaaaatattcacctaaactaattacactgaaagctaggaaatacatcttaattatatatatatatacgtctatatttattttgtttataaaataactatgatatgttacaaacaatataatataaataagatatactaattcatcagaaattcaatgttattcttcatagtaatttattaaaataaattcataagaagttatctgatacaaatatgtaacacgcacatatatcacatcaattcaacattttatctttcctatatatagtattgaattttatttgatattttctatctaattgagatcgatttaaatatagaactaaattttttcagtatattttatcgaaatgatgtaaaataaatcatatttaccatttacgtctgaacagtaggtggcaatccatcaactcatttagacatcaatagtcaaaaacaaatatctgtaaaacagactaaatgttggactaactaattttactaaaaaaaattatatgatacaaataactaacaaacacatatatcaattcaacatttcatttttgctatagatagtaattaattttatttgggattttataactaattgaaatcgatatatatatagctagtaattctttttaagtattttctatcggaaaataatataaaatactatttaaatcatatttaacagttgttagtcttactagacaaaagaaaacagacaaaaaaaaaaattgtattataaataaaaaaaatattgtcactcgaagcctttaaactcgcctcttctctcttctctctcactccagagtttctctctcccctttaaatggtcgccggaaactaaatcgtctcgaacattcattagtaaaaccggacgactcagcggcgatg

SEQ ID NO: 25328 - DNA, 3000 bp, Unknown
  misc_feature (1)..( 3000): 2750-1469P.txt file - cDNA_ID_2704968; gDNA_ID_2214635; Annot_ID_136107
ctcttcacttgttaggtaagtggtttaagttttgttctgaattcatttcatctacatgtattcgcttcttaacgctggctatatttaattttatggttctcttcatgttatgctaccatacattaacttcaagtttggtttaggtctgcttgtgatagtaacgagcagcacgatgccgaagtagattctgcaaggactgctgctgaaaaagatgtaacaaagaacagcgatgatataatccagcaaattgaacgtgagctttctttcttgcacatgactgtttcttagataaaagagtttcttggcatgatcattaatctcccaatcataaaccgatatccttgtaatctttcaggcatgtcagaggatgaaaaagcgtctgtatcaaaaatcctggaaaatgtcaggtcgcatgaaaaaactcttgaaagtttccaacaggatcagtgttgccaagccagatgcatcgaggataaagctcaagaaacttttcaacaacaatacatggagtatgagcccacaggtgcaactccaacaaagaatgaaccagagatcccaaccaaagccaccattgaatcactacgagccatgccaattgagacattagttgaagagttccgtgaaaacaactcttatgaatcctttgcgaccaaggaaacaaaaccgcaacagctaacacggtcgcctctctcacaagtcaactaaggaaccacctctgttccattatatgatattttgtttttaaaaccctcaaaatcagtgtctgtgtctgtatcatcactatgaatctatgtatacttttgtgaaagtgtgggatcaatcaatgaagagtcagatgcttctgacacatttgaaatattcatcattgtaatctatgatttcttattcgagtagttgaaattctcttacagtaatcgaagttctcaaagacggtttgttctactattacataatgcgaatcttggaccctttttggttatgatggtttgtgatatgtgcatgcatataccacttgatcactttctatatatgactcaaccatgaagatgctttaaaatcccaacaatgaacattttaagtgggaaatcaagtagaattttgtgaaatcagagtcactgtgccactcagaaaattcatctttctcacttcccatgagaatttctaaaaaccatgagcatgagagattctcatagaatcatcttttaccattttaaaaaaagaacaatcatgaaaactcttttagttcgtgatcaatttccaaaacttttacaactcagcaactactattcacttgggatttttattacaaatcgcatttgtgtatatataaagctcaaggtgacatgtaatgatactggtaatgtcaagtatggtttctatatcaagcttttaatgttaggtctttcattttagaaagtggaacatcaatatagtggaattatacatccaccaagagaaatttctttcattcaaatatatgtatggtaacgattagttaagcatggtgttagtcactgcaggttcatatacacaaaagatgcaagcaaagtgttgtagttgtaggtgatgtttcacaattatagaaatggaatcaacatcactagccaaaaagttgtggcagtatttctagtttttaggcacaaccggaattttgaagaaaacaatattctgaatttgaagcaaaccggagaattgggtttattgggggaagtaagtgcatatattgctgaaaatgtgaacgtaaactgcgggaagactctttgattcactttttggcgttatgatgatgtgatggcaaattgctcaaatataaccggacatataacataagattcgttatgcctcaagcattgtctctgagagttcacctttgaacccgttcttgattagaccgattatattggaagcgatacaactgaattttaaaataattttttaaactaatgctgcttatcaattttgttttggttgttctactgacataaacaaaattgataggaagcattaattaggctgatcattatcagaattaaccactatgcaaaatttgaaaaaaatgttaggcactattgtggtgccttctgaaacactttagagctcaagccatacaccaagatttttaagagtcactttaagagttttactatataacccacctaattggagtatatttgggtctgaatatttgaactcatacgattctgccaattaatccaagataaaccaattagttacatagtggataattatctcctacttctacggtcaatttataagaaaagataattaccgaaactataattacataatttgctatccacaaagaaagatacttgcatcacttcttaaaaatgaatcaaaaatgagatactaattaaatatttggttattaaatccttatattttggatttccgtttccattataattccatcagttgatatcgtgtggatttttttaatagaaattaatgattagttgtgacaaaaatatagtttgaaatttgctaaactaaccacgttaaattagaagaagaaaaaaaataaactataatatataattcttgttagatttttttttaaaaaaaaaaaatattcaagccatgacttcatttgagcaacggaatcgtcaaagaagttatgaaacctaatctatatacacatattccagtaacacactttaattaaaacatccattaagatatgtttgattacacatgagaaaaccctagatataaggaatcaaaccgccgaccaaacatatttaatttcaaccggatgtatatttctctaattatagtgagagtaaaaatcttcggatcggattaacattatcctaaaaattatctatgtttctgttatcttcctcctcatatttcgcctatataaacattacaacaaactacttccacttatcacattctctccttattcaacttaaatactacacggccaaaaacatttaacaaacgccactcagatcctgagtctttggatcaatg

SEQ ID NO: 25329 - DNA, 3000 bp, Unknown; identical to SEQ ID NO: 25328
  misc_feature (1)..( 3000): 2750-1469P.txt file - cDNA_ID_2704968; gDNA_ID_2214635; Annot_ID_188077

SEQ ID NO: 25330 - DNA, 3003 bp, Unknown
  misc_feature (1)..( 3003): 2750-1469P.txt file - cDNA_ID_2705028; gDNA_ID_2213653; Annot_ID_132487
aagagagcagagatgggcggagagaacaagagatgagaggcagaggaggcagacgatcccggctctaaatacttatatatatttttatttgtttgttcgaaaaatatttaatcaattttggacccacccttcttcgttaacaccaatgtttttttctttcttttcatttcatctcttaatttcaagatccgatctacaaatataatccttgttaagtatgctcaacataatttattttcttctttaactcgaattggttaatcaatagtggaatcatcaaattaacaaaatgatctgaacaaattcaggtgaataaccataaaattctaaccatttagaaatatggcttttcaattgagttttaagaatagatccgttttctttaagatttgtatataatcccataaatcttttgttatcaggtagagctatagatgcaactacttttgactctaaaagaaagaaaattgaatttaaaacctaattcctaccgttactactaaattattatgaaacatatttaatcctctaaacaacattttttggttttcctatttctcttacgaaaaatcccattacttttttatcgtatttatccttatctcaatttcatcaaatggaatgtatgacaatagacgtacaaatgttatgaagacgctgctgggtaagaagaagaacaaacactaacatgttccgataataaaggcattgggccggcctaacattactgcaaaagccaattttattaaagacctatatttgatgacaattctaaatattgtatgaccggatttaacatttatggtttgacgttttcgaaattaaagacctatatttgatgaacgaagacttggtagaaaataaacaaaatcaattctaacaaaagcccgagccgattggtttgctaggaaacttgagttatacaacatacgcatcataaaccaactaatagtcctttagccagatcaaacaagtaataataactcatacgacaaaatatagtctccaatatccaactacaaagaagaaagacaagtgactgcgtttagtcaaacaaaccgaaacccaaatctccgtcactctcttctgctggctcatcctgcaataccaaaatgagatcaattttatatcacttattagttagaagaatgatttcgtctatcgttgctatttcatttaccttcttcttctcctcagcagcaggagcagctgccgcaccaccgccagcagctggagcagcagctgcaaccggagcaccacctccaccaccagcaccaacgttcatgatgagatcagtcacgttacgtttctcagccatcttggcgaatagcattggccagtatgactcaatactaacaccagcagctttcaccaaggtcgcgattttgtcagcctatcaacgacataaacaaacacaagtaaagatctttacccaattcaaaacacatttagacagatacataaaatacttgttcaattcctgaccaaataatactataccaaatccttatcactccataagaatcattttcactaagtttctaactatcaagtcaaaagaaacggttccaaaaccctactgactaaagcaaagagaccaatcaagatttagaaatagacaagcaggagtcaaaggaaagataccgtgatagcgataccctcgtcctcgaggatcataacagcgtagctgcaagcaagctctccaactgtcgacatttttttatcctgaaacgattcaaaaacagtaacaatagattaattgcttattcacaaaaaaacaaactttaaatccgttttaaaccaaaattagagtaagtcgaacaacccagacgatgatgaaatgccaataacaagtataaacggatcaaatggagaatcatagactacctaagagtaagatcgaaaatgcttttcgcaaggcggcgagagagacaaaatttctagggtttggatgcggagacgggagatgcagagtttataaagcttttatccaattatttgatgggccgcataaatattcgctaggcccattttttaattttacatatatttgttttcagtattgggccttcaaacctaatagccgtgaataaataaaagataagagcccaaattaagagatttgactttgaccagaaattgttggttggtttctagggaacgaccaccgtggtccatcatgcatgtgacagcacgagcttggtcaagcaatacttgatggatgtccttttcgcactagtaacataattcttcatttgacatatttatagtcttcaataaacatatcatatgcgatccaatatattttcattttttcttgtacattcgtcttggtccaaaaatcacgagtttgattagttctttaaccccaaacttcacaaaatcatgtagttgtagacaccaagtttgattatatttgtcaattaataaaaaaaatgatttatacaatttgtttagaatctcgataaatacttgttcatcctactaccattccaaccaactttatataatagtagtaaaaattacgcatgcgctaagccaaatattggcatttagtagaataacagaaaaaaaataaataaaaatgtagattatggagctaaaacaacgtgcaatctctctccttatctagtctacgtatattgtcccgcacggtatataatcaatatggacccaaaaacgaatatattcatgttaatatcgatgccaacaaaataaattaataatactatgtatttggtgaaaagataaaatttattaaagagaaagaaacacagttattggtgtcgtggttgcagtaaaagaggtggtcagactcagagcaacttcttacaaagcaaccaaaggttatctgtactttctgtttctctctcactccttatttctgaaaaaaaaatctacagctaaatacctaaatctcaacttcacggaacaccgatacataaagacaatagagtggtaataatttgttgagaccaaaagtaattaaacacattacacatg

SEQ ID NO: 25331 - DNA, 3003 bp, Unknown
  misc_feature (1)..( 3003): 2750-1469P.txt file - cDNA_ID_2705047; gDNA_ID_2213671; Annot_ID_132805
ctcctcctccaccgccgccgcgccctcctcctcctcctctaagccctggctctgaaaccaccacatggaccaccaccactacttcctctgttcttcctcctcctccgccgccaccacctcctcctcctccgccttcttctacatgggacttctgggatccgtttataccgccgcctccttcttcctctgaggaagaatgggaggaagagacaaccaccgcgacaagaaccgcaacaggaactggctctgatgctgctgtgacgacggctccgacgacagctactcctcaagcttcgtctgttgtgagtggattctctaaagatacaatgacgacgacgacgactggaagtgagctagcagttgtggtgtcgaggaatggtaaagatctaatggagattattaaagaagtcgatgaatatttccttaaagctgcagattctggtgcacctctctcttctctccttgaaatctcaacctctatcactgacttttctggtcattccaaatcaggtaacaacaatcaagctcttgtcttctcttctttgattgattttgattagtgttttgtgtttgtttcttcagggaaaatgtacagtagtagtaactacgaatgtaatctgaatccgacgtcgttttggacaaggggatttgctccttctaagttgagtgaatacagaaacgcaggaggagtaattggaggaaattgcattgttggtagccattcatctacagtggacagactctatgcttgggagaagaaactttatcaagaggtcaaggtattcactttttgacttcatttcattcataaagttgcaatctttgaacaaaacaattaatctttgatgtatcttcatatgttaagttttgtggaaagagtttgaaaatgttgtttatattcagtttgaagtttgaatattgaaattgcttgcttagatttcatccaaatatggataaatgttttgtttttgggaatttggttgattcatgtgggcattaaaggcttgtggtgggtccaagcgtgagcagatagtgtaagagacccacgtgtgtacttaattctgatgaataatgtgttatgtacactggcacaaatatcttgccaagtagtgagtgagtgtttgttgttttttgaatgtgggttttgttgcagtatgcagagagcataaagatggatcatgagaagaaagtggagcaagtgaggaggcttgagatgaagagagctgagtatgtcaagactgagaaggctaagaaagacgtcgagaagttagaatctcagctctcagtatcttcacaagccatccaaagcgcctctaacgagatcatcaagctcagagagaccgagctttaccctcagcttgtcgagcttgttaaagggtttgttttgtgcattcccattgcttcattaacctaaagtatcttatgttggtcaatgtgaacaaggttcttgtatgaatgtaatgtaggctaatgtgtatgtggaggagtatgtacgagagccaccaggttcaaacccatattgtgcagcagcttaagtaccttaacaccatcccctccactgaaccaacatctgagcttcaccgacaatcaactcttcagcttgagctcgaggtccaacaatggcatcactctttctgcaacttggtcaaggcccaacgtgactacatacaatctctcacgggctggctcaggttaagtctgttccagttcagcaagaatccacttgttaggagtagctacgagtcaaagatctacagcttctgcgaggaatggcatttagctattgacaggatccctgataaagtagcatctgaagggatcaaaagctttctgacagcagtccatggaattgtggctcaacaagccgacgagcataagcaaaagaagagaacagaatccatgttaaaagatttcgagaagaaatcggcttcgctgagagcgcttgagagcaagtatagtccatactcggtacctgagagtaggaaaaagaacccggtgatagagaagagagtaaaggttgagatgctaaaaggaaaagcagaagaagagaaaagtaagcatgagaagtcagtgagtgtgactagagccatgactctaaataacttgcagatgggtttccctcatgtctttcaggcaatggttgggttttcaagtgtgtgtatgcaagcctttgagtctgtgtacaaccaagctaagagcatcggtgaggatcaagaggaggttaagaggttgcttccttaaagagagaaagacaaattgttttaccatttgctctctgtttttgcttgatccaagctaatcttttggttgaatgttaggttgagtttatgctgttttcgaaatgaaattggttaaatgacttttcattgaatcactgcttgaaacttcatcaattcaactacttcttagccaagtcaaatcattggaaggtgacctaccaaggtattattaacattggagaagtgttagttagttagttagtgaggtagttaaggggattgcttaaagaagtaagcaagtttaatgataatcaaacactcgtgatgtgtacgtaacagaagaaaagagagatgattcgtttgagcggcagaaaaagacaagtgcctaatttgatttcccataaataaacacacaatcgattggtaattttgattagttgggagctattaaaagaggaaatccacaataatcggaaatagaaagacaagtttggttagcggaacgtttcaacgccatttttcccggccaaagctaactctaactaactctttgttttttttcggtttttgtgccatcttccagttttcattttttttgtttcccctctatctttttgggtaatagggtttctaatctctgggacaaactccaatcgtttcgaatccgcaatgcccagatggtcgatcaatagaaatatcaagagtctccaattccaaaggctaaatctttgagatctttttttttataaatttccctgaaattaataaactttgaggggaaatg

SEQ ID NO: 25332 - DNA, 3003 bp, Unknown; identical to SEQ ID NO: 25331
  misc_feature (1)..( 3003): 2750-1469P.txt file - cDNA_ID_2705047; gDNA_ID_2213671; Annot_ID_182318

SEQ ID NO: 25333 - DNA, 3003 bp, Unknown
  misc_feature (1)..( 3003): 2750-1469P.txt file - cDNA_ID_2705049; gDNA_ID_2213671; Annot_ID_132803
caagtataagcttttgcaccacgattcctctaaatgtgaggaattatctctataggcattagtaacttttcttgatatgtcttttgaggattggaagtcttgttaagttgcagaatcttatcgctattgcgttctttgtttatatctgtctagatgatggattccgactcacctatctgggttatgactttcttgccattaaaacattggtcaaccggggtatatttaccggtgtcggtcgtcagattggtgttggtaaagagtcaggtatgttgttttcctatttatttttattttatcggtgtcgaagagatgcgtgttggtggctgatgtatcttatttatttgttctttgcatataatagacatatttgaggtcgctcaggaagatggaactattctagcaatgaagttacatagactagggagaacctcctttagggctgtcaaatctaagcgtgactacttgaggcatcgcagtagtttcagctggttgtatctctcccgacttgcagctctcaaggagtttgcttttatgaaggttattgccttcttccactaatgtaacactattcttgtgggtgtatcatctttttattttatttttggcctaatgtttgtttggcttctgggtgagcaggctttggaagaacatgactttccggttccaaaagctattgactgcaatagacattgtgttatcatgtcccttgtgcaaggttaccccatgtaaggacctaactacatatttacacaaagaaaagtggttatgatttatgatgtttgtcatcatctactgatatgttgtggtcggatattgattttaagctaagataatcattggatttttgagtttctaagaaagctaaaccatttgcttcactcactcactaagaaacagttacaccctttctgctgtgaatcacatcttttcacatttttcatttatgcagggttcaggtgaagcaattacagaaccctgagacaattttcgagaagatcattggtattgttgttcgtttggctgagcatggtctaattcattgtgacttcaatgaattcaacatcatggtgagatacttagatctatctagttgaattataccttctatttgtaagttactttgctgaaaatatcatgcatttatttgaagctgccttctcatataagttaattaatacttctgtaagcatgctagttttgtcctctgcctacttacaattttcattgacacatcctgtttatgtatgcatgtatgttatagattgatgatgaagagaaaataacgatgattgattttccacaaatggtatctgtttcacaccgaaatgcacaaatgtatgtgacctctcatctctgcaccatgcctcagtactttcttccaaatttctataaaatattcttggtttgttaatgaattttgtctctcaggtactttgaccgtgatatcgaatgcatcttcaagtttttcagaaaaaggtgatttaccaatttgattttctttttaatatatacatcatttgttcacaatacctagtagaaaataatctctcagtcgctgaatccatgtcatgaatgaccctgaaattctcatttttctttgaactctggtcctttcttacaggtttaatatgtctttccatgaagataaaggtgaatcagaggagacggaggtggatgagaacagcagaccatcttttttcgatattactaaagatgctaatgctctggataaagatctagaagctagtgggttcacaagaaaggagcagactgacctcgataaagtatgtgagcctatgaccttagttataacactgcttatcaatcttcaatcaaccgtttcttggtattgcgtatatattttgaatcttaggcagactaatttgcagcactggtctctgtgtggttttgtttcctcattctctctggtatatagaatgaacatatggtttctgtcttttatagtttattgaaggtggggtggagaagagtgaagattctgatgaggatgaggaatctgatgatgaagagcagacttgtgaatcaaacgaagaaggaaacctaaatgaaataaaatcattacagttgcaagacaaggtataaaactttccaattcatcatacaactgaaacatgtaccaagtaaagatgtcctctacttacagtatatgcttttggcatgatgtaggagcaaaaaagttcagatggtgttgaggcagaagttgagttggataataccgagaacggtgaaagcaatggagatgaagatgaagtcggaagtaatgaggttagtatcttgtgtgtgagtaactcggagagtgaagtaatgaaatcacttacaaaaatgagttttgctacttcctttgtacaggaggaggaagagaaagaggcagagctggagaaaaatttgggcaaggtaagacgcagagccatggcagcagccaggggacgtagaaagtcacagtcttcaagaaacacatacaaggacaaaggacgcggatcccaaaactccaagatccacagcaacatgagcggcttttgatactccaactgtgggcttgaatgggccgtataatgatgtaaacgggcccataatctttttctagtgactttttctcgaatcgttgagttttccaaattgaacaccaaccaatgtactgagacagagaaattaaattataacggatatgtttcttaataaatcaaatctcaaatgttattttgtccaaattttgtttgatgtagttttagcggggctaaactgaaaacacatgaaagtcaaaggagtagatgcgaaacgctcccccagtaattagcggaaatagaaaataatggaacgcaacggctagtgatctcaacggtcgaaaatttaaacttttttataataattgacagacctctctcttttgttaaaatcctaaccttgttctcacattaatcctccgccgagattccttttgtcttcttcttcttcatcttctccatttcaattacaaagatg

SEQ ID NO: 25334 - DNA, 3003 bp, Unknown; identical to SEQ ID NO: 25333
  misc_feature (1)..( 3003): 2750-1469P.txt file - cDNA_ID_2705049; gDNA_ID_2213671; Annot_ID_182316

SEQ ID NO: 25335 - DNA, 3000 bp, Unknown; identical to SEQ ID NO: 10737
  misc_feature (1)..( 3000): 2750-1469P.txt file - cDNA_ID_2705069; gDNA_ID_2213671; Annot_ID_132785

SEQ ID NO: 25336 - DNA, 3003 bp, Unknown
  misc_feature (1)..( 3003): 2750-1469P.txt file - cDNA_ID_2705073; gDNA_ID_2213671; Annot_ID_132783
tatccaactccgatcaatacattcatggccggtacacaattctttcccaacccaagatcatgaggaaaatctgacataaaagcaacataactcttttgaattcttagaatagaattagggtttataaacgttaattgtcggatcatattatataaaagagtatgcagaagtggggaagtgaatctgtttatgcttcccctacttttagacactcaaagttgttgcaagttttaggggtttttaaatggaaattcaattcaaataataccattgtctttttatatggttttgtgaggatatagtgttgtgtatcatttaaatgttaggagcacaatatagctcttgttgtctgaatctttgtttcattaatgtgtctgtttcttgtttgtgaaacacgtaaccttagaatccggggaaaatgtttttcatctttatataacaccttttgtgtcttctttcttctattcaatataaagaagaattcattacatttgtaccatacattatagtacaatttcatatttttcaacccattttattttttatttttttcaaccatggtttccgttacgacagaatatggtctgcccatcccatgcatttaatggtttctaaagtgtattatttgttagttactagtaattgatgtatgccataattgacatgtgatagaatcagagaagatgactagaagagcgacatgtatagatgtgacatgagggtgcgttctacaatgtacgttaatcccaattagttacttctcccgccgttgcccacaccattagttctttcattactagtttactataatgatttagttaatttctactatcaggtttttgatttttctattctttcacattgactagaagtcttgaacaatactactaatctttctctattttaaaataagtcttttcatgatcttgagggaatgtttctgttttaaaaagggtttttaatgatttaaatgtaacgtttgtcaagaaatgatctcattgtctctttaaaattacttaaatagaaatttaatataaaatataatttaaaagttaacatcctttgtaagaatacaataggatattaaacttttcttatatgcatgatcagtgtcaaaaccatgtctaatttcaaatggacgcgatattatttttatttgtataactaaatcaatcataacttgtaaggtaacatggtcgaagaaaattaatgatcataaggagtttacctttcatgtaagcttacgtatatataaggcatccttgcatgagatgtatttttacaccctacacgatgatatacacacacatatatattaatagatagagattttgcagattctcatagtggatatatcatatatgtgaaacctatatatattacatactaagaaatatataaatatggaatgcaatgccatcaatttcagacgagtatgtttggctacagaaagctatttactcctccttcctctctttttcatcaatcatttcggttttgctcatttaaatacaaacaacccttaaaccaaaaaaaaaaaactaaatacaaacaaccccatcttcgtcttctcttctttcatactctcacatttaattttggtttagctttcttaaagtatgtaatatatcatacaaaaatatgtaatatatgatgtgaaagaggatatataagaaacaataatacaatgggaaaaacaaaactggatcccttatacaattgagatatattgcgtgacaacattacataatcggtaaatttggtacattcaaatagtgctgcggtccaatcggccgactcgttccgacttttactctctgccgtatcccacagcttgtcatatcccacaaaatttattcatttctaatctttatatgatgtttcttactagatccaccagtatagtgtcgtatcccttttgttgtgtgttctcatatagtttctatgtaaatttgatgtctcttatttggataatttaatattctgagaagaaagccaaaagagataaaatcataaaaatgctggctaaaatttccaagactaaaaatctaaaatttgtcattgtccgacatttataaatccaaagcttcaggttccactcaaagaaaataattatactatttggatgtcttttggaccttttggtgcattgatgacaataagcaaataatactatacacattttgcaaatttgcaggatgaatgttacaactggatatatagtagaccaataaagagaagacatgtgtgatgtttataccaatgattgacatttgagttatgtgagttttaattagggaaagaactgaaccaaacgtaggagaaactgatcttcatactaatgctcacactacacattttattagtatctcaaaagtaaaaagcaactttaaaataaaacatatagttttgtgaaagatgcaaaaattgagaaggtactaaactattattacttatattagtgaatcaaaactttttcttaatccatttggagttgtttagttcaaatgaacggaacatatgtaatccaatacaaacacaaatataaaaaaatacaagagaacaaacagagaattccagtcaaacatgtttttataaataataccataacaaccaaaaaatacactcaaattgaaatcaacatacttaatcaatcaaaattcaaattaaacagtcttcgaatacattataccaaaaaagcacaagcttgccatgtttaatatatccttgactaggcgttacaagttaacattggattacatggcactaatttttcatggacaacaaaatatgaaacacagagaccataactaaatttagagacacgaaattgaaagtcccatatccgactctataggatctttgatccagtcttgtctcttcacaacctctctttctcttctttttcttctatttttacttccttcaactcccattttactccttcatttttcttcttcttctttctccataactagtactatacgcaagaccgtaaagatg

SEQ ID NO: 25337 - DNA, 3003 bp, Unknown; identical to SEQ ID NO: 25336
  misc_feature (1)..( 3003): 2750-1469P.txt file - cDNA_ID_2705073; gDNA_ID_2213671; Annot_ID_182296

SEQ ID NO: 25338 - DNA, 3000 bp, Unknown; identical to SEQ ID NO: 10774
  misc_feature (1)..( 3000): 2750-1469P.txt file - cDNA_ID_2705105; gDNA_ID_2213672; Annot_ID_132827

SEQ ID NO: 25339 - DNA, 3000 bp, Unknown; identical to SEQ ID NO: 10772
  misc_feature (1)..( 3000): 2750-1469P.txt file - cDNA_ID_2705109; gDNA_ID_2213672; Annot_ID_132825

SEQ ID NO: 25340 - DNA, 3000 bp, Unknown; identical to SEQ ID NO: 10772
  misc_feature (1)..( 3000): 2750-1469P.txt file - cDNA_ID_2705109; gDNA_ID_2213672; Annot_ID_182362

SEQ ID NO: 25341 - DNA, 3000 bp, Unknown; identical to SEQ ID NO: 10771
  misc_feature (1)..( 3000): 2750-1469P.txt file - cDNA_ID_2705113; gDNA_ID_2213672; Annot_ID_132824

SEQ ID NO: 25342 - DNA, 3000 bp, Unknown; identical to SEQ ID NO: 10771
  misc_feature (1)..( 3000): 2750-1469P.txt file - cDNA_ID_2705113; gDNA_ID_2213672; Annot_ID_182361

SEQ ID NO: 25343 - DNA, 3003 bp, Unknown
  misc_feature (1)..( 3003): 2750-1469P.txt file - cDNA_ID_2705117; gDNA_ID_2213672; Annot_ID_132822
actgcgacgcaaggagcaaacgcccagtgagcaccgcacgcccttacttcaagtgctgttgcagctccaattcttttgaccaaatccgcgtctctacaaagttaacacatgaagtaccaatgttatcacaagccaaacacaacatggccacaataaatgcaactaattatttaatactaatagctagcattaaaaagttagtaagtgtaacatgattatatcttcaaataagactcaaatgaatcagtgaaggcaagtctcatcagatcaaatcaatccctttatatgcaagtctctctctagtctcttctactaaatttgtactttgcttaaaagaaaaccagacctagtggcgccgagaccaatattgtggggaaagatggtggcgccgtagacgtcattgttgccatgaacagcgtcaatgccgtaaattatcggaattcccaaacgcgactctaacgctgatcgctggaagccgtcgatcatatccgcccaattcgacgactttgcatcctcaaatggccaacctcctgcgcggttcaatacactacctgtaacaatatgacaacttgctttgtatcttttagtatgttcaattttcataagagaacaaaaaaagaattagagaaaatctaacaaaggtttggtcgttgaccaaaacaaaatttagaaatggtctgtggttgtgtataccgatggagaaatctcttatcacggcctcagaagcgacgctacgttcgatcaaagtcatctggccgattttttcagccagagtcatccgagagagaaggtcctttacacgcgcctccactggcgcttcccggttcttgtaaacatatgacttctcattgtcaaccattttcttcctctttctcttcttcttcttacaatgtcacttctcctctttagtctttaatatatatatagccaagctagggacacatgggatgggacgttgacttggaaacacactcggattaaggaaggacaaaatatcaactagaattcatttcatatgtatgtaaggtgtgaagtcttgagaacatggctaaaacaccaaaaacataaattaatttttttttttgggtgggaaaaaaacgttataattaaaatgttgtattgtaagattaaaatcaattggaattttaggtatgaattcttaccaaataaaaaataacgagaaaaatgtttaacattgtgcataaatattattacatgattttcaaagttactaaacacaaactaaggtagtctaggcatgcttgtattgggtgaagtcacataaatatttttgattaataatatgagtaaacatataaaaacatttggttggtatacttaaaagctcttcaaacatttggatcggaggaggtgctggggttctacggacgtttattagcggctgcacagaaagaccaacaccgatcggcggtgtcaacaacgacagttccagcaaaacctgtgcatttaaactgttttccatatggatagcacggtggttctttaactttttcatttgtgataggatttcttaacgggtcatctttgaaaggatttcttaaagaatctacaaaagcaaataaatgaacctttttcagactatggttatgattataatggtaatgatgctaaatgacgatctgaaccaaacctaaagtacttataacattaactcaccacattcatgaagacttgctagaaaaataagaacgatacaaaagatactaaaattagatgacgacattgtaattttcacactaagaagttttgttgttttatcatagaaaaacttatatatagacaagtctttgattactgctaaatttttgtgaggtgatccgacaaaactgtcattagatttgtttggctagatttatttcttttctattctaaacttataattaattactttgttttcgaaagtccctaaagtttcgaatgttgatcaataaaagaaaacatagtaaccagaaaataggaccacgattaagagtgaagcatatggtggatggagctaacaatctatttttctttttcataccaactaccacacattaatcatatacttttcttgaattaggtctagagcaataaagtcagttatttaattagtatttacttgaataaatgaatcttgattcttgaccgtttcgataatcatggtcttttcatttttatcattttgtgcagattgattgtaccatgtttatttctgtttctaaccaacattcagaaacatttttattcgtaagaagaagatgcaagaaatgggttacaaggttggaggtagagggagactcggagattgtggtggggttccttaagtcgggaatcacaaactcacatccattctctttcttaatacgtttgtgctatgactttttgtcgcgtggctggatagtccgcgttttttcacgtgcatagagaaactaaccgcctaacggatgtgttaactaactatgctttttctcttcccttagatttttatttgttcgagggtagaccggatgtggttgtctctattgtctttgatgatgcgaacgggtctgcatacccacataatgttcgtatttgatttagttttaatttttttaattaataaaatgtggggacattgtcccccaaccctaccaaaaaaaagaaagaagatgcaagaaatttggaaagaaaagaaaagagtatgattgagtgatttgtcttttaggccgattttgggcctctttcggcccaataaactctatattaattcttccaattatatgtccacgtgtcctcttgcaccattcggttccgtacgccgtgtcacacttgattactcagctttgccgatgagataattaaccgtcctccgttgtatcgacggtcgaattttaatatctttgatccaacggtcacaattcgaagtcgtatttcccagcaaacatcgtcttcattgaaaattagacagatcgatataaatgtgttacctttgatttccccaatttctagggtttcgaaataatg

SEQ ID NO: 25344 - DNA, 3003 bp, Unknown; identical to SEQ ID NO: 25343
  misc_feature (1)..( 3003): 2750-1469P.txt file - cDNA_ID_2705117; gDNA_ID_2213672; Annot_ID_182359

SEQ ID NO: 25345 - DNA, 3000 bp, Unknown; identical to SEQ ID NO: 10765
  misc_feature (1)..( 3000): 2750-1469P.txt file - cDNA_ID_2705125; gDNA_ID_2213672; Annot_ID_132813

SEQ ID NO: 25346 - DNA, 3000 bp, Unknown; identical to SEQ ID NO: 10765
  misc_feature (1)..( 3000): 2750-1469P.txt file - cDNA_ID_2705125; gDNA_ID_2213672; Annot_ID_182349

SEQ ID NO: 25347 - DNA, 3000 bp, Unknown; identical to SEQ ID NO: 11017
  misc_feature (1)..( 3000): 2750-1469P.txt file - cDNA_ID_2705158; gDNA_ID_2214471; Annot_ID_133103

SEQ ID NO: 25348 - DNA, 3003 bp, Unknown
  misc_feature (1)..( 3003): 2750-1469P.txt file - cDNA_ID_2705158; gDNA_ID_2214470; Annot_ID_133069
tcttttttttaatgagtgttattattcttttatttatgaattctggtgaaattgtataatcaaaaatatacattcaagatttgagaaaataattttcaatgagaggaaacattatccaaaaacattaattgtgattaattacactttgctcagctaaaattttcaaagttggtttatgaatctttgaaactaaagaggtgctacttcaattgttctgttagctgtttatatgaattaaaggagaaaattaatatatgaacagattatttttatttagtgtttttatatataaccatttttaacaaaatatttagctaattagttcatgcacacattttgtctactatatatgcagtgttagatgaacaaattcgttttatgtagtgattgtgtttaaccattttcaactaacatttagctacttaattcatccacacaatttgtcagactacataattcacatgacatttactgctctgtaatagtattaaaggaaacaaatatgaaaataacctactagtaattcttttgacaatatagagcttttcttagtcataaaacagcttttgtttcaaaattggaaacgatctctctttttgggatcttacacaaagtacacatgtacgaaattcctcattgatacatcattcctcattacgaaccacacaattagatctaacatatatatatttgttccactcaaatacaaatcttgttagggtaacatcacctctgaggaaacgacaaaatgaagttaatgaaagtatttggctttagatggattcgtagatagtacgtgacacgttgctgatatgcggacttcagataaattatcggctagtatcataaagataatgtaagggtctaagcatactcactaattaacgaaatatcttcttagaaacacctgagctcgatctatttcaatcatagtgactcaaacctaagaaaatctttgacatatgtatattacattagtgttccaagaagatgctacgttcgacgtcatatttgttatcctgtaaattataacaaagatgcatcaacattcaacagagaacaaagtttagtttttatatatatatatatgtcacgatcataggtctacataactataaattgatacaattgattttacagattttacacaacatatgtatccaacttgatgatatatccggtctgccgtttcccactatatatagagtattttataattgattcccatttatttttcttagtttatatatgttcgtcttttggaattgcttaatgaaagtgtgtgcgagtggttaggtatgcgattctattatgtctctttatttatttttgatttcgaatcgcaccactaccttcgtatgggaatgtttcaatatgatatctatctgtatatgatcacgaatataatttgattttgatcaaaatcaacatgtaatataatttcacgtaatatcaaacatccaatagttacagtttaatctggctactgaatatatatatatatatatatatatatcttcctttgaaagaatgtttatatatttttattctttgtgacgttttttttagctaatggtgatctcttgactctaaattcatacaaattttttaaaaaattagcttagggttttgaaaatataaaaactcttttagggcttatgttttctttttggtcaacggagcttatgcttttgtagaaacactaatttttaagacattaaagtatacatcagttttgttttgtgttttgggttaaacttatacacaattattcaaagacgacaaaacaagtttaaatatgaattccaaaataccagttcatcttttcggactactgtatataagaatattatgttggcaaaaagtaggtttattataggttaaaaataaaaataaagtatagcctactttgttaggaatacatattaaacttcacactaattactagtagatatttaggcaatataagtctagaagcggaaagtagacaatgcctattgcctagtatacatttcggacagcacaagtgacttttaactctttaatcacacagaagacagaactatgcaatgatcgacaacttcttcactctgtaaaatatttggatttctcaattaatggtttctgaaaataacatcatctttttaaagcatgaacaaattaatcctaatgtagacctaaataaaaatcttaagaccatctttatcagtaaaaacaaggaaagattctaaaaaaaaataaaaataatattttaattaaaacagatacattaattattatttaataattgaattaatagtatgatgacacttgtccaaattggatgagaatagtttctcaaagtttctcggaagagaaattcaactctccttctcttctacttttttttccttctatcatactttttcttctttaattattttttttttttattgggtatcttattgagatacttcaaatggagatgctctaataattaatgggaatgtgtttctaattaaaaagataacatctttctttctatatttttgtcgtcatataacacacctcaactcttttaagtactcgtgttgaattttgttttttgaaaagacaaaactccttataatcaacgtaattattaataacaaggagaaaaaaagtccaaagaaaaaaaaaagaaagctttttgggaacataaacaccatcgaaggagggtgggaggtgttttatgttcatgggtggagcttcttggccaacctgaccccattcatcatatcattacccactttcttctcctaaattattctctcttatctctctctctctctttttattttctttctttcttaattcatctaaactctctctgcttttgcttttcgtaattccttacatttcactcaatattaatccccagaatctccgatccacccacaaatttagcaattttctgagatttgatcatttgggtcaccaaaaaatcttgtctttttgatctgggtttaacgccaataacatatg

SEQ ID NO: 25349 - DNA, 3003 bp, Unknown; identical to SEQ ID NO: 25348
  misc_feature (1)..( 3003): 2750-1469P.txt file - cDNA_ID_2705158; gDNA_ID_2214470; Annot_ID_182998

SEQ ID NO: 25350 - DNA, 3000 bp, Unknown; identical to SEQ ID NO: 11017
  misc_feature (1)..( 3000): 2750-1469P.txt file - cDNA_ID_2705158; gDNA_ID_2214471; Annot_ID_183043

SEQ ID NO: 25351 - DNA, 3000 bp, Unknown; identical to SEQ ID NO: 10985
  misc_feature (1)..( 3000): 2750-1469P.txt file - cDNA_ID_2705162; gDNA_ID_2214470; Annot_ID_133065

SEQ ID NO: 25352 - DNA, 3000 bp, Unknown; identical to SEQ ID NO: 10985
  misc_feature (1)..( 3000): 2750-1469P.txt file - cDNA_ID_2705162; gDNA_ID_2214470; Annot_ID_182994

SEQ ID NO: 25353 - DNA, 202 bp, Unknown; identical to SEQ ID NO: 370
  misc_feature (1)..( 202): 2750-1469P.txt file - cDNA_ID_2705162; gDNA_ID_1564427; Annot_ID_149437

SEQ ID NO: 25354 - DNA, 3003 bp, Unknown
  misc_feature (1)..( 3003): 2750-1469P.txt file - cDNA_ID_2705178; gDNA_ID_2214477; Annot_ID_133153
ttgaagccttagagaaaatcaaagctggtaagtgagcatatagccttggttttcttaaatctttttggttttggtttttaaatggtgactgattctacagagctgatgatccttggattcatttctttattactcacttttggagaaccatatattctcaagatctgtgttcctcgaaaagctgctctctctatgttaccttgtttatctgaagacacagtgcttttccagaaacttgctccatcatctcttagcaggcatcttttggctgctggtgatacatctattaattgcaaacaaggatctgagccactcataacattgaaaggcttgcaccaacttcacatcttgttgttcttcttggccatctttcatatcgtatatagtttaatcaccatgatgcttagcaggctcaaggtaccataaattctagttttgatcaaaactttgtttgatatagtgaataagtgcttcattttttgttggatttttggcagattcgtggatggaaaaagtgggagcaagagacattatctaatgactatgagttttctattggtactttgttcatcagattctgttttgtacccctgaactgaagtgttgttcttttacagacttacttctgttctgtggtgcagatcattcaagacttaggctcactcatgagacttcttttgtgagagaacatacaagtttctggacaacaactcctttcttcttttacgtcgtaaagaaaccatttctctcattcttcatctctttcaaatgatcaaaatgatcttcattcgatttattatatgctctttggttacagggatgcttctttaggcagttctttgtatctgttgaaagaaccgactacttgactctgcgccatggattcatctctgtgagtttttttttctaaatcttccatctctccatttccttctatctcaatcttgatatgtgattttcgtgatgttttgattcaggcccatttagctccaggaagaaagttcaacttccagagatatatcaaaagatctctcgaggatgatttcaagttggtagttggaataaggttacaacacaatcaaatcatcaaatgcaaatgaaaccggtcttacataatccggtcgtatataacagttttaacaaattgttttgctctgcagtccagttctttgggcatcatttgtaatcttcttgctgttcaatgttaatggtgagctaaatttatatctttaaatttaaattcaattcacatactgaagtctttctattcaattctaggctggagaacattgttttgggcatcgatacctcctctactcgtaagacaatctctccctctaatacatcttcttgaaagtttcttgatgaacaataagtatttttgcagataatcctagctgttggaacaaagcttcaagcaattatggcaacaatggcgctagaaatcgtagagacacatgcagtagttcaggggatgcctttagtgcaaggttcagatcgatacttttggttcgactgtcctcaactacttcttcatcttatccactttgccttgtttcaggtaattatgaaaacatcttctccttgatttcattcttgaactaacatgttttcgcagattctgtcttcttctagtaatgtttctctctctaaccggtaaatttatttcctctgtgttatgcagaatgctttccagataacacacttcttctggatatgggtaaagaaacatctattcttactttggtgttatagaatgatgttactgagtaacatctattactggcatttgcagtattcttttggattaaaatcatgcttccataaagatttcaatcttgtagtcagcaaactctttctatggtaaaaagcttattcataaacttacttatattatagaggaaaagtatttaaaaacatgtgaggatgtatgtatgtatgtatgtgcagcctaggagctttgatcttatgcagctacatcactctcccattgtacgccctcgttactcaggtaattaacttgtaaacaacagttttcgatcgatattttagtcgaatggtctattgaaggaaagaaaatagagagatgatgaaatggtgtgtggagcagatgggttcacacatgaagaaagcagtgtttgatgagcaaatggcaaaggcattgaagaagtggcacaaagacatcaaattgaagaaaggtaaagcgaggaagctcccgagcaagacacttggtgtttcagagagtttcagcctctcttcctcttcctctgcaaccactcttcaccgttccaagaccactggtcactcttctaacatcatatactacaaacaagaagatgaagaagacgaaatgtctgatcttgaagctggagcagaggatgctattgacaggattcaacaacaggagatgcaattccacaactcttagctgctttagtttcttctgttgttacttcatagttcaaatgaaacgatgctgtttactaacttagtcaggaaactattgtcgtacaagtgtttctttaatgtgttactacgtttaagccaatatagatatctaataacttgtcctaaactaaataactcgcactacatgatcattgttattattaatatagatttatttcgatttgaaaaatcctaacacgacatgatcatgttttcttcttctccttattatatgtgatccgtatcaaatacttaatcattgtttacgtcaatgcttgacattaacaaaattatcattaagctaaacagataaggacgcgagagatagagatagatagtgactaatatttttgaattatttaatgcagtttgagagaaagagacgaggaagaagaagaagaagaagaaaggaagtgacgaagaaagaatgagaagacgaagaaagagaaaacaagatccgattcaaaatatggaaacttgaatatcttcttcttcttcttccttctcctttctcatctctcactttgagggtgaattttgattttgtagaaaatg

SEQ ID NO: 25355 - DNA, 3003 bp, Unknown; identical to SEQ ID NO: 25354
  misc_feature (1)..( 3003): 2750-1469P.txt file - cDNA_ID_2705178; gDNA_ID_2214477; Annot_ID_183175

SEQ ID NO: 25356 - DNA, 3003 bp, Unknown
  misc_feature (1)..( 3003): 2750-1469P.txt file - cDNA_ID_2705186; gDNA_ID_2214477; Annot_ID_133150
tgagtgagagttttaactgtaaaactaaatatacgattttacaaaaagtaatataaataaattaagcattatttggaaaataatgtaaagctgataattatattcctaattttaaatccatattgtttccttaaagaatatttcaatataattgcaaaaagaaaagaaaggaaatatatcttccgacaatattatctgatgcgcgtgaaatagactatcaggccaagattaggtcaaaaagcccgtgagcccaaaaacctgagaaaacccggttcaaattgcaaaccctcgatttcatttctccaattcgatagacgctgggtaaaaaaattcggaggacgacgaaagagaaaacgagtgtttcagtcactgccccacggagctctcggaaatttgtcttccccttgtcgtcgtctccctatctactgcttcttcttcgttttcgtcttctttatcaaggtgcgctttagcttctcaacgccgtttgatttttagaatttcgatttttttttttttttcttctagttcttgaatcaatccggaatttggcgactatgttgcttcgtttgtaaatcgtattctcctgtttagaaatcttcaattgactgtgttataggaacaatttaaatctcaatttcaatgtctcttttagtcaccttcgtgtagtaatttgcttttgaattactgttaatgaatctcaaaaaatggattttataatttgggaaaaggggcttctgggtttaattaaagaacacgagataaggtctggttttttcttttcatttctttgtgtgtgtttttggtttctttgattttcttctgggttatggtccgtttgagtctggtgatagttagttggcaaccaatttttattgatctattacaatcgagaacacaaaactaaaccctaagaaagaagtacataaagttgttgaaaagatctcgttaactctcccaaagtcctagggctttcacacaaccagtgattaaataacctttgagctgttctccttcccacactttatatgtgtgtttgtggtttgtctaatttgtgaggagcttctatgaaacctctggttattttaattgttttctgcaattcctgattgatatgtttatatatatttcttgtatttgtgaatttgtgtaggaatgctgtttaattggaatcaacaatggagaatttgacggaaatagaatcaacgatggagagtttaacggaaatggagagtgagagagttgaacagggtaccgataaggaaattggaagtggagagaaaaggcaggatgatgtaaaggaaacggagaatgagaattctggagagagagtaggagaggaagctcctgtcagggaacatgaagattctccatgtctcattgttattgaagaaggtacttccctagcttcccttgaggaggtgaccaatgctgatgatctgccgaagattgatgatgagaagaattcccaatttgaaacaagcccgcatccaagtccttctccttcagtagctttagacactgaagaagggttaatcaaccctactgcagaagacactgtagaagagaacatagtgtctagcgaagtaagttcggatatcttgaaagatgacggagatgccgtcgaggttgacagagatactgcagaagtccaggaagaaacggccaacatacctgaatccaaactctcggaggacacaggatcacctcatcatcatgctgatattctgatggtgcaggaaaaagctgcagaagaacatgacatgatagcctctggagaccatgaagaatttccagtcaatcctgataacaaacactctgaagaaaatcagtcaccacatcatcatgctaataatgtgatggagcaggaccaagctgcagaagaacgtgagatcatatccccaggagaacataaggaaattccagccaatcctgatactaaagttgttgaggagaacaatgacaggatagatgagggtgaggctaacaatttgaatttggctggcgatggaagtggagcagtcgatcatgattacttgaccaaaacggagctggacaaagtgctagaggtgcctggttctgagaccatatcaaaactggaggataggccatctgagcatctctcagaaacctcaatgaacgtggaaaaagaactagaaatgcctgccgttgaaattttgccagacaatgacaaaaactctgatgtgttggcagttggagtttctggagacagtgacaatgtggtatctgtcttgcccgcttcccaaacttcctctgatcgtgatgaaggaatgattacagttgatgctgaacctacggaagacatgaaacttgatgttccagattctaaattggttactgatactactgttgactctactaataacaaggatgcccatgttgaggctaatactgaaaggcaagataattctagtgcacttgtgctaaatgatgcaaataatgaaagtgcaccagtgaaacgtgtacctggtccttatgttgcatcttccaatataaagtctgaagcgcggggtagtggagatttgaacaatggagtacataaaatagttcggaccccacctgtctttgatgggaccatgcgcgcaaagcgctctttcctcttggatgatgcgtctgatggtaatgaatctggaacggaagaggatcaatctgcttttatgaaagaattggatagtttttttagagagcgaaacatggatttcaaacctccaaaattttacggggagggactgaactgcctcaagtaagcttgatacccatcattatttggtcactttactgtgttacattttaaaattttcagcaggagctgatatctaatcaatttctttggcacaaggttgtggagagctgtaactagattgggcggatatgacaaggtacgggtcactgtgaatacgcctgttgaatgtcacagcatcttttttgacaagcaaatgtgacttcggcttttcatcttttgttccatcctggcttacttgcatg

SEQ ID NO: 25357 - DNA, 3003 bp, Unknown
  misc_feature (1)..( 3003): 2750-1469P.txt file - cDNA_ID_2705190; gDNA_ID_2214477; Annot_ID_133146
agaagcatttgaagaggctcaatgctcctaagcattggatgcttgataaacttggtggtgcctttgtaagtttcacttgtgttggattgaatcttattagagcttagttttcgtttgattcggtgcttataatgctatttctgtccaggcccccaagccgtcttctgggccacacaagtctagggagtgtttacccttggtccttatcatcaggaacaggttgaagtatgctctgacatacagagaagtgatttcgatcttgatgcaaaggcatattcaggttgatgggaaagtgaggactgacaagacttaccctgctggtttcatgggtgagtctgttagtgttgtgatacgttttcagagtctggctatagtccttgtgctgattgatttttatgcttcttgtgatcaatgatctaactaaggataaatatttatttacagatgttgtgtctatccccaaaacaaatgagaacttccgtcttttgtatgacaccaagggacgtttccgtctccactccatcaaggatgaggaggctaaggtttgttctcctaaatctcttacattgccatatactgaatctgtcaaaacaaagtcaagtctttattcattgctctatacttacattagaggtctgctgaatttgcatgttgattaccagtttgtaatatattccaacaagtatcctcttttgttgttgtgcagttcaagctttgcaaagtgagatcgatccaatttggtcagaagggtattccctacttgaacacatatgatggtcgcaccatccgttatcctgacccgctcatcaagcctaacgacaccatcaagctcgaccttgaggagaacaagattgtggagttcattaagtttgatgtgggcaacgtagttatggtcactggaggaagaaacagagggcgtgttggtgtgattaagaaccgtgagaaacacaagggtagctttgaaaccatccacattcaagactcaacaggacatgagtttgcaacaaggttgggaaatgtgtacacaatcggtaagggaacaaagccatgggtgtcccttccaaagggtaaaggtattaagttgaccatcattgaggaagccaggaagagactttctgctcaacaagcttgatagttaatactatgctctgttttccagtttcagaacaaaccatgctttagtttgcagcttttcaatgagtcacttttgttttaaaacttatcttttcggattgttatgagctatattttggaccttttgcgctattaatattaagtttgaactcaaccttgtttcttcagatagttattgaattgcttcgtagtatttaggggccattttgttaatgttagggtcttagggagatcacaacttctgctaaacaacagtaagataaatgtatcacttaaacatgtggtaacattctgattgatgtttcaaatttccgatctcgatgtcatatttcggtgtgggagacaaaacaaggtttatgggtttgctctagaaagtcttacattgattatggtgcacaagcatacgtgtctgctttaagaatactgaagtcatgttgatatcgttattgtcgctagcttcacgtggtagttgtggcgagtgttattttaaaatcgttagtagaagttgctcaaagattcttctccttggtgacttggtcaaacaaaaaatcctacaaaatgagaagaagataacaacaaaaacgacactgaagtcaatgtcgaaccaagtgcctcggaaatgcaactacagtcaggtatattgattgaaaacaatgtatctcttgtatgaaatcaaacgccatgcatgaatctgttttaagcttggggaaattataagagtaaatcaagaaaaatattctagatgatagaagcatagaacattgatcatgtaacttcatgacaacaagaaattgtcttcgaatcttttttgatggtttttctacattcaagttaaaaaaaatgtcatttgatgtgaaccggttcgacttagcatatggttaattgaaatccagcaaaataagaaaagacttgagaatatctaaagccaaaactgctgaattccaaaagccaaaataggtgttaacttatggtggatataaatataaatcatagagaaaattttacggagattgaataattaatacccgcaaaaggatcgggaaactgaatagcaaaaagacgagagagaatgagattttacttctttataattgaagttatgcgaatgttgtgtatttttacaatgaacggtttatcgttctttatatagagataaaaaaaaagataaaatttactgtgttggcatagtaacatttaaattttaaactacatcactaaataattagctttgaaagaatatatatttctcttagttttttttcttttctttttaagttattattaagaatgtggccaaatttacccaagagttaaaattttgtcccatcctttatattttaaggaaaaaattaatagttttagagattgatttttaccatttcaatttgggggaaaaaaataacaatctaaaagcattgaaggtttgaatttttgattcaaaaagacccaaaataaacgcctcatctttaggttaattttcagaataactattaaaaagtgaataattcttcactgatccatgttggactagtaagtagtaacaatcaaatccataacattaaatgtgttgaaaaaaagaatcaaaagtaacaaaaaccataaccctaaataatcatcccaaaagtggaaataataaaagaagcagttagattgtgacggaggagacaaaatcatcatctctgttcttcttcttctcctctctcacatacgatgatgacccaacaaccttgacgttgatttcgatgtcacacacaacactataaataacactcttcacctatttttgtcatctcacactttggactttggagcccaaaataatctcataaccattaaaaacaaatctcctccttctctccggcgtcaatg

SEQ ID NO: 25358 - DNA, 3000 bp, Unknown; identical to SEQ ID NO: 16564
  misc_feature (1)..( 3000): 2750-1469P.txt file - cDNA_ID_2705194; gDNA_ID_2214477; Annot_ID_133144

SEQ ID NO: 25359 - DNA, 3000 bp, Unknown; identical to SEQ ID NO: 11057
  misc_feature (1)..( 3000): 2750-1469P.txt file - cDNA_ID_2705198; gDNA_ID_2214477; Annot_ID_133143

SEQ ID NO: 25360 - DNA, 3003 bp, Unknown
  misc_feature (1)..( 3003): 2750-1469P.txt file - cDNA_ID_2705209; gDNA_ID_2214477; Annot_ID_133138
tacataagttgttaaggagtttgttagtatagatgagtgaagatcacattgttaaagattgtttttatggatgcagggtgatcatccttgtgacaggcgaagaagcgtcactgagtacaaggctctctttcccgctattgatttctcaattgtaagaaaaacatcttatatggttaatatatatctctgtggaaatgttggcaagttgcttatgctttgacctctatggttttagattgaaaccgacaatgatgttctgtggaagccgagtccaagagagagccttgaagaagttgcagccagaggtgtagagttcatcaaatggtgagtttcatttttgttacttatttccacatggagatatatgtaaacatatgtatagctgaatctctctactgccatttgctttgtgaaggatatggacaaggaaagagaaggagatcgcaattgtatctcacagtggcttcttgcacggtctcttgagttctttcgggaaggattgttgcgatgacctaaagaaagagttgtctatacagtaagagcttaaacaaaaacttgatgtctacaagcaccaacaatttgtataacttgaaactgtttaactaatcaacatctttaactttgttcagtttgagcaactgtgagcttcgctcaatggttatcgtggatcgagggtaagcaataattacaataagttttgacagaatataaatataatttgagagtgtgttggattatttattatggtgttgggtgtgtaggaacctggggactgactctgcagagaccacaaactatcctgggaaggttcctgaaggacttgataatcctagtggctaaatggctgaagagtaagagagagaattctgagatagtttttctttctaaaataaataaattacatgatgtttccattggactagaatctggcattttcagttatttgatgaacattagtgttggtatgtagccatgtaggttgactctgctgctacatgaatttattgtatgattgttattatccaaaatttagcggtagctttaatatttctgctccaattctcattttagctgtgattatacaattgtggaaataatagcattacaagtagaggaactggtagatgcaactaaattataagtgtgaatcttagatgagtagatttatctctatcaacatgagaaccagcagaaacttaaaacattatttatgtaagatcaacttcatattttatggcagctgtgttgaattttcttatggccaagcattttaataaaacaaagagaaaattccaaaaattacactcagcttttcttatagtactaggttttatcttttggtgttgagattttttatgaaaatagaaaatgttttaagtgtttttatagaagtagatcaaagtttaatgctcttcgtacgttctatgtatttggactttaatataatcgataatcgtattcagattctttatagaaattacgctctctccaaactattggagaaagcttttaccattaggaattcgaaattttttgttccccaattttgaacatatgataagatcttttaaagaacactcgacaatgtaaaatttaaagtaggtctagcttcttatccgtttaagagaacgatttttttttttaaatgatatgattcacggtttgtaaagttatctattggaaaataaaaaaactgtaagtacaatactgtgatgtcaaaaagaaaaaaaaagtacacccaaactaaatttgtaccacgtgcgagacaaattgtagtctgcgatcttactcactacccgacaatgacatgccccatgccttagttcttgtaagaaaaaagtgatatcctatatacttcactaattattggtaaaattatgcaaaactttcagtgctaaaagtttgatttatactgtactagttgttatttcaacgtagacataccaaaatgtttattcaagaaagcctatatactagcaaaagtaaaaaagaatgtgacatctttgatgaaccaatgtgaaaagtcaacataataaaacttgagttttcagaacaaatttagttgtccattgtttcgatctgttaatcaagaccataaattaactcttaactatatgcatctaataataatattttgtagttagctaagttaagcacatccaactcttaaaaaaagctagtataacgttaggcttataatcattctcttaataataagttatcctaaacaaattattgcaattttttattctccctacttgcactaagtatcattacaccagtaaaagatgatgatcccttaaattaatactaattaaacaagcaattaaggaatgaagaaggtgagacgaaaccgcgtaaaagacctttcttctttgcaccatcctctctccttcatcatttcacaaatccacaaaagaatcaatctttttaacactctctaatgattcaacgaatccaattacccaaccagaaacagcaacacatatagagatatatactattaaacaataacataacaaagaaaccattttttctcttttgttattgacttaaacaaaaactatcaacgaataattatccttttttgagtttttcccatttcttcttcgtctccatttcatcgtcttctcgctgttctgctatattccggtactagatcctctgttttctcatgtttcttttattaccaaatgatttcttcatttattgttgtgtctttgattcttttttgggatctataatgatcgatgaacatttaaagctacgacttttcaggagctcttgtctttttttctttaatctttgattatgttacaaaacaattatgttttttgaagcttgatctgatgtgggttctttgatttcgttccaaagtttgatacttttttggcttctctttatctgattttttttgtgtatgtttgttcatgaaacagtttcgttggatgaggagaagaagaaagtgaaaaaagttgtgaaatagagagagtttgtttcatg

SEQ ID NO: 25361 - DNA, 3003 bp, Unknown; identical to SEQ ID NO: 25360
  misc_feature (1)..( 3003): 2750-1469P.txt file - cDNA_ID_2705209; gDNA_ID_2214477; Annot_ID_183161

SEQ ID NO: 25362 - DNA, 3000 bp, Unknown
  misc_feature (1)..( 3000): 2750-1469P.txt file - cDNA_ID_2705220; gDNA_ID_2214478; Annot_ID_133177
tttttgtatcaatgttaagtacttatactattttcacaagttttttaccgaagttacagcgaaatacaaattacataaaagatcaaaaactaagtaaaacaacaaaactacatcacaacacaaacaccagggagtacaagcaaaaactcaacgagtagagtctccggaaaaaaacattactgattctgaaccgctcggacatcttgtcctgagctatcttgtcctgagacactaatgtttgctaaccaacgacttccacccttgaatcacatagtgtgaggtaaacaaattagagatcatgttcattcattatgcatcaacaattaacacacctcataacacatagataacacgactaatatattagtaatttttagtattaacgatcgttaacaatattattagaagattaagttagtttgtagttatggcatatgtcgtatatgtgctacgaccaatcgtagacaaagatgcgtatgcaactggatttcgattattcaattaaaagagatgtgatttcatggggtccatgaaagtgacaaatgccctgcagattcctctactccatcgcatggtccaatcatcttttcctaatccagataataaattacataaccctgttatttggtaaacacttttagcgtatatgtttatatttttttctttcttctttttgtcaaccattataagtatgggtttctaaaccaacacgttattgaatctatatagtcttacgtaaaacgaaagaaaagaaattccaaaacggttggcttcctacaacaatttatttataggagatgaaattgaattgacgtgctttcatcaagtctttccatttctgttctacgacttgctaatatacctagctacatggcattttaattgtgttatagtttttatatttgattggtgaatgaatctataaaaagaaaagctcatgttatactcgcaaaacgtcttttaagagatgtgattaattcaggagctcaaacaagttgccaggtattttttttgataaagggtataacaaattgtcaagttgcaataacttaagagagcaaaagtggtaatgttgtagaagaacttaacaagctaaacaagtaaaagatgcaattaggtaaatgcgtaaatcgcaaggagaatggagaagtcaagagggcatttagttgcttctaaagcgactttcaattgctttgtcccactatagatctcctccacattaacttcatttgtctcacacacttttccgtacacacctcctaatctcacaaaagactaaattgcctctaatacaattcaaagaccacgaatgagaaaatcacatactaagtggtacaaaagaagcgtgattagtgcggaacataaagaattactcgtacgaatgacgactataacaaaacagcagcggatatagaaactaagttttgttgtgttcaaacataatttatttatcaacaagtgaatactatataatttaacatacggttaatgtagttgaatcgtatcgtacattagtgtacaacttttatgtagaataccaaatacaatgggttagtttggcattaaaggtagggcccaaaggagggacaatgggagacttcaacaaatgccggttgcgtgaggagaaggtaaaggtcatgtctcttgtccaaataatacaatgtggatttgtcgtcaacgaaatccatatcgactttttttttttttttttttctcttccatatgttcttgttgtatgtctcaacataatattatttttagttgcggtcaataattgggttgtagagaaagttacgaaaaatgaaaattacatgtcaagaaatgatactttacttgctcatacttgttactcactcggcttgttaagctttattgtgatagtcaattactcgtttatatttctactaatccaggatatttctactaatccaggttattacaatttcacaaaatattatcaaagtgaactatcattttatttgagttacggtcttaattagatgaaaacaaaccaacccctagaatctatggataatgaactaacatgctaaagttttgaccaagcgattggaaaatcaacaaacgaaatggaaactattatgtggcaatactcgagtactatagacccaactgacccgacataatctcttcactttttattttgttatctaaaaaaattcggtataaagccttgtttggtttcaaattttatccacttgagaatctcatatatcaagatgaaacacctacaacaacaaatgtaacttcatatgtcaggaccggtccgcaggacaagcatgtaataaaactgtgtgttttctacattttctatgaaatgggtgtaattgaaagatactaaatgttagggcttttcagaaacttccgttacgttttaggcgtttaacacaattattattttctaaaacgagagccgtttaaagagaaagagaaatttctaactccagagagcgaagaacacaatcccagagtagcagaatctgatccatcccacctttttcaattctcaggcaaaggtacgatctttctccttccccgttagagatcagccttagattcgtcattctcgtccattgaatcaatagatctcgaataattgtcttgttttattgtttcttctcacgctgttttgatgctcttgcttgattggtggatccaattgaaattagatctctgtatcgattcggttgatgccatttttatgattcttgttctggatttccactgtaatggagctgatttaaatagttctatatctgcatgtgtagagagattgttggctgtttcaattttccttatggagctgactcatttttacaaagtgactttcatgtttgattcaattcattacctttttgcttgagttaatgtgtttctcagtgttgttcatgttgtttctcagttttgggtttgtttaatgttgattatcttcattcttcagtgtttgatctcatattcagataagtcaaacttgaaaaaatg

SEQ ID NO: 25363 - DNA, 3000 bp, Unknown; identical to SEQ ID NO: 25362
  misc_feature (1)..( 3000): 2750-1469P.txt file - cDNA_ID_2705220; gDNA_ID_2214478; Annot_ID_183211

SEQ ID NO: 25364 - DNA, 3003 bp, Unknown
  misc_feature (1)..( 3003): 2750-1469P.txt file - cDNA_ID_2705247; gDNA_ID_2214478; Annot_ID_133187
acttgtctgactctggttgattccctgatgtggtgtctgaaactgcatctgcgtagatagcaaaaggtgtcttggatgatctgcaaaagacaaagttgcttaccatagtgagttgcagaataatttaaaggtatgagttgatagaaaatgcagataatgaaaacaacgagaaatatagaaccaatcaaactacttactgatttggctttagctttttggcttgtgggttagaacttcctaacgcctgccttcttgcatctacagaaaacattttcatgtaagatagcttaccaaaacatttcagtggtttccaagttaagttaatgtgactcactattatctcccctggacaataaagtgccaaagcttcttgacggtaagtcattattctcctttggttcctgctggtaggtagaacattaattatgattaggaaaaaccttagtccataatgaatagatataaagtgttacaaagagacaaaactttttacttcatcagctgtgttggaccttctcatcgttctcaccataaacttcttgtacgcgtcattcaacttttccactggctttgcatccctgcacaagttcccactttcaaatcagaccaataacttggagccgaaacatgaaagtaagattacatatctgttcatttacctagagattccaagattgaagatctcattagcagttttgaccttattcttaaactcaatgtgcaaagcataagctatatagtagacagcatgtgtctttccaatctcattgacctccaaaaacttgtaaatcacttccgcatcagcgcaatgctccgccttcaaaacacacacaaaaactatgagtactctctccataacaaagaaagaatcatctagagggtttaattaaagatagaatcattacatattccaaccagactttaagataacgaagatcatccttgtaacgttcagagtgccaaaatttacgaacacattgctcatatatcactaacagtcctgaacattctcctcctggtggaaaagcctcttgtacccattttatacaccttccaaagaaaccaattaagaagctcagtttacaaattggtcacagcataaagattggttcaagaaaaatttcaatttttcaacaacccaatcaagaatgataaaaggaactcactctatccatggagataaagggtcatctccttcatactcatcaatggcttcaatcaaattcctaattcacaaaaacaacacaaaattagacaagaatcgagcgattagactaaaacccaagagcaaagatgtgagattgaaatcagtacctgcgtttctcgatgagattctttctcaattggtggtcagagtgagatttgagagcgtggttgagaataccaacattgcgacctctcttcaatggccggacgttctccttgaaaagctcccactcgtatccagtctcctgcttcgaattaagaaactctgcctctggatctgaaacctgaaccttcgtttcggctgccatcgtcgtttcttcgagcaaattttgaatatcagagagaatatagccgttagtttactcaatgagagagcttcgcaactttttgctttgatgtacgcatactcggagcgtatagacgcttttgatgggcctaacttagatgggccatgatttgatttcttaaacccattaagtggccatctaaaccgaattgtgtatactcctactacaaataatcgataagagaagaaaaatgacaatgagcgaaagtaaaatagtaaaagaaatgacagaatacacttcattaattcaattggctgaacaaaataacacaataatccagagaaaattatttttactgttttgttttcttctaaattagatggttttggtcttttggagaataacaatcaaagcaaaagataaaagagaagatgtactctttttttaccttctttaaataaattacgagcataattcactttttgacttggaagctaaaaaaaagttcatccacaaccacaagatgctctctgtctgtcggttcaacaagggatgatcacatacattgcgttacacgctaaacctagtgtgctcaattatgaattcctaaacaaaacgtactcaagattagaagttgtatacaaagtctgtttttccattgtaacaacttccaccgacaataaaacagtaacagtttattgaagaaaatgaaatgaagaaaacataataaaagaattgatatttatggtatccttcagtttgggaatgtgacacacatgatctcctttattgacgtttaagtttggaaaaaaaaacaagtctttaaatgcatgcaatcgtattcgcaatcaatatacattttgcttgttattactaaagtctaaaactaaaagccttttgccgtacgtttaagaattccataactggaagaacaaatcatgtttttaattcaaatgtttaaaacaaagtctacattcaaaggaatttagaacacactttttttttttactttttgctgggaattcacaaactctttaacgagtctattcacatttcacctttccgtgcccaaactcattcgatttctctaaccgaaactaaatcatcaccaaagaaggtacaccgttacgccaacttgcccaaaggaccatgtgtccccaccatgctgccaattgggagccagcaatacataaaacagacttgatccaactttttacaagttagatgcagtgtctttttcgtaaatcataatagatccaagcccattctcgtataacctccaccacatcactcctcatatcatatgtgagacagccacgagtcttctaatttctacacgccgtgtcggcaaagcctctcgtcacttctctctgacgcttgtcgtcacttttgaatttttttaatttttaaataattgataaccgaaacggtgcgttttactcaccgtcgtcgggaaaaaaaacatgaggaaggaagttttgccgccggtgttatcaaccaccacagtatg

SEQ ID NO: 25365 - DNA, 3000 bp, Unknown; identical to SEQ ID NO: 11112
  misc_feature (1)..( 3000): 2750-1469P.txt file - cDNA_ID_2705251; gDNA_ID_2214478; Annot_ID_133185

SEQ ID NO: 25366 - DNA, 3003 bp, Unknown
  misc_feature (1)..( 3003): 2750-1469P.txt file - cDNA_ID_2705261; gDNA_ID_2214478; Annot_ID_133181
gattctttattatgtagaaaacctacagaaaatcacgttgtaaattcggtttcgaaaccataaaggacttcaatattcaactattctttaacaagtgaacttttatcatctatatcacttaaatctttattctctatatcacttgaattcataatagagaaacgaaaatttaactaaacacaacctttaaagaacccttaaaaagtaattaaaaaagaaggaaagtgaattatactaaacaaaagattatgttaaaattcggattcttaaaaatcttctagggaaaaaaaagcaaaatggaatatggattcgataaggaaggaaggagaggagacccacacacaagaacagagtgacagacacaatttggcgtctctttcgatctgaaacatctctgtctctcctcagagattcccttcttaggtcccattgtctctctttctgtatattacaactcttgcaaacctttctaccaccaagataaaattattatttggtaaaaagcaatatctttaattttctaggaaaaaagaaagaaagaacaacactggattgaagtggtcgtcgctttctctttctacacttccaacagattcccttttgcacttctctctttcactcttttcactatttttgttttatcattattttgtttacggaaacgtcattttcctccagacaatacctttattccctatatatataatggtatggtgtaaaaatgttattgccactgtatatattggtctatcacaattccttctctttatcttcctttttgtatttttgcagcaacaacaaaaacgtaatttatagttaggtagttatctttctttgcatgttttgtgtatgtacgtaactaagaatggtaagttttttttgttttccctcgattttaccagttcaataataaacgttatgcaatctgaagttaattatacatacatctacctaatattctattaaaccatactatatagatatagcatgcttcatgttagtacctaatatcttatatagttatatatcacatggtcttcaattgtttgggtgagaaaactatatttattggctttcttttctcatctttttcattcctttgtgtattgttgtttcgtaaactttttaggatgaaagtaggaacatggtgatcatggtcttgacttttgtagtttttatttttgacgtgatgttcttggctttattattcaaaagatgagtgaagtgaggcatcaatatatgatagttttcacaaatttaataattgcagctaaagatcgagagcctttgcccacataaaaaatactttactctaatgtgttaaaacaaatgttgacattttgcatttactttctttataatttggttgactttctctaaaataaaaatctttagttcttcaattattttgctccacccatcatattgcattattaggctttagctattttaaattgtcatctcacggccagattcatttcattttcgaggttagtacttgctgtcgtatagtcattccatcctgaaaatatcatcctgtttgctattgactttcgatgtatgcaccaaacctcaagctagccatcgagttttagatttgaactcacatataacatattcttataaatatttattggattaaggttatagtttgttgtattcactctattcaaatatgaatggattagatgaatatgtaaaaggtgaccgtcttagcaagaagattgatgtgttatgcattagactatgtgaaaaatcgtatattgaatgtaatcgtgactatacgtgcatgagatgaaagtgataatgtgtgatcgatttataaaaatataagtatgaggctatgtgatctggttttgattgagtgatttgtggatctcaattaatgtttgtagacgagaatgatcttctagattgaatgagttgaaagccgtggtaagtcctagttatcattggatgaaggaggagatttatagatttttggatgtttcgagtagatattaaacagtagaacatagttggatttaaattttagtaaaggcttaatggctttaggatattataaagttgatcatgaacaatatttaggttggacggttcaagtttctcatgaatcaaatattcaagtgctaattgccgaaaggaaatactgaaccgaattcgaactgaacaaccacaaaaaacagctaatgtaaatttgtttgagaatatttttgataagaacttgaatccaattcgaaaccgaaattgtaccaaactttttatattttatatcacatcaaagattttactttgaaaaccattattgataacaaaaaatccaaaaactcaaactaaaattcagattaaacaccggtttaccatctagggaatgggattaatataacataaaaaatactaagttgtttcatttaataatcaagtaagattttgcaatgctaaagaaaaacgaaataacagaataaaggaagttccggcattcttttcgatatctacgttgatagtaatatttaatttaacagagtttttccttctttctaaaaacaaaaatctcaggtttaccaactttaacccttcccaagatttttcaacttttattctcctcttattttaaaccggccactaaccgataacaccacgcgcctaaaccctcgcgtgtgaacctaatggtcatacgttttcaagaacacggtaacacggacgtgagacaaaagtgcgagagagcctctgtggtcactttggtctctctgacagctacgggtccactttctcttttacccaaatatccccacgcgcttcttttacttgcgcgtgaactttcaaaaccaaccaatgctaaatttccgaaactacccttcactctgtttttttgttttcttcgttctcttaagattagttttctcatcacaaataataataaactcttttcttttgtttcatctctttcttcttctctgcgtctttgaggcaagaaaaaaagagaagatgaaagcacccaacatg

SEQ ID NO: 25367 - DNA, 3003 bp, Unknown
  misc_feature (1)..( 3003): 2750-1469P.txt file - cDNA_ID_2705265; gDNA_ID_2214478; Annot_ID_133179
ttgttaacgatcgttaatactaaaaattactaatatattagtcgtgttatctatgtgttatgaggtgtgttaattgttgatgcataatgaatgaacatgatctctaatttgtttacctcacactatgtgattcaagggtggaagtcgttggttagcaaacattagtgtctcaggacaagatagctcaggacaagatgtccgagcggttcagaatcagtaatgtttttttccggagactctactcgttgagtttttgcttgtactccctggtgtttgtgttgtgatgtagttttgttgttttacttagtttttgatcttttatgtaatttgtatttcgctgtaacttcggtaaaaaacttgtgaaaatagtataagtacttaacattgatacaaaaaaaaaaaaaaaaaaaaaactcatgaggtcttgttatatatatggtgatcacatctttaaagaaaatgttatagtatttgttttagtttaaacaattttttatgtgccaaaaacattattaaaaagagagcaataccctactctaaaatagtaaagctaccaaattcaattcattacgacatggctcaaaagaaaaagtatttcgaatattatacgatatcaaccccattatcattgctataaaataagccaaactttacctctccattttcaataatctctcatcttctttcgtctctctttctacggttcaaacattaaaaagatagatggagaagaggagctctattaaaaacagaggagtacttagattaccaccagggttccgatttcacccgaccgatgaagagctagtggttcaatatttacgtcgaaaagtaaccggtttacccttaccagcttctgtaataccggaaaccgatgtttgtaaatccgatccatgggatttaccaggtacagaaattgaaaaatctactctagggtttcattcaaattcaatatttgatggtgtatatgcatgatgatcacaggtgattgtgaatcagagatgtatttttttagcacgagggaagctaaatacccgaacggaaaccggtcgaaccggtctaccggttcgggttattggaaagcgactggtctcgataagcagatcggtaagaagaagcttgtcgtggggatgaagaaaactcttgttttctacaaaggtaaaccaccaaacggaacaagaactaactgggttcttcatgaatatcgtcttgttgattcacaacaagattcattatatgtaagagaatcaaattcaaataaattagattcatcaatcagttggataaaaacttggctaaaaagtgtattttaatgtgtttttaaaagggacagaacatgaattgggttttgtgtagagtgttcttgaagaagagaagcaatagtaatagtaagaggaaagaagatgagaaagaagaggtggagaatgagaaagagacagagacagagagagaacgtgaggaggagaacaagaagagtacttgtcccatattttatgactttatgagaaaagacacgaagaaaaagagaaggagaagaagatgctgtgatttgaatttgactcctgctacttgttgttgttgctcttcttcgacttcttcgtcgtctgtttgctcaagtgctttaactcacacatcttctaatgataatcgtcaagaaatcagttatcgggaaaataagttttgtttgtttctatagattaacaaacttgggaacaacttctattaactttaataaattagattatgattgtttccaaagttaattatgcaatccaggagtctttcttggttttggtaattaatagccatattttatagcttatctaattgtatcaaatattgaaaactggttgatcaaatatctaatttgttaatgagtgtcaattaacaacaaggaccaaccatctagctaacaattcaagcaatcaaatcagagactaacactacattaaagatcactcttacaaaaaaaaaatgtggaacatttttttatagaaaaaatcatatacccaaacaacacaaattcatttattttgatatctgaaaaagcattatatgttaaaaatagaaaatgcataatgattatttctttcaattgttgggttgtttctaagtttttggacaacacttttttacccatactgtaaaagatcacaacattgataagaaaactctcatgtctggttgaaataaattagtaaaaggttagaataaattggtttaaaggtaaattaatattttagttttggcacaaattaacaaatcaattaatttttgtttatttttaactaaaacatcattgattatctatctatatccgattcaaccaatataaaataatttatcaaatataaatcacccaaaatcaataataaactagataattttgcaatggaagtcgaaaacatcatctcatttaaaattccaaaaaatcaaataaaggaatattaatataacatagacaatttagtatgattttggttttagttaaacatatctttgatcttcaaattttttttatttttttttcggtttgattgaaacttacttttatagtttgattttcagattgattaagaatgaatcggtttgataaaactctaatgtaaatggagtaattattgtaatattcaaaagcctaaaccatttgctgccatcattaattgcacttgctgacgtaattataagcgagaataatatgatcccaaaaagaaaattgataaaaaggacgaaagagaatcaaagagacgacgaagtcaaggatcaaagccttaacttttcctctaaaacaatcgcttttttatttttctaaatttctctctgttcttttttcctctggttttgattttttcctggcattattattagggtttttttcatacgttgttgaaaatggcgtagttggagaaaggagacgaatcgatcatctacctacttgcccattctttgtcgtcgtttttcgattttccttgattcgccggagaaatagcgtttccggcaatg

SEQ ID NO: 25368 - DNA, 3003 bp, Unknown
  misc_feature (1)..( 3003): 2750-1469P.txt file - cDNA_ID_2705273; gDNA_ID_2214478; Annot_ID_133174
tttggatattgttgaaattctaagttttgtttctatgtaacaattttatttaataatgtaaattgaggtttcactgttttaggaaattactttgggtagaagattagttttcttttcaagaacaattcatgtgggaaatggtaaatttattttagtaatcttttagaatgctgaagcatgctaaaaagagacgattactcttgtggtcaatctgtggaaaagcaaatacaatttggggttaaaaggaaacaatgtcaaaataaaagggcgatctgatgatatctccaataaataaggggaaaatgaaaaagtaaacaagttgattttaaaatccagcggacaaaatctgatgtgagtttttttcttttaatctctcgtccccgaaaaaaagttgacgaaactctctaccggaggcgctagttttcgccgtcggcgaggcaatttaactttccggaggtgcgacgcttctactccgcttatttttttctgctcttgttatttctcgtctcatgtcaagcttctttatgccttctctttgggtgtaaatagttggattagtcgcgaaaaaatcacgattggttcttcatttcgatgtatattagggtttgtgtgagcatatgattgctgagaagtagctagtaattgaatgtttatgtggttagtgggtaggagaatgggctgtggagatatctctactctgcgccgtctagttctttaggtcgtggattacttaatgcgattagattcaatcggatcgtagttctgatctattcgttcatcttgaagtttctagtcaagtagttaggaaatggtgttggtttttagaggcgcagtcactgtttcttgtacaatcagttaaataacttgctttttctggtggttaggagcttgttaaatgtgatcgaagatctatgatatgataaaaaaatctggaatagtattgtgttggtaggtttctgtttctgtgattttggctccatgtatcttgtaattttgaagttcctggtaatgatttctatgttggacgagggagtggaaactcatgaattcagctgtgcattgccttataattgtcttttgttctcattctattagtttgtgatttatgtctgctgatgattgtgctctctgctcattatctcaagggaataaagcaggatgaacgaagttaataagcaaaaggaaaatcgtgatggacatgaaacacttgtaaatgaagaaggatctgctgctcgaacaagacctacaagtgttgaggagattaggctaaggaggaagaggaaagagtccttggaaaatgtgaaggaggaaactgtaggagcagcacagttactgggttacgatcttgttgaaaaggcttctgactatcatgagtccaagaatttgaggcgtgaagaacatgttgaagacagttcaagaaaggaaaaagaagccatttctagatgtagggaagaaaaaatagaaaaaccaatgaaagaggaccctgtgggagcagctcagttacccgataaaaatcttgttgagaaggttcttgactgtcatgagtctgaaaaagggtatgatagatccgagaaactgagtcatgaagagcttgttatggacagctcaagaaagaaagaagaggctatttctagttctagagaagaaaaacttgataaaccaataaaagatgatcttgttggaacagctcagttactgggtaatgatcttgttgagaaggttcctgaatatcatgtgtctgaaaaagagcatgatggatccaagaacgtgaggcgtgaagaacgtgttaaggacagtttaagaaagaaagaggacataacttctagttctagggatgaaacaccaatgaaagaggatcatgtgggagcagctcagttacggggtaacgatatcgttgagaaggtttctgacaatcatgcatctgaaaaagggcatgataaatccaataaagtgaggcgtgaagaacatgttaaggacagttcaagaaagaaagaagactacatttctagttttagagaagaaaaatcaagaaaagaggatcatgtgggagcagctatgttactgggtcacgatattgttgacaagttttctgactatcatgcgtctgaaaaacggcatgataggtcgaagaaagtgaggcgtgacgaacatgttaaggaaagctcaagaaagaaagaagacgccacttctggttctacggaagaaaaatcaatgaaagaggatcatgcgggagcagctcagttactgggtcacgatattgttgagaaggtttctgactatcatgcgtctgaaaaagggcatgatagatcgacgaaagtgaggcgtgaagaacgtgttaaggacagctcaagaaagaaagaagatgccacttctggttctagggaagaaagagtagataattcaacgaaagaggaccctgttggagcagctcagttactaggtaacgattttgttgagaaggtttctgactatcatacgtctgaaagagggcatgaaagatccaagaaagtgaggcgtgaagaacgtgttaaggacaattcaagaaagaaggaagaggctatttctagttctagaggagaaaaaccgattaaagaggatcatgtgggagcagctcagttactgggtaacgatcttgttgagatggtttctgactatcatgaaactgaaaaagggtatgacagatccaagaaattgagccgtgaagagcgtgttaaggacagttcaagaaagaaggaagaggctatttctagttctagagaagaaaacctagataaacaaaaaaaagacgagtctacttcaaatagaaaaaggaaagcagaaggagagtgttctacagctgaaacagaatcaattgaagaacatagtaaggatagacgaggaaagaaagaagaaactaattctaattgtagggaggaaagacgagataagaagatgaagaaggaagaccttgcttcaaacagaaaaattgaaggagaaatccctacaactgaaacaaaaacaatg

SEQ ID NO: 25369 - DNA, 3003 bp, Unknown
  misc_feature (1)..( 3003): 2750-1469P.txt file - cDNA_ID_2705277; gDNA_ID_2214478; Annot_ID_133172
ataaataaataaataaacgaagctgatatggaaaagtcttctctttctttttttttttttggtaagtcgatctctctttcactcactttaacccaattggccgctattttccaaagtctgtttatttttttaatctctctctcttctctctcacccaatttcacaaacccgaaaccctaattttctcgggacactgaaatttttacagcttctttcctcttcttcaccggggagatttgtcggtactaaatctagggtttttgggtatcaccggagggttgaagagagagaaaaaaactcacaatggaatcagatcagggaaagctatttatcggcgggatttcatgggataccgacgagaatcttctgagagagtacttcagcaatttcggcgaggttttgcaggtcactgttatgcgagagaaagctactggtcgtcctagaggattcggattcgtcgcattctcggatcctgctgttattgatagggttcttcaggacaagcaccatattgataatagagatgtaagcaaaaatcttgtttctcaaatgggtctttctaaattttgaatctttatagtaaaaattgatactttgaatcttgttgttgtcgaggtttgattttcatctttgatggatttaagttgtgttaatttcttaggttgatgtgaagagagcaatgtctagagaggagcagagtcctgctgggagatcagggacttttaatgcttctaggaattttgatagtggagctaacgtgaggactaagaagatattcgtgggaggtttgcctcctgcattaacatcagatgaatttcgggcttactttgagacttatggtcctgtgagtgatgcagtcattatgattgatcagactacacagcgtcctcgaggatttgggtttgtttcttttgattctgaagattcggttgaccttgttttacataagactttccacgatttgaatggtaaacaagtcgaagttaaaagagctcttcctaaagatgctaaccctggaatagccagtggtggtggtcgtggcagtggtggagctggagggtttccgggctatggtggttctggtggaagtggctatgagggtcgtgtggattctaatagatacatgcagccgcaaaacactggaagtggttatcctccttatggtggttctgggtatggtactggttatggttatggaagcaatggtgtaggttatgggggttttggtgggtatggcaatccagctggtgcgccttatgggaatcctagtgtccctggagctgggtttggaagtggtccaagaagttcatggggcgctcaagcaccatcgggttatgggaatgtgggatatggaaatgcagctccgtggggtggttctggtggtcctggttcagcagtaatgggtcaagctggtgcatctgcaggttatggcagtcaaggttatggctatggtggaaatgattcctcttacgggactccatctgcctatggtgcagtaggggggcgatctgggaatatgcctaacaaccatggtggcggtggctatgcggatgctttagatggctctggaggctatgggaatcaccaagggaacaacgggcaagctggttatggtggaggttatggaagtggtaggcaagctcaacaacagtgattgaagaagaaatactactagaatgtggttttatcgctgaccttgaaacctcctgctttccgccttaaccatgtcacgtctttggcggttagaccaggaggtggacctacgctggattatctcttttgttagtttctcaataagttgttttcaggcaattccggatactatttcctatcaagttgtagtttttaagtttgcgtgcttatttatatttgtcgctttggaatggttttctttctctgttatcctctagtgtttgtgtttaacgatacatcctccagattatcattattcatctcccttttggttcattcatttttgttgaatattccattcacagattcttgcttttgcatctcctctgtttaggggaagatgatttgctcagtgttcaatgtgatctaagaaaagtgtttggtagagcaagagctgcaataaatcactttgagattgcgttgttacatgaaggtcgtgttggcggaaacttaacagtcccaagaactttaaaatattgtcttttgtcagacaaaacctgactaaactggtctgtttggtggctgttcaaacatgacgtttctaatccaaaccggcccgtctctaaatcattttctctctcttacggtaataagttatcttctctactgcattccagtttttgcaaatcctgcggctaatctaacacttctgacatgtgagtaaagcaatacattgtagctagtagttgttttcccccagttaattatgttttaaacactcgctcagtgaaacctcttgagtttgtaatatatattttctttcaatacattagatttcgtaaccattttggaccgacagaagaaaagagattaccattatgtcttttttcttttctatatacgataactaaaagtctaaagcgtatttctcttcgtataggtaaaaatgtagattgagacattgagtagcatctacattaaagaaatatatacaaaaactggtatattgtgctggcaacaatctagtacatatatataaaagattttacagatgagatttggatggacaaaatttactcgaaataggaaattagctaattctagtgttatttttatttgtgagtattcctaattttactcgcatcctctatgattctctcaatacagattttttttgctgtagattacctttttccaacttgtcgccttcctcctccacctcctcagtttctccagttttatttttacgtttgtcttataataacacaagagatatgtcttttcctttcctctttcctctctcattgagcaatctaatttcataaaatcccgtaaagttttcctttccaccctctcccctcctccgccatg

SEQ ID NO: 25370 - DNA, 3003 bp, Unknown; identical to SEQ ID NO: 25369
  misc_feature (1)..( 3003): 2750-1469P.txt file - cDNA_ID_2705277; gDNA_ID_2214478; Annot_ID_183206

SEQ ID NO: 25371 - DNA, 3003 bp, Unknown
  misc_feature (1)..( 3003): 2750-1469P.txt file - cDNA_ID_2705281; gDNA_ID_2214478; Annot_ID_133171
gtataatatgcagcaatttattattttttctcttcttcttatagtacttgatccaaaaaagttgaaagatcacaacttgtatcaagatgtagttgcagaaacaaccagtgggaagaatagccctaaaagggaaaacaaatacaaacctccatccatacacacacaaagaatcagaaatgctacaaagacaaacaaacaaaacacagtttttcttcttcttccttcttgttaaccactgtgaaacctttacctgttctccatgttggtgatatccacaattggggatctcttcgatgaaccattcgcatgaagactctttggtgaggccaaccaattggaaaggctagtattaacgattatctccttcagtagtggttttgcttgatcatccatatcctcttcaacattctctttcattacccgtttaactttcactggccttgctttaaccgctttccactgagcaagattctccactggattcaaaagaggagccacgtcctgctcattctcttcttcttcttcttcatcttcatcatcagcatcatcttcatagtcgttttcattatcggtgtaatagtcttcatcttccaaatcactctctccataacccatttcatcatcttcatcctcaaaactatccacacagttgtggtatctatagtttgaaggatacacagatctactgcttagatcctctggtttcttatctatagccgaagatcccttgcttcttcctcctttcccctcttcatcatcactgcaagcattctcatatcttgaaggtacaataggttcataggtttgtacattcaagtcaaatctgactctcttcctcgtcttcttagtcaccttcttcttctcctcctcctcccctacctcactcctgacacagtaaacataaaatagccatttcaattgataatctctgctaaaattgggtttcattttggcttttcataactcagattaagaaaaagtttcagtttttaagtaaatccaagcccctaagacattatacctgaggttcgaatttgagatcttttcagggttatctgaaacagtactgaaatctgtcggatctgaagaaagcagcggctcatagctacagattctctgcaataaaggttaaggttcaaatcagagtaatggaaaaaaacctaaactttaaagagatagagtaagaagaaagagtgttattttacttattgtggaaaattgaaaaaagcttacttgatctcgaggaaggatcttcctaatggaatttctgcgttttttgttggaagagagaccgaaacaacccataaaacatcccattggtggtgatgtttctctgtttcggtttcgatacttgagaggaagaagaagaagagagatgattagttgtttactttgttgcctcgttgaggtgttttgaaaagagagaaataggaacgttggggtttcaaacggatgaaagtgacggtgggctcacggagtttatgccgtcttttctttatgaagatgagacaaaattaattattggattccttttctatttttataacattttatgccaaaataaaagcatttatttgtttctatgcacaaccaaggaatgttgggccttgcggcccatttcaaacagtttgttgttaatgtgctttttgacttttgaggtctgtaaagacagatttaggcctacgtttatgccttttaagttcaacgttcactctaaacaagtggtgcacaaattttgatcaccttgcgcaatatgattatgaatatgtgaaaactgaaaacagcttaagttaagtttgattttagaaatgttagttatcaccaaaatatgaaaatatcaggctataactatctaagaactttcttttgagattcctcgatccaatttttatttaataggaattgttttctaaatttataattttagagtttctaataatttaattttttttttgcgacaaaaatattcttaagagttaagagaataacgttgatgactagaaaaaaaagagagattaatgttgcttttttttttttggtcacagcataatgttgcatttaagagttcaaatttgcagtactagcatctatacaaaataacatgattaattggtttcccttgtaagctgaatttgtagattacattgtattctttgattatataaattcttctttaataccacaccctcacaaagtttgccaaatgaagtgtttattatttttcggatcaatgaccttcttaacatacatttgaattaatacgaaaatgtacgattcttagcacattccacgttgtttgattttttttgtaaaattgcagatatttcatttcttccatcaatgctcgatatatttcgatgagagaagtagaaagattgctttgatgagctcgatttgagatatggtttttttgtcgattaatgcttttatatatatatatatatatatatatatatatatrawagtaacaaattttaatacaaaaaatcaaagacttaaaatgatctaacattttttctcaaataataaggtcattgatccttatataacatggaatcactataacatttataacctacattcttgctcatatatctctctccttttttttccaacatattaacgactaataataaaatttatcaaccattttaaatctctaaatggaacttattattacatgactaaaaaataaaaataaataaataaataaacgaagctgatatggaaaagtcttctctttctttttttttttttggtaagtcgatctctctttcactcactttaacccaattggccgctattttccaaagtctgtttatttttttaatctctctctcttctctctcacccaatttcacaaacccgaaaccctaattttctcgggacactgaaatttttacagcttctttcctcttcttcaccggggagatttgtcggtactaaatctagggtttttgggtatcaccggagggttgaagagagagaaaaaaactcacaatg

SEQ ID NO: 25372 - DNA, 3003 bp, Unknown; identical to SEQ ID NO: 25371
  misc_feature (1)..( 3003): 2750-1469P.txt file - cDNA_ID_2705281; gDNA_ID_2214478; Annot_ID_183205

SEQ ID NO: 25373 - DNA, 3003 bp, Unknown
  misc_feature (1)..( 3003): 2750-1469P.txt file - cDNA_ID_2705289; gDNA_ID_2214478; Annot_ID_133165
ctagattgaagaacgagctaatgacgcatatgtatagttcatatacgcatgacattttgttttgttttcaaccctaaataatacgtacgtataacgtttgagattatgtaattaatattggtgaatcgtaattatatatagataattaatggttgattatatattacagatgcacatgcatatataaattttcttcattttaggtattggttttatatcttgaaattaaagtggtggtcgttttctatttggataatgcgtgatgcatatattgcatttcagactttatatgaagatggtcatatcttcaaaagtatcaattcatcaaatcagctttgatcttaagctgttttacttttattttaatttcctttcgttaaattttaatctgtaaacaatttattgcaattctcgtaatcccaaattctgaacttctacacccagataatccttataatatgtgtcttaatcgctattatgcacgtgtgtagtgtagtttaagctcatacacaattttgtgttcaaaaaaaaaacctcatataaaatttagtttgtgcagacgacttgaaagtgaagtaataatatttttggacatagaataactagatagactcttgacaatgattttcaaatggtagatagacttttgtgaccaaaataagatactgaaaggcgatgttgatgtctcatgattagaacaaataaaaagaagagaactatattttccatgtaatgaaataagtgaaatacaaaaaacacttaagatctactatagtaaccaaaaacgctttcaaaaccattaaaataatattttatttttatcggcaacacaagtacaaatgtaaatcgtgggcttaaacaaaaagtgaatccgtgtttacctatttgaagactataaatgtgaaataaacactcgtaagttatagtttgatggataacacgtacgactcgtacttttgtttgtgtcttacgtaccgataatgagatctcgagcatgtagcctgtagtctctacacacatatcttctcatattaatttttttctgttatggaccttatggttattagaataacaaaagtgtacgaaagtgaaatattctcaattttgaataacaatgcattgaccctatgctcaaactgtcacaatcaaagcatttttctatatgaaatcattttcatattttttattaaaaaaaatgttcgaagttggttaaacattgttttcgaattttatctgatatccctaaatattttcttaaggcaaataatatgcttattgtccaaagacattttgtccagtagcattttactttagatatcttctattttctaatactttactgacctggtcgaaatctttttctctcctttgcgggaaatcatgagccaagtcaataaaattagcaaacgagataaaagatagaaaaatgcatatctaaattaaaaacatagaaactaattccacgaatatagggcttaatttaggacgattttcagtcaaaaacgtcaaaatccacggaacaagaattgggtcaaactcattgaccggtctaaatagtttcctcctacgtgagatcctttacccacgtcaacaccattatatctacgtgggctttccacgtcatgtgaagaggagaatcgagggtatcacatttttgcatcaagtccacgctggaatatattataaaaattatgtgaaaataatttgtacatacactgaaacacacatgcattagtttagtatatacaaatatatacatacacataaaaccaaaagtatatatatatatgtatgattgttacgtgaaactcccataacctctttttttccagaaaactataagaatttgaatttcttctctgtccaaacagaagaacctttgttctgtttttaattcaattacctctttgttttttcagtttttgttgttttttcctcccaatatttgaatttcttccatggattttcttgttcatcatacatcactcattccaatattattccacaaatcatccttgaagcctcgttcattaattttcttgctataattcatattttctcgggaattttctttattttcccagaaagttttcgcattaacattggagatatacaaagaacacaaacatgttgcaagacatgatctcgtctcactctcacgatcagctttccatcgtaattctcttctcattattgctttcatttttattcatgcaatgcgtagatgtttttgtctttgaaattttgcttacatgtatagatcatataaactcgagtctaatcttataaactgattaatttttattccgtagtcttttattcggcaactaccctataatttcagctagtttttcttttttggtgtaacgtcattttcttctacttatattccatttgatcttcttataaattgcttcattcttttcgcttttctttctttgttattctctccgcacttcaatttgtccttccatgcgatttttttttgaacaatcattatcataattctcattggcatacgattattacttataaaccaatagaaaatcgtcacatgatatggaacaatattgttctacaaaataactgtaaccataattcactatatctatcgtattttagtatagatttttattctcatcaaacgaaaaatgctagatttaatctctcaccttggattttatgcaaaatctacatattacgtgaatttcactaggagcattgtttgttatcatgatgggtttgtatatgatcatgatcataatgggtttcacacatgttctgatattttatgaagtgccctttactttttctttgtgggaaaaaaatctggatgttggttcataccaggcaattttaaattattttgtcaatacgaaaaggaaataccagaatcagaaaactttccgtttatagaaactccactcttctttactttatctttttagctattggaagtaattggaacacttcttcttaacatgtcacataaaagaacagatg

SEQ ID NO: 25374 - DNA, 3003 bp, Unknown; identical to SEQ ID NO: 25373
  misc_feature (1)..( 3003): 2750-1469P.txt file - cDNA_ID_2705289; gDNA_ID_2214478; Annot_ID_183198

SEQ ID NO: 25375 - DNA, 3000 bp, Unknown; identical to SEQ ID NO: 11074
  misc_feature (1)..( 3000): 2750-1469P.txt file - cDNA_ID_2705291; gDNA_ID_2214478; Annot_ID_133164

SEQ ID NO: 25376 - DNA, 3000 bp, Unknown; identical to SEQ ID NO: 11073
  misc_feature (1)..( 3000): 2750-1469P.txt file - cDNA_ID_2705295; gDNA_ID_2214478; Annot_ID_133163

SEQ ID NO: 25377 - DNA, 3003 bp, Unknown
  misc_feature (1)..( 3003): 2750-1469P.txt file - cDNA_ID_2705308; gDNA_ID_2214478; Annot_ID_133155
ttcaaaactttatatcccaggattgataataagcccttaagaaagaagccgttattgtaaacctaccaatcaaacaatttagaatagacaatcttggcaagagcatctctgcttagtgctgcactaccgggatcaagaggctttgtaatgctttcaccacgagtcaccatcaccctattgcacaaggagttctctagagctttctcatcacacctacccaaaaaagagcaatcagggttctacctcccattgacaagaaacctgtaatccgagaacacataatagtgaagcatatacatgaaaagttttgcagcaacttttagatggaaccgggatttatcgtccttgggttctgcaccatctgattcttcgctctttgcaaactcaatgtttcctagatgaaggatagcagcaactacccgaaagattgcatcctacaaaagtaaaatgtaagaagagttatcctcattgctgatcatgtcaatgaaaaaacaaaaggtacctgttcttcaggactaattccaacaacgtccatagctttcctcgtagctaggtattctttggaatcatcaattgcatccaatgcatggcaattcgattgatttaggtagtgaaatgtgcttggtttccctaactgataccgctcagtttcctgaaatttcagaacagaagctagttttcagtatgaatcccatatatggccaagcactggacatacagagccttcatatgttcgacctgatgtaaacatacaagggaccatgtttacctgttctggcgcagcgcaaagcatgtaaaagcaatgatagtttctttcaggatcagaaacttgacaaactcgtgacctctccagcaaatatgttctaatagcagctcctgagattcttcccatatgattgaactgaatctccacaaatttaccaaaacgactgcaatatgagatttgcctacatatgtcaaggttgacttcaagaacatacataaacttgaaaaatcaagaaatgtgaatgacattccaccttgaattattgtttctgacggtttttgcattaccaaaagcttctaaaactggatttgactgcataacaggatcataatacgagaagaataagaagatatctacagagagaaactcagtgagtctgtctctagtaagaatgtagatgcattgtaaacagactatctacctccaaaacttgctgttcgacagatcgtccttcactctcagcttttccacccatgtatgcaagatattgcatgagcatttttgtgctctctgtcttcccagcaccgctttctccactcaccaagatcgcctggcttactccctcgttgatcatttttctaaatttatattcttgatgatggtgaggcccaaaaaaaaatgatagtgcaacattagttaaagtttcatctatgcaacaaaagattacctgtatgcagaatcagcaacagcaaaaggatgtgggcttaactcgccaaaatctgtgcccttatattgctccattatctcatttccatataggtggggtaatcttttaaagggattcacagctatcagtatattccctgtgtatgtctgtaaccatcaagaagaaattagcttgctacaaacacttcagagaaatattaatgatattgctataactgtgcagtaattttcagcaaaacaatggtagagataatcatagaattcataagtgggtgtaatgaaagaaggaaaactgacaagagttacatgctgaagcgtacatatatttcatttgcattgtatctggcttttagattgagaagaacccctggttcatgcaaatacgcaagctttgtcatgtcgtccacaccaagctcaggaaactcaggatccttggggtggacagcattaacctttgccacaacctacaaacaaatgcatcacaaatatgagcaatgtattcttaaggtaccttaagaactaacacattgtctcgttgctttggagaaaagggactaaccgtcttggtttggcaattaactttgatctcttgaccgttagcttccacaacttctccatctagccaggcttcatctggatcttccacccagacctgtgaccccacagttaccttcactgaagcctgattaaagtagaatatattagaaacaaataaaaaaaatattgtcaagcttcattagctggttcttttgttctcttttagacacatcttataatgaaatctaaaatgtaaggggcaacataaaaatcagctcaaatagcaattatggttacagaagataaaaaaaaaaaggtaaaaatgaagaacacggagaaatcgcaatgcagataagagaagagagactcgtaccattatcacggccaaatctggtctgattttcctagaaatgatcccgaataaagatttccaacgggagaaacattagaaaaaatccctgagaacccaatcagctggtgtttccacaccatggatccaaacaccataaatcaaacacaaaacgcttctctctctctactagcttcaaaatctctgatcgacgttataaatgcggaagattaagactacattcacgttttacggacgatatttcaaatttctccgacgattacagagaccttaaacccttcggcttttgccttccaatatttccccaggaaagctggagattctcgcagaacgtaagaaattttctcgcgttttccctcggaatattctctcctggtttttttttgtttttgccttgtttgatgcttcgtctctctctccctcgtttctggaaaaaggaagagaaaagagaatccacgtaggcgtgtcaggtcagacatttgatgatctcgaaattacccctgcaattataccggatttcagttctaacatttctcctggaccaagccggtttatagtattcgattctaatggaggagatgatgacaacgtggcgcaagttgagtgtgtctatacatggagcagagcattttcttcactgttctcgcttcgccagacgttaatg

SEQ ID NO: 25378 - DNA, 3003 bp, Unknown
  misc_feature (1)..( 3003): 2750-1469P.txt file - cDNA_ID_2705315; gDNA_ID_2214479; Annot_ID_133217
acaccaagaagtatcatgaaacctgcacattctaagtaaagcctacaaaagcaaaaggttgcaatgtttattctcaagccgcaagtaaataaacacagatcattaagaaatcgatatctctctaaaacttgttgtggttttgcaccagagacgaaaaaaggacttcaagtccggttacagagatctcacagattcaattttgacataaagcaaagcaaccactaacaccaaatttagtactagcagctcgattcgtctcaaaatcgaaacatacatgcatgattcacctcccattatattacagacagtgaagagttcaagaaaaaaagcttgatagataccaaaattccagcagaagacttcatagaacgaaattacttaaaagagtaaccctacatagaaagaagttacgcaccgaagtcaaaggaaggggagggaggcacgaatcgctcggtgtcgtcgcaaaattaccggaaccctaaacccagagagaaaaagctcgcgagaaagaggaagagagagattcagaaattaaacaagtctgtatttaattttggtttatttgcaaaatattgataagaccctattttatgacggaatgaacccgatactattctttttgtcaaaataacccatctcctgcatgttttttgggctgacaaattgggtttcttttgattgattttgacggcgtagtaacagaaatttatggatagccacaccttagcttagaccaaacgtttaggtacaaagagtatgataaagttgagaacttaagacaatgtcaagaacatcaaaaccatgtcctgatcatacattctcttgtttaatcaatgtattatagattggactgagactcaaacacagatgccactcgatgtcagaaacgagccactttcgtgacaaaagaagcttggaaagcaaagataaataacgggtttggttggacatatcaagccagtgaggattagaccttagatggaaccttggtgtcagtgtccacctgtttttggccttcgaacttgtctatagccacttgaagctcgtctgtgccaccaaccgccctcattgtgtagaagtataccccaaaaacaaaagctgtcaagccaccagctacaaccgtgttcttgccttttgggcctaggtaactaaaacctggaaatcccgccattacttcaaagtctttaacctgcaagatccaatgtgtcacatgttacagaagagacccaagtatcagaagtattagattatgttatatcttcaatatcacagtttcataaatactaagatgaggaataacaagagagaactctgaagcatgatataacaacttttgattactctttttaacattgcagaagtgactccagaagccctgaggcatcgcaggacattgacatattgttcatatagtgaaaaacagattacacagattgaatacgacgaattttcgaattgttatacttatacctcatcctaagaactactacgccaagagtaagtgatagtactcacaacgagatcaaagatgagtacaatcatggtatgaatgaacaactgaaagttgcaaaacatttcagcaaaatagaactttcttctgcatcataatggaaacggagagaaaatcaattggtcacattcatgcccatcagtctaacataattgtccacaaaatcagcgcacttccctttaacgagtcaatcaaccataaatcatcaaccaaagcaaaaataaaggcaattagaaacctaactctacatctatacatccaaagctaacatcttttaaacgcaggctactgttactcaaccaaagttctcaaaaccagatcaaaatgtcaaaatgaaaggagagcagaaaatatcaatcaaaaattggttctttaagcaaattactccaaagtccacaaaattaaaatggaatcgaaaggaacctggtgatgaaggtttgatgatcactcgaaaatccgaaagatacaacaaagctgatatttttttcttctacagagaatcgtgcctaaatgcgacagaagcctaaagtttccctatttagttgacaactggttcggtgacgcttagtgtcgtggccacttaccaatctatcgaaaaccctaaacccagtaagagctctcgtgtgaaagagggatagaggcagaaagcaagccgtctcgagttcgaacccaactgtataacacaagagaagagatttattgcttcattatgtaaaaaatattgagatgatccttgtaattttggaatattatcaaattgaaccaccatactttttaaaaatccaaataaccctcaaccaagcatgtttcatgttgtggcctcattcacactatacgactatcaagttcatcgaaattcttgatagagaactttaaatacttaaatagttaatttagatactatctaataacttttggcggtttataagtttttgtgtttttcaatctacataaaatttagcgatttttcatgttacaaaaataatctcaaaattaaagtacaacccaaaaacataatatcaatgataataactacatttatctatgattcattttcacccaacatttacattcaaaaaaatgctgttgttacttgttaatgataacgattaaggaaggaagtcaatggaacaaaaaaaaaaatggtgataagtcaatgtaaaacgatgccgtttgtaaccataacagtgttaaacatgagaataaaggatcaaactttgaacagtggcttgcttgcttgcttacacacacgggtcaagtgaagacccaaaaaaaaataaaaaaattaatagatccgtacgcacatgactttcacttcttgtctctcagatctgttttgaccccaaaaccaacgaatatcaatttctccaatttcattcataattcactcaccccaaaattacaaaaaaaaaaaaaaaaaaagattttccatttccctcttctcgatccaccaccaccaccaacctcaaaagctttcatctttaccggtcatg

SEQ ID NO: 25379 - DNA, 3003 bp, Unknown; identical to SEQ ID NO: 25378
  misc_feature (1)..( 3003): 2750-1469P.txt file - cDNA_ID_2705315; gDNA_ID_2214479; Annot_ID_183276

SEQ ID NO: 25380 - DNA, 3003 bp, Unknown
  misc_feature (1)..( 3003): 2750-1469P.txt file - cDNA_ID_2705321; gDNA_ID_2214479; Annot_ID_133222
tattccagaccaagcaacagttgctttgtgtacattattatcacctatttaaaaagaggttcagacacaacattcatcgcctgtgactgtgatgctcaaacacaaggattatcaaagattcaaagttcaggtacagtcagaacttactggctcaggaaaagatccaaacttcgccaacaaagatgaaattgatccaccaggaacaattcattgatccaccaggaacaaactgcatcataatattcaacgaatcactctctcttacagtacccaagtatctctgcaaaaacaaagataataagaagaatgcatgtggaacagacattaaacatatgaaaaatagctgaatggattcgccaactcacaacaatgttcggatgtgaaagattcttaagaagttgtacttcttcctcgcgagccaccagaacttttgtttcaactttagctaggcaaatgaatagaaactcttaagtaagcagcattttagatgaaagtgaggcaccaatgatggctcgctaaatcttatactcagttcaatttctcattattgtccaaaaaaggcttaaataagcttcgggccttacctcctttgtgtccaaatttgtgccgttcttcatcctcgtcaatgtagcctttaaaaagttttaagtgttcaaactcacaagcaaaaggccaactcttctttctacctgaaaatccaactatcaagatgagatcgcacatagtttcaataagagcagaataattttggtgtgcagcttaaatatgttccctaagttcactaggccaaatgggtgacaataaagtttcacaaacaacaactcatacgagaagctcatctgtacaagaaaacagaaacatgaatgggataatggcagtcatggttttaaaaacataaaacttgcaatcatatattgtaataacctcatggatagaactggaagggtgagacatttttgacgactttgggggtctaaaatgctgaacaaccgatgtttttaatccactacatacttgaaggtaggagaagagttgaagatgacattggagcagaagcactatatggggttcagatgtaacatttccatgtccaagtgcgtttctgcagagagcttcaagtcatcaaaaatcaccaaccaccactaaatgtgaactttatagttatctaaaattatcactaccatcagatatcatctagaatcaatcgtaactaaaaaaaaaaaacaactttcaaaaactagataataacatataggagctagcaacatgtatactatttcactttttttagagtttctaagccaatcagaaggctctatttcacacccactcgcacaaagtgagcgttgagcgcgtgagagcaattctgtgggtgtacccctttccaaaacacgcctttttcaatcgacgcatttgtctccaaaatcctcgtcgcgtgaatattttgtttgttacttcttctctatgtaaaccgaaccgcaaatcaattctaatttatttcaataccatttaaacctaaccgaaatcaattgaaattagtaatgactaaccgcttgtcctcatcggaagagtgatctaaagctagatttttcgagagagaatctaaggaaattccgacaacagaagaagggagtataccggagagctcgccaatcaccgccggagcgatggagtaaaattggtacgattttgaaaaagagaagcgtggtggaagaatttcggattaggattttgatagtgtgtaaacgacggtggtcgatccatgagctccgacgacggcgaactttactggcaacgttgtttagcatagtttaattggatatagtgcccatttagtcaggcccattaatatttattcggcccattgttttcctttttcaaatagaatcgtctgtgtgggcttgttttcatattttcgacaaataagaggcggggagaaattttcccaattgaaaacaatttattcttgttcctctcttgaagaaagtctttagggtttaggattttattccacaaacttaatatatggtgttttggctggaaaactaaaaaaaatcaacggttgggatctctgctttcttttcgccaaaaatttactgcagcaccttctccataaacaactttggatgtttgctcttaatatagaccaagccagactatgaaagtttatatttaaagaaatgtcccattctcgaaatttttattttgagtttattttcagtttagttttatatcaaaccgagatattgatacttgcatgcaaattagtactccaagttctgaaccctttatgaactgctagtgcttggctgctattcttgctttatttggtttaccaaatgcatacattatttttttggctttgttaggtttaacatatacatcacttgacatttgatttttgatttttttttggctttgttaggtttagattttttttaatatactaaggtttagaatttttttataacacccatatttgctattataataaacattttgccgagatcttattctaactatagagcggtagaaaatttcacttattgacttcctaattggatatttctatttccttaaattttaaatctcttacatatatattcacaattgatttcctgcaaaattttaattatactagttgcaactaaattaaaaatgttgtcgagatcttttattctaactacagaaccgtagagaatcttctgactttgttattacgtcccattttcatttccatgtgtctatgtactctccatcttcccaaagataacacaataaagtaaaaagaaataaaacttaaaatccaagcttttcacttgtcacccttatttagtttttttttggaccattttcttttcttgctctgatgaaaagctgttgtcttctggaagaacctcacaagtctattaatatatgtatattcccaatatccctttattcgttctgcggaaagcaaaagattgagagcgacagagagagataacgagagagagagagatg

SEQ ID NO: 25381 - DNA, 3000 bp, Unknown
  misc_feature (1)..( 3000): 2750-1469P.txt file - cDNA_ID_2705338; gDNA_ID_2214479; Annot_ID_133197
tgaattttcggaccaaattaaaaagtgaaatagggtaataggtttgaggatgatcgatttacaaactcactaagtttggcgatcgaaacacaaaaaccataaaatttggaactctttaaagacgtaaacaagatgaaaacttttattccatagtcacaaagtttaaaattgaatttcaaatcgtttggacgtttcgatttaacataagccatttaatttattattcatccttccatttctatgtactagtcaatgttgcttatattttgtttgctaacagattaagaaaaaaacaaaagacaaaaactcaagaagatatttattttttagccttggtagatggaaagtcattagttagcattaggaatatgcaataatgttaggccatggcttttgaataattgacaatacatgttaaatagtagtacaccgcagcctctaagtggaaaaaaaaaattgtataaattaattaattcatttctaccatataaaaaggttccttccaagtggtctacgaatacccgaagatattggacttttttagttaccagtacagctgaggtgaccatcctagaaggaaaataaatgaagagattatagactatcttcagtaatgtatgtggatttgttgacgaaaaacaaaattatacaatatatagactcgaataatcaggcagtgtgcatgaatgtctatatgaaacttaagatcattttataataagatacacctacgaaaaactctactttaagatgaaacaatgagtcccaaataaatttgaaagaatgagttagtacccagcgaatctgtccttttatttaattgagctaatattactgttaagggaatatgaattgtcttcatctcgtaaagtttttattactattaaacaatatacatacgaatttgaattttgatacttatatgatgacgatgctaacaaaacagaaaacaatggttagcgtatctacataattcaacagtaacagctggttatatgtgaaataagcataaaacaaagcctgaatttctttgatagtgagcacgagtcattattatccagcgagtacgttgattaatttgagattttatagtaagaacttttcttaagaagtataattcataagaactaattggaagtgcaattctagcgttagaatgtgtggatttagaattgcacttccaattagttcttatgatcaattgtttttctttgacaataacttcattttaatgagtaaatacagtttctttgacaataaatcgaaaaacaaaacacagtcatcttatttatctacttctcgtttctttttattcctaatgctaactcgcaacgaattcgtggtgattcagtacttgatagacttagcatgaagttaagaactaaggtttgagtaatttcattgcgattgaaatcattataattgatcattatgattatctcttaaactttaaaaatttccacgcggcgactcgagttttaaaaaatcattgaaaagaatgagttggttgttgaatcatacgattcctgaaagtccggaccagtgaggcagtgaccgagccggaacgcacaacgtccggtgcagttgtcacttccaccagaaaaggcgaaaccaagagctttgaattgaatagtcaaaaataattgcttctactcttcattcttcaacgtatgcaacgtaacttgtatgattgtgcatttatcattttttatcggcaaattttagccttacacaaaagacataataaagtatcatggccttttttgttgacattgtccttctcttgtcaacaatcttcctggttttaagatacatatggatggttcagaatgtcatatagtataatctattactctacactttgattgatgacattcttattccgatttttatccaagtcttttattagatgaaaatcaactgttattttataaaaaaaataaatagtggatttaaagtgatttgagtgacatacattaggtgaaatttgaaggaatttcttagttaaaaaatcaaagatgcaaatcttatagttttaggtgagattttagagaatgttaatagcaatttcctaaagttcactaaaaccatctcaaaactcatcaaaactaaaatcactctcaattcatccttcaatacagcccctaaaactgagaatcattttttgtcaactaaaactgaaattcatacatttgatggaatttgagtagccgccgggtaatggacccaaccaaaggctcacatagtcacatggtaccaagatttatagtgatattatgcgacatctctctaccacatagtcacatggcaccaagatttatagtgacaatatgcgacttctctacttagggccggctttcagaaactctagaagaactagccactgatcgactatattagagtagttaattttatcaattacatttgaaatgtttatctctagtaagataaatatcaaacaaacaaaacttaatccaaggacttgtcttcatatcgtctattaagagtcgaatttaagaaatgaaaaataaacgattcaagcttaagttagttttaggaaaaagacatactgtttgctccatatagtttgtacatgtattaaatatagaataacaaaatattttaatgtttgctccattgacattacatgtattaaacagtttaatagaaaaacgaacatttttgtttgttcaatcattgggaaatcatagaattgttcaaaatatgaaacaaaagtgagaaatatcaattaatataatagttctgtttaacaagaaaattgaatttagaccaagtccacaatattcatcttgagtaagaacacgaccaaaagtcaaactcgtttcgaaatacataaatatgtaccccgctatacaaaaaagaaaaagacatttacatccacttatcccaatagacaaatgaccaaactacccaacatctacccctatatatacctcaccacctttgccctctcaaccacaaacaataacacaaaacatg

SEQ ID NO: 25382 - DNA, 3000 bp, Unknown; identical to SEQ ID NO: 25381
  misc_feature (1)..( 3000): 2750-1469P.txt file - cDNA_ID_2705338; gDNA_ID_2214479; Annot_ID_183251

SEQ ID NO: 25383 - DNA, 3003 bp, Unknown
  misc_feature (1)..( 3003): 2750-1469P.txt file - cDNA_ID_2705354; gDNA_ID_2214479; Annot_ID_133203
ttgatcatcgccgtcgtttacctactgggaaatcgaaacaaagttctgctgtgtgcttatttggtgggaaagataaacctgatggtagtgatgaggtcagatgctttttcctcatgttaagttcttctgcctgtaaatgaatttactttgcaactggagagtgatttcttttgtgtttgtttctaagaactttgctgttctgtttgctgatgataagtgtgttcttcttattttttcaattttgttcttagtgattgttgtaatgaattttgttatcagatatcgccatggaaagcaatagagaaagctatggggaagaaatcggttgaagatatgttgcgagagcagatacagaagaaagacttttatgatactgacagtggcggcaacatgcctccacgtggaggaggcagtggtggcggtggtggaaatggtgaggagcgtcctgaagggtcaggaggagaagatggtggtcttgctgggatcgcagatgaaactttgcaagtggttttggcgaccttaggcttcatctttttggtaaatgacacaaatttcaggaaagatttgaacttcaaatatcgtatcttgctttgatggaatatatctttgtttttgcagtacacatacattatcactggggaggaattggtcaagcttgcaagggattacattaggtttcttatgggaagacctaagactgttcgattgacccgagccatggatagttggaacggattcttggagaagatgtcgaggcaaagagtgtatgatgagtattggctagaaaaggcgatcatcaacacaccaacctggtatgatagccctgagaagtacagacgtgttatcaaggcttatgttgattcaaattctgatgaagcttatgtggaatcaaattctgatgaggtatcttactaggttaggaacaggaagagatccataataacaattgagttttttttcttagtgtttgaaatttagaatcagtttctttgaattggatttatgttcgtacatttgtatggaattggtttatttatacacgatgaacattctcgagggaaaagcaaatgcaaaccaaaatctctattataacacaagtcaaaatcttttagatctttcaatagctttcaaaattcaactcttaagcagcaattgcaaatcaatgagaaacacaaaaggagaaatcaaagtttcttagatttagtggttgaagtgctttctttcttctctgcctctgtcgatttcttccggtctttcctttccctcttcttcaaagcagtcatgtgggccttaagaatggtggcatatgatgcttgaaatctctggtgatccttagcaccaaccttacaaacaagaaagcattgtaacaagttagcttcttacagatcatagaccagtatcactttacaagaacttgggtaggttttcaatcgttttatttgtttaccgagctacttcctcaactgctagaaggcaactacaatagtgcaaggaaggataaatagagacttaagagagaatgttatcttttattctagttcattatccaaagagagtagtaactcttaaacaatatctcgagtaatcgatgtgctgtttagtttactaatgaatagttcctacgtttggaaacatacatggttcgagatcataatcttgagataatgtgtagaacataccgaagtagaaacagttttctttccatcggttgctcgaataaggcatctgtattcaatggattctccaactgagctcagtttcctcttctgcaccttagacttgagagatgctgacacaagtaacaaaaatcatataagatatcttcaaaaagatatttcaagtataaacatataacaaaagtggaggatgagattttcaaagttacatcttttcaaagtaacccacacagaacccttctctttgcttttctcaaacatgctcgtgagttcattgaggaatggatccaactgtaatagaacctgcaaaaccaaaaaggatggcatcaaaaaaacgcatgatcagtcaaaacaatggcaaaaattagttttctttactccatcaatcattgaaccttacaatgtagcatcaatgctgaatcaaatcccaccaaacacaaatcagaggaaaaaaaaaaatctcacaaaaatcttcacatcacataatcctgaattagcactgagaatttaccattgttaaaccgcagatggatatcttttgcagatcctcaagcactgaaaatacttcttatcactcagataactgagagagaaaaccataaacacaatgcaagtgcagggaagagttagatcttaaagtttagaactttgtcgatataaatggaatacgcaacataaaatctaagcacaattgaaacaatttcttcaaatcattcggatttctactcaattctacgctaagacaccattgatatacaaccctagatcgtcaaagcttctgacaaatcacaacacggaaacaatataattcaattcgcaacaattaggaggcgtcaaatccgatcaagtcaacaaacccagctcaaaagccacgagctttaagaatcagaattcaaacttagaaaaaaactatgaaactgaccagagagagacaagaatctgatgatgatctgcgtccgaaaactcaccggccggaggagtctcttcggtaaaaaggaagtcgccacaaatcaaaagacgggtatactcttagtactaaaggaccatttaaatatgggcttatttagataataatgggccttattaggcccagtaatttataaaaccttactagggttttaacgatacgttctcgttctctttctctgaaactcagcttcttcttcagacaccattgatatcctctaaattgttccccgtcgtagaaactttaggtaatcgttgccgtcgagctgatatttgtgaaggggaaaccctaattcgataagggattgtaaagttgcacaagtttgcttatccccagaacctgctctgcaacacaacaatg

SEQ ID NO: 25384 - DNA, 3003 bp, Unknown
  misc_feature (1)..( 3003): 2750-1469P.txt file - cDNA_ID_2705361; gDNA_ID_2214479; Annot_ID_133206
ggttatagtgggaaggaatgtgggaagaatcaattagttgaaatattttattattcttgcttgaatgtattccaaagtataattatatgcgtttttaacactaattagtaaatcatttttccaagtccctaaacgatacattacatttgattcgcatgtcttcctcttagaccaagaacaaggtcgagttttttgtcaacagaaatcttctccccgaaacatgaaacaacttatagagcaaaagataaatattatgaactttaattgcccaagcatctgtgatccagtggtgggagaagatttggggaagggtgaaactttcagagctgggttcgatcctccctggaaacaaaaatcacatttgtttggaaagtctgtcagttgggctttagcccaattggtttacctggtagtcagaaatgcaggcggcctgactaccccctggcattagtcggaaagcatccaaattcgggacagacagtgtggtggtctttcggggagaagtccactctgaagtatttcggtgcatttctactgaggctgaccggatcagccgataaagtttataaaataaaataaataaatgaactttaattaaccagaaaatgtagaaacaaaaaatcttactaaacctatgaccaaaaaaaaaaaaaaaaaaaagttgtggagtaagaagtatgaagcgttttatccaacatatcccagaggagaacagtgattggtcgatgtcacgtgaaataacatttggcaaatagtgcacaaattaatgaaggcaagaaagtgagaccagacgcgagatgtgagcgcgtatgaagaaacatgatgagacaacaaagagaatcaacctcgtctatgaaaatttcttcagattctcttctcattgcgataccaaacaaaaactcgtagtatatttttgttggtcgtttttgtacaaaatatataaaaagcaaactgtcgcaattatggtttgtatattatacaccagataaacaaatcagaatctctccactaaacctaatatattttaaaattttgataagtctatatacttttttggcggggacaaccggatagttcttctttgagacttctggcttttttttctcttgatgataataagaaactgtatgaatatttgaaaatgccttatgacgttttcttaccaaaaaaaaaaggcaaaggaactacaaaagatagcttaaacaaatttagacaattcatgtggccttaccttaagtattttagtgatgatacgattttaaaattattagtgccattctatcatgttctatactatataaaatattcattcaatattgatttcatagttaaagtttacaccaaaaaattgacatcacatcctatcagctacggaaatggttaccaacacaaaatagtatatctatgtcctatatatatataggaatttaagacaaagcaatattagtctacttttggaggagatgaaaagttacaagaagtctccctataaaacactattaatgaaccaaaaacaatctactaatcaaacttatagtctactagaggtactttgttaccgtttggttagggatgagtttcaacgtttgtggtggttacaatgaaggtaaaagtaataggcccaagacattgagtgataaagtgactaactctttctctttcttcatgatgataaatcgatttgattaattccaaaaaggaagtaggaaagaaaaagtttcgaaattcatcgcaataccaactagacccagatccaaagttgcagacttttcaaagtaatttacccacacacactctaaaaaggatgggttagagaagactaattatttttcttaatagccaattaaaatagtatttctttattgtgtgtttgcgttagaaaaagatatgagagctgagagagagagagaggaagcagaggatagacagagagaaaagggaaaattaccagacaagagttcttctttcttctctctgcctgcttctttttcctctcttttctctctctctctctttctttgtgaaaatctagaagaagagaaagctacaaaaatctcaacatcgaggtatgttattcgtgtttgcttacctaggagatgatttaagttctgtttcttgatttttcactttctggttttctggggtgtttcaaaagatctgtctttttttgttctctttgatgtctctagtcttgttgggatgtgaaacacatgattttcgaggagtagagagagacagagagaaattaagggaaagagctcacttgtgtgacttgttctgtgagaaaattctctaagcaaaattctcaattttttcagcttctttctaatttatgcatattaaaattcagagcttttacacttgaaagttgtcatctttgtctcagtctctctctctctctctcgtttgcatagaagaaacaatttttgtgttgatttagtcagttcacctaatctgaagagaagttaaaaagtttggctaagatttgtcaaaaagttaaaacttccttttcatggaagctcaacaacttaatctctttggcagtttccttatcttagtttctttggatctgcctttgattttctttcatttgtcttttaactgcagtttccaatttggttcatgcaggtaagagttttggctacagagcaaccatgctaacttgcgccttctcccaaaatcttatccactaatctcggtaagcaatacttctgttctgatgatcaatacacaactgtactagtcttgaagtttctccatgcatagatcttagaactaccataaaggttaatcctttgagcctgaaacaaaggtttgagttctgtttgattgtgacaggtaaggaaagtgatgttggcaaaatggtgaagaaaggaagttggttttctgctatcaaaagggtttttactccacattccaaagagaagctagccaatgtaagctggttactccttactggattttcttagcttgcaaaaatgttttattacagagtttttgatg

SEQ ID NO: 25385 - DNA, 3003 bp, Unknown
  misc_feature (1)..( 3003): 2750-1469P.txt file - cDNA_ID_2705392; gDNA_ID_2214479; Annot_ID_133218
tattttgcaaataaaaccaaactatacacgagcttatacaacaaatgtcacatttaaacatagtttctttaagaaaaagaactaatcatttctagtgaattattcaagtgaaactaaaaagaaaagaagaaaaaaaaatctagatgaagcaagctaaagctattgtagcactttagctttggctttcctatttttgccaacttttactcttttttatttagttttcttttactttttttcccacaaaaatccaatcctatgcaaaagattttgcctttcacgtcgtttggagcacgattcactctaaaaggtacgttttctcacaagtacccccaaaaaagttgcatactcaatatacacacaagctaatagtataaatcacttgcttgaagaatttgaaatcactgacgaaaataataagctccttttactttcttctctagtttcaaaacgttaaatactttatattgtttttgtttgtcaacgtactttatattttacaattttcaatacataaatcatagctttttattatctccaaagttgttctctttaaagaagaaactccaatcaaaaatctcacgtttgaatgatgatgcaaacaatcacatttaaattctacaataaatagtgatagagataattcattatttcatttgtacagtttggttgtatgatttgattatggtgtgtatatcttagttgaaagggtaacatcgtaaattaaatgttactttgaaaaccggaacaggtaatagtcggtgaataagagggctaacaaaagagagaagaagactgacacgtgtacataaagaaaacaaagtgggatgactcagtgaaacgttatggatttgcgtgattcacgggtttacagtaaaatgttctcgtcgtctagctctctctctgtacgctctttttgtactcagtttttgttgctccgactatttctcaccgacggttttgttctacgtcgtcgttttttgtttcacttgtagtgtataattgtttacacttattagtgttatcatgaagactaaacaatagtttaatggtggtcagaatgaatctttttttcaacagagggaatgttttgcatagtttattaactacatagcttaactttattgaccaaaccttaagtggaattttcaaattgcggttaattgtagttttggagaagtaatagatgaaaagttgtaaaagttaagacaacttaaaataaagagaagtacaagtgaaatttgaaatttctaagaagagagaggagaatctttggagaagtggaacatgatgcaaatcccaatactttttgttacttgaatacttgtaatttatagtactattcactgtcagtgaatactttttgaatatcgaatatttttctcatattgtatagtaacaaaattaatcatcaactaagacctaaatatgacattacatggtttgatatcagaacatcaaacttcaaaacactagtccaaaatgtatttgagcaattaagttgaaataaatacggttaatgtttttgttatcacattcttaactttacattgcacgtaagattataagtttggatattcaagatggacaataaatttagattagtaccgccgaccaaacaaattcattacccattttccttgtcacgatattatatcaattggctctgtgacattgaattgtattgtattgattgcattgactgaagctaacatttcggttgaactatataagtctaaaatcactaatcagtaatccaatgcaatgcagtaattagtcttcattaattatgcaaaagcaaaacacttaaatgtcatctatttaactaaaagtatcgtttcactaacttttctagatttgaaatgttgaaatacgttaatagatcagattcattatatgctttatgttttagataacttaaagtttgttggaaataaacatggcttaaaaaccaaaaataattaagtattttgccatttagagagaacttatttattcatgaacacaatcagtaatattgaggaaaatctattttatgttatgtgtttaggtgtatagtttgtaaaagatgttaagtaaaatgtaaaaataacaataagaacatttttgttttttgtatgttaaatgtatcttgtttgtctcaataaatttggttctttattgcagaaataatgtggttgtgttggaagaaaatttctgacttcgctcgctattcagtacaacaatccagaagattttgatgagccattatattttcacaatttcagctaaaattaagtagtctcttctttcacattctccatattttaacgatacttcaaaagtaaattcaaagtacaaaaacaagaagaagaagaaaccataaatgtttaactaattgtggcagtgaaagagtcacaatcaaaatctttttatcttactaattggtgatataaatataattaacagaaatcttgttgggaaagaagatgttcattattaattattacagcaatcattatgatcgaaaatcgatatttcttctaacaattggtccaaccaaacaacatatcatttaattttttgttctcaaacaaattaatgatcgaattgtatttttaattatcaattattcggttttacagatacaaaatttaaagcctttttggataagagaaaacgtggaaataaataaaacacgaactaccatttctcaatcaaatcaaatactagagagacgttaaatactaattcgaattaagtaatgacacctacttatactattccctccaatttctctttctaaaagagtccctcgtaaagaccaaaccttttttatcactctctctctctatctcttcatcgaccagaccaaacgcttcttcactctctctctctctctctctctctctctctctctctctctctctctctcttttctcttcaatgtcagattttgaatgccacaacaacaacgagccctaaaactagttgtgtgtgattgggggaaaaacgttgcaaatg

SEQ ID NO: 25386 - DNA, 3000 bp, Unknown
  misc_feature (1)..( 3000): 2750-1469P.txt file - cDNA_ID_2705399; gDNA_ID_2214480; Annot_ID_133232
tgtaaatgcgttgtttgataaattgagtgcaatgagttccttcaagagaccaatagatttaggaatctgtccttctaatctattcccagaaaaatcaatggcactgtaggagttgaggaccatctgttgctccatggataaccctttgtatttcatatctatagtatccctatacacatacgaatctataccgaatgcattattcttgtataccatatataaatctccatcttcattcaccgtgagtgatgatgttttccagttcacaaagtatcttggtgacaaggttccagtaaacatattatcagctatctcaaatatccgcaactcaggaaacgcgagaggactttgatgaggaggagctataggaccatacaatttgtttgaacttaggataaggacttgcaaatttggtaaagccttgagccagaagggaaatgtgtctttgattctgttgttgtcaacgctaagaaactctagagacgagcagtttaggagagatcttggaagcgtcccagatattagattgaagccaatgtcgagtgtctgaagagagtccccggcacataatgtgtcaggaatacttccttccaaattgttctttcgaagatgcacaaacgtcaaattactcagacattgaggaattttaccggtgaaattgttgtaaggtagagaaagagcagcaagagagcttctgttgcagattgaaagaggtatctctcctgagaaattattataacccgcagagaaggctttgatagagagtggtagattaggaagtgccccttgaatattgtttgaatgcataaataatatctccattgatgaatttactaaaacatctgttgaaccttcgaaaccgttgaaagaattatttgcaagactcattgatcttaggcgaggaagtctccataaccactcagggattttaccattgattctattgttggacatgtctatatactccaacttctgaagggtctttaagatgtttggaaactctatgatgccgcattgctccaatagcaacttctcaagggttagtgggatgtataaatctgaccttaaacttctcggagatatactgttaccggaaagatcgaggtatgttaaagatttgagagaggagaagaggtttaagtcgagtgggtagcttatgtttagaaaagaaagttcaagacgctttaggtttatgagctttgagataggctctaggatttgtccttcaaaaggtttaagcccaaggtaaaggatctcgagcttcgatgaggtagaaacttcaatggaaccggtgaaatggtttccatataaattaagatatgataaaaagggcatcatgaggagagaagaagggacggttccagagaatttattattttcaaagtctagatgggagaggttagttagattttgtacctgtgggaaaccaccagtgagctggttattggaaaggtgcaactcggttagctgacttaggttactaaatgaggaaggaacttggccagtgaagctattaaaggaaagatccaaaacctctactttgttgagattaccaaactcggaagggaatgaagtggaggtgaagttgttgtgagagagattaaggaaacggagctgatgaaaccagaataggctactgttgggattcagagttccactgagacaagcgttgagttgtagcttcgtgaccacacccgtcgagttatcgcaccagactccattagagtggtcactatggttgcaacgatgggtatcaaactcgttcttgaactgtgtaaaggcttgaatctgatgggaacgacaagcaacaagatcaagaacgggataactgaaagtgaataagcttgaagtcgaagaggagacacaacagagtaatagtagcgagagaaaacgcaaacgcagatgtgatcctgacatggttcatggaaactttttaacaaggatgatttagtttaaagaaaagcgagagtcaagattgatataaatataggcatatatagatacgtggttatgcataattggagcacaaattgacttataagaagttatagccgtgaagtctttgtattcgatcgggagtgaagaaaagtatggctaagtgggtcaaggctaggtgccactaaagtcatgaaatgaatccacgttagttgaaattcctaacgtataacttggattggaatcacatcagtttgaaacttctaaaacttacttttcaaaactacaaaaaataaacttaccataacgacaaacccatatacgtttgttgattaattgtgctatctgagtctttaatcattggtataaaactggtgaaaaatacgagtttggtaattgataatgatgttatattccaaaaacatgaactacttgaatcttgatagacatctaaagaccaaatgtaaaacaaaatacgtcgacgtgtcttatcggcaacaaatagcatcatcgagtcatcattcataatcatatatatgggcaacacttgatattttgatgcctcgcgtctttacatgagttataaaggggccatttgccacactttccagattttatgtttgaatactagttttactattagtgattttttttcattccatatatgaacacaaaattatattgtgcattttgttttgttacaatttttctcttctattcaatacgattatcttagaacatatactataaaaaaatacattatgcattttaaaatgataattttagttaattcattataatatatagttctttacattatttatctagtattgttttcctggggcaaattctaaatctgaaacggtgaccatctaccttccaggggtcaataaataccccatgcaatttttccaaaagggatcaatgtaacaatcgttagtttctttctcagcctcaggtaagctgtccccacatatccctccctctttctaattatctgattgtagtttgtataatgttttgttgtattcgtaagacttgatcaacttgcaagcaaaagagatg

SEQ ID NO: 25387 - DNA, 3000 bp, Unknown; identical to SEQ ID NO: 25386
  misc_feature (1)..( 3000): 2750-1469P.txt file - cDNA_ID_2705399; gDNA_ID_2214480; Annot_ID_183301

SEQ ID NO: 25388 - DNA, 3000 bp, Unknown; identical to SEQ ID NO: 11143
  misc_feature (1)..( 3000): 2750-1469P.txt file - cDNA_ID_2705418; gDNA_ID_2214480; Annot_ID_133235

SEQ ID NO: 25389 - DNA, 3000 bp, Unknown; identical to SEQ ID NO: 11143
  misc_feature (1)..( 3000): 2750-1469P.txt file - cDNA_ID_2705418; gDNA_ID_2214480; Annot_ID_183304

SEQ ID NO: 25390 - DNA, 3000 bp, Unknown; identical to SEQ ID NO: 11144
  misc_feature (1)..( 3000): 2750-1469P.txt file - cDNA_ID_2705422; gDNA_ID_2214480; Annot_ID_133236

SEQ ID NO: 25391 - DNA, 3000 bp, Unknown; identical to SEQ ID NO: 11162
  misc_feature (1)..( 3000): 2750-1469P.txt file - cDNA_ID_2705429; gDNA_ID_2214481; Annot_ID_133262

SEQ ID NO: 25392 - DNA, 3003 bp, Unknown
  misc_feature (1)..( 3003): 2750-1469P.txt file - cDNA_ID_2705433; gDNA_ID_2214481; Annot_ID_133261
taatgtaggcaccatgcaaaaggttgctctgctgtttcttataaacccaacaagcacccgtgtctgacttaatgccatctcaagaacccaacaactactctaaaaccatcattatcgcatccttatcaccacaagaaaaacaaatcaaaaccaaagaatccaaataatattatgtcgccaagagtattgaatcatgaaactatagagaaataagtttcatgggtcttcctctggcatttgatctaggctccaagcggcagtcaggtcaccattaaaagtggcgcctgctgttgactcgataaaaatggagcctttatctcgtaaaacaaaaacattcgaaaacgcacagatctataacaagtttcaaacgaaacgatacatgattgatgcggagaaagagagagaatcgagattatatagtagtgactgtggggaggagaagcaaaaccctagcattttgaactgtgagaataacgggcttttaaactgtctttattaagcccaatcactcattacttgggcccatcatagtcatctatatatattcagaaacgatggcttgttgaaccaatctcacaagtcacaagtcaaaatgacgtagttttgacttcgagcgatgtatttgcatatttggtaaggttttgcaattgtttataagaaaatcagaaatttttgagagatccaactgaaaaaaattaacatctatattcattcatacccataatggttatcacaaatattattatttattatcaaaattcatatatatgttaataaaagttgggttcataacataaaaaacactttcactaagtttatatttgtatctacgtattttttttgtttttgttaaccaaatttcatacacccacactctgtgtagaccaaaaacaagtcctcaaatttcatatataggcctgcctaaaggccaaaaaagttttgttgcccatttacaaacaaaaattccaaaaatgttaaaattttgagccatcaatttttctatttctaaacgtatataattaacaataaaagcgatattcaaataccatccacaagaaacttttaacaagttgtcttaataagtaatttactatacttggaagcttggcttaacatataaatacactaatagttaaaccatattcaacagccagaatattcaaaggaaaaagaaaaagaaaaaaaaaatacattactagaagaaaaaaatgacgtttgaaaagaaaattgtgattgtgtcaatggccatatttttaatgatagtagcaacaaccgctaccgaagttgatggtcgaattcatgtccgacggagcttagctgattttggtggaggttgttgcaacgtttttattcacacttgttgttttcctaaacattgacttaatcacttttaaatatatattacctcgtaataagtttcttctcttctttttcttttctcttaggagaattgattaactgtataaatattcagataagtggtggaccattgaacataatatacgtatccaaacatgttattcaggattgttgcatgtaataaaactatatagttgagagaaagataaaccgtccccacatacatttttttgtcttaaatttttcctttatataaccgataatagttatctatcgaatttagattctcacctagagcaaacaaaaatacgtttgtttttgaacgatcgaatgttttggccaaaatattcgatctagttacgaaaaaatccaatggttgtgtaaattttatgaccatcaatcagtagtgattaaatatatcaatggaaatatttgtatttttatgtgaaaatgttattttatatttaaataagacaactttttcttagataatcaagttttctcagccaaaattcaaactaattaattacaaaatatatatacgatggttatgtgaattttgtgagtatcaattcatagtgatcatgaaatcaagggttaatacaaaaatattggttttgattcctgattacatatatacactgtaagcctatccaaaccttttcattcaacaaagtctccaacttgaatctcaatgtgggatactgaaatattcacacaaaactctccaaagaaaacacgcacgtgtcacgtgtgtgtgcgtgtatatatgaaataaaatatttacatgtatgtgtaagaaaagcaacatcagtgaatactttaggtttagattaattacttcatgaaattatctttgtgccccacacaagaagtaaaacatccaacactacgaatgaagcaagaatagaagccaagttttgtccttaagactctaatcgcaaatcgtctcttggtcgtaccttgacgcacttccgaaacccatcgttcggccgactcgttcattcctttcattgacttccgaagcttctctttgaaactgaatctctctgatcccatcaagtcgtagcttgccaacacaatccgtcttccgtcccgataacatttctgagtgtagcgttctctctggtcatggtgcggcagcgttacataggcgtacatgtacgtttgttccggcatcatgaatataaagcaacgtaagaagagtgatgtagtgtgtatagcctctcttacatatatatgtatatatatatgtacgagagggagagttgggtgagattttggttgaacaattatgaaattgcgtttgatagtggttggtgactgtgttgcaccaaatatggaatctcatgttatttggtcatacgcaacacatgtgaccataatgtgactgacctatgtgcaagccgccatgtactttgtcaattggttaaagaaatcttcaatcctatttaatacatagaagaaacatttggacaatctatttttagataatgggaagagtaatgaatgagcttgccacgtcatcgccgagtcatttctaagctttttgttttttctttcgttctttctctgtttatacgaatgaacgcttgtgttccttaatcctccttggatcatcctcctaattactcagtgatcatg

SEQ ID NO: 25393 - DNA, 3003 bp, Unknown
  misc_feature (1)..( 3003): 2750-1469P.txt file - cDNA_ID_2705440; gDNA_ID_2214481; Annot_ID_133254
acggatctcgtttttaaggacattaacaagaacaacagagctttcccaacttttcaaagaacctacacaatgtttagttaacttgatacaattaattatgatacataaataaaagaagatatcagatgctagtgcatgtgaagcacataccttcattttttaaaggagcagtttctgacccagagagcccaatgatatcagcaacacttacttttccctgaaacaagatgatggttacaatgcaaaggttaggattttctatacatccttactcttgtccgtggtattataatttataaagcatggaggcagccaaaaacgattcttgtttttcactttttaatgaaaatatataaagatcaagcaaactgggcacttctagacatactagttctaacatagcggacttacttacaaggttcataaagaaaaaagtatgatcgctttctgattcacattttagccaagaaaagctaatgtatccactcttaaaaccagcattagaatatcatcctaccacgtcattgatctttccagcaatcacttcttcatgttaaatcttgaataaaaggtttgacaagcaaagtttctttgcctaggctctcaaaaagccaagtgtacacatcagtttttaacttttatgtctacttccttacagcttggaggtgatgaactatattcaaaaattgcatttgtagtaccttgaaaacttgtaaaccgagcgcatctagattctcccctgaatacctgtgatgagctactgtctacaggagaaagaaacgaaaagagaattagcatagcagggtattatagagtctactccattctcaaaatgaaagaaactcttcattcctaaaatgatgatgatgataaaaatcgacaatgagaaaaaaaccttagaaggtatgatctcaacagctggtgttggaagctgcaaatccttctctgataatgcagacacaccgcctcggtcttgaggcagcaaacccggcaagcattgtgcaagcaaagatggtgcacgcattcttgagctttgagttctcaataacgctcaaaatggtcacaatctaaaattagcaaaaagatcaaaactttagtaatactattgtcactttgaacatctttaactcgaaaacttaaaccccaaaacttagacatcatgattttcacctaacgtcgatgcaatcacatgattcacatgaatagatacataaatgcgaaagcaactttgaacatagtgacaaccatagagaacttagcagtcaaataaaggtcaaaattaaaactttctgattcaaaactaagcccaattgcgagatctaggcgaatcctaaaatccacatccctactgtgaaaatgaccagcaaggatcaaaatcaaaaacaagaaaccatcaacagaacatgagttcttacaagacataatgaatcaaaagtttgactttaatttcaataataaacgaccatgtaccgtatcaatggagtatcaagagaaacagacaacaaagaaactgaaatttacttacagagtaaaataaattaaaaagagaaaacgagaagtggaggagtggaggagttctcgacacgaaatttcgattcagacggcaaaaaatgagattcttctataacacggcgaaaatctagggatcaaacaaagcaaccaggggttgaaatttcggagcaaagcgatctctcacacgttttaaagtaagaagaaataaaagaaatgtttttaaaaagaaagaaaaattctaaaaaggaaagagcaaagtttggccaacaaaaaatcgaagcttcggttcagacccgctggtctgcttttgtacacctgttccttaactatttataattctagtcctttttattctttgcagttcatggaactcaccactttctttcgttcctctggtcgtcgtctgatttctcgcatttatatttctcatttcctggaaaaaatggagtttattaattaatttctccttatagaccaattatatgggcctttaaaaggcctctattgtatggcaatgggtcaacaaactctacctataaacggatttgttaaatttaggcctttattacataccaatgatattttaccaatgaaatatttgtataattaaatttcatattatcataggataaaaaataaattatcacattaacgcatgttgaacaaaaattttacatggattatctttctttctatttttgcggagtaggttgtttaagtatgtttttgtcctttcaagaatttgtcagtttataacttataagtaaaattttaggtacagtatatatataagttgtaaaagttgataggtattcttgtaatcaaggtttactatcaaattttaaactaaaaatggttaatcattcatcaacacatgctaattatgtttagtatgggtagatgtgcctgtagatagagtgtcctaggagagtgtggtcacgcgcttacgctaaacaaataatatatcctctgtctttgctacacgtgtataaacagcagcaaagatgaaacgtgattaaataaaataagaggttgagaaagcgagtagaagatatttagataaacgcgggagtgcaattatggtttgtttgttggaattaagagacaaccttatccagagtaagctcgccacgtgtattaaaaacattattattgtctgttagtcacagtcgagtaactccagataatcttctctgtctcatttctcgtcgtctttttaaaaacgttttactttccacggcgaattttggtctgattccaaattcttccctagtttgaaaaatcttctgtattctgaaaagagattttatgcgtatcgctgaaataggaagaaaacagattcctttccatttcccaaattttgtcattgagtcttggcatttcaaccaatcgcaatttattgaaattccggcgagtcattagatttttttggattccgtttcaaggtacggtgctttttcgcagattgagaagagcttaataagaaagatg

SEQ ID NO: 25394 - DNA, 3000 bp, Unknown; identical to SEQ ID NO: 11170
  misc_feature (1)..( 3000): 2750-1469P.txt file - cDNA_ID_2705471; gDNA_ID_2214481; Annot_ID_133264

SEQ ID NO: 25395 - DNA, 3000 bp, Unknown
  misc_feature (1)..( 3000): 2750-1469P.txt file - cDNA_ID_2705474; gDNA_ID_2214481; Annot_ID_133257
gagatacaccatattttctgatcagctaggaagatgggatatccctgtttcggataatttgacttttattccacttgcatgcaacgagtacgagaatgacattgtctctagtcaatctgaggcgactctctatcctcctaatagacaattcatgagaggtacaaatacaatcaaatcaaagtgagtttgaataaacaaaacaagaatctgaaaccaagtttcaattctgtctgttgatacaacaactatctagtatctacacagacaaactaaatctctatttcaacatcaaatgtgagtttttatattcgaacaaattcaatacaaaacaaaatataagataataatagttcattagttctaaaaaaagaaatataagataaactacagaaacaaatccaactgtaatgtcatagttcataaaaataataatatttgatgaactattttatccatttagataaattacaaattgcatcatcccaaatttttttatatcttaacaatcaaatctatacggccataatttaagatataaagacaattcactcatgttaattgcaaaacaaatatcttgtttgtaactaaaaaaaaaagacaatttctgttttgctatatttgattaacatacactacactttttttttctttggttcaaaaggcactcttaaaagtctctaacaccaaatattattaaaaaaaaatctgtaacaccaaatattattgttattttttttacaatatgattacttagtcggaagaatgatgatcttgactataggacctcctatgatgatgggaaggcaagtgtttatgacgtttgcgagatcggtcttcttcagaacgttttgatcttttgctgccagaaacttcacccttgttgtcaccatatcgatcttccatacctcgtgctctctcttttctatcagaacgggactcttccctggaacactcctctctgtctttgctgcgtcttctatgagaactgtgtgtgtgtgcgctcgacctgtgactgtgatatgacctaaggctgcttcgctctttaaactcttcttcccgttctacagaactcttttcccgataatattcttcctctctatccgacacacttccttttctccttggaggtgatgggatctgcatccaacaagtaagttgtggtaccaagattttagtttacaaactatcagctttccactagacacattgaacaacccatttaatatattatttctagcagaagaacattaacaaatgacccaataagatagcaccagagacagaacaggggtaaagttcaaatgactatagagtggtggtgaagttcaagacatggtagacctgtgtgcgcgacatatatcttccctcaggcggaagctgaataccgagctttttcaaatcttcatgagggattggtcgtctgatattaacaaatagaaagaatgcccatttcatgaccactatgtttagctggtgttatctctggacatgctaaaggaagagtaaagcaaaaccatacaagggagcacggaatggtctatctcgtcctccaaagcgaagttgtccggattctttcctaccaccaaggccacctcctgttaagagagaaatagatttcatctgtaagggatgaaaatataacgcctatgacatttcattacagacaaaaataaaggtaaagaatggcaaacctagtcttcttggtatccatccaggcatcaattgctgtctattataatcaacaataatctctcgcccatctattagtgaatgatgagcatcctgctaaagaaacaccaaaaaaattctcactctgataaacaaactccactagtttccagtaattacacggagatgttaatgaaacaatcacattgcggtgccttagtaagtggttcagacagctttcaacaacaaaaacaagaggtaaaaagaaaatgcaatttagtatcacagcacctcataagcacgaagcatctccttttcagtctcatactccacaaaaccatatcctcgtgaagctcccgtcactaaaaaaaggtaacaagaagaggagactcaatactacacaatgtggaacttagaggaaatatgtaatcacagttctgcttagacaaatatcttggtagaaagtaacaaaccatcagaaatagaaagatgataaatttcctaaagataaagcaaagtgttgatgtcataagtagagcaattgcaaaatcttaccaatgtgtcttaccaagcgcaagttcttaatcctgccatacttactcatcacctacgaagaagaaacttttataatcatattcaaaacatagtctacacgaaaatcaaaaactaagtgaaatttcaatcattaacctctcgaagtgtatcctccgtagtgtgatgagagagacgacccacgaagagagtacagtaaggatctccaacagccttcgaatcaccagaaggatcatctttcaaaacaacccaaatcaatgtatttgaattcagaaaccaaacgataaaagtgaaaagaggagcagagagaacgagagagtatacatacataagccagcgttataacagagaagagctcgacggacgccgttatcatgtggagcaacatcagttccgtcgatacttccggcttgaatcggatgatacgacgtcgcgtagaacactttgttcacgacgttgtttcctccgccgctcatttcttctcccccgactctctctctctcacggcggctccggctgtttaaggaaataaagaataacgtcgtcgtttgaattgattactattaaaaagcccaacatataaattgggcttattacagcccagttaaagatatatgatattctcgtaggtcccacacgaaggcggaaactccaacggtggctgctttgggttaggtgaatcactcactgaagagtgaaaagctctagcacaaaccaaacaccaaatctcatttcttcttcttcttctttttccacattttctgattagcagatcaaatg

SEQ ID NO: 25396 - DNA, 3000 bp, Unknown; identical to SEQ ID NO: 25395
  misc_feature (1)..( 3000): 2750-1469P.txt file - cDNA_ID_2705474; gDNA_ID_2214481; Annot_ID_183340

SEQ ID NO: 25397 - DNA, 3000 bp, Unknown; identical to SEQ ID NO: 13905
  misc_feature (1)..( 3000): 2750-1469P.txt file - cDNA_ID_2705502; gDNA_ID_2214667; Annot_ID_136591

SEQ ID NO: 25398 - DNA, 3000 bp, Unknown; identical to SEQ ID NO: 13929
  misc_feature (1)..( 3000): 2750-1469P.txt file - cDNA_ID_2705565; gDNA_ID_2214672; Annot_ID_136627

SEQ ID NO: 25399 - DNA, 3000 bp, Unknown; identical to SEQ ID NO: 13929
  misc_feature (1)..( 3000): 2750-1469P.txt file - cDNA_ID_2705565; gDNA_ID_2214672; Annot_ID_189137

SEQ ID NO: 25400 - DNA, 3000 bp, Unknown; identical to SEQ ID NO: 13928
  misc_feature (1)..( 3000): 2750-1469P.txt file - cDNA_ID_2705581; gDNA_ID_2214672; Annot_ID_136623

SEQ ID NO: 25401 - DNA, 3000 bp, Unknown; identical to SEQ ID NO: 13926
  misc_feature (1)..( 3000): 2750-1469P.txt file - cDNA_ID_2705593; gDNA_ID_2214672; Annot_ID_136620

SEQ ID NO: 25402 - DNA, 3000 bp, Unknown; identical to SEQ ID NO: 13937
  misc_feature (1)..( 3000): 2750-1469P.txt file - cDNA_ID_2705601; gDNA_ID_2214673; Annot_ID_136630

SEQ ID NO: 25403 - DNA, 3000 bp, Unknown
  misc_feature (1)..( 3000): 2750-1469P.txt file - cDNA_ID_2705638; gDNA_ID_2214675; Annot_ID_136640
cagatacacacgcctcaataatcctagaggttaacctcggctgccaaaataaaaagcttacctcaaacatcaatctttcttaaataatgattttacaaggatttttaaaaggggtttaaaaacgttaataatgattttacaagattttttaaaaggattattacctgagtagtagatgcagaatgagaagcaaaaggatatgaagtcgtctcagcctgtaataaactcaatcactgacttaataatgattttacaaggatttttaaaaggggtttaaaaacgttaataatgattttacaaggatttttaaaaggggtttaaaaacgttaataatgattttacaaggatttttaaaacgattagtacctgagcattagggatagaatgagaaacaaaaggatttgaagtaggctcagcctgtaataagcacaatcactgacttaataatgattttacaaggatttttaaaattataacacaagaaggttattgaaaaacctgctcaactgtcacagaaatttgctctacagtcaaacataactgaagcaatcctccactctgtgagaatttgtgcataaaagttgcaagcagtctatcgttcctaatataaagaggatgagattgtatggttgtagacgtggagactaacttgtaactaagcttcaaagaattggttgaactatctatttgaaaatcctctacaagaatatcaaccaacgcgtgataggtaatgtgctcatcaatgagcactaaagaagctcctaattcaatgtctaattcaaattcccaagtcatattgtttgtcaacttccacaaggcacaaacagaatacaattctagcattataacctgataagataaataacaacaaaatcaacagccacaaaaacactgtcactacaaagagaagaaaggtttacaaatcgttttaaagagtaagtaagtagcatagaataatttacaagggattttaaaagctttgaaaagtggttaacatggtttacaaatcgttttaaagagtaagtaagtagcatagaataatttacaagggattttaaaagctttgaaaagtggttaacatggtttacaaatcgttttaaagcgtaagtaagtagcatagaataatttacaagggattttaaaagctttgaaaagtggttaacatggtttacaaatcgttttaaagcgtaagtggcatagatctatcacgaaagcatatgcaaaagaggtaaacactaaatcagaatcaaaatctattacgaaatagtataacgaattcacataagcaaatctatcacgaaacagtataacgaattcaaaaggattttagaacagtataacgaatgtacaaggattttagaaacaaattcaatcatcaaatctcaaacaaaattcaaattcgaagctgaagcaaatgtcaaactgtcgattgaatcaggattcaaataacgaattcacataatcaacaacaaaaatcgaataaaccaattcgaaaacgaagatttaagctaacattataaaatcaaacctgggaaacgtaagagattcgacggcgacacacagctctacttacgacggcgaagatgggttttcacggcgagtaaactcactatttccgacggcatgggattcaacgacattcacaatttccgatggaagaagaagagagagagtgaagaaatgaattaggtctgtgggtagctcattaagggtaatttggggagaaaagtattagaaagggtagaaatgaaaatggcaaaaaagggtagagttgcaaaagggcattgagaaaagggcattagagtgaattattcaaaaattaatttgtgtgttttgaatttatatttctcggatttatatgaacaattcaactagtttaacttggttcaacttattggattagattaaaaacatgtatgtatttgtttccgtgataatttttaatttaattagttgaactagttcaaatgtctattctttggttttcgtagtaacatttaatataattagttcaactagttcgatttagtaacgctaaaatgtttaaattttttaaattgataatttattatacacgtaaaattatatacgaatatctaaagctataaataaataattttatatcaatgcaataaaatttaatattttctaaaaaacaatgttgttttcatataatacaccccttctaatacaaggaacatttagtatatgatcaccttatatgaagtaaaataggtgaaaactaagcttttaccgatgtaatattatgaaaactttggaaatgcaaaataatagagacaaagtgtgagttcaacttataattaattatttaccgtctagttcaactgtaaattatgaaaactgtgaaaagttcaactatgaacacgatggtacaacagtacaactatgagtattttctgccgcaaaaagacaaaatattttttagtggggttcacatgttgagtaaatataaccactaaattaaatccagcgtttttgtagggtccatatacagaatatttatgtttttcttatttttttattttattttttaaaattaaataaaaagtcattcattaatggtgaaataagaataacacatatagaatagcatacagattaaaaaatggcactccaaattcaaatttctggttcaggtgcattcttgactggaactcaaacataagagtggtactactaattttttattttcgaatagtggcataagaggtgagccttcacattttatgttgattttgaccatttttccgataactttcaaattgcctaagatagtttgtaactacaaaatttaattgtaaacattgcctaacatattcacgtaattacgaaattgcactttagaacttccaaattgtaaaacttcggctcccacaggggaaacaaagcgaccgttttgctcatcattatttatagccgccggcgaattgatcggtaaaaaaaaaaacttccgacgtttctacaaagttgcgaatcatg

SEQ ID NO: 25404 - DNA, 3000 bp, Unknown; identical to SEQ ID NO: 13952
  misc_feature (1)..( 3000): 2750-1469P.txt file - cDNA_ID_2705651; gDNA_ID_2214676; Annot_ID_136660

SEQ ID NO: 25405 - DNA, 3000 bp, Unknown; identical to SEQ ID NO: 13954
  misc_feature (1)..( 3000): 2750-1469P.txt file - cDNA_ID_2705659; gDNA_ID_2214677; Annot_ID_136663

SEQ ID NO: 25406 - DNA, 3003 bp, Unknown
  misc_feature (1)..( 3003): 2750-1469P.txt file - cDNA_ID_2705706; gDNA_ID_2214678; Annot_ID_136676
tcttaagattttcagagtttccccattggaaagaaaaacaaagccctcataagatcatgatcacaaaacaacgaaatcaaatgaccaaaaccaaaccaaagttgatttagctgaagcatactatagattaatacgagttgattcatatggatggatggatagctgcagagaagaccaaaaaccgagaaacaagattgatcctcttaagaaatcgaaaaactgaaaacaagattgatcctcttaagaaaacaagcattcgcatcatcggtcactgtgaggtcattgtgaaaatccaaagaaaaaaaaaaaaaaaacaagtatgctttgctaccataaccagagttatatagaatatgaataacgagcaggtaaaaaaaaggtaaatccagaacaaagctatgtaaggtgaaaaacaaattgggtccaagtaccgatgaccaaaaacaatcttgaacttaggcaagaaaacttggcaactgatatcaaaatggactcttaaatacaaaagagaaaggggcgacactaccataaaagaggaatgtgatgaaagagattgagaagcttataaaaacctatggggaagaaaacaatgcttgaaggaaagaaaactcaggttgtttattccagagaaaatcaacttgaagcttttgaaagagtcccaaaactttttccagtactcaaaaagacagatttaaaacaagaatgtaaaaccattatgtctgatcctacaaacgggtctcaagacaactgcagctggaagatacagacttttggcagttatgacatatagtggacaaaactataaatgtcataagcttcttctccagctatagcgaacagatattcaatgaaaatgcgggaaaacataaaaccaaaaacaaggaaaaacaaaagagaaaaacatacgccatgccacagaagaaaaccagacgtgagtttgatgggtaaggagaagacagaagaccataatgggggactccaaaagggaaaacaaagagatagcaaactactttaaaccaatattgatcctagtaactaaatcttctagacaaaatgaccacatttcactggtttatgagaacagagcagaacaccaatgacagacttccagagagcaacagaaaattcatcctttgagcacacatctccctcaaaatggctcatataggggtagatacctcgttaaaagagactataaataatgaaactaaaaaagtaggtttgaaacatcaggcatagaaaataaagatccgcaaaaaaaactcctgcaattcccaaaatatcaagttggagtcgaagataccggactaatcattagcctaatctataacttgaaatatcagagaacatggtcataccacttgggttctcttatctcagataccaagcacgttcaccatcaaaaccagcaccagcaccagcacccgcaccaacaccgttaacattaccatcaccaacatattgtcccaccattcccatatgattcggtggcatcataggtccttgattcatcatacccgagccaaacatacgataattctgtaaaccagcaaccatcggattacccatcattgcaccatacataggattaaaaccaggaggaggctgagaatgtccataaaagggcatgttctgtccagcatacattgacatattctgctgctgctgatgtcccttatcaagtccatgacccaaatcaatcccaggcaaagccatttcactctgattacccgtatgactcaaatcaatcttcacagactcaaccggttgttgttgttctcgtggctttccagaattaaacggcctagctggtaaacaactaacagttcgattatacattctcttctccggattcttcaacgccgctctcgctcctttacgcgtcttaaacaacacaaagccaaaacctttagctcttcctgtatctttatccataaccacagaacattccgttatctccccataaacctcaaaagccgccttgagattctcatgcgttgtatcccatccaagaccacgcacgaatatgttccgttgagaactatctctatccgctgattcaaacactgctgagatcaatttagaacctttctcagcagttttgtaaattaggttaataagctcctctttagagtaagattcaagtagattcttaatatcttccttatcgaattcgaaatcagaatcagactcaatggtaacaatcgggaccgtaacaggctttgaatcgacgatctcttcggattcatctgatgatctcttatgtttcttcttactctccttcgatttcttaggagatggagatggagatggagatttctcctcttcttctacttcttcgtatttcttcgatttcttctttgatttctctggtttctcttcctctttggatttcgatttatgtttttttgagattttcttctctcttacagcgagttcttcagcttcgcgacgcttcctctccttcctctccttcttctctttcttctccttcttacgttcttctccttctttcgccattgttgacggcagtggctaccaaaaaaaacactctgaatagagtaactcctctaaaatagggtgcaccagagaacactagattatttaagtatatttataataaagtaaagagtctaacaaaaacgtctgggtggtgtagtcggttatcacgctagtctcacacactagaggtccccggttcgaacccgggctcagacatgcttttttttttgcaacacataatttttttttttaacatgaattagtagaggggcaaaaacgtcaaaatacagaaaaggaaaaagatacaacatttctggtttttgtgtgccggcgaagaaccggtgagtgacgggtcaattcacatacttgtttaacggcaacaaaaacctaccgataaatgctaaactaacgaaatcggatcatagctcgacgaagtctcgatcttttctattctctctttctgggtattcgtgggttttacccagatttcgaaattgaatg

SEQ ID NO: 25407 - DNA, 3003 bp, Unknown
  misc_feature (1)..( 3003): 2750-1469P.txt file - cDNA_ID_2705709; gDNA_ID_2214663; Annot_ID_136538
aaatatcaaagagttcttttactctcacttatgacacgctaaattaaaaccactaaaaaccataatattaatttcacggctacaagttgatgcttcctcaaacttactacgttccaatgccgggcactgattaaatatggacttcacatctttttttttttttttagatattcatttccaaacggtctattgacagatgggctaagaatttcacgggttacaaaaaagtggtccaaatcggaacataatagaaacaagatcagtaaaacgacggttcaccggccggagacgcagccttcaccttctatatccgatgcaaatttaacatatttcgaacgaatctatgagatctatatgagaattttgcttcttgggttttatacggttcgggaaagtggatgtatcaagttgtgacaagaagcatcaaagaatatgactttgtccagtcatttttatggtatagtgatgatcgtcaatgatcataattggctaggaagaaagagcacatgtgcattcatatgattatcataattgtgcatatcatatgcttttatgggcatagttgtcgatagaaacaaaacatgcgtcgaggaaaaaacaaaagaatagttaaaacttagaatctttgattctcatgagccatgaggccatgtgctttttctctcccacgttatatgttttaccatccttataatttgctcccccgacttctctcactttcagacgaaaagaactgctgtcgcgatttttgaacaattatggaaaataatttagatgtgaaggaagccgtaaaaatagttattatactttttgtccatatatatagaattcgtgatgattatgttgtggatgacaattggtggtagatagaaacctttactatcgccattgttatgggctaattaatcaagtttggtaacaaatcaacataataggaccaataacaacaactactgcagatcttactattattctttttattaattcatcagtatattttattattttttcttgattgtttatccgattgatcttgtaagagataacttttgattattacataacttacttcaacatgttaaatgacacaataaaatagacaatttatttttgatatccttttgaaaaatattaaataaatatttgtaatgactgtgttgcactaaaaaatcgagataaccccatgagtgataatttggtaacataatctaaacttagagacaattaactaattaagttattatctgagaaataaattagacaatatttttattcgtgtgtgtaatttttgtggtataatattttttcttatattgtttcaattctacggatgttttggataaaaaggttaatcaaatttataaaatgtaaaattttgcttgaacaaatgaaccaaaatgtttactaattggctaattgctggaaaaaaacagttatataatttttgttaacaaaaaaaatgtttgatgtaaataattaattcacagctaaaagtcaatttcctcatttatttttgattaaagaaagtaataaaaaacaattaagtataccattcgctgtacaagagtcgtttagttctgtcggctcgacaaccgactcaagccggctcgagtcgctaagtgaatccactcgctgtctgtcggtggacaaagccggctccaatctgatcactctctctcaccagcacacacacagctctctctcttccctctctctctcccccgctttatactttgttgagtcaaaatcacagacgaagaagaagaagaaacctctctctcactcctctctcctttctctcgtcttattcgcttctcttctacgtaacagattgttcatcttcttctccttgttgcattgaggtgagttcaatttgatctatcaatgtctaaatgcatgctttttgaattatcggatctcttgtgtttgatttcattgatagagatccaattatgatctagatctgaagaatcctgttttttgagttcctattggttaaaaagtttcctcatttagctttagttcgaatctggaatgttaaacgattcggatcgagatttagcagtagtagaattcagttaggtagagtgatatttttatactattagtcttcaattataatataattgcattgagcttttcctacttcactgtatcgttttctattgtaaagattgatcctttttatatattatgcagggggtgttgttgatgttctgacgatctgatttgagtagatctgggtagggggcaaggtctctgggtctacttttgatttgagaattttttaagtgaagtgaagatatgacaagtgctcttggatggagatttccttccactaatggaaatggccttgccccaagtgacacggtaataattacttgattcagtattaacattcatcacacgggtttatggaaaagcttgtttagttgatatactgcaatctttctgagttgcaaagtcagatctggtgtattagcaggatgattaagctgatatgtcccttgcattttgaatctgatttgaaaaaagtacttgagctaagtccattgttaattaatggctttgtaccagtcagttatatctgatagagtgtcatgataaaggttatagtttttccattgcataggagcgaaaaggtcttgttgctcttttaacttattttctgttgtttggtcttgattgcaggagagaaatggggatatgaagatgcatgattcagagcccccaactccacattcaaccacaaagatgagtttgaggtaacgcatatatgtatttggtactgcatgggagctaatcatcgtgataaaattgaggttttatctgtatttgttgcaccaccatcttggtttaacaatgcctgtggaaattaatattatctggattggtttcctatgttatcctttcaaatgagacattttaagcagaaaggcacacctattagcgaattagtatctaactttccccatcccctgcagagaccggacaaccagcatg

SEQ ID NO: 25408 - DNA, 3000 bp, Unknown
  misc_feature (1)..( 3000): 2750-1469P.txt file - cDNA_ID_2705740; gDNA_ID_2214683; Annot_ID_136699
aaagaatatggaggagtcctcttccacctttggtaaacttatctagtaatttatataaaattttttttttttttttgtaatttgagtattactatgtttattataaaacattttttaaaatttttcttaaaatattatattttatttaatgtttttcatacaatataatccaaaaggagacaatatacacacttttctagattttatacacataaaataacacagtaacatattaatatgttattttatgtctataaaatacagaaacttgtgtttgttatatggaatatacagttttggttgtaaatgttgatttaatacatgaatagacgtatttctctattcaaaatttatacttaatgagctttctaatttgttctcaaatcaaaggcattttatgtaatattttataataataaaggtttatttttcaaatgttcttcaaaaatacttatatagatgactttgtcaagattattctagaaccaaaaaaaaaaaaaaaagcgtcaaaccgagtcagattcctcttctagtcaaaaattataagaaagtttcaaagaatgaaacattatgttcctataatacctttttgtttaacattataagttttttaatcattaagatcactaatattgatcttggtttcttttctaatgattttttcataactttttaagatatgtttaagaaatttataagaatttttagtaaaaaagatttatttttaatactgtcgattcaaaagaatataaattatttagaaatatttaaattttatattatttcaatactactatgtttattataaaaaaaaaatctcttatttttgcttaaaatgttaccttttattcaatatttacttcatacaatatagcctatatatatataaacacattactatgttattttatgtgtataaaatacagaaaattgtgtttgttatatggattatacagttttggttgtaaaatgttgttttgattcatgaatagacgtatatctctattctaaatttatacttaatgagctttctaatttgttctcaaatcgatggcattttatgtaatagtttataataataaaagtttatttttcaaatgttctacaaaactactaatatagatggctttgccaagattattctagaaccaaaaaaaaaagaaaagtgtcaaacctgagtctgatttctcttccaatcaaaaattatgataaaatcctaaagaatgaaacattgtgttcttataatacttttttgtataatattgtgcgttaaatattattttgtatgaaacctgcaatcactatgtatgcataataaattattttttatgtctatataaacggtcgaattcatttgatataattcacaattgacaatttcaattacaaaaaataataataacaaaaaatttcacttttctctcattttatttcagtatctctatataactgccgcttttaatttttttcttatttatatttttatctactataaactaaatctttatacaaaatctctctctgctcttgccgccgcttagtgaaaaattccagatcggaggctggagagtggtggctttcatagcaccggctctgacctctccctagtagcttaattttgttttagttcttcgttttcttcttgttgtggctttgtttggagaaacctttctccgaagttggagtttgtgttttcttcccatcttatttgcagaatttcagatttcgtttggggaattgtttagtttgtttcgattcttgagattgggtgtgttgaggaagcggttagagtggctagatctgtaagggtttctgtttacagtaaaattgatgatgccggatctattcgatctacggttggttcgatgaataatgccattgtattttgcttgttcctgtctcagttctttatgcctttctcgggtcaatctatgtttttgccgttggtgtggtttggttgttggttagcgtttgcgccgttcaccatttgtttctcctttacaccccggtctcgtcgtatcagcttgcagttctcttttggttctttccctttgtaggcagaggcttcgtttggtttgaagttgtgaattttctctatgtttgcagaatctcttctccttgttgtggttccctgtgtttgatggctggctcgagttttcgtctttctcgcttctgtgagtggtgattttcgagggcttatgcttcgctccttgtccttgcttttcagatctgttgagattggatcgcgttttgaaggattctaactagacgtccataggcgtatcagacgtcatcgtcacatccagaagcttgtttgaggctctcttagtgtttttgcttgctggattatgatttccttggttcttggtttcgagagattggctctcatcgtgataggaggtagttgttgttgtctttgggtaagcagggggcacccttgatgaatctcttttgcaggagttccaggagaagatgtttcctaggtttcaaacctatttgtgtttgttctatgtttaagggattgccctctttcgaaactggtttgaaatttcttgctttgtaattctagttgtgatccttgtttccctttgttagggcctagttttcggggaagtttcgttttcctccggctcttgtctccggggactgtttcgttgtccgctggctttagcttcctttgtttgggcatttgtaatctcaccataatttcatatcatgcttttcaatgaaattcaggtgacaaaaaaaaaactaaatctttatatataacattgtctattttatggtagaaactccgtaaaagattgtaaaaattatgctaaagaaaaagatattctgttggaccaaaaaaacaaagaatgaagaaaagaaaatattctcaatgggccgttaggtagcaaaagcaaaaagcccattgcaactgtgaagaatagacgaagccttaaaagaacaccaattcgctactttactcttaaaataaactctccactaaaaaatatg

SEQ ID NO: 25409 - DNA, 3000 bp, Unknown; identical to SEQ ID NO: 25408
  misc_feature (1)..( 3000): 2750-1469P.txt file - cDNA_ID_2705740; gDNA_ID_2214683; Annot_ID_189296

SEQ ID NO: 25410 - DNA, 3003 bp, Unknown
  misc_feature (1)..( 3003): 2750-1469P.txt file - cDNA_ID_2705769; gDNA_ID_2214686; Annot_ID_136712
tgtggggagaagcagtaaggcactcaacctatatcatcaacagagtaggaacaagatctttgcagaaccaaacaccatatgaagtttttaagcaaagaaagccgaatgtagaacacttacgtgtatttggatgtattggttatgccaagattgaaggtccacatttgagaaagcttgatgataggtcaaagatgcttgtttatcttggaactgaaccaggctccaaagcatatcgtcttcttgatccaactaaccgcaaaattatcgtaagcagagatgtgtactttgatgaaaacatgagctagaagtggaacaattcagattctgaaactcgggacatctctggaacattctcacttaccttaggagaatttggaaacaatggaattcaagaaagtgatgatatagaaacagaaaaaaacggagaagaaagtgagaacagtcacgaagaagaaggagaaaacgaacacaatgaacaagaacagattgatgctgaagaaacacaaccctcacatgctactcctctgccaacattaagaagatcaacaagacaagttggaaaaccaaattatttggacgattatgtcttaatggcagagatcgaaggcgaacaagttctattggcaattaatgatgaaccatgggattttaaagaagcaaacaagttgaaagaatggagagatgcttgcaaagaagagatcctgtcaatagagaagaacaaaacttggagcttaattgatcttccagttagaagaaaagtcatagggttaaaatgggtttttaagatcaagcgaaattcagatggcagcataaacaagtacaaggcaaggttagtagcaaagggttatgttcagaggcatggtattgactacgatgaagtatttgctcatgtagctcgtattgaaacaattcgagtcatcattgccttagcagcatcaaacggatgggaagtacatcacttagacgtcaagaccgcttttctccatggggaactaagagaagatgtttatgttacacaacctgagggcttcacaaataaagacaatgaagggaaagtctacaaattacacaaggctctttatggtttaaaacaagcacctcgtgcttggaacactaagctgaacaaaattcttcaagaactgaattttgtaaagtgttctaaagaaccatcagtgtacagaagacaagaagaaaagaagcttctcattgtggctatttatgttgatgatttacttgtgacaggctctagcttggatctaatactctgtttcaagaaagatatggctggaaaattcgaaatgagtgatctgggacagctcacgtactaccttggcattgaagttctccatagaaagaatggcatcatattaagacaagagaggtatgcaatgaaaattatagaagaagctggaatgagtaactgcaacccggtcttaataccaatggcagcaggattagagctctgcaaagcacaagaagagaagtgcatcaccgaaagagactacagaagaatgattggatgtctgagatacatagtgcatactcggccggatctctcttattgcgttggtgtactaagcaggtatctacaacaaccgagggaatcacatggaaacgcactgaagcaagttctaaggtatctcaaaggaactatgtctcatggtctgtacctcaagagaggattcaagagcggattagtaggctatagtgatagtagtcatagtgcggatttggatgatggaaaaagcactgccggtcatatcttctatcttcatcaatgtcccattacatggtgttcacaaaaacaacaagtagtggctctttcatcttgtgaagcggagttcatggcagctactgaagcagccaagcaagccatatggttacaagacctattcgcagaagtgtgtgggacaacaagtgagaaggtgatgattcgagtggataacaagtcggcgattgctcttactaagaatcttgtctttcatggtaggagtaaacatattcatcgaaggtatcatttcataagagaatgtgttgagaataacttagtcgaagtggatcatgttcccggagttgagcaaagagctgacattctaaccaagccacttggaaggattaagttcagagagatgagagaactagtaggagttcagtgtgtgttggaagatgacttcaagcttaaaggggagtttgttgggataagcatgaagtcaataaattagggaataaaagttatgttttaaaataggattaagataaatctttaggagtaatctaaagatatgttaggagttatctacatcttattctattgtgtttgttatcatccctctcctatataagagttgccaaagttgtggtaaaccttaagagatttgagagagagattgaaagctttgttttgagttattttcaaagctaataaaaggagtgcttttatatttgatctaagtattcaaatctttaaagttgtggctaaacttcagtttgtgtttgcttttgtttatcaagattgttcttagactttttcgagttaaaaaacttgtgtgttggagtcatcatcgtgatcaatggaaaataaagttgagaaggagattacttgggtgattaaaaatttctcttctctgcaatctgcaacaatatattctgatatattcgttgttggtggctgcagatggtaagaagataaattgttttctaatatttttcgtctaatctacggtttacagataatattctttgattgctttcttttgtttttgcttgcaggcgttgtcaggccttccccaagggatataataaggctgattatctttctctgtatctcgacgttcctgataaagaatctttacctattggatgaagaagccacacaaaattttcttttactttagtaaataaaatttcggaaaaactctccaaacttaaaggttattggtctctatgcttgctaagagtatacctcatgtcatattttctggttttgttcagagataaaatatg

SEQ ID NO: 25411 - DNA, 3003 bp, Unknown
  misc_feature (1)..( 3003): 2750-1469P.txt file - cDNA_ID_2705789; gDNA_ID_2214687; Annot_ID_136719
tgtggttggctttgttgggtacccgaatgtggggaagagttcgacaatcaacgcattggtaggtcagaagcgaactggtgtcacatctacccccgggaaaacaaagcatttccagacattgataatctctgaggatctaatgctctgcgattgccctggtttagtcttcccttcattctcaagctcaagatatgaaatggttgcttctggagttcttccaatagaccggatgaccgagcaccttgaagctattaaggttgtggctgaacttgttcctcgacatgccattgaggatgtgtacaacatctctctacctaaacccaaatcctatgaacctcagtcccgcccacctcttgcctcagagcttctaagaacttactgcctctctcgtggttatgttgcctctagtggactacctgatgagactagagcagctaggcagattctgaaagattacattgaaggtaagcttccacattttgcaatgcctccagagataacccgagatgatgaaaacgagacagcggatgacactttgggagccgaaacaagagaaggttcacagactgagaagaaaggtgaagaagctcctagtcttggtcttgatcaagttctagatgatcttagctcgtttgatcttgcaaatggacttgtgtcttccaaaacgaaacagcacaagaagtcacataggaaacaatgattcggtcttgatggaacgccaattctgagagttttcctgaaaccgatcaacaaatgctcgaatatatgatacagttgtggatttttcttattgtagaaatcgtgataacattctaacagctgttgtttagatattatgtttgagcaaatactagtgatatcgataaagtttcaacttgatgctagtcaatatattgatgaagagtccttcgaagcaggtttggtagttgtaatatattgccattgagatattatagatcactcactcattgtgggtttgtttgttttctatttgtgggtttgtttgtttttaaatatgtgtaaaatcttggcctgttacattggctttataccataaataacaaaaaaaaaaaaaaaaaagatcactcattcatatgcaaagcaactcaaactacaattttcatttcccagacttttattgtattttttcaatttaggaatcagacttttgttttagacaaaaaaaaaaaagaataaacattttgtaacctttatattctccagcatcactcttgtactaaatcaatgcacatgcaaggttttctcaccattgttgatattttcattttttgctctatttcatagctttggactttggacaaattcaatagattcctcaagctttgtcacttcatctaaagtatgtcatcgccgtcttttaatgagcaaacaaacatatcagtaaagaagtcaacaatttatttgcaattggctcaaatttgagtagctcaactcttctaactcagaattttcctaggttcttcattgttttaaaaaaatttggcaaagggaaactttactgattaagctctttttgtagttaattacaaaccctctgaaatttaaattcatatataaaaaagtgtaacatccagattgtacgcaatgatgaatgagtttcattatttccattatattagtcatttttcttcatagattatttctaaagcttccaaaactgaaattggcggtttgtacgaagttaatctgaattgactaatgtcgtttctgttgtagatgacattcaatgcattagaaatcctcatttcattacgatttttcttcaccattcattgtatatttattcatgagcaatattgtttattccacttttatgtattgtaacatggatattattagcaatattttgatgatggagtttcatgtgttatattcatcaatgaacttaaaattgactgaattcttactttctagtaaatgtagttactgccatttaagaaccgaggacatgtgaccgaacttttcttctctacgtggttttatctagtctcaactctcaatttggatgatcaaaaccaatgtaaaagtcttatagcacttattggtgaccttaaattcgtaggtacattactagattctgtactgtaagatacatttctatatgttactgcctaataaattaaaacatttataaaaatacgatacaaacatttgaaagggtacgatgtcaaaaaaaaaaaaaaaaattttgaaagggtacaaactctgagaaagtgtgtcaaatacaaatagttttctaaaaagcgtatcaattatcatagtataaatcaccctttataaatcaccctaaattttcctagaaaacactacaatttgcaacatatgtctctcacaaatccaccattaggtatataaaataatcaacacaatattttaagctaactacacattaccaaatcagttcagtttcatgcgtattgtttgcattacataaatgatgaaacaatttcttagtacaagactatatatagcttcaatttcgttactcaaatcgaaatagataattgttttatttcctcaaataatttctgttgtttttatagtaattaagtaaatgataaaaatgatttaataaatgtaattatcttagcttaaagagagagagataaataaacaaagggcaagttttttgattgtttggtgttgagtgtctctctgtccttattcctcaacaaaaaaaaaaaaactgggaagaagaaagaacaaactcattttcaaattctccgaatctctctactccaattaacttttttccgggaagatctcaccggagaaaagctagctagggtttctccaccgtgaagattctagaagcgagaatttggaatttgctaattaagaagatgtgttacgatctttcttaattaaaaaagcattgaaattgacgaatttagggttgtgaaaaatatggatttggattcttcaatggtaccagagaatgatcaagatcctattgctacgtctgagaatcaatctcctatg

SEQ ID NO: 25412 - DNA, 3000 bp, Unknown; identical to SEQ ID NO: 13991
  misc_feature (1)..( 3000): 2750-1469P.txt file - cDNA_ID_2705793; gDNA_ID_2214688; Annot_ID_136720

SEQ ID NO: 25413 - DNA, 3003 bp, Unknown
  misc_feature (1)..( 3003): 2750-1469P.txt file - cDNA_ID_2705826; gDNA_ID_2214692; Annot_ID_136740
attttgcactgtggcgggattttttcgtgaaggagcgaaataatttgacacgtatgggaaagaagagcaacggacggaataatggattgtgctcttcaaatcctgaccgtccatttgacacgtgtacctgagcttgcagatctcgcccttaattacattcataaagttcttcaccaattgacgcatttgctttctaataaaccccaaatattgtttgaccagaagagagaaagataggaaaactcgaaccgggtttgaccagatcaattagatttaaccggtaccggttatttacattttttttcccctgtaaaatattcccctcccctcttttctctcatcgctcgctgcctttctctttcacagtcagcgctcttgaacggagaatctcagtcgcgccgtcaactttttgttgagaagagatatcatctgttttcgatccaaagaatagaaagcttggattccgaaatctccctttttgcttccccaattcgttttcctttacaagctcggcgcttgatctcgctatctctcaggtaggatcgagctatatacaacagtttctcaattttactagatataattgctttagattttcaagtgctcttgcgtttctggggttttgttaagattggagtttttgtttcttattctcgaaatctgttgattgattcgtttgatccatcaatgtttgtttagaaattcaaaaagcatgcaaatttgcagattctttgtttgccttgtgcgaattctatttccgtattccgtatcgaaactaaaaccctgactaggttatgtttcaagtgtgttttttagttttctatttgagggatattttaactaactccataagtttggggttttgtgaacagccaaaagtcttttctttcgtgacatcagtttcttggtaaaggaattcgatttcttcacctaatagagaatttattttagaactttggactgatatgttgaacattgatgctgatttggcagaaatggatcgtttgatatgatacgtatctacatttgtagaactgattttttcacctagaatttgcagcaagtaagactagaatgaataaaggggaagcttgtattatttgttgttaaatgagttgttcaaagagctttgtttgatatcattgttgcttctttgttacatgtggatagtttaggatgctacttgttaagtagtaagtactgttaaggtgtgtagaacttatatttcactgtgaaacgttggagtaggttgccgtttgtgccgttagtatatcttgttttcgccttttactgacaagacttatgaatgttttgctttcccgtagagagctgagagctgaggatattggaaatttggaaggtggaatctcaaatggctgaacttcctggtcaaataagacatataggcggtcgaatgagtcaactgctagagcagatatatgggttttcgagaagatctttgtttcgggtcatatctatgggtcctataccttgtcatattgcctttatcatggatggaaatcggagatatgcaaagaagtgtggtcttttagatgggtctggtcacaaagcggggttttctgcgcttatgtcgatgctgcaatactgctacgagctgggtatcaagtatgtaacgatatacgcatttagcatagataattttagaagaaaacctgaggaggttgagtctgtaatggatttgatgctggaaaagataaagtctttgcttgaaaaagagagtattgtgcatcagtatgggattcgggtctattttatcggtaacttagcgcttctaaatgaccaagtgagagctgctgcagaaaaagtcatgaaagccacagctaagaatagtcgggtagtgcttctcatttgcattgcctataactcgacagatgagatcgtacaagctgtcaagaaatcttgtattaacaagtcagacaatattgaagcatctaattataaacacgaggatagcgatagtgatatagaaggaacagatatggagaaccaagagaagaagatacagttggtggatattgaggagaatatgcagatgagcgtggcgccgaatcctgatatactcatcaggagttcaggagagacgaggctgagcaattttctcttatggcaaacaggtaatacccagctctgctctccggctgctctgtggcctgagattggtttgaggcatctgctctgggctatattgaacttccaaagaaatcattcatacttggaaaagaggaagaaacaattatgattgtcttgaaaggagactagtgaaggatatacaaaagctctcttctctatttggctttgtaatgtgatgtgatgctcttgtggtatactatcaaaaggaaacttgggattacatagaacaagcaatgtattttacacacgaactcatttgagtttttctttatgaatccttaaccaaaactccaaaagtcctctctaaagacatcttacttcctgttctgtcttgtaagatccagaatcttaacatttgtgtttcacgagtgtttttttctcaaaccaaaattaaaccaataaatttagttcgttaatggttcagattgattgcatatatcatggaatttcggtttagcgatattaaaacaaggaaaaccgggattggtatccaaaaccgtaccgggcgtcaagtctggttcggtaggttagagtacacgcttgtggcgaacttgcaattggaaacctaaaaagtcgcgactatgctctctgcaaagatggttctacttttggcttaaagagcaatgttttcgagtctttgccatggcgggtttcattaaacgcaaaggcaacgtattttttcattctcaagccttagctgctgtctactccaaggtgggtcattcctcctctttggattctttcgtttagtagattcatttctctggggcaattgatcgaacacttaatctgctggtttcttcttgtctctagttgcagagaagtaattgcacgcttgctgagggattcatg

SEQ ID NO: 25414 - DNA, 3000 bp, Unknown; identical to SEQ ID NO: 14019
  misc_feature (1)..( 3000): 2750-1469P.txt file - cDNA_ID_2705830; gDNA_ID_2214692; Annot_ID_136737

SEQ ID NO: 25415 - DNA, 3003 bp, Unknown
  misc_feature (1)..( 3003): 2750-1469P.txt file - cDNA_ID_2705834; gDNA_ID_2214692; Annot_ID_136732
gatatcataagttctaatgagtaatgattggtcaatttatcttgttgtaaattgttcaatatacgtgacgtggtccacttctatcctccaagactccagctacacaaagacacagtaacacaaacgcatacgcatatgcatgtgtcgtgtctttgtgtgtgtatgttgtatatattaatatattatctaaactataccattttcatgaaatttataatatattttctcaaatgatttaagaagataatgatatgtttacgagagtaaaaaaattaatgatcttccagtaatcaataaatatagtaaattgatatcagatcttgttgccaactatagaattgaacaaaatacaaaactgtcatcgccatgttatattatcgtaaagccagcttatatatccttccccattggtgttttttatttttactttgtttggtgaatattaaagcgcttaaaacacgttccaacagaataattgtttgacctttttagtttatctgatttttaatatcaattcttaaaaacatctcctcaatctttgcgtaatttgtcttttcctaatgcatcggatagagatagattcttctgagttcttgcatggttcaggtactttctattcgtttcttaatacgtgttctttcttttcggatgaaacataattcatcgatcgatcgatatgtataagtctgataaaaacttgatcgttgcttttgatcattactagtaaaacatctcaataaatcacataacatgtttcacgttttgaatcggtttttcagccttgttgtttcagatttgattgatacgaattttaatcattattattgcaaaaattcatatttaaatttgagatgtttttataatatacatgcttaagattcataccaataattaagttcaataatctagatatggtttagaaactttagatatatagagatgctgatgacatgatgaaggtgatgatcgattgatcgtttattcatttgtcatatatatgagttgtaggaaaaacatcttatgaatttagatccattaaatacgcttatatgcatgtgtgcatgttcaatgtgtagataagttctattctgaataaattgacgaataacaattattgatttcaatttcgttttgagtgtgcatgtcatgtgtctgagatatgggaaaatgaaaaggaaacttccctatatataccgaaacaatagactatcaactttgatctatatatacaaattgtagaaaagccttggatctaactgatatttccttatgtgagatacacattaatgtcttttgttttgcttcttaagattaacgtgttatatattatctctttattttaaaacatgttgaccaaaataatttatgtcttacgtgttgcatatgaaatagatccaatcgaatcagcctcccatatcttgaatctttgatatttggggtctaccattgatatgatttactttgttaattacttgatgttaatatttcattttttcttaagaaattgtaaactaattctttacatatatgcatggcaattaacttagtcaacaggttcaacattttataatgtatccagaatcccagatagtacctgtcctgataaaaccttttcaggatctcatgatatttcttaaaatataacagcttagtgattttaaataacataaaaattagccgacaaaaagaaaatatcataatataattctgaaaataactaataatttactcttttcaagtaattattcaaaataaatttagaaaactaattcaatgtatttcctcattgtcactcttttatttccctctacaaaattatatatatgaagtagttttttttaaaatagagccccataactaacattaggggtccatatatttgcattgtaatttataaacacgtgtagaacattataattatttaaaataaaatttagaacaataacttaatgtatttcctcctcgttagttttcctttttttccctctacaaaattacatatatggaatagttgttctttacttcttttaagtagagccccttaactaacacattaggggtccatatatttgcattataatttataaacacgtgtagaacctggcactgaagtctgatgaatatatatccatttgttttcacaactaccctagctttttgtatcatcggttactttttttttatcacaagaaatttctcgattttgattttgatttttcaatgttgtgaagttgagaagttcaacatgttttggacagatgtttttgaacagtaaattagtattttaaacatgtgaatctatttgcaaacgtaatgacgtgtcgtctgaccatttcttgaatgttagttaattttttagctctagttttgattaatctaccaattaggtcattcatttcagtttaagtcaaatcaacaattaggctcgtcctaacgttttcatttagccaaaacaaaaaaaaagatttcaacagtataaataattcgtccttatcaaaaaattaataaataaaaaagatatacatcattacttacgtaattgtttgtattttgatagttttcgataatttctatgtgacggtttttaaaataaaaataaatgttgaataacaaaaaatagtagtacaatagaatactgaattggtttgtgtagggtcaaaccaacaaatatggaaagaaaagtattatttagttacaacgtgaaaacacaggttcgtgctactactccaatgatacgggtctcaaaatactcaaaactctggcatgtctcaattccacaaattattgtttaatcattctgcttcttctgtaagtttatatataaatgtgtatatactcaacgtaaatatttgcttacctcgtatattttctctcttctcaggcttattaattctctgcagataactgcagaagaaagaagaaagaagaagaagaagagattagagcttgagccataatatataatcccttgatcattagtctaaagaaccacataaaaagatg

SEQ ID NO: 25416 - DNA, 3003 bp, Unknown; identical to SEQ ID NO: 25415
  misc_feature (1)..( 3003): 2750-1469P.txt file - cDNA_ID_2705834; gDNA_ID_2214692; Annot_ID_189413

SEQ ID NO: 25417 - DNA, 3003 bp, Unknown
  misc_feature (1)..( 3003): 2750-1469P.txt file - cDNA_ID_2705845; gDNA_ID_2214693; Annot_ID_136761
attcttatcctctgtaggcgataagattgtgaagatctgtgaaggcaagtctcgaaagttgtcacctttatgtttcctttggaatttgtcttgtctcgaaacaaagagatttgattgattgttaaaatctggattcgattttgtattttgcagagtatggctactttgaaagaaatgaggtcagtaatatcaaagctaaaaacattcagggtctggaactagagctgacatcagagcgtcttcaggaatatgacttcaactctatcaaatccacttgtttcaataaagaggtgcgtgcgtgcgtgttataagtaacattgacgaaaattttcacgattttgcttgcttgcttactcttttactcgttattggtgttagattgggatcttgtataagcttaagtatggggaaataggtgctaagttgatatccaaatcatcccgtcctatggctcagttcactggtactgttagacacctcggtaaactctctggtttggaactcacttccatgagtattgttgacattaacggacacaagctcgataagtggcatgttgggctcactctcattgcagggaacgcctctgtgcagattagacggttagtagttttaaaacgttgattcctccacctcttatagaacaataagcattgtgtggtgaattctgaatatgtttcctctttgcagagaggctgatagatacgttgtttcaacccgccatcatattcacccgagatttgtgtcgctcactgagctgagatcactgtatttctggcgcatatcactcccgtccactgtggcgatgggattcgagttcgagcttaaccctaggataactcttgaagtgatggtctccgaatcccatcttcaacctccgagtgttgcactccaatatcaatgttcaagggctcagtgtctcattagagtttacggtgatgtctactccaaaaaaaatggtgtatcttttgcgtttcgtccttcttctttcgtctagttactcggatttttaccctcaaattactttttttttacttgttggcctcggctagttattgggccaattgtttctatagtgggccgtgtattacagacagacacacctaaacgacgacgggtcgagaggataaataaatgggaatattctcggaaacattgatgtgattccaaatattttattcccaatttggtattcttcttcatcatagctcgaaaccctaactccccacttccatcgaccatcgacatgttttaatcttagaattgtgaccaataaggtgatggatacatttcaaggcaagtccgaaggcctggaaccacaattggcatcgaaggatcttcaggcgtcgaagccgataatttcatcatcttcttcgttatcagagcgtcgatacaagagtggtacttttcttttctccaattctcgatcatacttgaatcatatgtgtttcgttttgctccgaatttctaaatcaatcagaattacgtggttatgtatggctgatttgttagaattattagtgtagctatagaccaagattttttcttactcaagagttgtgattttctctcgcaggcagaaagatacctattattgctattgaatgccgtagatgcttatcagtctcttctccggtagttattgccgacccttgcatgcacagattctgcggttaggttcttctttactctttctttaacccactagctaatgtgtgtgactgaaaacaatcagggtgtttagctttgtcttattttaacacaaacccctgattctggactaacttattaccctaacaaaattgtctttttttctttcttaatgcaacagtgaaatgtatcttattcctctggggacgccagaaacgtagagaaccttgtgtatgcccccttgatggagaaaagatgatttgcttacatcctcctatgaacattgccgaatctgcggctgaggagattactggccttgtcgacgtttataatcctatgttcaatccacgccattacatggtaattaatcagttcacctcctaatcaattgaacatgctctaatattcttagtaagggagtagttattaatatcttttctaactctctgcttacgaacattatgttgtttcttctttgaacggaaaatcattatgcatttttaggacatggccgagacacaacttggtaagttccttgatatatgctttatgtatagatgtttttagactttgttttgttgaacctaactcttttagttacacgttttttttgtagcgcggacatttacacggttttactgtttggatctcactctcctactcatgggggcacttgcgtactgcttcaagtgttctaaagcctcccgcacttagaagtctctattttaattctcttggaacgactttatgagtatgttataattaaactattttaatcctgaattctggttatggatctgtgtcattttggtcaaactcatcatgtctttttctccgatatccatccattcctaaccttgttactattatctatcagtctttttgataattaatacaaatgttgatatgtagagtacgacgaatcgtaaattgtaataattgtttcgttttgctgtaatttggctctatctttatacattagaagagataatcaaaaaagagataaaaataaagccaaaataaatgtgttttttttgcgctggtcaaagaaaaaaaaagaagtccaaatgacagttatacccctaataacgcaccatgagaactcagacgattaagggtgtaatagtaataacaagaagtgagtctccggtctgaaactaattaaggagacggcaagagaaacaagacatacgtttgctgtcccacgttgatcttgttgtttactctctctctctcctccatcggcgacgaccaccggagatcagcgtcaccgtaccaaaacatcatttaccttcttttagatttgttgttttttaatcagttgaatcggaataaaatatcgcatcagagatg

SEQ ID NO: 25418 - DNA, 3003 bp, Unknown; identical to SEQ ID NO: 25417
  misc_feature (1)..( 3003): 2750-1469P.txt file - cDNA_ID_2705845; gDNA_ID_2214693; Annot_ID_189451

SEQ ID NO: 25419 - DNA, 3000 bp, Unknown; identical to SEQ ID NO: 14038
  misc_feature (1)..( 3000): 2750-1469P.txt file - cDNA_ID_2705859; gDNA_ID_2214694; Annot_ID_136766

SEQ ID NO: 25420 - DNA, 3003 bp, Unknown
  misc_feature (1)..( 3003): 2750-1469P.txt file - cDNA_ID_2705869; gDNA_ID_2214694; Annot_ID_136771
gatttttttgatgaataaaattttgcattcattcaaaaaaaaataaaaaaaaaaaataaaaccgaaaaccctaaaatccgaaaacaccaagaaacgacaccactccctatgaactggactctagtaaccaataaaacgacagaggaaagagcgttttggtagacgacccaagtgagataaaaaggcccaactgaatatcgttaagggccaagaataactgcaaaagacgaaaaagaatctgttcactctctctctctctggctcgctcgctctcaatctttccgatttggttgggttcttctccaactccaagtctctgcgaaaatggcggcttcggtgcaacctgcatgcttagacctccacttctccggaaagcatccaccgcttcttaaacacaacgctattatcgtccgctgcgtttcttctccaaatgtaattcccgaagctgactccatctctggtccgcctgatatcatcaatacgaaccgtgaccagcgcaaagtggttcgtatcgcttgggagaagttggttcgatggtctcgttctttgcgcgctaaagctaaaaccgatgttcttgagcgtactcgcaaggttttattatcttcactttctttcttaatttcgtttgcgttttggagaatttgaaagaatctgggggtttttaggttgttgttcttggtggaggttcgtttggtactgcaatggctgctcatgtagctagaaggaaagagggattagaggttaatatgcttgttcgtgactcttttgtttgtcaatctatcaacgagaaccaccataattggtactttatagcgtttgatttttatccaaacacaattcataattcttgaagacttcgcagtgataaggttgattctgttgccagtaagtattttcctgagcacaagttacctgagaatgtgattgctacaactgatgcgaaagctgcattgcttgatgctgattactgccttcatgccgtgcctgtgcaggtttaagcacattgagtatttgtttttagttttgttgatttgtttctatgttctgctgattaatgtggggttgttgttgcagtttagctcttcgtttctagagggaattgccgattatgtcgatccaggattgccttttatatctcttagcaaaggtctggagcttaatactcttaggatgatgtctcagatcattcccattgcgcttaagaatccccggcaaccttttgttgctctttctggcccgtcatttgctctggagctgatgaacaatttaccaactggtttgtttgactcttgttcttcttttgtttaaatcgaatagcattatagttttctattgctgaatgatgagaaatgttttcttttggtatgttattttgcttgcagcaatggtggttgcctcaaaagataagaaattggccaatgctgttcagcagcttcttgcttctagttacttgagaataaatacttccaggtacaacatttcaaaacaagactccattggtttcaatgatttctggatgcatttccctgctgggctatgataatatccatttgcctacctgcttgagagtttattcatgtcttgtatatgtgtggtgttagtgactgagctctaatggtcaacttcttaattcctcgagggagttttgtgcactcagcttgtaacctctgatcatttcagtgatgttacaggcgtggaaatcgccggtgccctgaagaatgttctagcaatagctgcaggaattgttgatggaatgaatctcggtaacaactctatggcagctcttgtgtcccaaggttgttcagagataagatggttagccacaaaggtagtaagtttaatttgtgtctataattgcttcatagaaagtggttttttcggtccatgcaactcactacaatgattactaaatcctgtgtttattgcatttctgcgtttttctgtcttgtatgtgagaagatgggtgcaaagccaacaaccattactggtttatcaggaactggggacataatgcttacgtgttttgtaaatctttcaagaaaccgaacagttggagtcaggttagggtcaggggagacactagatgacatactaacctctatgaatcaggtgtgtttctcattggtgtcgctcttcatatggtaaaacaaaaaggattggttgaatctgaaacccatgaatcaaataacaattgctgcgcaggttgcagaaggtgtagcaacagccggggcagtgatagcattagcacagaaatacaatgtgaaactgccggttttgacagccgtagctaagataatagataatgaactgaccccgactaaggctgttcttgagctcatgaaccttcctcaggttgattataggtttcacagattcccatttcgactcggctactcttctggtatttttatttgactctgttctgtataattctggttttgcagattgaagaagtatgaggtagaacaatcgttttgaggaccacatattcaaagagatggctttaaggcggcaagagctttgcattcgtttagagatagctaacgatagagatgattcgaagtgagttttgtaatcgatttttaggcctgaatctcatgaatgtgaattgttcataaacattttacaaaatctctgtaaatttttctcttacatctataaaaatgatgtttcagtatcttgtttagagtggagtgtggaatttggaataggcttcgtatgatcttcagactttcggagccatggatataagtatgggtgtttcaaattcgggtacacccaaccggtttaatccaaacttaaaccgtaaaaagccgatcaaaaaaataaacaatgcgcatgggctttgaagttgagaggcccacaatttttgaaggctcagacgtaaacggtgacgtataggaggcaaaacccttgcaattgcagtgtcgtcgtcgttgagtagtcgaagacggagggaaagaaacagagaacttgtttgtttcgtcgaagaataagatgatg

SEQ ID NO: 25421 - DNA, 3000 bp, Unknown; identical to SEQ ID NO: 14041
  misc_feature (1)..( 3000): 2750-1469P.txt file - cDNA_ID_2705877; gDNA_ID_2214694; Annot_ID_136774

SEQ ID NO: 25422 - DNA, 3000 bp, Unknown; identical to SEQ ID NO: 14051
  misc_feature (1)..( 3000): 2750-1469P.txt file - cDNA_ID_2705937; gDNA_ID_2214695; Annot_ID_136793

SEQ ID NO: 25423 - DNA, 3003 bp, Unknown
  misc_feature (1)..( 3003): 2750-1469P.txt file - cDNA_ID_2705949; gDNA_ID_2214695; Annot_ID_136797
aacgatgttgatttgaagcaggagaggttaattccgatcatcgtcgccgccattggagctgaggaagccgagcaaattattttatccgttccagattttttttttattgttctttaatataaaattgattttacaatttttaggttgactttttcagtcaactcaattttcacaaaatgttacaaaacaactctcttaattatattcgaatgcacacacacacatatcaaatcaataaccaaaaaacattccattctcatagggtttggttggttacactcacaagttattgaatatccctattcctaaacgcccgcccacggaaaacagcgaacccaagagcatgcccgaaaatcgcggctaggaaaacaccaccgttgaaggaaacaacagccagaatcactaggtagctaaagccggacttgacggtatacatagccgtgcgaaatgcaactttagcaagcttatcggcaccctgtttgatggatgacgcgtcagagcaccgagcaagccactcagctaagaacgccagaaagaagacgaagataagtgcgagtgcatacatcccacggtcagaaccaggccagcctgagaagagcacttggcagttgtaaccccaatagaatgttgggtgtaacagtgacggtctatgtggcgtttgcgtttgcgttgtggtggtggtgttccaagcctctactacgacaacgtttttgctcgacaacatctcctttaatttggtgtaaaaagagaattgggatgtcgttgtcgtagtggaaataggagactcgctagtctttgcctataaaaagtgtttcgtcttgagaggaagagactggtcctactaaattatatgctatgttcatgttatgaagcaaactcaagatttgattgtcggatttttctttcgaaaagctacaccatgtccatcaataaactatttttggccgtatatttgtaatcaaaattcgtttttaaacgtatatataaatacattgatgcacatatcataagctaagctagctaactaaaagtaaagtatcttatggtttaatatgtttttttgtctacgttagaatattttctttgcttttttatataaattttatcacaagctattgcaagcaataataaaaatattaaataaaatatgctaataaaaaccagtaattttattttgattcacttaacaagtaaattagttatttccccaagcttgttttcaaataatcatcaatctattctaggctatctagtggttaatttgtttttagactagggaacaatcgatcatatgattagtcgatatacgaaattttttgattatgtcaacaaaaagtgacataaaattttcagtgataaaggtgagctagcccatgttacaagagctaaatactaatccgatcccctcgattcaacagaacatttttaaacttatccaatttattattatatgctttacgtcaagtttgcgttcttccacgagagaagccttaacacatgatggaagagtgtaatgttgcccatgccaattgccaagaaacaaacaactatgcgtctatgcttatggcgggcaccgactaggccacgttctctatttcacaagtttaaccgcgaacacacaaaaaacaaacaaccaaaaaaaaaaaaaaaaaaaaaacttaagattatgagtttgaagacttggatgcacgaagcatagcaacgttgaaggtgaggagaacgatctttaatgggtatagtccactttccatcatctaacctttgtttatacggatattccaactcaagtataatccactttaaacttttgtgatgagtgaaaactatttcaaaactacactttgctttttttatgcatttcaaatttcactttattaatgtaaagtgtataaatatttgaataattggttttgaatctagatcttaatgtcaaggcacctataaagagaaaacatcaattcagttgcaattaagggcatgtagctatatacatttttttgttcttcagccgaaacagtacttcaataatgattcaaaacacacacacaaaaaaaaaatagatagcgaaacagttatatcttagccggaccaaattttcctatgaaatcactgtcagctttcttactcattacctcatgcggcactacctttggaccaccccgatttgataatcacatccaatagatttcaccacgacaaggtactcaaatcctctaactaaatgtaagaggaagaagatacaattaccaaattcagtaaactagagaaaacttgcactaaaattattatttctataagaaatgttttaaatattttaatttattaaattagagtaaaaatggatatttaacggaagagagagtggaataattaataaagaattaaatccagtagtaacagaaaactcaagtgtttggacttcagtggcagttttaagtactttgcttcggtcagaatccttcaaacactgtttcttcatctcccttcgtcttctaccttttgatttcgcgccaccacgctccaaccttttcgttttcctctcactgctttctccgatctgcctgagtttctccgtaagtggtccctaattcccactttttcctctctctggtttggtttggagtgacaaaaagaaaagggaaagttacaatttcgttttcctttctctttcttctttggtgatcccattgctaaaatttgctgatttccttgcaaaggtttctgattctcctaagttttagttagatctgtgatctactgatatcctctagagcctcaattcttcaagagactgtttagcttttgctaagaattgagtatgaagtactgaattgtgtaattccaatgaattctctagtgatatttttatgcttaaactttatgtctttgttattgcagagtggttagtgtaaaggtggatgaagaaactaagatttggtttagtccctgaatgcagtatagagtcattgctttgaggttgctggtaattattctaccactatg

SEQ ID NO: 25424 - DNA, 3003 bp, Unknown; identical to SEQ ID NO: 25423
  misc_feature (1)..( 3003): 2750-1469P.txt file - cDNA_ID_2705949; gDNA_ID_2214695; Annot_ID_189505

SEQ ID NO: 25425 - DNA, 3003 bp, Unknown
  misc_feature (1)..( 3003): 2750-1469P.txt file - cDNA_ID_2705965; gDNA_ID_2214695; Annot_ID_136803
tcgttttatgtctgtgtttgtgtaaatttttatatagtacagatttatgtctgtttgtgtttatggccttgtggggattttgctaattatatgctttttttggttgattttattacattctttgatttatttattagtacttcccaaatatggtacaatagaatattttcaagtttaagcatctcatatactgtatatctggattttaaaactttgggtatagataataacactagtcataaatgttcacgaatcattcataagccagtgacatatttgctcaatcggagaaagtgaacggaaaaggttacaggataggccggtgatggaagagaggcaatctccctcagcgtccataggttcacacagagatagagagtgtatattgttttctacgattagagcaactatatatatattacccaattaaaagtaaagttataacttatataagttctaacttacataagttctaacttctaacctatcccacaacaaaatggtttgtagtttatacccgatccactaacactctctcgcccatgtacacctctagatcacggccacacatgtcgttcgtttaccctttaattattattttgttatttagaaaaatgaacaatgcaacttagttgctatcattacatgttttaaaatgtttattatctttgtctttaaaatttttagctaatttcttacactagaaactgaaaaacgtacaaattaacacttgatcaagatgtaacatgtgggccaaaccttagatttgccgtcaaatatattggacacgtaacccctaaccacatacctcctatcacctgctaccacgtggattcattccaaacactttccggatctcaagccggtcggcaaagagcaccagcgtgaaattcgtcttctgcaccttcttcgtgccttgatggccgttggatccgaatcagacggccgatacacgatctcccttgatcttacatgtgaacttgtcatttgcgttaagtcaagtaccaaatcatttgtaaatatgtcggacgaggtacaaaaatgtgttgttatacaacaaaatatttaaaactcatataaaataaaggtatacaaatgtgaagagtattgcaaatagatttagctggttagtgatgttttgaacgtcatggatattgtcgtagtatgtgtttataagttgatcgttgtctatgtttcaatgtaaaaacagatttttggatgtaataaattagaaatgacaatcggttttaaacttcaattttctgataagtggttcattgaaatactcaaagttgatgatttatttttcctcgtttagaacttgatgatcttcgcaaagatcttaatcataatataattagattttgtttgtgagtaatccagtcatatatagaattaaacactagcattgtatgtttaaggcaaaattgcaattacaataagattcggtttcatatcaaatctcttgtttatggaacatgtatgtgtcttttttttttaagaagtttttttgaatagaggtttggtgatagatatggtcctttttttttaagaaagggagggtataacgatataaatatattcttcttccaaaaaagagtgaagggcaacaaatacaagaagaattatgttgaaatcaggcgttaattaaaaacataaaattcagatgtgtattcatgctgcattgaaattatttatatcgaaaatgataattgtagtaggagtagaataacaaagacatacacaagtgcaactcggtgtaattagataagatcactgctttgcttctttgtaccttcgatcatgttcttgtataatcaagattcgtatagaagctaatatattcacatgtttttgttcttctaattatgaagttgaaccatctattattgtagttggggattaatggacgatttgaaagaatcaaccgaaactcactagatcgtgtatttgtgtcttggttttatgttttatctttttaaaaatttctatactgaatctggttttcttagcagcttaaatttttaattaatatcagaatgagatcatgataaaacttttcacaaaattgttgatcttgtattagagaacaaattgaacaaccatgagaatgaatttcatgagtcacacacatcttcacattatctagatggaaacaagtatacttactagaaaattcaaatggagccacctatcaaataaatcccctgttagataactcatgatcaagatattcatgatcaagaaattatctactcgattttctgttttagctcttttgataaacactaatttttaagtgttttatattcctcacacacatattcaccaatagattagtcattaatctcaagttaacacacgtacctttatattcaatagacctaagtcttgtttctgacctcaaactgttggtgccagactcccacttccatgttcgaacttctttacattctttaagtcaggttattttttggattccaactgtagtgacaatccatacattccatggctaccaaacttatcttgattcacattatgctaagaagctaaaacatacaaaaagaaccgaaattgtcgtgagtttttttaatacgatagggtattaatgtattcttaacaacgttatggtcttgagaaataaaatatgcaaatctcgggtagggttatttggattagtgaaatttgggattttcttaatttaaggctaaaaactatgaaatttagagatttatgacagttaataaatacgaataacggtgttcgttgcaattttatgtggtacttatttgtttttaaaaaaaaagtttagtactaaattgttcgatttcgaaagttaaatatatttttgaaagttataaaggaagaaaggatttcttagcaaatttccgttatttaagttggagagaaaaggtttaactcaaaatatcgcaaaaccctaacaaaaaattttcattcttcctccactctctcaattccaaaacactgcgccgggaagacatg

SEQ ID NO: 25426 - DNA, 3000 bp, Unknown; identical to SEQ ID NO: 14056
  misc_feature (1)..( 3000): 2750-1469P.txt file - cDNA_ID_2705969; gDNA_ID_2214695; Annot_ID_136804

SEQ ID NO: 25427 - DNA, 3000 bp, Unknown; identical to SEQ ID NO: 14056
  misc_feature (1)..( 3000): 2750-1469P.txt file - cDNA_ID_2705969; gDNA_ID_2214695; Annot_ID_189513

SEQ ID NO: 25428 - DNA, 3003 bp, Unknown
  misc_feature (1)..( 3003): 2750-1469P.txt file - cDNA_ID_2705971; gDNA_ID_2214695; Annot_ID_136805
agttgggcaaggaagctttcccttaccgttacagttggtgcatctgcggagaaaagagagttttctgtaattaaaaccacacttttcattttgcaaccatcaaagtataagtagagttcttgatctgaactcacattgtgtcggacccatctttatgagcaaccaagcctcttccatagcaagtggaacacttcatcatctgattctccttgtaaaatcctggctctccatcagcattgcatgttggacatactacatctcctcttccggtgcaacctgtggatcagttaaaccaagtctcatcagtatttacaacattctgattgtcctaatggtcatatgtacattacatttgatacctgtgcacttctcaacagtctcagaattaggaaccaggacttgagtttctttatacgggacaaacagagtaggaaactgcggtctcaggtccagttcccataaccccggttcagatccatgtttctttccattgaattcaccaccagtgaaaggcacagtctgtgtcaaagcttccctctcctcaatgaaagtatcaagagttccgacataaacattgcagtcttcaacagcatgaatcttccatgtacgagcaggacggcttccccaacagcaacgatgaccaatatgatcaataagcagctctcttatttcaatctcatcaagaaactgcctgtaagaaattacataacgttcaacataagttaagaaagtgagggctaacaacagcaataagggaaaaattaggaaccattatcactagaattacctttgttgcaattcatgacctgctccagatgcacttggataaccaatagcttgagctgttaaatgccaagaagaaatcagaaatttgtataaaaccattaagaagcaaagagagaagattataggaaatgaatcaatgatgaaactttcacatttggaagatcaaaaatcaaaatctagagaaaacagcatgtagatcacttccactacgaatcaagactcgaataaaaagtctgctactttcaatggaagctgatcaaataactaaaggtgtcaatacaaaattttgaaggatcaggaaagatggaacgagacttacgaatgggtaacgaaacaggggtcttgataacgggaggataaagagacggaggatcagaagaaacagcagaagcggtacggatttcttcgacggtgacgacgccagctccggcgaaagatgggttacgagcagatgagctatttctctgcaggtattggtatgaatccaacctctcggattcattcgttttctctgatcctaaatgagcatttcgacaagacaattttatgaatcagaggactcaaaggagatatacacagaggagatgatatgttcgtctgaatttacctgaaagcagaggcttatccatggattacgaatctctctgtcttcccaattaaccaaagtagtggtttttcttagagagtaaggaaaaacccaggtcaattcgatcttcttctccgtgcgagagaaattttcattacaagaagaaacaagacaagaattcgagtttttcttatcgggtcgggtcagatccagatagaaccgggtcttcgtattgccacgtgtgaaacggttgaggatattttcacccactatataattggttgttataagtacgtaagctaaaaagagattcacgagggaaataattgcgcgttttggtccagtgtttaaggagagagagcaggtatatgaaaataacacttacacatggatgcttttaagtcctatcacatgcggcatatcggcaacaaaatctttttcatgttcgttcatttccaagttattcaatatgaacgattccaaaattttgtcgttgatttgattatagttgacctggaaaagatactatagatactaacgaacatcatctctgttggtctagtacatgtatttaggagtggacacaaaatggattttttttacttttttggtgctctgtccggattcaacatatatctagttttgtgtatcattttgattcattatggaataattggttacaagttacaacttcataatgaacaatttattataagacgtcgtcgactctactgatctcacctcacgtatgattaagcacaatattggtgtatgtttcttttttctagtgttgagatgtctttcatacaaatcccatgaatatgcatgtctcttgttctctcaatctctgctaacacaatttacgacctctatgttatattaccataaaaacattacaagagaaagaagaaaaatttaattagttttcaaattaataaaaatttagacgttttaagaaaataataataatttacaggtcataaaaaaactgattgaagaaatatatttccagctctaaaacccaattcctaaatctatattcatttagaaaatatatatacatttggtatttaatattcttaaatggagtaagataataaatttatattgtaatattaaataccaaatatatatattttggtgtctttttaattaataaaaaaataacaaagacacttattctaaattaagaagagtcaattaacgaaataataaggaatgaaattctcaattatgaaaaacacctgtcacgaaagtaaacgggaaaaaaatcgcacgatagataattgcatcggtgctcagtgctctgtttatctcgttatataataatgttagagaaattggatgtgaatgcaatggggcggtttaatgtgaattgatgagtagacacaacaagagtttggtttggtaatggtagcaacaagccaagagcactaactaccgacaaccactcgcgtccacatttgaattttcctcaattcccccactcacgctttttagctctttctcaatctttcatggcggattatctctctctctctcacttctccttctcgtgtgattctgattctcctctctaagatccgtatctctcttactctcccttctcaagctcacttcaatcaaccatg

SEQ ID NO: 25429 - DNA, 3000 bp, Unknown; identical to SEQ ID NO: 14067
  misc_feature (1)..( 3000): 2750-1469P.txt file - cDNA_ID_2705975; gDNA_ID_2214695; Annot_ID_136806

SEQ ID NO: 25430 - DNA, 3003 bp, Unknown
  misc_feature (1)..( 3003): 2750-1469P.txt file - cDNA_ID_2705979; gDNA_ID_2214695; Annot_ID_136807
aacttacgtttggtcaaagaggagaatcgagcaaggtacgaatttatcgaccggacgaaggagtttggagatcggagcgaagacgaaacatcaagcaagccacgatcctattttcttcaaattaattacctttttcagaaaatatacttttttattctttttgataaataccatattttatggattttacattaatttggaacaattattttaatgatacatgtataattatttttttttaaactatgggttatttttttcaaaaaaataatgtgtggatgtttcaaaaaaaatcaaatttcataatgaaacaaacaaaaattcgaagaagataatacacattgtgttgagaacaaacaattattacacattgtcggattaaccatataaataccgaactttgccttttgatttggccaaaaccttaaagttaaggtaaaaccttcatagctgtccaacaatgttaataaatccatcttagagtttaaggtcattgacagaactttcagtaactttgtctcccaaagcactccttatgtgatacacatacactaatgggtaaaaaatttcaatttctctgaccatatcaataaatgtcaacggcagaggcaaaaaaaaaaaatttggtcaacgaagcaaatcatagtggtttctaccactgtaaagaagcctaacaacattcttgtttgtcttcccctttccccagcctcctcgaaattcacttccatactcttgaatcggtataaaacccggcccataccctcctcctcttccatgctagataaacaataccaaataactcaagttctgaatacagttactagaacaaaagaaacacctagtcttgcttacataagactcaaattcaaagggcgtttacctcgtgctcaggtatgtagacgatgataggctgtttacatagcttggagagaacctgttgaagcaaaacactgacattagatcatttctctatgatggcagttttaaatgcaggaaactcactagcagctcggactctcctccccagaaatcgtgtcttccaatccgctggcaaaagctgaagaaaaatgcttaacgtgataaggaaaaacaatgccatttagctgaaaagtggtaatgagtgtgaatgaattcttatgagttatgactcaccgtttcagagactcatccacagtgatagccactaaagcttctttgtacttctccctttccttggggtcattgcatataacctctttcacagccattcgtaactcatctgtgaaacaaaggcaagttttgccacacaaaaacatgatgaacaagagataaacattcaaatgtatagaccagagaaaccacaaaacatttttccaccaaaaaggctaacagaatgaaacaaaatccagttttgattccccaatctcagcaagcttaacacagttcaatctcttagatttcaaaaacacacaacaaaaatcaaaacaaggctatatgatcaaatatatagttacctgcatcatctctctctcgttgggggttaagagtaatacccttattaaaggccattcctttcacctaatttacattgaaaaatcacatcttttattcaggaaaccccaacaagaacacataaaaataacagaaactacattaccaatgctcgaaacagacatctcccatcccctttaactctatccacagcatacttctcaacctttttcgctgcaggagaccgattcctagagatgaatataagaatcaattcgcagattagcgtaaagggttttatcagagactcgattgttgaattcaataaacgagaaaacacacatcgaggaattgattctggcgaagaacacataactatttcccttcgttgtgcttatgaatgaagcagggagtgaagtggaagatattgaatctgacacagaagcagtaggagaagaaacaagctcgaatctagcgaagccatttctcagctgctctagaatgttatctgcgatattaatgaatgatagtgttagaaattaaacgagaacaaagcaataagggtgcagagcaatgaagtacttactgttggaagaagatttgagctccattgcaggggacggagataagggaggaattcgaattttgacttgaagaagcaaggaagaagactcagaaatgtagccatgaatgtgtaataagttaaatagttaaataactctacgataacacaaatccgttgtagtctagctggttaggatactcggctctcacccgagagacccgggttcgagtcccggcaacggagtttttttaatagtttttctttttttttgtcggccgtccgattaatccattaaacgacaccgtcacatataacctaaccccaccaaatccaccggaacatatccaaataagtgataggtgttaatctcacacgtaggaggagtcacgtgggcacgtgcgagagagcaaaggtctaaactttatggtttaacgaccaaccggaaagttctggcaattggcaaggaaggattcgaagctggttgtttcccaatctgcataagaaatatcgaaacacttccacacaaaatccacgcgctctctcacgctcactcactcgcataacacttgttccttcttctctcaatttcaaaaaacgacgatctcttcgatgctttctcttccttcctccttcatttccttctgactctgctcttcttcttcgtcttggatcttcgaatttgtctttgtgatttgaggtaaagtttaattctttgagctgggttttgttttgttgttgatgggtttcagagatttgcttgttttatttctgagacacgaaatgggcagtggaacaaatctgaccaatttgtgttcttcttcaattttatttaatctctcgtggattcagtgatcgacgattgcttttgatctaatttgtgttggttttggtttctgtcagtgttatagaataaagatctgtttggagtggatccattcaagtaattgaagaactcaacgcaaaaaatg

SEQ ID NO: 25431 - DNA, 3000 bp, Unknown; identical to SEQ ID NO: 14102
  misc_feature (1)..( 3000): 2750-1469P.txt file - cDNA_ID_2706032; gDNA_ID_2214700; Annot_ID_136844

SEQ ID NO: 25432 - DNA, 3000 bp, Unknown; identical to SEQ ID NO: 14101
  misc_feature (1)..( 3000): 2750-1469P.txt file - cDNA_ID_2706036; gDNA_ID_2214700; Annot_ID_136843

SEQ ID NO: 25433 - DNA, 3000 bp, Unknown; identical to SEQ ID NO: 14101
  misc_feature (1)..( 3000): 2750-1469P.txt file - cDNA_ID_2706036; gDNA_ID_2214700; Annot_ID_189629

SEQ ID NO: 25434 - DNA, 3000 bp, Unknown
  misc_feature (1)..( 3000): 2750-1469P.txt file - cDNA_ID_2706063; gDNA_ID_2214702; Annot_ID_136896
atgcgggaagtagggaactttgactacagttcacgtgtgaggtgatatttcactttaatcccggggattaaaacgttacattaatataattattatactacacctaatccatcccctcttcagaaatgcattattacactaatataattattaattataaattatagacggttcactcatttttatataaaaaatcaataaataaatatgtactctatcaaatatattaccctttaaaattaaaaatgtatgaaaattcgatttcaaagatgatttagttcttttaatataaaaatgcgtcgaatgatgatagtacgaaaaaaatagtttcagttattttagataaaattaattagtaaatattgctttgaactacacaatgcatggaatcaattaagtaatttgtaatgccaaaaacaaaacaattcatttatattgaaattatgctaattaacaatagttgatattcatagccacgttatgaatttttgtataatctgaattcagagttaatatataatctgaatattttttcatcaaaagaaaacaaattttttttataaaataaataagtaacgtatcaaagttaggaaacagagtttttgacagtcagttgataagatcctttgctttgaagttttaactctcgattcgatactaatattttaccttgttgcaatgtaatattttttttctttttcttgctgcaatgtttatggagtattcaagggaattaaagagaataaaacgctggtaaataattgtagttgaatgcaaagaaggtctagctaggtaggggctttgttagatcaaatcagatgtcaaaagagcataataaaaatgtaatatcaaatcacacaaatgtttctcaataaaaacatggtcctacagtcctactttctactgtttgactgtttccttcatcttgtcgctttaacgttatctttacccatgcttatattattttcttttatctacaaaacaacatttaatttgcacccatttccttactaaatataattataattaaaactagaaacctaaacaatgttctcacatagttaatttatcaccgcattattattattgatcatataataactcatcatttatagtttagcacaatgcaacatattacgtcttaaaaatatgtgaagttaagaataagttatcattaagtttggacatctgattgtccgtatagacaacttgttgtcactgtctacgctgccgtgtgcacttaatagttaaaaaccaacaaaatctatgtattgtaacaactggggggtaaaaagctatgtatagtaacataataatatcataacggaaccaaatcgatattgttgtgtttaaaaaggaactattggccttttccccaattaaagtagaaaattacgatcgcagtttagaagttatcacgaaaacaaatgagattaaagagtgtaaatagaaatctatgaagtgacaagaaagaaaaaatagaaagctaagagaaagagacaaacaaaaaaataggttcagaagagtgttgaccagaggaactgtggattcaccaacaagtgggacaaactttctcttacgtccaaaactgacacaacagtatattaactctttctcctcatcatgatgaatcatattcatatgacactcactccatgttcactctctgctctctctcaatatatatttctttttctatagcccaagatgttaatattgataaacctataatgatttagatctcttgtaatataagcgagatgttgcgaatgataaggataagatatatgaatctacaactagatctcatgttgcagtatcttgtagccttgcctagagtcgtaggtgagactctaaagaattttatgattaagaaaaaacaatttttatcataaactatactgtaataatatgaggtccttttcattcaaagtatatactgggattactatgtataaacttggacaaggccaatattaacatatctagcttgagtcttcaaaaaataagagattcttatttttcaatttgttaaccatataatatcatgttatcagatttcaaatatcaaaaataatgatatcgatcacctttgcatttgtttcaccaaattcgttttatcacaattagatgttcctttcaattgaaaataaacaatatacttaaggaacaaattaactgaattacagagaaaactagttcaagtttttttttttttttttttttaactagtttaagtttaatttgttttgtttttctcttttcaaagaacccatccataaccatacacatattatatagccattttattttgcgtttttcagtactttcactttttagatttttaagaacctttgaatttgtaatgtataaacataacttaaagattttttagtagcgacggtttcacctcgttagcctcaaaatcattcttgaattttgatatgataaatattcagtagtaaaaaccactatagtacaaaatctagtaatgtgtacttacttaaacgaagactgcagttattgaggtttttagagcctgtcatctataaaatatattatgtatcttaacagcaatgtgatatttgcaatagctgtggttgacatctagaaaattttaggggtgatttcttattttagaaaattttaggggtgacattaaaggacccattttaaagaaaacctaagcaaagatcatcacacaaaaagattatagctagtatcctcgggagatcaatcttgagatatatatttagattatcccaaatttttatgaccaggaaaatagaggataacccttgattttctgaatcatttctgtctcttcttctgaaattcaacattcgtttcctctccaatttacaaaacgttaaaacaaaaaatagaaacccaccaaaaaaaatataacaaaacccatcttcagatattggatcgtgttccttgtcttccaaacttcttggaacgtcataactaaagacaaaagagtaccgaccagatatg

SEQ ID NO: 25435 - DNA, 3000 bp, Unknown; identical to SEQ ID NO: 25434
  misc_feature (1)..( 3000): 2750-1469P.txt file - cDNA_ID_2706063; gDNA_ID_2214702; Annot_ID_189723

SEQ ID NO: 25436 - DNA, 3003 bp, Unknown
  misc_feature (1)..( 3003): 2750-1469P.txt file - cDNA_ID_2706080; gDNA_ID_2214702; Annot_ID_136883
cctcaatcgactgaccacccacaatagaagtcaccctaaaccctagataatgcgcaaacttaacagtttcctcctcaatctgctgagcaagctctctagtaggggccataacaacagcataaggcccctcagtctcattctcttcgctcatcggtggcaatctagagatgtaagctaacatgggtaaaacaaaagcagcagtcttaccagaaccagtctctgcaatgccgataacatcacgctgttgcagtccaagtggtatagctgccatttgaataggagaaggtttcttgtatccagctctctccacagctttcaaaagctcagaagtaagcttactctcttcccagctcctcatcggacgaggaatcctcgaacccttgtaagagatattgaaatcttctctgaaaatacgccaatccctttcagtcatctcctctaatctcttatcactccaatgcctgtcaaccctcatatcaaacgagtcataagtatcagcagcttcttctctcactctctgagcagcagcttcctctggtttctctacaataccatctttcttacgaatctcgtctcgcatctctttctcatgcttagccgcttgtttcttctgctcacgacggtccataccagcacgaaaccctctcccaaagagaagctgagcttcatgagggttttggtaaagaacgttcatatccctagaagtatcctcagtgttttcccaatcaaaagagaaacgaaacttctcgcttggcctaatgactctcttcttcggcttcttacctccaagatactgctctttaatggcgtcaagttccttctccttctctctctcaactaatttctcaacacgcgccttctccctagccttaacctcctcttccctctccttttctctatttctccgatccggttcacgatctcgttcacgacggtcacgctcacggtctctctctcgctctctatccctatccctgtctctatccctatcgcggtctcgatctcgccctctatctctctccctatctcggtcacgttctcggtctcggtcccgatctctatctcgatccttatcccgattggtatctccattggagacatcttccgtctcgggctcggggcgaccaagttgctcacgacggacacgttgctcggagatttgatcctggcggcgttttagggctaactcttcccgctgttttttggtgaggaagacaggcttcttagcaatggaggaatcgagagtattgacggaggtagatccgacgacttcgttgattgttcgcttcatcggtggttagctggagattattcgcttggtcgattagcaggaggggaaagcaaacaagacctagaacctttcttctcttcttctctcgctctgatttctttttcacttggattctctttttctacatttttccaaaaccccccaattctagcaaactctcaagggttttaggcccattagtttttcttttgcattccgaattcaaatctaattttgtttttaggcccattagtgttttttcagcggagattatgtagagtagttagattttctcttgggtgaagattacaaacccatttcaagggttagagaactcgcttgtagtagtgtggtgtgacacagttcattcatcattagggattaaaccaactacactaattctgtctttccaacatgaagttttctggtaatgcaaacgaaaccgattatcttcgacatcaatgttcagataaagttgaaaactgatataatggttgctaaggagacgacaaaatgttttttgtggaagcagagaaactaaaacctgattcgttctaattgatgctctcaaaacataaccctgcttaaatgctgatgttcctaaactcaaccctgctaaatatgctaattcatcgtataatctatacatatcacctaatcttagttaagcaattaccaaagataatgcttcaccccaaggccattgcaagtcaatatgagctccttgtactcattcaatagttcctgcaacagaagatacacagggatttatcaaactcaaaagctttggaagtagtttctctctcgaatgaaattaataactttcgtctaccgtgttgtgctcatagatacgacgcatccttttcttatcgtactcctgccttgcaattgggtcgctcaacactgttcagttacaagatcaaattctttattgctaaagtccacagaatcaatggctaaatgaaaacagattcctttcccctaaactagtaaacttctttccttcaataatacattctgcattacatagttagaagaagaccaatgaaacaaattcacattctaagcttactactacttcaaagcctagctcaacaaacaaacacaactacatctacacgatgaaagagaagcaaaaccttgataagcctcgttgatttcttgaaacctagacgtagcagaatcctcttctttaaatttgtccggatgccatttctgcaacacaactccaacacaatcatcactgaagaactcacactcagagactgtcacaaattagtgggaaaatgaagtggaaaagagaaggaaccagagcaagacggataaagctggaacgaatctcatcatcagaagcgtcacagttcaattccagaactttatagtgatcctgcaacacccaattcacaaaaaccaaaactttaacaaattcaaaaccaaacaattatcaaatttttgtttttttgtttgtttaccttgtaatcctcgaaatcgaaaaaatcgaagccatggctgtctccccaatcggaacaccacattctccagagcaaacaaacgattccaagcttcctcaaatttacgattttcctcctctcgtcactgtgggcttcttcagataaaattttattattattatgcaatttcgttttagacccctaaactattacattattacagttaaaggacatttcgcagcttccagaaacatttagagacggctgagatacacagtgatg

SEQ ID NO: 25437 - DNA, 3003 bp, Unknown; identical to SEQ ID NO: 25436
  misc_feature (1)..( 3003): 2750-1469P.txt file - cDNA_ID_2706080; gDNA_ID_2214702; Annot_ID_189700

SEQ ID NO: 25438 - DNA, 3000 bp, Unknown; identical to SEQ ID NO: 14156
  misc_feature (1)..( 3000): 2750-1469P.txt file - cDNA_ID_2706095; gDNA_ID_2214703; Annot_ID_136918

SEQ ID NO: 25439 - DNA, 3000 bp, Unknown; identical to SEQ ID NO: 14165
  misc_feature (1)..( 3000): 2750-1469P.txt file - cDNA_ID_2706099; gDNA_ID_2214703; Annot_ID_136919

SEQ ID NO: 25440 - DNA, 3000 bp, Unknown; identical to SEQ ID NO: 14159
  misc_feature (1)..( 3000): 2750-1469P.txt file - cDNA_ID_2706134; gDNA_ID_2214703; Annot_ID_136910

SEQ ID NO: 25441 - DNA, 3000 bp, Unknown; identical to SEQ ID NO: 14159
  misc_feature (1)..( 3000): 2750-1469P.txt file - cDNA_ID_2706134; gDNA_ID_2214703; Annot_ID_189750

SEQ ID NO: 25442 - DNA, 3003 bp, Unknown
  misc_feature (1)..( 3003): 2750-1469P.txt file - cDNA_ID_2706138; gDNA_ID_2214703; Annot_ID_136911
agatgtcaacatgaaataaacgaagaacgaaactcaagaatgaaccatattttacagatcaggacgtaagaaagaaaagcaacaaacctgatgaattggaggatacattaaatttgtacaaaccggacattcaaggagctcataaacaccattgctcgaatggaattttccaatggagccactacctgattttgttggtttgctattagcctcaacctttgccatcttaacctcataatctacgcctgtcgagttagattctagagcttctttcaatgcactgccaccaggagccatagagagtccaaacctagccaaaacttgttttatttctaacagcaagtaagtgaaaatccctagtcctctcttgttgcagatgatgtactcctttcgatgatatattcctttggaacttcgttcttctgcaagaaaaacaaatgatggctaaatatacaacatttaaggaaatgttatcaataagcaagcaggtaacatgttagttaaaaaactggagcaaagtaggttaggaagtagatacgtggtgcacttgatcaagttcttttctttctttccggaaaaagggaccaatgatctcttagcagtacaccatactgcaaatccagtcttataccgttgcggtccaagcatataaaacgtagcagccacttcgttaggaaaaaaggatagtcttgtgaattaatgtgactaagttcattcccaatcaactgaaagttgccaacacatctttctttccacgagcctgttgcgtctcaggtccctcgattcttcacaatcctttctaaatgctagcggagtaaaacagttatgtaacaagtcagactttttaattcaaggagaaacagttcatctatgaacaatgctaaaaccttacaagttccaatattttaaatggttataatataacaatcacaggctattcaaacatcaaaaatagagctgtcaaatgaaacgatctgtttttattttgcaagacataacttttcaatgtaaactatacaaaagagaaattgattcaacaggaaaacacaacaagtagaacaaacaaacatcaggtaagttcaaactcaagatctcataaaaatggaggaaaaaaactcaaaaaatttaaaacaagtagcaaattttgaattatgaaaacaaattgaagctgaactcaattttcaaaaactttgtacccacaaaattattcaaaatcacctcatcagcgacaaaagttatttccgattacatgaaatagttaacgaatccataaactaagcaattcaaagacaattgacaagaggaacataactcattcctaaaagacttggccagattcgtcacaataagcacccctgaacgaaaaataaaaacacagaaccaaaaacctagttcttaattcctaagctcgtgtttttttctcgattctgatttaagaacccattaaagaaaaaacccaaatttgaacaataaagagagagagagagataattacccagggagaaatttgcaggcggtggcgttcgagttatcgaggttttactttcagattcacatgaggattgaggaagacgaaaatatcaattaataagagattgaagaagaaatgggctttgaattaggaagaagaagaaacgaattaagacggcagggagagggaggagatagttgtgtcgtgtcttgttgttggtatcgatgaaagccattaatggtgctctgtttttattacagcttttcaatttgaatttcacccaatttcgtttttcttactttttggtcccttttgtttttctaaatagacaaatgtcgtccaaaagtattctttaggggtcaattcatcaaaataaatgtaggtggtgtcttaacaacaaaataacgaaaaaggtgtcctcatctcacaatttgtcaaatgtattgttaattttttctttgtttcattattgtccatcaattcgagtttacaataaaaatcttcatttttgattgatgtaattctcaactctcaagatataataatccacacaaacaaacaaaaaaatgtcaaccttacttattataaatagttatgtatcaaatgattctcttgtatggctatgaagtatgaacaatcagactatgcctcggcaagcagcaaatatgcttacactggatccagttgccaccttcagaatggcatacaaggcccataaattggtccaactgatccagggccagacacatttggaagtcaagctgagtcttgttgtatgattgtatcctatgcagtgtttgtgtatgagctcaaagataagatcattatctgagcattgaaagtttcttacaagttggacaaggccacatcattatgatcaatcaatagggaagagagttgtaaaatgatactctcacaccttcaatggcctgcagagcctcatggaaatgtgatttgttaaaattggaaaaattttaagttctgaaacttttgcatatactatagtaaaaatcggaaaatgttacattgggtcactatcgattacataaggaagaggtaatgtgaatgggcttgtagttacctaccaagtaccaaacagagcaaagtaaagaaaacaataaatgcaaaaaatctaattccttctatttattgaagaaagagtttttcaaatcttcaaagacattctgggtaactctgtcaccacagttgactgtctcatatccccacgcgctaactcctgaacgtcaaactcaccttcctccatctctaaactctgtgttttagccacgcgtgtaatcgcgtgagtaagaaccaccaacaatgggaccaacttgcttaaaaagatttatgggttttcgcttttattacacactctcccaaatccaaagaagcgtttgtgtttagatacgtggtggtgggcaaagaaaagaaccaaacacgccactaggagctaccatctctgttttattgctgcttctgcttcctcttccattactcgtcttaaaacaaaggagaaagagtcaagagacatg

SEQ ID NO: 25443 - DNA, 3003 bp, Unknown; identical to SEQ ID NO: 25442
  misc_feature (1)..( 3003): 2750-1469P.txt file - cDNA_ID_2706138; gDNA_ID_2214703; Annot_ID_189751

SEQ ID NO: 25444 - DNA, 1024 bp, Unknown
  misc_feature (1)..( 1024): 2750-1469P.txt file - cDNA_ID_2706142; gDNA_ID_2214498; Annot_ID_133604
atcttaacatattttattaaaataattattttggtttgattcaatcataatagttagaatttactttgtaattagaattattaaatatgagtcaccatttaattaaccttaactaaatttgaaatcataaatcaagaaacatatatatgaaattagagactatttaaattcaaatcattgataagttaaattatatgaaattagaatctaattaaactattacactatacatggttgatggttttctagttacacatggcgcattgttattcattaatattcaaaaaaagtatatcttactcatttagtataagattgttttgggttaaaatggtaactttttattattttcaataaagtaaagctaatctagtttttataaagatacaatgatacatattatgacatatatagtatatatactatatagggcaaggtcggccaaaacatgcaagcagtagcgctgagttggctcattcatatcattttaattttgttagattttttctttttacatacataatttataatcaaaaataagaaaaaattcaaaagattaggaaaaattgcacttatttggaagggggaaaaaattgactcctactagtgtgggacccatgtctctttttccatgctctttataaacgaaacaaagcgataggatttttgtcagaaggattcttgttgccgagacgagacaaggaagaagaaggagaagaacataatttttgaacgtaagagaacgatattctttaagtgattttttttttgttgtcactgcagcgatgtttgccattgcaataactagggttcttttctaacaccatccgtttgtagttattaggtatatatttcgagctaatttatccttaaacataagaattaacatgatctctgtatacgatatctgtttttttccgaaactgattgttatttagttgtgtacgttttgaaggtatataatgataataattttgaaaaccaattttttgaaacatgcatgatatgtatactctagataatg

SEQ ID NO: 25445 - DNA, 1024 bp, Unknown; identical to SEQ ID NO: 25444
  misc_feature (1)..( 1024): 2750-1469P.txt file - cDNA_ID_2706142; gDNA_ID_2214498; Annot_ID_183889

SEQ ID NO: 25446 - DNA, 3000 bp, Unknown; identical to SEQ ID NO: 14166
  misc_feature (1)..( 3000): 2750-1469P.txt file - cDNA_ID_2706146; gDNA_ID_2214704; Annot_ID_136922

SEQ ID NO: 25447 - DNA, 3000 bp, Unknown; identical to SEQ ID NO: 14177
  misc_feature (1)..( 3000): 2750-1469P.txt file - cDNA_ID_2706146; gDNA_ID_2214704; Annot_ID_189770

SEQ ID NO: 25448 - DNA, 3003 bp, Unknown; identical to SEQ ID NO: 15999
  misc_feature (1)..( 3003): 2750-1469P.txt file - cDNA_ID_2706154; gDNA_ID_2214704; Annot_ID_136924

SEQ ID NO: 25449 - DNA, 3000 bp, Unknown; identical to SEQ ID NO: 14175
  misc_feature (1)..( 3000): 2750-1469P.txt file - cDNA_ID_2706163; gDNA_ID_2214704; Annot_ID_136928

SEQ ID NO: 25450 - DNA, 3003 bp, Unknown
  misc_feature (1)..( 3003): 2750-1469P.txt file - cDNA_ID_2706173; gDNA_ID_2214704; Annot_ID_136940
caaacagcaatactgaagagttcctggtgaggattagaacagaaggatctaagctcaggatatacgtacaatgtcggataattcttcaatgaattctcctctatctgccagaaaacaatcaatagacaaaatcaaaacagctttcagaagcgtaatccaaaagctgagactaaatcaaacaaaggtaaatccagtaacgaattccagaaatctaatcaacgcaatctgcaatcaagtaacaactcttcactatactatcgccatatccatcaatctaacatccctgagaccaaaattagaaagcgaattgaagaaaccgcagaagtagaagaagctcaccgacggaagtgatgctcttgagccgattcgaaacgaaaacaatcggagctaaaacagataacaatagcagcgagaggatcagaatcctctgccaacgacgaacttgattcatcaatgtgcgtaacttctcagagaacgcttcatatattttatctccgttgcgctttaatcgttctccacgaagaagaagaagcacattcccagagggaagaacacagatctcggagattctctgcttcttcaacaagcaattgaagaaaacgatgagcagattagggttttcagattcttctgcaataggattcgataaatgcgagagtctgtttctacgatttcatatctggagattcagagcttcctcgtgcatgtttagagacttctgctcttttattttttttcgcttaactcagattttttaatatttataaatcaatgtatttatttgatttttatacggagaggattaatgttgagatacagatatagtgcggcgcggtgtacatgtgctagcaaaattactagtttactaagatttgacttcttttgattggcttagtggaaattctcccaagccaccatagatgttttgacacgttgatagaatgtactgtcaatgattttcaagagtgggaaattcacagctttgtactttggagtttggaggaacaactggaatgtttgaggtcgaatttgggaattgaaatttttaacccctggatgagtttatatttgattgatctctctattatggggtgttgaatgttatttacaaaaaaaaaatagtcattgttttatggacgaataaattatctacttgtcgtttttttaccgaataacgcataaattagattcaatacggataattcctaaaataaaataaaaacggttagttcttctaacatacgttactataacaaacgtacttgacgagttggcataaaaatgtatttctactgttttaaaagtaacgtacgattcgtcttgcatactgtgacgaaatatgtaaattcttttgtcgcttagtgatgatgtgaattattttgattcataaagtagaaactcgatacatacctattaactaaacatgtattatgttgtgattcatttttgcctaacaaataaaatttattagcaagaaccattaaaatttcatactaattttggatactaaaatgttagattgatatataagaaaagtatatactcaaaaagatttaacaatttaccaatatttagtattggaatcagtgtagtgtttgttagtacatgcttttctacatttagaaacagttaaattataattgcaaaaggaagcaatattgaggtattaataaggttttacacttttacttcagctagctttgaattttagaagttttatggactattaaattatctacttgtcgatctttcataaaaactgttggctcttgcgagagatatgtgaccttccaattgatcgcgaagtgataagatgtattcgattttttcagcttatgccatttttacaacttttcggaaaaatgtttcaaaatatccattatgaatttgacatccaagttataaattagataaaatttacttgagataacatatggacatatagattttacttatttattagagttcattaacgaaaaattattgagttaaatatagacatctttaaactcgttaattttaaaaagaaataataaacaatatatatatatatataaatattttattttcaaattttatttatttaaagggttttaatttttattaacagttataatatttatgattgtttccggttactttgatgctattttctcgtaattcccttttgtacatatatatttagaaccaaaaattcaatcattgagaagcatactctctgtcaagtgtaattgattcctcctcttcattttttaattcttcatttcttaagttttattaattaattgactcacctcttcatcttgtttatttccaagtaattttcctaatgatgtcaataaacaaaaataaaaagattaaaatcacgcaatatcagtaaaaaaggagagagggttaaatcggtggtggactttgcagccctaaaccattgtttcgcctcggaaaagcccatttacacaattgggaaataaataaaaacagagtaaagaaaggaacgtcttttactctttacggtatcgctcgcttctcttctttctcctcaacacgaagacccctcttgcctctttattagagagaccccttccttcttcttcttcaccttcaccttcttcctcgattcagatcgtctcctcctctgttttatactcaccctattccttcgaatctctctccatttttatccccagattctcccttcttcaacctcgtcgactcttcttcatcactctatttcttccgattgagacttctttcactctgattttcttcgaccctttacggatatattcggtcttgagtctccatcggatttggatttgaatgtaggtatctcgcacgagagttgttgtttaacgtaaatctgggttcttttttttggtgggtcgttgtttttcttctacatgcagttttggggatagtacgtgcgattcatcgatcaatcctcgtttagatagacatcaaggatttaaaggagtcgttaagagagcaatggaaggagacatg

SEQ ID NO: 25451 - DNA, 3003 bp, Unknown
  misc_feature (1)..( 3003): 2750-1469P.txt file - cDNA_ID_2706176; gDNA_ID_2214704; Annot_ID_136941
tttttgcatttgtttctagatatttctaaactgttgggaaataaaaaaatttgcacacaaaacatagttaaattcacgtggtatttatagagatttacttcaaccaaatttggattttgggtcattgttttatggacggataaactatccattagtcaaatttccacaaaaataatatgtgaattagattcgacaaggctaattcccccacaacatacgatactagaacaaacgtacttgactacttgacgtaacaatgtttctcttactgtcttgaaaataacatataactcgttcatcaccaattttcttgtacatgattgattaagtgtgtaagcatctttttcgattaatgatgatgatgttaattggagaaacaaatttttcataaattcccttatagacaaagtcttataattttgttaaattccgcatatattttaccaaaactttgtcgaatggaaagacacgtcaaatgtgctaattagaaactgttgtattgagatttcaagaggaatcaataataaggtactactagggttttatttcaattaggtttgaatcttgggtcattgtgacgaataaattatctacttgtcgattttctacaaaaagcacacatgaattagattcaacgtggccaattcatctaacatatgttactaaaacaagcgcaatagacgagttggcgtaattttattttatactatctataaagtaacgtatgattcgtctatcaccaattatcttgtaaatgatggtaaaatgtctaaattcgtttgtcgcttaataatgatgatgatatacgttactttaattaaaaaaagcgaattttcgatagatactctattaactaagcatgcacatatcacgttgtgattgatttatgcctagtaaataaaatttatctccagcaagaataattgaaacttcataactaattttgaatgctaaaatgttaaattgatatatgggaaacaagttatgatactcaagaagtcaccaatatctagtattggaatcgctgtggtgtttgtttgtagatatttttctacatttagcaatgtattacattatgattgcaagaggaagcaatattaaggtattaataaggtttttacttttaccgggttagaattttgggtttgtttattggatgaagaaattatccacttgtcgatctttcataaaaagcacacgtgaattagtttcgacatagttatatagttctcctaatatacgttatttgaacaagaatacttgactagttgatgtaacgatgttttcttaacgtttcaaaagtaacgtacgattcttccataaccaaatgtcttgtatataatggtagaatatatattttgttttgtcgcctaatgattatgatgtgcgttactttaatttagaaagcggactatttaaaaactgctatattgaaaccgcaagagaaagcaatagtaaggtattaatatggttttacttcagccagatttaaaccaccaacaatactttaaaccattggtcgatctttcaccacaaaaaccacacgtgaattagattcggtgtggctagttccctaaacatacgttactagaacaagcgcacttgactagttggcgtgacgatgtctttcttactaatttaaaagtaacgtatgattcgtccattaccaattgtcatatacctaatataaaatataaattcgtttgtcgcttaataatgataacatgcgttactttatgttaaaaagccaattttcgatagattttctattaattgtaacgttataattcattatacataacaaaaaaaatcttcaacaataatatattgaaatttcataactaatggatgctaaaatgttagattaatagatagagaaaacttataatactcaaaacatttaacaccaaaatttccaatatctagtaatggaaatgtaatgtttgttagtatataaatttctgcatttagcaacacttatgcttaaaaacacatcattgatccgtagaataaaaagacacctcaagtgtactaagtaaccgttagaaactgcgtaaaaaagtttggtaccactttttcttttactttttttgttttgtcaagttacttatcaaaaacttggaaattaactttctctctttttttttaaactcgtgaataacaatgaaacattcgtatatttttatatcataaaagaaaacaatacggtattatatgaacaaaaaaaacttaaagataaaagaggtcaacaaaatgtccgaagtatgatgatgctaagtttgattagttatcttttttatgtcagagaacaattaaatttgttttattattatactaaaagaagaaaaacctaaactgcaaaaataataattacgacccgagtcttcgagtaggacccacctctgaatctgtgacagacgccggtttcgttctctctctctcctttttttcctctctttgcttttccaaaaaataaagttgtctttttttatttataataaaatgatttgttgtttcacagtgtgttgtttgttttggggtaaaaaagaaaatcataaggatgctttcaatatttgttttgttttggttgagtgattgctgaagccaacttaaaagagagagaagagaagagtgactctgtgtgtgtgtgcaagaaagtcttctctttcacacctttcgttttctcgaacctctcctttaaagatggtggaggaatcttgggtttgacaactcattaacactgaccctctttttagctctacaagcatccaaggaacccctcttacttttccctcttcttcattccctctctctctatatctcccaattccttctctttttttaaccttgatcttcttcttataagagactcagagctgttcttcaagatgggattgtgtaagcttgaaacttgactatctgggtctctcccattttctgttctcttttgtattctgagtgaaagttttgttttctgggggaaaaaattagggttcttagatg

SEQ ID NO: 25452 - DNA, 3003 bp, Unknown
  misc_feature (1)..( 3003): 2750-1469P.txt file - cDNA_ID_2706179; gDNA_ID_2214704; Annot_ID_136942
cagcaacagcaacagtttcatgaacggttacaagctcaccatcttcatcagcaacagcagctacagaaacatcaagctgagcttatgcttaggaaatgcaatggtgggataagtttgagtttcgataactctagttgtactccaactatgtcatccactaggtcctttgtttcttcacttagcatagatggtagtgttgctaatatagagggaaagaactccttccattttggggttcctagttcaactgatcagaattcactacattctaagaggaaatgccccttgaaaggagatgaacatggaagcttaaaatgcgggagctctagccgatgccactgcgctaagaagaggtcagttccatatttttgtttcgttttcatagcctctctttactaagatggtgtagttaatctgattgggaaattgacaggaaacatcgggttaggagatcgattagagtaccggctataagtaacaaggttgcagatatccctcctgatgattattcatggcgaaaatatggtcagaagcccatcaagggctctccttatcccaggtatacacttcttgatcatattttgttatgttaagaagtgataaagattgatgtcacatgcaaagaaccatccttttaacattaaggcttttgagttttgatgagaaaaaagagtctaaaaatggctaagagatgacacaagtaagatgagtccttttaaggaagtgttgtattggatttttgtgtgcagaggatattacaaatgtagtagcatgagaggttgtccagcgaggaagcatgttgagagatgtttggaagatccggcaatgcttattgttacttatgaagcagagcataaccacccgaaattgccatctcaagctataacaacttaactctcgtttatctttgcggtccagcataaaccttctcatgtatgttgttctcttttgtgcgcgatgatcggctttggggttgctgcaatgttgtgatatatggatcggggtaagtgcttttgttggggtggatttgcttgtgagagtttgctgcaattgttggattttgagctatatatggggtaaatgtaggattggtcaagactctttttctgtttctcaagtttattggtcttaatgattaaaagtttaatggtttgtttctggctatgtatcttttttttcttctcaagtggctttttcttttatgattggtactgttagaatttggagattgttgctaagtaacttaatcatttagcaaggtagcttaaatctaagatgattagggataaagaatattggattctgttctgagtttagagaatattggattctgttctgagtttagagaatattgaattcatgtatcaagcataatgaatgaaacttattttaagacaaaattgagtttgagattccattttaggaatagacaacaagtctacaaagtgctcacttatgtactaatataagaattcactaagttagtaaacctatcattaatcccgaaaatgttaagtagtttgatgaaaatcagaagtatgcgtaaaataataacaaagaatgagaaaatctgacacgtttaagcgcatttttggtaaatttaatctgaatattcatctcattcttttttaaagaacacttacactaattacattcccttttcttctccatttatcatgtattttatataatattctcatctaaaagatcattctcattaatagtatagattatttaaaagtgggtgttgaaacctacaaaataaaattaaaacacatttcaaaactttaaaatggatgtctcttacatatgtaacagaaatcacattgtccaactatctactatacttatgtgaaaaaaacatacatatgcccaaaattgttatcaaaccaaaatgttctggaaatagcccattggacatctatttataaaattgcatacactttagctaaaaaaaagtacttcagtttgttgttagaatattcaaattcaagaattatttttgaaagaattgtgtgcagaatatcaaagaaattttgaaataattcagaattgtgtacacaatatcaaaaaatccatttcgaaaatgctttgtacacttgtgttttggcttgtatttttattttaaaagtatgatatgtaaaataaataggaagtgtaggattattctttttcttgtctaataaaaaataaaaaataatcatatgcatttatgaagataattaaacttttaaatactttttaatatttcatacatattatccatttctcattccaaaaaaagagtttaattctcagtttcagaataaaatgtgggccttatacagatttagttggcccattaatgtacaggtgacaataatccaccaactcgtttctcctgacacaaaaaatatctcatcatgtcttcttcttcgtattcgtgtctctcatttccttttttgactcttctttccaaaaaggattagatctgactcactattacgtgtcacgcacagttcattaggtacgctcggaaaattttatccacacatctaaatatctgatttatgatcaaatcacccatttttatttttccttttgtagcttctcaaatcttttgtctttattcgatttaaaagttgatgtactctgcatctgattgttttgctcgtgttttattaccacgttgtggttgaaatttgacggcggaagttcatggtggggtatgaagccagttggattcagatttttttgccaagttgattgctttctagctgattcattgaaaataacgttcctttttaaaaacccatttgttatcattgtcttctcaaaacgtatgatctggtttttcaaaagtgagtctggttgagttctatgtgtttgtgaaaatgtctcaatgagtgaaattttgtttctttttatgtttttagtgtctttgtctttggttatatagatgttgatggcttgtgggtttggaaatattgtaggtgaaggcaagagattttatgaagaaagatg

SEQ ID NO: 25453 - DNA, 3000 bp, Unknown; identical to SEQ ID NO: 11256
  misc_feature (1)..( 3000): 2750-1469P.txt file - cDNA_ID_2706187; gDNA_ID_2214486; Annot_ID_133358

SEQ ID NO: 25454 - DNA, 3000 bp, Unknown; identical to SEQ ID NO: 11256
  misc_feature (1)..( 3000): 2750-1469P.txt file - cDNA_ID_2706187; gDNA_ID_2214486; Annot_ID_183501

SEQ ID NO: 25455 - DNA, 3003 bp, Unknown
  misc_feature (1)..( 3003): 2750-1469P.txt file - cDNA_ID_2706195; gDNA_ID_2214705; Annot_ID_136954
ttttgtctattgtgcatattatgcatctgctggagtcaaacttgactcttgatcgtcggaaagggacttctccatttatgtattataatggacgtaaacaaaaattgtgagttatcgacacaacttcagaaacacctctcatttatggtatattgtgaataaacgaataagttatccattggaaaaattaaatcagtagctagtagaaacatatatgaaaaaatatactgcgacagacagtatattaactgggaaaggagaaaaaccgagaaagaaaagaaattgtcaaaggaaatcaatcgtatttaattaagaaaaggaaatctcaactgaatctgcccttttttggttaagggggcttcagattaaaaaagagttatcgcttcataatgaatgaatgaatattcagtacaggtcacgacgtcatgttacgtacgactaaaaccgcccattttcagaatcagagccgatcggggtattgtttaataacggatttaacgatcgtgcatgtcatttcgttataattccaagctttctcatcattatcattttattatcatctttatcaacttaaacagactcttctttggcggcccattcacagcccatataatgattcttaagaaaagaaaccactcgctaccgatgtaacaacaaaattattaaaatgatcactagtattatagttttcattaaaacgacaaatccatgtccgtacttgtcaacacacaccacaaaacatatacatatatatcaatctctcaggccagaggattattcaaatcattaatttgtcgaaatccatcacttgaaagtcgggttagcacgagcaatggtggaagaggaactgagcttcatctttgccttctttatgtactcagagaactgatctgatgatctccggccactactacctacgtgagagataggcacatggtggtgaagatgatcatgacgtgtctgatctgtttcatcacttgtctcccacgcatcctccttcatcatatcaccgacattcgtcatcgcccttatcttcagcttcgctttctttatatactcggtgaacctctcgtccgttttgatcgtagtatccactcgagcgatcaccggttccacctttgtaatgggtttggctgccctaggcctagccgatgtctctgcaaatttgacgcgaacagcctctgctggtgaagatttggtggagatgcgacgaacggttcggacaggactagtcactgctctgaagatcttctcgcacactctgttttcttgcttcttcttgctactactctgtgatgatgagttctttgccatggatgtcaccttgggaagtactaaaggtgatctgtgcagagaagatagtgacattaacgagctttttataatgcaaaatctatgtgattttatctttgttaattgcagaataacgtgtttcaacatgcaacaagcgaagaaattacaacttgttgaaaagaggaaagttggaaacttttacaagtttttcaaaaaaggaagagtgatgttagaaagggatcggattctgattccactatgttttctttctttctttcttcttcgttgtttttgtttcggattgttacgttcctgtcaggatttgagaatcatgcatcagctgtcactcctctcaggagggggagattatatctacttgtaacatactaatcttccaataaataagcacttcacatattattaaaatacagtagattctcataattaggccattttccataagcttttgtttacttatttcaatccactagtatgcttttcacattattcttttcctgcaatttagcatgaatcatgtatgcaatttagcatgaatcatatatatgaaacgggggtttactaaaactctatacataaatttctaaaactctaacccactccaacccggttttttctgttcgggtatcgggtccggtttttttttcgcaggccctaattaagacattcaagaaaacaagaagaagcataagaagaggcctaaatgcccagagaattaaacaaatgggcctttaacaatattttaaacaacactgaacaatagatgagatctcaacttcgaaaagctaaagccttaatataaaaccaaacatcaatctctcgccgttaaggttacatctgtcgccgccgctgagaccgccacttaaggccgtctcctccgctctatccatatccaaaacagctataaagataaacttccagagcttggtgaaggagcagcaaccctagttttcaatccctaaaggtgaagtttttgttcttctttttctttgattctactcttttttcgtcacaatagcgcagtagcgatctgggttggcgtttttattgacggattttggtgggtttgggttcgtgttagattttactttcacagattcaggtatgtatttgatcttatttagctttggtaatactcaaaccaactagtatttgatcttaattaggtgacgttgatattttgtgtgttgtgggtcaatcatccactctaggttgatctgcgtctatgtttagtcctaattttgaagaatcattctaattgctgatgtttatttatgacaattttatgtcttacttcgaatttagctaagataataaatctagacgagtgcctttataaacagtttatgtatgaacaatgcttcgcttgtgggattgttgatttcactacatttgattaagaatgtacatactattacaaatgttatcgattaaaaacgtcattttcagatattagttctccagcgagttgacacaaaacccgattacgtttcatccggcgactcgctttgatattccatggattctcagttgaatccttccaagagacgcaagataaggttcgcgtctctcatcttttccccagttttttttcttattcgaatcacttaaggcttgagaaattagtggttagggtgtgtaaattgcgtttgatatagtgtcaggcacagatgcgttgcgtgctataagatg

SEQ ID NO: 25456 - DNA, 3000 bp, Unknown; identical to SEQ ID NO: 14187
  misc_feature (1)..( 3000): 2750-1469P.txt file - cDNA_ID_2706203; gDNA_ID_2214705; Annot_ID_136949

SEQ ID NO: 25457 - DNA, 3000 bp, Unknown; identical to SEQ ID NO: 14186
  misc_feature (1)..( 3000): 2750-1469P.txt file - cDNA_ID_2706207; gDNA_ID_2214705; Annot_ID_136948

SEQ ID NO: 25458 - DNA, 3000 bp, Unknown; identical to SEQ ID NO: 11342
  misc_feature (1)..( 3000): 2750-1469P.txt file - cDNA_ID_2706211; gDNA_ID_2214490; Annot_ID_133449

SEQ ID NO: 25459 - DNA, 3000 bp, Unknown; identical to SEQ ID NO: 11336
  misc_feature (1)..( 3000): 2750-1469P.txt file - cDNA_ID_2706215; gDNA_ID_2214490; Annot_ID_133451

SEQ ID NO: 25460 - DNA, 3000 bp, Unknown; identical to SEQ ID NO: 11336
  misc_feature (1)..( 3000): 2750-1469P.txt file - cDNA_ID_2706215; gDNA_ID_2214490; Annot_ID_183640

SEQ ID NO: 25461 - DNA, 3003 bp, Unknown
  misc_feature (1)..( 3003): 2750-1469P.txt file - cDNA_ID_2706219; gDNA_ID_2214490; Annot_ID_133443
tgcttttggaaaaagagaaggctcagattcaagccccacctataaagataccatatagttagcaccccacattcacacccattaattccacattgtatccaactaatacacccacataaaatttaatatcaataatcattacctacgggattggtattttgtatatggtttgccatttgaaaaagacacttacagaatttggtaactatgatataacttcaaacgaatattgatatcattaatcaatggttgacaaaaaaaaaaagattatgattaaataatagtcatacaaaactgcatgcgttttaaaatctttctataaatgcattcacatttcagctcaacaaccttaaaaaatttatgtctaaagattgatgattctaaagaaaccatcatttctagttttgtacatagatttacttagaaccaatgaacttaaaaaagatggctagttatatcaaaattacgttcacaactaattacaattaatctttaatagtattacataggagttacattttgaataaactcatgggaatattttttttctccatgaacattgtcagagacaagatttgtcttaagagttagaactacaggatttgatcgatactatatatatttctaaggacactaaaattcgtcttaagcgattccaaaaacaagaaaatgagaaaggaaagtaaaaaaaaaagggacgagacactgcatgtgttttggaccgtttggttagagtgataaaagataaatctgtcccaaacatagatcccctcaatccacgcgcagtctcacctgatccgtattcaccaattcaccctcgtctcgaaagccttatttccgtctatgaaggttatttccgtctattttccgacaactatctctgttgcttataatctttgttttcctttgttcttttgctcggagaattttcaacttcattatagttagtgaagatttttatacattattagcagtgtttaatcttcccaaaattctaatataaaattatcgtcgcagcttttatttactttacagacaaataaagtatcactcacgaagcccaccatgattagagcgtcgaggtccaacattgttttcttaatcaaactatactattcttattgctgaaattaagacaaatattatactatgaattaatacaattttttttttatgactcgcaaaacactgtgtccactaatcattgctttcaagcacataatgtaaactgttcctatataattattggcataaaaagagagcagacaaattagtggaattggagagacaagattaattaaacaagtgatcttatcttttcaagaaactcaattcattgccatatgtgtcattgtatcaatacacttctccctaaatgattcgtttgataaaaatttataactttatcaccaagtctatattcattttaaaacccatgcaactctcatcataatgaattctagagtgatgagtgtacgtatttgtaatactcttcttacattctctattgcacttacaccactcattatttttctttctgtttcacttgttgttcaagttgcatttagatttcaaagaacacatgttcaaatgaagacaaaatcttgagtataggaaaaacaaaaggcaaagaaaaaagaaaagaaaagtgatgggaaatgggtagaaaaataacaaaaaaagctaatcaatattatgcgctggtgggtcaaaaaagtgttatttcacaaatccacaaggctttgattctttgtctctttctttcactattcattttttctatattttattacacaacaaaaggaatagtttcttcatcttctctctcacaacaacaacaacaacaaaatatgtatttcatttttgttttaaatgtgatcaactattgtttgatactactataccccttgtggccttgtccatctaataaatttatcagcatacgtctaatcaaagattgtggaatcaagctaacaaaatgaataaagacatcgatcttaacgacataaaagataaacggaatctctcaaagaaaaaacctttgatctaaaagcataaacaagaagaagaaacgtctcaaacaaattttgtaaattgtaggttaaacaaggaacacatgtaggtcctactttaattactggaccctacatactctgggccccactctctatttgccattttttgttttttaattttagctttctccgttaccgtcagtagtcgcagcagcaggagctagatagcgcccacacacacacataaagcaaaagcctttgagctctctcaccattcccaaatcccaaagactctctcatttgagggttttttgtgtttatcttcctaatctctgctccaattcgattttcacagagaaagtttcttccttttggaacatttttccggtgttgaaatctctctctgtatcggctacattgtaccggaaaaacctctcgatctcgggaatctcgccgataatcctctctttgttaccggttagtgacgatttcgaaatctctttcctttgtcgttttctatttgggatttctcgattgattctgttgaatgataaagtttaataatccctatgaatgttttctttaatcactccagaaagtgaactcctgttttctcgacaaggtttctgcaaaatctcagatcgaacaatggataataatcttaggacacacacatagagacaaacacaaaccacacactcgtgttcttattctttgtcttgaaaaccataagtaagaattagtcctgtggcttattcccaaatcacgtgttactgttgttgttgttgttgttgtgtttatatatatatatatatttgccgacaagatttctaaatatggtcccgaaattgttagtgggttttgttagtatctttctagtgagcttgtgttaattgaggttggagattgatttagtttacgttatttgcttttgtagggaaagagagatttgtgtttggtgttaaaaatcgcatgaatgctggaaatg

SEQ ID NO: 25462 - DNA, 3003 bp, Unknown; identical to SEQ ID NO: 25461
  misc_feature (1)..( 3003): 2750-1469P.txt file - cDNA_ID_2706219; gDNA_ID_2214490; Annot_ID_183631

SEQ ID NO: 25463 - DNA, 3003 bp, Unknown
  misc_feature (1)..( 3003): 2750-1469P.txt file - cDNA_ID_2706227; gDNA_ID_2214490; Annot_ID_133447
atggtgacaaagttcaagacactgggaatcatgtgattgagaggctctatgatctgcagaaagtagctgaaatcattgtttctaaatttggcaactctgttaatgcttgggttgttgaagcttctgtctttaatggaccatttgctatctacaaagactttgttccatcagtgaatcacatgggagcaccaaaatcttattccccagttggcttcccagcttcttcatcaattgtctccctcttatctagttgcctccatgaggtattgaaggaaggcactgatgtgtgtttgatagaccagattgcatcagttcatcactgtcccaaaactattgtgcttggatttagcaagggtggagttgtgatgaaccagctcatgagtgagatcagttccttggataccaactttgcgaaaacttcatctgcaatggtagaagaatctaccagccagcatgaaaagattcagatcattccagcctccaaagaaagcttcctcaacagcatttctgaagttcattatatagatgtaggactgaactcttctggtgcctacattactgatcacaatgtcgtgcagagaatctcccaacgccttgcacgaggtgcagactcgctacgcattgtcattcatggaactcctaggcagtggtgtgatgagctgcgaggctggattcgcaaggaaaaagatgagttggttcgtttgctcaaagctgaaactgagaattccggtgggaaactacaggtctgtgaaaggttctatttttctgatagacttgctgatttgcaaatgcactttgagataattgatgctatggatgtctcctaaccattcgcatgataaaagacacataataatacattgcaaaatgatagcaacttaaagccgttttatcagtacaaaaaccaaaacttttttttttttaaagacttccaaaaacaaatggtaagagaaactaaagaagacttgttctttaagatgacaccagcatcagagtaagtgagaggcttttagacggatcatattgttaccacagaatcactcttccatggcttcgttttgaacagacttcttttcggaaacatcaactttgatcttctgtgccccgggagcctggaccatatgaatgttctgatcaagttctttcatatcgtcattgagtttcttctgcttgtttggcttcaacctaagtcccatacaaaaaacaaaaacaatcataatcaaaaacagagtctagttttaaaatcatacaagcagtgttatcaaggatttgcaggagactagaagaagaagaagaaggaatgtatacctattttcgatatgtttggcttcccttgcggttctgatcttagcaatcttcttaatggccatgagtgtattctctgtaacgttcctgtcgtatctctcaggtctgtttctcttcttctcaaactcaaatgttgtatccttttagggtaaagtaaacaaagaaagacaagcaggagggtcagcatcaactagacaaccccaaggaaacaaagaaaaacttttgctcaaatgaacacgtaccttagtcatgtccttcccgtgtgcagctctgaatgctttagtccatttcactttacgtgggtttctcttcatcttgaagttcttgtgacacttcgacctacagaaccggaatatctgcaaaggagaagataccatgcttgtaagtgaattacaataacgcataagaaacaaagctaatcgataacaagacatacaaacaataaggtgttttgattaacatttatgctcaaatttttatcagaacatttgtaaacctcttatatactaaactcctagctaaagacacataaacatattgtaagaatatacaaaatggtcatttttttagctaaagactcacacaaataacgacatatatcaaaaattgttcatttaagctagagaatacgagcaaggagacattcacatatatagaatctaagagtactatgtaatataaaactcaagcaaactatttactgtgaattaaagcaggttgataaagatttatgccaaattaattaccttggcatcgttacggacaaattgaataccatgaccaggatatattgtggaagagcaaaaccaacacttctccaatctcatattgcctcgtcttgaaaaccctacaaaagactgttgcaaagttaagacatgtaaaactgaaactcagaccacaaaattgacaacaaacaaacaaaaaaagaggatactttcccagaaataaagtcgcttacttatagtaagagctaagaagcagaagacaaagtttcaatttttctctaattacacggtttcaatgaacagatattcaattatactactcaaaaattagtctagatttcaacaaatatgaaaaaatcataacaaagagaacaccaaacgaacgagatgggattaggactttgagattaagcggcaaacctgtaggtgattcttctaatttgcgacggcgatttcaggaaaagggttttgctttagagcccccctgcagaaaaaaaggtctaaagagaagaagatgactacttctaagaaatctcttagggtttatgaaacgttaacataaatttctaatttgaggcccataacctaacattgattccggcccattagttgttatgttttgtctgcccattaatgcggtaattacggcccaaatattcaattttggattccttattatattatatagtatctcgatcctttcatataatatgtaaaaaagttgtaaataaatatgcaagtccatttaattttgttttcatataagaaaacttttaattgcatatatattgttatttgaagagttttagataaaacttttattgtcaatcgataattttcatgttcatggttttgtatcagattactgaatgagtttagtcattaaaaatcttagaaatcaaatatgtaaaatatacaaaagacacacatagaagcatggaacccatctgttgcaagagaagaaaccaacatg

SEQ ID NO: 25464 - DNA, 3003 bp, Unknown
  misc_feature (1)..( 3003): 2750-1469P.txt file - cDNA_ID_2706230; gDNA_ID_2214489; Annot_ID_133417
ctgccttgaggagtatctccttcccaccaggagagaggaagtttgattgccaccccaagaccttcttccccaatctatcttttaaataactcaatgtggcaaccttggagccttggaacgattctggtagccccaaatagactccttccccgccttctcgttcaatacctagcttccttttcaccaagcagcgtctctcctctgaaatgtgtttcccaaaatagatactcgacttaaggtaattaactctctgccctgaggcaagactgtactcctcaatgatcctgattatttggcccaatgcttcatcgtttactttgcagtagaacatgctatcgtctgcaaatagtagatgggagataggaggagctcctctagccactttaagtccagtaatttgattcttttgctctgcagactgtagcatcttgaccagcatttcagtacaaattacaaagaggtaaggagagagggggtcaccttgccttaatcctcgagatgggatgatctcaccatgaggggtcccattaatcagcacttggtatcgaacagatttaacacactccattatcagcctaatccaatgatctgcaaaccccaaccctctcattgctttttccaagaagggccactccactcggtcataggctttagagatatcagttttgatagcaatgaactcctcagaacatttattattcgaactcaaggcatgaagcagttcatgagctattaagatattgtcactgataagtctgcccttaacaaaagccgcttgagtttctgaaatcaggctagggagaatcttctttaatctgttagccatcaacttcccaatcaccttgtaaatcacgttacacagactgataggtctgaagtcagtcattttctcagctttgaggatcttcgggataaggcaaatatttgtcttgttcattccttcctcaatactgcccgacctgaagaatgcctgaaccatctctgttatctgatcccccatagtctcccaaaattgttggtataagaacccattcattccatcaggcccggggcacttatgagggttgatgctaaaggtagctctctgaacctcttccttcgtaatgggggcaagaaggttattattcatttgatcagagactaaaggcgtgagattttctaactcctcaaccgtgtaacctacatcctccgatgcaaatagcttcttaaagtaggcctctgccactcttccaagatcttcatcggaggtccattccctaccctcttcatcaatgagtttctggattcgattttgggctcttctattcttggtagccgcatggaaatactttgtgttcctatccccattcctcatccacataattctgctcttttcttgccaaaactgttcctcattattatattcctgactcaattccttcttcagtctcgccagctcccttctatcaaaaggaatttgtttggtagcagcatctagtttaaactgaagctcctggatccgaacagcagaacttggctttgagactcttttccacttagatatttctcttctacagcttgcaattttctccatcattagagcatttgttttcgtagattgttgggaccagaagttacacaatagatccttgaaaccctctctctgtacccatctcttgtcatacttgaaaccggcccatttcctccagttgtctcccacaagattattaatgagcggactgtgatccgaacagattttctgtaaataagtcgctttagcctggggaaagagctccatccaagcttggtttgctactgttcggtccaatctgcactgcactaactcatcattgcgattcccataccatgaaaattgatagcctgaatgattaacttcccacaatccacacgagttcagcatttgtctaaattcaaggcaggatgactcctttctcgcaggccctccaatcttctccgaggggtccacaagctcattaaaatctcctgttagcatccaagggccacttctactcaatcccagtcttgttaacctctcccacagttctcccctttcagcttgaacaggttcaccataaatgcaggtgaggtaaaactccttgtcttgccatatcagtaacgcatcaattaatcttttatcagattgtagcactttgatctgtactgaatctttccacattagagctagaccaccactcttccctatcggctcaacagtatgcaaatcaaaaaatccaagatggcctaccacattctccaaataatttcttctcttcttagtctcacagaggaatataacctctgggaaatacagaccacgtatttccctcaggtgccgaactgtcggggtattccccaccccctgacagttccagctcagaatcctcattttaaattcgaagggttggaattaaccatcaacccttctttcaagtttttgttgctatcattctcaggtaagataccagaagagtgagagcgattggctgccactgaggaggcagaatgattagataattgagctgccacatgagcagaatgatcttgatgaacagagttctccttgcagattgagctagaagatgaagcttgtgaccctaacctttcaaagacagaaggagagtggtgtgctctgtcatttgaattacgatggccagattctcttgctttttcattgcttgatcccaacctttcgaaaacagaagggggctgctgaggtttttctccagaacccaaccgctcaaagacagatggtgaaacctgagactcttctcccggtgaattttcagattttagaaaagaataaataatgaagaattattagtcgttgacaaaacaaaaaagagaattattttagtcacacgacgtcgtttagaatatgttaattttcatcaagtcttggataaaccctagactcgtctctctatttctctatcaaaattcacaccggcgattttgagattgttctctgattggcttaatccgagagaatcaaggaattgaatg

SEQ ID NO: 25465 - DNA, 3003 bp, Unknown; identical to SEQ ID NO: 25464
  misc_feature (1)..( 3003): 2750-1469P.txt file - cDNA_ID_2706230; gDNA_ID_2214489; Annot_ID_183588

SEQ ID NO: 25466 - DNA, 3003 bp, Unknown
  misc_feature (1)..( 3003): 2750-1469P.txt file - cDNA_ID_2706237; gDNA_ID_2214489; Annot_ID_133436
aaacggcgccgttaccaacgttaccataagacaaccagcttcagtacctggtggtggctcatctgtcgttaacttacacggacgtttcgagattctttctctctcgggatcattccttcctcctccggctccaccagctgcgtcaggtctaacgatttacttagccggtggtcagggacaggttgttggaggaagcgtggttggtccactcatggcttcaggacctgtagtgattatggcagcttcgtttggaaacgctgcgtatgagagactgccgttggaggaagacgatcaagaagagcaaacagctggagcggttgctaataatatcgatggaaacgcaacaatgggtggtggaacgcaaacgcaaactcagacgcagcagcaacagcaacaacagttgatgcaagatccgacgtcgtttatacaagggttgcctccgaatcttatgaattctgttcaattgccagctgaagcttattggggaactccgagaccatctttctaaatcgcgaagaaaaaacaagttagatacgttcgttgtttttaatttataatctctcttctgtcaagttttaattttctttttcttcttctttgttttctaaagataattgtagtctttgacgaagattcgtggtacgtatgaatcgaagagaatcgttttggtcatgggattgatcgatctattaggtttgagagggggtttgtgttttgcgttgactagcagattataaaattgttgattttcgagtttttattttcatgtgttggtgataattagctttgtgtctatctatgtatgttgaattctagtgcatagttattatatcgttgaaaggttgtgattaaggttaaacaggtcactaacaatgtcaaattgttatgttcttccgttagattttgggtaataggtcaaatgaatttcttcaagtccgttactgctgattaatcaaactctaaactcattttccaaaatcacgttgtttgtacttttttctgttcaaagagttaacaacggttatttttattttaaagtttaaacggctgtagatatttataatttaacttaagttggaagacataagaaaaaaaaagatgattgttccgaggttggttagaagatggtgaggcaagaggcataatgacaagaacaagacttgggaacaaggtgattgcatttggcagatactttacatttacacgaaaatctttgtataaacatccaaatattaaaatctaaactaattttcataatcactttttggttattgaaaaaggtattgactaggaattagattctagaacttggaacaagagaatgatatatgattgtataattgactaactcacttgatcaagttgcatatatagacatggatttgatggaagtatgtatacatatagaaattgtgtgagcagggttttgtaagtgagagatgagaaagcaattaaggttggggaagagaagagcattggatgatgcaccgacgcacgtgcatgtctctgagagagaaagaagaaaagttcctttacgaggcgatgagtgaaagtgagaagaaagagagagttccttacttccaaagccacctccctcccactttgcccatcattcatttcctctcactctctcttttttttctttctttttttgcatttataacctcactccaccaattatatttttagtataacctatgattatgaatctatgatcgatcggtcatttctgttgtcctaatttatcaaaaggatattgatccaaacagacgatcaagattttgaaaaatgagaatattagacgcttgatcaacaatttttgttcgtcaaagttttggtcattacaactaaacgatccaattcatcaaggggctattgcgcttagagaagaaagacgtagtaagaattagttaacttttttatattggaaatgcatcggagaaaatgtagtgttcgagacctaacaccaaagtctcaaaagttttgggtccgataagacgatcctaaattaaattccatgatgacagctaaactatacaaccacaattagccaatatatacgttattatatatgtctatcttctaccattttactttttgttgtaccttacttttgttttatctgaattttgatatttttcggcattatgagtgattagacatctatagatattcttttgactttccaattcaatgattacactatactgaccgcacaacaaatccaataacgcacaacaaatccaatactataattgtagatagaccaacatcaactatagtattggatttcattaactattaatgattcgggtttccagtttacaatattgggcttataatgatcggaatgtttttgttaaatttgggcctataatgggctttactttaaagacaattaaacacaattctgacgcgttgacaaaaacaaatcagatacaacctttttttttttgaccgcaaagaaaaaaacaattatacaaattacaaagcagtcacgatggaccgtttataaatacgaacgtgccttgcataatctcttacttacgagaagattaatatccaatggagccctccttaatcatatgattaaattatccattgttttgtgctataaattcttccaaaagatgctataaaaaccccaaattgaccataaaaaaattatgcgtatcaatcagtatccacgtggcaatatctgaggagatacagagagagacaaaaaccctaagacgctttttagtttcgtcctccgtcaatctctctcgccgctttatccttgttacaaatcccatcgatcttttcggaatcttccctcattatgctcagccaccattaccagagctccattgtttcagttctccgttcaacgattatcggaattattcacaacactattagtatcaccgtcgccaaccgattttgattaccagctttggtgacgacagtcgtgattaaggaggttttggtaaatttcttcgttcctgtttgttttcaaagatg

SEQ ID NO: 25467 - DNA, 3003 bp, Unknown; identical to SEQ ID NO: 25466
  misc_feature (1)..( 3003): 2750-1469P.txt file - cDNA_ID_2706237; gDNA_ID_2214489; Annot_ID_183609

SEQ ID NO: 25468 - DNA, 3003 bp, Unknown
  misc_feature (1)..( 3003): 2750-1469P.txt file - cDNA_ID_2706252; gDNA_ID_2214489; Annot_ID_133422
tcaagaagatgtggagaagaccaatcgattgtcacagagtctgttctgctaaggagttttcaaatggatttgaagaaaaatggcaggcttcattgttttaaggttgttggtctcaaatccatttgtatctttgcccattttgggctttaaatgaaaagttgttcgacgaaaaaaaaagggaaaaaaattaaaaaaacgtaaaaaaagttgcaaatatggatcgaactcacgacattagtaaaatttagatgtcgttgaaccactagactactgagaattatacgatttttaatccaatagtttttaaatattgattcaacgatagggagttaaaagactttcatcgttatatatgtggcgccaacaatgatttcatttgggcggcgtaaatcgccggcgattgaagaaacttcactcgcgacttcagtcatggaggcatggaggttaccgttatcgccttcgattagaggaaaactgatatcggccggttatacttgtctgtcttcgattgcttccgtctcttcttctgatctcgctcgaggtaaatttctgctttaccctaatcttagaagattagaatctgttgctcgtttttctctgattagcacagacagtacacctcaattgattagtccttgggttgataattagggttctatttagtctcttgtttaaggcttatttctggaataattctatatatgtgtgtgtgtgtgttttgagtcatctttgatatcgttggtgtgtgagtagatgcaaatatcacagaggaggaagcatttgagattttgaagctggctaatcaaagttgttgcaatggaagccgttcactcataaatggtaacttgatgaactcctccttggagctatgttggtggtttttctccttcttaaatggttcactcaaggattctctttatgaaattttgtgactaaacaaaggagcaaagaacgcttgggatatgcttcacgaggaggagtctttgccgcgtattactacatcttgctctgatcttgataacattttgggcggtggaattagctgtagggatgttacagagattggtatgtcatctccattatcattctttctctggtccaatttgagatcattaagtgatttagtggtttgcttattttctcaaaggtggggtaccagggattggcaagactcagattgggtaaatccgcttcactgctttcctctactttctcatcatcatcagagtgtttcctcttctgttaacttcgatctggtttcaggatccagctctctgtgaatgttcagattccacgtgagtgtggtggtcttggagggaaagctatatatatcggtatgtttcttttagtagtgatgactaatgccttggttgatcacttacttggttgttaatgctttttgtatgctacagatacagaaggtagcttcatggtggagcgtgctttacagatagcagaagcttgtgtagaggacatggaagaatacacaggatacatgcataaacattttcaagcaaatcaagtacaaatgaaaccagaagatatcttagagaacatattctacttccgtgtctgcagttacaccgagcaaatcgcattggtcaatcatcttgaaaagttcatctctgaaaacaaagatgtaggtataataattttgaagttccatcccgttgatttgctgctacaagtgtatattgtgacataattcggcggctcactaagactctctttaatctttcatggttgcaggttaaagttgtaatcgtagacagtatcacctttcatttccgtcaggactatgatgacttagcccagaggacacgagtgctcagcgaaatggctttaaagttcatgaagcttgccaaaaagttctcacttgcggtaagaagaaatgatctaattcacaatacaatccttgactagcttaagtggaggttcctaatcaactcttatgatccaatctcaggtcgtgttactaaaccaggtgaccacaaagtttagtgaaggctcgtttcaactagcgcttgctttaggtgagccaaactcaaatctaccatctcagtttgctattatcatcatcatcattcatttgttatgatacttaaatggtcaacttgtgctgttttcaggcgatagctggtctcattcgtgcaccaaccgagtcattctgtattggaatggtgatgagcgttacgcatatatcgataagtccccttcacttccttcagcttcggcttcatacactgtaaccagtagaggtctaagaaactcatcctcgagtagcaagcgagtcaagatgatgtaatgacacaccacgacacagtcacaaggacatgagtaagctttctccggtttagttttggttcagttcttgattccattaaactgcatgagtttttttcggcccaattgtttcataaagcccaaatgggcaaatattcggtacaaaagaaggtcataagaaggcccactaattgcaaacataacaagaaaaaatgagcaaaataaagacacgtgctatgcaacgtgggatgttgagagaaaaaaaggtttcgtcagctacgccgtcaccgactgggtcaataccggagttggtgaattggtgactaaaatgtatttcctaaatctaaagcaattttgcccccaaaaaaaaaaaaaatctaaagtaattaggttcttcaccaacccttgtcataaccatggcttttgcttaacacaccaaccatgccgcattgtcaatctattttttacttaaattaaattattattttaataattagcgtaaaaagcaatgattagttgaaaattaaacaaaagaattagattcgaaaaattgttaaagccatagagcatcacagccgtcaagattgtgtcctttctgaatccaacggtcagatcgagatctcattggtttattaatagcaacagtctcctaaaataggtttgcagagaagctttctcttctattttctctctctcagttaaccagagagagcatcaatg

SEQ ID NO: 25469 - DNA, 3003 bp, Unknown; identical to SEQ ID NO: 25468
  misc_feature (1)..( 3003): 2750-1469P.txt file - cDNA_ID_2706252; gDNA_ID_2214489; Annot_ID_183594

SEQ ID NO: 25470 - DNA, 3000 bp, Unknown; identical to SEQ ID NO: 11327
  misc_feature (1)..( 3000): 2750-1469P.txt file - cDNA_ID_2706256; gDNA_ID_2214489; Annot_ID_133430

SEQ ID NO: 25471 - DNA, 3003 bp, Unknown
  misc_feature (1)..( 3003): 2750-1469P.txt file - cDNA_ID_2706277; gDNA_ID_2214491; Annot_ID_133474
tatgtttaagaataatctatgatcaaaatatagatgaagaggaaatgatatatatagcgaaggaactttcggtgatagggcaaaagaaacacgtttctgggaggaataaatggtttcgtcagctttcgtctttgactttgagtgtctcttcagtcaagtcaagttttgtgtgtactttgtttttcattctcaagtctctctcctcgattaaattaaaatcgtggtcacatctacgaatctaactgtgtgaatgtctcgtcgtgatctggttaactaaaggttgaatatttttaccctaataaaggttcttttttccaagcttctacactaacttttctttttaattaaaaacaaaattgaactagtttatgatttcatttgtgtatattattttacgtatagaccatgtcaccatgctatttttgttatatatcatcgtatcagtgtttgttatttgttatggttattgtggaccattggccaaacatatatgcattgtttcaatcatgttgaaggtctaatctacaataacactctcttggataatttttcacacaaaaaataaaatgtagaaaaagatgatcacatgagtactgattatggttttaacttttttttttttggtatcaatgttaagtatttataccattttcgaagttatgacagaagttacacggaatacatgtagcggaaaaataaatctacagaaagcacagacaaaaacaaacagtaatagtggttaacgttaactaaaagcggaaacaagagaaaaaacaccgattccgagaagctaaactcagaaatttgcgtgatttccacaactcgaagataccaaagagttggagtcccatcgtagttgccacgagcaaactttagcagaagcccgtccacaaaacctcttaataaagcgcctacagcttctccgcaaactaacgcaaaaacgcaaagacaacagaggactaaaacacaaatccgacggttacagggataaccaaagaaactaccttcagtcaccattcctatcaaaacaataggaaccatctcccacggataaatgatgcctcgaagaccaacgcgccgcctctattcttcccttaagactccactccgacatgacgcataacatcactgttgtctaagtacaaaacaacaacaacaaaagacaccacaagctccaacttcgagcaaaaacgatgaagaatcgaggaggctttacgaagagcagaaaaaacaaaactaaggcgatgcaccacctgatttctagatcggagaagaatcccgtcgctaggaggtccaacgaacccaaacgtctcatcaagagccacaaccaccgcagaaaggagaaacccaccacgcaccaccaactagagacgatgggcaatcgaaatctgaaacaaaacgatggagcacgagaggaggagaaacatcaaagacaacaaagagggaggaggaggagccctccccgttcgccggcaaggagtgccgcaaacggagaggcggaggaggcagatcgccgacattatgatttaaacttaatttgtaacaagaaattactctaaaatgatatcggcatagatattgtattagacttcatttttaacaaatatggttgtacaacaaccaacctaaaccatgattagtgaagaagaagcaataaaagtagagtaaataaagcccaaagaattaatgaacaaaaataacaaagaggatgttgacgaaaagtcaactccactaagctggcgacgacaaaaacttctgcgatttaagttaaatttgttgggtcctacttcgaaaccagatcatacggctgacgacgaaagtttgactcgatcctctctcttctttttcgtccgttatgactcttatcatcacacctatcttgatttgtctctccataaaaataaaaaataaaacattttctttttcattcatcttaacaacatgtattttatcaagtttaattacaatagtgtcgacgaaaagaacaagaaaaatgccgacaaaaaaaaaaatactagaacaagaaaaattagaataatgtcgaaaagcgattaagttagtggtttagccgtttgttcatcttctagcctaatagtttggacatctctttctttagtggagtaaaaaatgagtctaatgtactaattaaaccagaatagagataatttcatcctaatacaaattactagattatatacgaagtagtaatacttcatttgttctaaaaacttttttgaaaaaaataaagttttttcgatgaaatgtataattggttaatcagagtaaaaatatgtacaaaagtgtttaactgtgtctaaacggatgactagcagtttaataaggagttttggacagctttaatcactatagttgtaagaaaacaagatgtgagtttgtaagttctctcacaaagtttttttccaaagctctttcaaaaacattgaattgtaggcattacaaatgttttggtgcttaaatgaattgtatcaaaaattgttggtgttacaaattgttacaacaactcatctaataaagacttgattcttctatctcgacaaaagattagagtttgccaaagctcatgggatagtggtgtatagtaaaataaaataaaatgtattgagttctcttggtttttaagtaaagaacatgtatgcaaatatgctcgtaaacgttttaaaaatagtgatgatcaagacttatcactaccgttgcaacaaacacgtgaaggttgaatcctctaattttgtacaaactttgacttttcgaatctaacaaaaaaagaaaaagttgactcttaacaacaaaaattgaatagtaaaaaagactatttatgaacataggaaaagtctaaaccgtgacacattagtcagtcacctaccatacaaattacatcactttaaataccaaattttttattcatttttgttctcttatttactttagtcctctcgaatcccataaagtccacaactctctccttgtagagagagagattttatg

SEQ ID NO: 25472 - DNA, 3003 bp, Unknown; identical to SEQ ID NO: 25471
  misc_feature (1)..( 3003): 2750-1469P.txt file - cDNA_ID_2706277; gDNA_ID_2214491; Annot_ID_183671

SEQ ID NO: 25473 - DNA, 3003 bp, Unknown
  misc_feature (1)..( 3003): 2750-1469P.txt file - cDNA_ID_2706293; gDNA_ID_2214491; Annot_ID_133470
cgaggtccaccggataacgaggtttttctacggtggagaggagatcacgggctgactcaatagtggcgagattgatgtgtaggttctttgatgataacgagagatgttttgcgagtttgagcattggattgatgtgaccttggaatggtagtgttaccattaggacatgtgtttcttgaccctcactactgcccattattttttatttttttcactaatagtttagattttcatgaaactttgagtcatatataatagcaatggtggtttgatgagagattttgcttaatgaagacataaaattagattatggtaagaaaatctgtctatagtaatggctaacccagtcaactgttagcaagtagattctttagtatccaccttttcaccaagtatgttcatctattggtcatcgggtcagttacaatttttatcttattattaactaaaaattgtttattagtgtgacacttgaccgttacaatgatcaacttttgtatgtgtcaaaaatttcacaagattttcacatctgtttagtattgtttctttatttataaaatcatttttatagtaaaaaagtatgaaacatagaattaaatttgaaataaagtttggtcaacgataagatatccaaaataaataaggaataaaaagaaaagtgtttaagtggcatgtaccaaaccgaatgttaatttgctagaatgtataaatagcccaaacatatattccatttgttcctttttatttgattgtttagaaaaatgcacatattaagaaaacatattaatgttgattttaaatgtattattttttgtattttacagtttcctataattttaaatcaatgatattcaatcatttttattaaagtttacaattcattgataataattaataaatattacatagaaaatttaaaacatcgatctttttgaaatatttttcttaaaaaatcaaacaaaaaggaacatagggaataggtgagtctcgtgtttttttatgtaccatccaactcagatctcattttcggtaatttctaatctacaggtttattttcttttataaccaaaaccaatgaatgtgaaaatataaagaaaattttacaatgtacttaaaaagaaaagtcctccatacacatattcgtcgtcatacattaagttccactaaacgatttttaaggatggttttgagaaaaaaaatacacacacaaaggttgaaatatcaacaatctgatacttcgctcatgaacatttcaaagaaggctactttgaatggaaataacaacaacgtgagaaacaagaaaagtacatagatagattggtggggcctgaaattttgtaacatcaatcaagtttgatgcccacccaacaattttaattttcaactaaaaactacttcgaccgttaatttggtagaagtagtgaatttagtattctttcaaattaacggtcgaagtagtgaaaatggttatgaaaaattatgtaactatttagatcatcaaatatatgtttgtggtaatcaatccttagaaaactcttatcataaaacatttttgagttaatgtcatctacagtgattatagtatacttgaaggaaggtgaggacattaggttttgtcacaatattatatagataaacataaaataccatactagatttgaattccacacatagtttatggtctacaactaaaagtctattccaaacaatcagagacaaaattaaaatcatttaatttcttcagccaaataactaatctccattcctcgttgatggctttatatgttcgcaaattatatttttaaaaagaaattggaagaccaagaacaagaagcaacctcagtattttcccaggaaggagcctaaaattcaaatctcacgtcttgttgaattttaagcttatgaagtcaaaaactgaaaatgtcaaacttttcttcttcttcaaggctcttcactttactatatattctaactcccaagtccacaaactactcacaacaaatttagtcatctcataaattagggaacacaagaaaaataaaataaaaaacatttttgtttttactactcaaaaataccactcaaagaaaatgatgatgaacaaagttgttttgggttcgtttctgtttttcatgttggtgagttcgaattttgtggtggaggctcgtcctttgggtttaacgaaggctgaagagaacctcgtggctaagttcttcgatggtttgtcacttggggcgattaaggagtcgggtcctagctctggtggtgagggtcatcggttcgtggaccggactgagacgcttgaatatggtaagcattcaggtcccagcacgagtggacccggtcactaagttcccgaccgaaccagttaatgtggctgctttggtctagctccggaaattgattgctttgtttagttttttttcagattaattattcagatttttctttttatgcttagaacttgggaaaatcaagaattggaagaacctcatttgttctctgtaggaatattcttttgttaacttattgaaattcatttgataataatgtacaatgtaatatatattgtaattaatttattattctgattatgtgaatgaataactggatattcatgtttttaatgagtttcaataacaacatagttaagctccaaatccacaaagcaaaaagaagcgacttaactttaaccttcttctgagtgataatcacctaagcttacctctttaacagctacatccacttcaactttaaccaagaaatcgcgatttccgtggaaattgaagttaaccaattctttagatagtttctgaaggatgttgttccggatggagctgtggaaatttggcttggacaacaagttatacacatatctagtgcatatttcttctccattatataggtaaacattaggagccttacgtgcaaagcaattgaacccatttatggacatcatcaagcaggaattgatgcaagtgtgactccttgttgtattgtatg

SEQ ID NO: 25474 - DNA, 3003 bp, Unknown
  misc_feature (1)..( 3003): 2750-1469P.txt file - cDNA_ID_2706296; gDNA_ID_2214491; Annot_ID_133472
taatttcaatttatatacatgcaaattacaaaatataatagtttttgggggataattatcttcttgcgcctttttattaaattaatatgctcatatagcagttcttacaattaatataactagggttttaaatttcaatatcgagttgacaaaatgaattgtttacaagtttttttcttttcaatatgcattgttcatcacgtattcgtagtgatgcaaaaacaaactataaattataattgcactagtgagattagcaagaagtgttataaattagaataaacggaactatcaaactgtgttatgtacaccatttatttttgttaaagaatatgtgtagtagttagaaaactgatcaaattaaactgaaaattcacattacggagatcaagttacattgtctattgatgaaaaaaacaaaataaatccaaatggcactaaaagttgtagaaattgaaagaagaaaatagatttttgtctaggaataaaagtcaaaatgggaaagacaaaaaaaagagaggcaaataagcagtgatggagctaaagcaacgctttactcttttaattatgaattatttgatttgacctccactcgcctggctttttttggttgttctttatagaaaagtaaaataacacaattagcacataacatgagttatcgagaaaccaattctctttgtggtgttttagttaatttctataacttatgaaaccattttctcagtttatcatgataattgatcctctatttaaaaccctaaagtttatattttgtttgttcaaacacagtcggtactcaaaatagatgaaacataaatttgattttatttctaaaccacttggaaaaacatatactattattcttctcatgcaaaggaccccattataaaactaacatggcttttactattggattcactgtagtgattaagggtgtatcaccaactgttttgaatttttgtcaacttaattagttattaattaagaagtgggtaaagctaacataccaaccttttactacacaattatcttaaaaaatccttaaatttataagaatagaagaaagctaaaacgaataaggaaaaagaacagcaatcgagtgaaatgatgaacatattcaactcccaccattttgtttatatggatgagttccaaaattttggggcatacattctctaacagtattgagatatttcaataatagtatttgcataatgaaaagtaatattgatcatttcagaagattatatgctctttttatttaactattacgagatacatggttttattttgtaacatgttatttttaccaaataaaatttgttaattgttttactcatatcattaagctattttcaatggaatctaatatattggacgtgtgacattatcttatattttctgtaattatttagcatgttaaatattgatttttagtatattcatgtatggtaataacaaacaattatattgaaagagtcgtatactcgtatgtatgactgtttatatcgtaatcgtatatactgcaagttaaattcaacaactgtaattactaattagataaaatcaaatatctgtcgggcgtaacatgcgacccaacaaacgtcatgtgaatattttaattcttctattagtttgttaacctaatcgtgattgggtattcatataaatacacattttcatataaatacactttgtatatggtaagttatcattttatacaaaaaaccaaagaatgttttcttctctattatatcatcatatcccataattatgggaacccaaaaaaaaaaaaaattggaccctccattataaatataaactattgtcatataaattttagacataactgattttgtcataaagaaattgaaaggagaatctccgtgacggttggatatagcaataataacaactcttaataatcatagcaacaagcaaataaaagcagcacatggaagccatttgcgcaaggataattcttgtaagaacacattacctaaaagctaataataatgagaaaaacagcagaaatattcgaaaccatattaaaaaagaatgaaacatttcttaaataaacctaaactagattcgattttgcatgtttgatccacttgatgtatgaacaaaagaaacataaaacagtaagcaaaagtcaaggatctaatgtaaagtcataaggaaaaaaactaaatttaaacaagttgtaactgcagatcatgttatgtcttttaactagtaaatcctacgaccaattagattagagcaaccaattcttttatgattttgatttttgagagccaatttttatttgtattgaaaataatagttatatttttcactcctataaatttattttctactaatgaaattgttgtttataaaagtattctgtgtgtaatagtctataaaaaatatagtacaattttacacatttttaaaagttaatatttttgatattttgtatagtaaatacaaaaaataccaccacacaatacattgatgattcgaagtttcgaaccaccattttcattgaatcagctctaatattaaaaaaaaatgatttttttgataaaatatataaagaatgttagttttgttaaaccaatatatcataaatacgatagtatatatttttgtattttattgagcttgtaatcagtacatggatgcgaatccgagtgacgttgatattggtacaaactacaaagtatagtagtctaagtatatgtccatatatatataataaatctgttatattcaatgattaatgaaacctggaaactggaagtgcaaaaatgcattgattactttaatcgaaaagaaaaacaaaatgcattgattatagtatttataaaactgcagattttgcagagagcaggaaacagagaggtttggttttgcgttgcgtgagctgtttcctctttaactctctcttcttctacctcttgaccctctctctctctctctggtgatgcggtttcttccttggaagccatg

SEQ ID NO: 25475 - DNA, 3003 bp, Unknown; identical to SEQ ID NO: 16598
  misc_feature (1)..( 3003): 2750-1469P.txt file - cDNA_ID_2706298; gDNA_ID_2214491; Annot_ID_133473

SEQ ID NO: 25476 - DNA, 3000 bp, Unknown; identical to SEQ ID NO: 11366
  misc_feature (1)..( 3000): 2750-1469P.txt file - cDNA_ID_2706305; gDNA_ID_2214492; Annot_ID_133496

SEQ ID NO: 25477 - DNA, 3000 bp, Unknown
  misc_feature (1)..( 3000): 2750-1469P.txt file - cDNA_ID_2706317; gDNA_ID_2214492; Annot_ID_133491
agtctttctaacgcagcctgcagagtaatccttcaagtcccagtctttctgcgacataggcctaaacccttgtgggcaacggcaaaaaggctcagacttgtcactgcaaattccaaaggagccacaatacctatagacctgacattgttgtcgaggttgagaccagaacaagttccatgccttgtttccttctaaccaagtgaactgtttgatctgtccagacacgtccatgacgaagcgtgacacgttcaactggttatagatagagtacgtgaagtatgagtctgtggtgttagagaaaaagctgaagttgtagatgtaattgagtctcatctcgggaaccgaatcaaagatcctgctctgagggttccaaggaccacttgaccagtactcattagatccgttccagagaattttgtaagctgtggattcgtctagctcgagagagaacaaacctggtgatggatcttcgagactcttccacgaagtgagtcgctggctctttccggttcgtttatctaaccggatcttcactccgggaagccacgtgtctcccgggtgatcaaagctttgccacaatacgttagctgataagctagagccgccggttctgagaacaagattgccgtcgtcttgcaaaaccgcttcaagagcagaaacagaggaagtggagttgagaccggtggaccaaaccggagtctggtaattaccgtcgagtaggattaagtttccgttggagattttgaaaactgatgagtttttgtcggaaactgctttgtctcgattggctacccatagtatggtttgagagagttgcttataccacatacctatgtagaagtttgaagaagaacctggtttaaagaaacccatttcgtaagttccgtcggaggagacaatagtctggtcgccggagagagtaaagtcgccggagattgtgtcgacggcggaagagccatggatgaagaagcagatgaaaaagaaggaagtgagggtcaagaacgaaaccatgagaaaagcttagaggaaactggaaagagagagagatcatatgattatgaagagagactcttcttttaaaaaggagaagactccgtgaggtttggtttgttaatggcgattatcaaagagaggagatatgtcgtatgtttgggttggtttgtttattggagaaaagtcaaacaagttacaataattatgatgggacggacctaaaatacttttcttgacctcgtcaaaaactcaaatattattagatttgtgatttgtctttctcgtatatttcacgttgtgttctgttgtgttgtgtgaataaaatgcgtagtcataaaatgcatttaaccaaactagcacccaattcgtattatgaatgaagtctaacgtcttgactagttaatatggtcggacatatgatgattatacaaattggaaaataatgtgtacccaaattcttgtttttatttgtgggtcaagatatactttatttttaaaacacctcttgaattcttatagaaatgtttttagtcaagataaaaactttaatcaaaatggtggaatcaatacaacaataaaagaaaaaaaaatgtatttaaaagatcatgtttagctaaagaatgacaaccacgttacaaaatcgttttgagatgagtgaaaattcgcttccttaaatcttttaggtaatctacaataatatatccctaatatattatacgtatgttttcgtcttttcgatctcaatatcttttgaattttgatagctaaagaatgaacaactacgttctacgttacaacaccgttttgacataaatgaaattcgtgtacttcaaatcttttagcccacaataattttttttatcccacaataatatgttgtcatatcttttgattcgccgtaaatgatcttctaaaaccttttgctaacctaaaatacaccctctgcttttttttttttgcttttttttatgtatttttttaatgtttttggaatttttttttgttttaaaatagatgaggttttcaatttttaatgcaaaattaaatatatttttttaattattttaacaatttatattctacagattgttttcatactggttaaatcttgtttaagtagataattaatagtactataattaaaaataataataataataattcgtgattggtgtgtgaaaactttaaacatcacatacaatttttaaaaagaagtattacaaaaagaactttaaaacaaatacgattttttttgctctttctctctctttctccccctatataagcatcaaagggtttatcataagctaaacaaatttgctcttacacatcggatcataagctaaacaagcaaacatgttttaaataccgtcagattatctaacgtaagccttaatccaacggtccaagttcaatctcttacaaagtcgcatagtctctaagccaccagattcctctcccctccgatatcgaagaatagttttaagttttaataaaatctccggtccccgtcgccggcgtcatcggaagacgaattcgtatcttagaactgtaatttcgtactcggcacagtacaaactttgccggagtagagtgagattacgattgtgctcacgtaacacattctttttagaccctaactaaaactcgccgccgccgttcgccgactctgttaccggttcgtttgctcgatcttgaactttgcttgaataacaaatgcgtgtttgcgccatttataatcatctgttctatattcatggtcgctgaatcaatgttttgatcactatgcttagtttcgattttgaggtttaagctttctctgcagaaacttctgtagttcagaggagatacgtcatttgattcttttattgttacttgatcttagtgaagtttctatagatgctgatggaaatgataaatgttaatttgaatcaaccaaagaatgttattgtatctgcaaacgctaatacttgtggagattatgacagataagaaggtgaagtgatg

SEQ ID NO: 25478 - DNA, 3000 bp, Unknown; identical to SEQ ID NO: 25477
  misc_feature (1)..( 3000): 2750-1469P.txt file - cDNA_ID_2706317; gDNA_ID_2214492; Annot_ID_183711

SEQ ID NO: 25479 - DNA, 3003 bp, Unknown
  misc_feature (1)..( 3003): 2750-1469P.txt file - cDNA_ID_2706321; gDNA_ID_2214492; Annot_ID_133490
tattaaaactaattataaatgtattaatttttgtaatttatatttttctttaattataaattaacgatattcaattaattgttctaaattttaaaattcattaataataactaataaatagtgcatagaaaacaaaaaaaaaatcaatcattttgaaacaatagtttttctaaaaaatcaataaatgatcaaaataataaaaatgcaatgaacgcgacaaagcaaagtttgaataaaagcaattaatgaacctttactcaagagtacattaactggaaatatttgatgaaacaattaataaagttttacatcggtttggaaagccgcaccatccaaaatttgagatgaaagaaaaaaattacccaaactatggattttatagtttttgcgatcaagataccacaaacttaccgatcgggtatgccatgaaaaagcttaaagctaacattcaagatgtccttgaaacctataacgatgattattttgttataggtttaattacctacgacaatttgaaacttttttcccattctgactattgtactctaataaatgatgcaatcaaaatcttccatgcacagagaagagttggtaattgttgcaattgtaaaaacaaaaacccataaaatctcaagaacctcatgtcacacagataatgccacattgcttacttaaaaaatttgctttcttgtttttcttttttttttttttgccaagaaaccaatgtttttcttttctctttttttttttttgagcaaaaccaaaaaaccaatgtatatttgtactttaccaataataaaatctcaaaaacttgaagataagtttgatcaaggccgacccatgggtaaaaagcccaacaagcgaatgctttaggcaacaacgtttataaatgtttttagcagcctcactaaccatcaagagttttgctttatttgttatcatattctttttcgcagtatacactataaagatgcggtcatattatctatattttttgtaacgatttggctgggactgtttgtggaccacgacgtctatttttggttgatggatttctacaatatacgatactgaaaagagtaaaaatcatttattttattataaaaataatgtctccaactttctcttgtaataggttatggcttgtattcactgattcttaatgcattctagtataactttatgtcatttatttatttaatttagtggtttatcatttaagccgcatacgtctttactctatctctttctcctagagtataactataagttatactatgcaaacatgtgagattttattagaaagtataaaagatataggtagatattaagagataagctacgaaagtagacgacattggtgcgttgcgttaaaagaatttgtagttaattatttagaatgataaactaagaaaatcgtactaaaaacaataataaagaaaacaatgagatgaggaatcacacatggattccattttcgtgacattccacttttgggggtttccactaaattttttataactttgatttcgtgtctcttcctcacgagataaaatccccctttgaccatttgtttcgtccaatcaacttaaaacctagcaagaactattaatcataatataattattcagattcttagatatgctatatactaatgtgcctaaactcgtgacgtatcggaccagttttagtcccgccctactttcaaactaataatgttttgtaatctcaatacttttccttcaaaacaattttaagaaaactgccgtatttgttatgagctaattataatcgagcatcctaccttgaattaacttggtttcaagactaattaagatcgacttttccaaaataaagtcatgcataaaaattgatttaaatattatacatacgagttatgacaatttgtatataaaaaaatttgctggacgtttgagtaaaacgtttcataaaatataggaactgaatcttgaagataggaaccggaaacaaataactaaaaagatagcctacgagatttacgtggtaaaaaaataacttaaaaccccataaaaccttaatcaaagaaaaaatggtttaataaaggtttcaaaaatttagtaatggttctaaaatcatttggtaccccccttattaaactttcaacaaccttatacacctactagatttgtggtatttttaataattttgaatttttgtggtagttttggaaaacatgatttaataatttgaagcttttcgaattactctataatttttaatagagatcgatcattatccctaaatatatttataaaaaatctgataattactaaaatgttaaagaaaactaaccaatcatcttgcatctaacattcttacttatctgcctatataagcaacaactcccatttcttgacttctctatgttcctaacacttctctcaacctttatctgatcgcaccaaaccagttttttcgcatcggcttcttccttttgctactagctctcctctcttctccggtatttttgtctctcttcttaattcacacagatttcatgataagtgatgatctataacaagacgctaactcttctcttgcatttctcgtgttttcattttcttgttacgccaaatttatcccttcaaaatcatttttttatgcgtatagaatccaaataataagtaaaagctgattcgtcttcttccacttaacacaagtaagcaatgagagggtgaagatttttctttaggaaaaaaaagagagtgaagatattttttggcttgatctcaacattattttttcttaaaagtaaacattttcaataagaaaatacaagacccataccgaaagtttcttcttaaaaaaaaaaaaaaggttttgaactgtttcatgataatgataactaaaaaagtttttgctttcttgttttttttcctccgcaaaacagtcttaaagtataaccaaaaagcctataaatcaatataatttgttgttttgatttacgttttacagaaaatg

SEQ ID NO: 25480 - DNA, 3003 bp, Unknown; identical to SEQ ID NO: 25479
  misc_feature (1)..( 3003): 2750-1469P.txt file - cDNA_ID_2706321; gDNA_ID_2214492; Annot_ID_183710

SEQ ID NO: 25481 - DNA, 3000 bp, Unknown; identical to SEQ ID NO: 11364
  misc_feature (1)..( 3000): 2750-1469P.txt file - cDNA_ID_2706329; gDNA_ID_2214492; Annot_ID_133488

SEQ ID NO: 25482 - DNA, 3000 bp, Unknown; identical to SEQ ID NO: 11362
  misc_feature (1)..( 3000): 2750-1469P.txt file - cDNA_ID_2706333; gDNA_ID_2214492; Annot_ID_133486

SEQ ID NO: 25483 - DNA, 3000 bp, Unknown; identical to SEQ ID NO: 11362
  misc_feature (1)..( 3000): 2750-1469P.txt file - cDNA_ID_2706333; gDNA_ID_2214492; Annot_ID_183706

SEQ ID NO: 25484 - DNA, 1801 bp, Unknown; identical to SEQ ID NO: 11834
  misc_feature (1)..( 1801): 2750-1469P.txt file - cDNA_ID_2706352; gDNA_ID_2214519; Annot_ID_134015

SEQ ID NO: 25485 - DNA, 1801 bp, Unknown; identical to SEQ ID NO: 11834
  misc_feature (1)..( 1801): 2750-1469P.txt file - cDNA_ID_2706352; gDNA_ID_2214519; Annot_ID_184539

SEQ ID NO: 25486 - DNA, 3000 bp, Unknown; identical to SEQ ID NO: 11382
  misc_feature (1)..( 3000): 2750-1469P.txt file - cDNA_ID_2706369; gDNA_ID_2214493; Annot_ID_133513

SEQ ID NO: 25487 - DNA, 3000 bp, Unknown; identical to SEQ ID NO: 11382
  misc_feature (1)..( 3000): 2750-1469P.txt file - cDNA_ID_2706369; gDNA_ID_2214493; Annot_ID_183740

SEQ ID NO: 25488 - DNA, 3000 bp, Unknown; identical to SEQ ID NO: 11381
  misc_feature (1)..( 3000): 2750-1469P.txt file - cDNA_ID_2706381; gDNA_ID_2214493; Annot_ID_133509

SEQ ID NO: 25489 - DNA, 3000 bp, Unknown; identical to SEQ ID NO: 11381
  misc_feature (1)..( 3000): 2750-1469P.txt file - cDNA_ID_2706381; gDNA_ID_2214493; Annot_ID_183735

SEQ ID NO: 25490 - DNA, 3000 bp, Unknown; identical to SEQ ID NO: 11380
  misc_feature (1)..( 3000): 2750-1469P.txt file - cDNA_ID_2706385; gDNA_ID_2214493; Annot_ID_133508

SEQ ID NO: 25491 - DNA, 3000 bp, Unknown; identical to SEQ ID NO: 11380
  misc_feature (1)..( 3000): 2750-1469P.txt file - cDNA_ID_2706385; gDNA_ID_2214493; Annot_ID_183734

SEQ ID NO: 25492 - DNA, 3003 bp, Unknown
  misc_feature (1)..( 3003): 2750-1469P.txt file - cDNA_ID_2706393; gDNA_ID_2214493; Annot_ID_133503
agtcgaaatacccactggtgtcacagatgtcagcgtgctgtccgccttcacggccaagagcctgtatgcttttattgcggaggtggatttgttgaagaacttgatatggctcaagccagcccctttgatatgtttagatcccacaggggtgttgtagaacgtgatcagacttttgatctcatggatgctttctctgtgtttatgaggaaccgcttagctgaaaggagccacgacagagaaatcagaggaagaaccatcagttcaggtcctgaaaactttcctggtctggcccctttgttgatctttggtggtcaagtcccttatagactaactggcgacaatgcagtcgaagccctcttcaatggcggctcccctggcattggcatcacacgtggtaacaccggcgactacttcttcggtcccggccttgaagaattgttcgagcagctttcagctggcactactcgccgaggcccaccacccgcaccgagatcagcaatagacgcattgccaactatcaagatcgcgcagaggcatcttaggtcatcggactcgaattgtcccgtgtgcaaagacgaattcgaactgggatcagaagcgaaacagatgccgtgtaaccacatctatcattctgactgcattgtcccgtggctggttcagcacaactcttgcccggtctgtcgccaagagctaccatcagctagcggaccttcaagcagtcaaaacagaaccacccctaccagaaactacagaagcagtagtagtagtagtagtagtaacagtcgtgagaacgggaatgaaagaaggaatcctttctcttccttctggccattccgttcgtcaggttcaagctcaagctccactcaaaaccgtggaggcacaagaaactcggatacaagcgatgagaaccataactaccatcaacagcaacatcaacaatcatatatgggttacagtggctggccttttgattactaaaagtctaaaagtgagctaaaacaaatctttggtctcactttggtctctttacttaaatatgcttgtgattctgcatatgccttgtgcttcactctctatctctctcactctcttttatcaacataaataatggagaactgtatttgttactgtagattttctttctctgttaaaaacgagttcatcattttctatatgctttgttaaatatgtcattttagttgggtttttgaaaatggttgaaatagatttttgagttgatcgataaataaataaatgaaaacgtctggacactcttgagcgatctatcagtatctcgtgatcttcttcaatactaataaaaaaagggaaaagaaagagaagagagtcgtgctcataaattaacggtgcagagcgattgaacaaaaacaaaaatatcttccagaaaaagccatttttgattgcgtataatgaatacacgaaattaaaatcattacttgccatatatagtacactatttctcagcttcactcactctcgagactcgtgtatgttgatttacggtttgttcaagcaaaggtgatcatcaattcccaattttttttacgtcactattttcgattcactccaatggcttgcgtgttgctgatttcttgattttgtggttcttgagttagtctccatctgataagtaagtaaattatgtgattgtgatctgggttttgctaaagttttgatttttattattgttgtttagagaatgatgaatctaggatctctttcgttgagtacgagcaagtcgagtaagccaatggttagcatcagcttttggataccgtatttcactcactggggagagagcctgctggtctgtggctcggctcctggacttggttccgggaatgtgaaaaaaggtttgctgctaaagccatcccagcaagatgatcagctcatctggagtggctctgtctcggttccacctgggtttagctctgactattgttactatgtggtggatgactcgaagagtgtgttaaggtcggagtttgggatgaaacgaaaacttgtggtgcctgagacattgaccggtggagagtctgttcatcttcgtgatctctggcaggtttgagttctttgtccttttcgagtgtattatacaaattttgtaatctgattttgtagtgttgtgattgatgttctgttcctttaattttagagtggggatcaagctcttccatttagaagtgcatttaaagatgtcatcttccaccacagtttcgatgtgaaagtagaaaaacctctaggggtctttatgaataagtcagatcaagatggtattcatttttttatctaatcctatcacaccattgtctctgagattctctagtttgtgattgatctctttgctaactgttgtggccttatgactttaccatgtaaacagattcagttgttgtccaattcaaaatctgttgtccagacattggagagggaacatctgtaagcctttctctatgatctttggttttctttcttttcatgtttgagcctgatgtggtgttgtggccatcattcttacccttgattatgacatgtacaggtgtatgttctaggcaccccagaaaagttggggaattggaaagttgaaaatggacttagactcaactatgtcgatgattccatatgggaagcagattgcttgatccctaaagcagactttcctatcaaatatcctttctttttactttcttccagactaattagttgaacatagttgacacttcacttctcatatgctttctgcatgttgggttcttaacgattctttcacatatagatactgtaaagttcagaaggaagatagcatagggtttgaatctggtggtaatcgggagctgtctcttcactccatcggtagtaaacaggaatacattgtcatgtcagatggcttgtttcgagtaagtaacagagacaagctatgaactagctctaatgtgacagaatcaatgttgtcttactattatttaattttacttgtaggcaatg

SEQ ID NO: 25493 - DNA, 3000 bp, Unknown; identical to SEQ ID NO: 11376
  misc_feature (1)..( 3000): 2750-1469P.txt file - cDNA_ID_2706397; gDNA_ID_2214493; Annot_ID_133501

SEQ ID NO: 25494 - DNA, 3000 bp, Unknown; identical to SEQ ID NO: 11390
  misc_feature (1)..( 3000): 2750-1469P.txt file - cDNA_ID_2706397; gDNA_ID_2214493; Annot_ID_183727

SEQ ID NO: 25495 - DNA, 3000 bp, Unknown; identical to SEQ ID NO: 11397
  misc_feature (1)..( 3000): 2750-1469P.txt file - cDNA_ID_2706401; gDNA_ID_2214494; Annot_ID_133523

SEQ ID NO: 25496 - DNA, 3000 bp, Unknown; identical to SEQ ID NO: 11397
  misc_feature (1)..( 3000): 2750-1469P.txt file - cDNA_ID_2706401; gDNA_ID_2214494; Annot_ID_183757

SEQ ID NO: 25497 - DNA, 3003 bp, Unknown
  misc_feature (1)..( 3003): 2750-1469P.txt file - cDNA_ID_2706409; gDNA_ID_2214494; Annot_ID_133540
caattcaaataatataaatatgcatattttcccagaaaaaatacttttattctttctaaatccaccaaaattcaaaaataaatattaaattatttattaataaccttaatttcaagtttttttgtttatgtaatatttgatcatttaaggcaaatagagacatactcaaagtccaagtttgatataatttgtaaaattataattgatttcaaaatttataacacatctgctagaccgtgagtaatattaaattcgaattgtcactgatggttagtcacatatgtaaaaaagtttgaaagagatttaagctatatttattggttttaataaaaaaaaaatttatggttgaacctcacagttacaaaaataaaaatatattaaaagaaaagttttttttattacaaaacaatttttttttattgagcaataacttcttgatgtgaatgttttattgagcaatatcgtttttttttgtggtgctctaccgtaaaatttcgtaatgtatttttggaacaattgacaaagaaaagaatagaatcgcatatattattattattttccgcgaaaacacttagaaattttgtgagcaatatacttttatcctttcaaatcacatgattcgacattgatatgctggaatatctttttttctcaagacatgcaaagttgaagtttcttcatcattgagttgatagaattctttgattagatagataaagagatggaaaatgaagttgacacttttattctcacccaccaatgtgaagtatttacaattggttgttttttggatcccaaattgcagttgaaatgatgacaagaaaaaaaactgcggttgataatcaccaatcaaacctatactattatccctgtatcccaatataaaatcaagagttgtacttgtaattatatttaagtttgtctatttaaaactataatgcaaagaaatggttacatttgtttttttttcttattctttttcaccggttacatttgatttaatgtaatacttttagaattaaatagatcttgcatttcatacaaatttgtatgtttgaacatttgcaaagtgttatattttattaagaccaattggaacccaaaatcaatgaataattttgatacggcaaatcatcaatctcgaatatgattagtaagtgagtgaatgtgtaccaaaaatgacaccttaattcgtcgtcgtcatcatcttattacaattatccgattagcagaattattatttcaatttttgctttctgaatttgaatgcttttaatatatatatatatatatatatatataatatgatgagagagaaatttattgagtaatcaagaaagatgatttgcaaaactaaccacttttgataatttaatttaaaatataaattaagaaaatttactattaagaaaaaaaatttattgagatttctcaaaccatcaatctcatcaattggtaaactactctctcaagatgccacgtagacaaacactctgatagctaattctcaaatgccacgtgtacctgcaaagctttcctacttctcaaaacgtgagaaggtttcattgaggaaattcaaaacgtcattataaacactcttcttagtttatgatcgtctcctctccatctatccctcacgggcctcacccttcttggtttataattttagaacattaattactagagtttatgatttctttcggttctctagggttttcacttcgaattgaagccgataacatattaaaatttagtcgaaggacgaaactttttggttttgaccgtcttgattaacaaattttcttttctttatatcgttctcacatccgctattttatcaattatataatttttacaaagcatatattttcaaccgctaaaccaatcgtttaaactgcttgataacatttaaaaccgcaaccgtccacttttgtatactcctgtaattttatccacattggctgcgtttaaaccaatcacactaagttccaaacaaattctttcttatactgagtatgaccatcgtttttagttgtaaagaaacaaattttttgtttttgatttaatcttactattctgaattttttggtctaaaattccttaaattaaaaaaaaatagaagatttaaacgaactaaaacaattgatacaaatttattttctattaaacaatattacattaaagatcgaatccgggtcgggtaatgtaactcaaaacttgcttggtgcgaccctctccactttgccagcctcattcatctctaaaaataaacaaaaaccagtttttttgttgttgttcaggtcaagtagtttggtttaactactttttatacgtggaccaatgaaacaccaagaagccactaattttctttattaaaaactaaaactgaataacaaaataactaaaaaaaaaggaaaaaaaataaaataaacaaacaaaaccgaacattatgaaagagagagaatgccagatggatgatgaagatgagccgatgagagatagcttcatgatttgtctccgcgaccgcagttatctctttctaatttctgtctgaaataataaattaaacttcttctactacctccgatcatcataatcctccggtaagacttctcttctcttcttgaatcttcttgatgcagcttttttttgtcggcatacaacttttgtatttttcatattttttttttctccagctgataaactcagaattcttgaaattcggaaacttttcatttttctttgaattgtaggaaattatcattgttcgtatttatcttcttaaaaaaacactattaaatcctggaattggtaattatttactcacgtttccgaatttgtttacacaaagatgaaaatccgatgatcttgattaaagtatgtttgattcttgtataccatatttgtttgattagagtaatttgatcatcaaagatgttttgtattcaattttttctcaattagtctttatgttttgtagcaatttcaggttacaggggaatg

SEQ ID NO: 25498 - DNA, 3003 bp, Unknown; identical to SEQ ID NO: 25497
  misc_feature (1)..( 3003): 2750-1469P.txt file - cDNA_ID_2706409; gDNA_ID_2214494; Annot_ID_183776

SEQ ID NO: 25499 - DNA, 3003 bp, Unknown
  misc_feature (1)..( 3003): 2750-1469P.txt file - cDNA_ID_2706421; gDNA_ID_2214494; Annot_ID_133528
tgcaatgacaaaaattaaaagcgataactaaagtggttggtactaaatcgagatagtaatgcttttcaaacttgcttttgtcacagcggtttccggcgaaggattcttggcgagggatataatgataacaaacacagcaggacccgagaagcaccaagcggttgcactacgagtgaacgcggattttgtggccttataccgatgtgtcattgatggttaccaggacacactttacacccactcattccgacaattctaccgtgaatgcgatatttatggaaccattgattatatctttggaaacgcagccgttgtcttccaaggctgtaacatcgtttcaaagttgcctatgccaggacaattcacggtaattactgctcagtcacgagacactcaggacgaagataccgggatctcgatgcaaaactgctccatccttgcgtcggaggatttatttaatagctcaaataaagtgaagagctacttgggacgtccgtggagagaattttcaagaacagttgtaatggaatcttatattgatgagtttattgacggttcgggttggagcaaatggaacggtggggaagcacttgataccctttactatggcgagtataacaataacggtccgggttctgaaacggttaaacgggttaactggccgggttttcacattatgggttacgaagatgcctttaacttcacggcaacagagtttatcactggtgatggttggttgggaagtacttcgttcccttatgataatggaatttaacatttttttttgctagaaatgtatagggtttgtcttcatataaaaatctaattacaataattaataaataaaaatctaaataattctatggtttgagttatttctcaaagctgtgtattaattaagataagctggcaaaatatgtatctttcttgaaaagtctaaagcatgtctttcttggctttatctgagtttccactttttaagaacgagaaacccatgcgaccatgtctttttgaaagttccaacactttaaattaaaacatgcttgacaagttgtgttctgtcagattcagtggcatattttatttttatgaagacggtgctgctaatcaaatgcttaaaagacggtgctggtgatacataactaacgattgcatttttgttttaattctttgtttatatacctccttaattgtattcagagttgaaaaacaaatttgtatacacatacggtagccagtcgcatcttcttggctttgcaaaaagtgggttacaaagatagcattatacacatagacggatccataaattattgtacatcgaaagataatttttaaaatgttaagatagtatatgtttggggcaggttttcgtaaatcgtaatccaccagatcattacatttgtttgtagtcgaaaacgttgttgtttttggattactattgagcaaaaagtagacaacccaagcaaatttaactcaactgtgttaggtgttgatgattttgcttaggaatggacagaaaaaaagttgtaatctccaatatgtaagctagcatctgttattgcgtgaggcaaagcaaacaacgactagcatcctcgcttgtgtcactccaaacaactttagagctaacttaagtgataaaaatatggcacaagtacttgctgcaacagcaacaccattcacgtaatataagttacacgtattaataagggattcgtctaaaattcggtgataaaaaaactaagatacaaatatactattacaattgttttttttgttttttttgggttgaattgttcaatagaattatgtaacattcccgtgacaactcttttcaaatgggatttgagatgtttcccaataaaaaatgtttacgtctagtcacgagtgtgtctcttcaatagtcatcacgtgatcataacttggcatttgctcactctgaagttttacatatatccaccaaaaccattgttgttgcctcttttcgagtctggtgatgtggtcacttactcacttactcacttacctatatgatcttaagccctaaaaagataaggaagcaccaaactgatagagaccgaattaataatactatttacttttcattattgtcttttattagttttattgttttttcttatagctagattttcctttgtgatttgcttgttcgccaaggtgtattcctatttaacgaagacctatgagtttaatagagatcatccattaagatatcaaaagtggagttgttattttactcgaataaacgaaataggagattgacttcgttttgatttttgaccaacaactctagtctagcaataatgtatgatacaaaaaaaatggttgctaaatttagaaggctcaatttcttttcaaaaaattgacatcagcccacaaaactctcctgtccagagcagatatgttcaattgtagaaattgcaacaaaacagtaacaaataaaactgaaaccatggaatgaagacaggggagagaagacaagaaagagccaaaaataaaacgtaaaaaggattcatctttccttttaacctctctgccttggccgccttctaaggcagaggagattcatttctttctctccccaagaaaaacaatacaaaatttcagaaaatttatagtaatttcagtatggcgtttcaggattttgacaagatccaagaacgtgtaaacgccaataggaaacgtaaattcaggaagaggatcatcgttggaacggtctctttgcttgtggttgttgctgccattgttggaggagcttttgcttatgttgcttatgagaaaagaaatgaacaacaacaacaacaacaacaagcaaagaaccacaacaaaagcggtagcggcaacaacgtcgtcaaggatagcgacaagaagagcccgagcccaccaaccccgagccaaaaagcgcccgtttccgcagcgcagtcagtgaaacccggtcagggtgataagattatccaaactctctgcagttcaacgctttacatg

SEQ ID NO: 25500 - DNA, 3000 bp, Unknown; identical to SEQ ID NO: 11400
  misc_feature (1)..( 3000): 2750-1469P.txt file - cDNA_ID_2706446; gDNA_ID_2214494; Annot_ID_133529

SEQ ID NO: 25501 - DNA, 3000 bp, Unknown; identical to SEQ ID NO: 11400
  misc_feature (1)..( 3000): 2750-1469P.txt file - cDNA_ID_2706446; gDNA_ID_2214494; Annot_ID_183765

SEQ ID NO: 25502 - DNA, 3000 bp, Unknown; identical to SEQ ID NO: 11398
  misc_feature (1)..( 3000): 2750-1469P.txt file - cDNA_ID_2706457; gDNA_ID_2214494; Annot_ID_133524

SEQ ID NO: 25503 - DNA, 3000 bp, Unknown; identical to SEQ ID NO: 11395
  misc_feature (1)..( 3000): 2750-1469P.txt file - cDNA_ID_2706468; gDNA_ID_2214494; Annot_ID_133518

SEQ ID NO: 25504 - DNA, 3003 bp, Unknown
  misc_feature (1)..( 3003): 2750-1469P.txt file - cDNA_ID_2706472; gDNA_ID_2214495; Annot_ID_133552
aataactgatcagggtagaactggtcgttttctccctatatataggtagaagcaaagatggttcaggctccacgtaaaggaagacagataaaccagcaaaaacacatggtaaaaggggttttacctgatcaattagaattgttgcagaaagattgttgtactttgaaataagacaagtggcatcgtattcctgaagatttacaaaaggaacaatgcatcaaatttggggaaaaggaactatgataatggttttagtttgggttggttttacctcccaagcagctttgttgtcacctagataattggtgaatgccttctgtccccatgcacaatttatgggattcgtgattggtgcaaacgcagatacagactgaacatgttacacagatgaagtggttaaattaaaagaatgatataggagtaacaagtatttggttcaagcacattatccaccatgaaagacaatctatctttagatttgagattccacgtttcaagcatctaactcacattgcattgccacaagaaaactctttgaaatgaataccttgtatttatcgaggttcctcaggtatatagtaagagctccatgtccacccatggagtgtccagatatagatgcttttgttgtgtcaagctgggaaaagttttcactcaggagttttggcaactctttgacaacatagtcatacatacgccagttcttccacttttcctgagtagcattgaggtagaatccggctcctagtcgaaatcaaacaggaaagaaagaatattttatcacccttgatcattaactgaatacttaaagaccagaccaataggtccaaagctacaaaaagaagtgtgtgaaatgcaaaccagaagcatgtaacgttgcatacctacaccaaagtcgtaactgtctgcctccccttcaacatttagtcctcctacaatatcaaaaccatcacagagtgttaaaaatacacatcaagggaagatgataaatcaaaaaaatgaaaatagtgttggctcacttggagaagtgtctggagcaacaagagcaatgccgtgagtagaagcagcacgttgagctcctgatttgataatgaagttctcgtccgtgcaggtgaggccagaaagccagtaaagcacctgtcaatcaacaacatggagaatcattcatccaaaaatccaatcagttgttttggcatcacaacgaaatcaaggcaataaaaaatccaaaaacaatcatgcaaaacttaaagttttcgtctttagaacaatatgggagaaacccacaaatatcagtaatacttggttcaaactagagacatgaaatcagatgagtgaagataagagtgaaaatttgagaaaagtcacaaaagagcccttttttactgtagaaacaatcaaatctctacctcagaacatgaatcgtgaaaactacaacaagaaatttagatcaaagtaatgaagaagaaggaatatcattgcatacaggagatttatgggaagaagaagcagaaggagggaagtagatggaaaaggtcatggaacatccaagtgtctcactgaagtgtttgtatcttttgttgtagccatcgaacatcttcgtgctcccgatctcgcttagtccactcgccattatcactctctctatctcactcactatctctgtgattgcaaagtctagaagaaacaacagatgcaggctgcagcgaagacgaagaagaagaagaaatgatcgaatgagagaggtctatcggtttctacagtggatccgagagagcccatagaaataattcaacaacatatctccttaaaacttctggcccaactaaaaggtcttgaaaggccgatttgagtatcttaatgtaataatcaaatccggtttattatagtgacatgaacatctttaatgtaaaaatcaacttcattagtacaaagtgtgtctttgttaggtgatcaaatcatttatatatacatgacacatcagaagataacgcatagatttttatttgcggcggacccatttattgattaatttgtatatctatttgttttgttttcggtgtataataaatgccggtataactaaaaaaccatttcataaatgttgttcagattgagaaaccaaaaaaaatggaggtgatgaagaagactggtaccaaaaaaagatggagtaattttttcatgtgccattaatgaatgtatccgaagttaggcaccttcccttaaatatccccataaccaaaatataatgttacaaaaaagtctctccctttccccaactgtacccatcaatgcctatgtccattcctctcccttgcacataagctttgctctgtctatttaatttaactcttcttctgcatgaaagttttatgctttcgatgattcccaaaatctttctcatgcgttttttactttcttgatttggcaatcctcatgagctgattttgatttcttctttatggttgccgacacgaaaggtttgttgttcttgacttgtgtttttattttattggacagtcttcttttggtagatgaacaactcaaagacggagctaacaaagttgtttttttgatattccattaattttcctttattttattccttaatctttctttgatttttctctgcattgtgtcatgttttgtggcattactatttaaaggaattttttggtatctatgcattaatgtctgatttcttacatgacagaagaagctaggacacaaaacaactcaaattttgtttggtgagaaaaatcaaccaagaaaatattgattcttttggagcaaggagttggtttgattggtaatgctcaagttggtctctcttttttcttttcaaatccaacttgatttctttgttctatatgatccaaacccatgtagtataaatctgtagtggattacataaccaccagaaaaaatcatttctagtcattgttcattattgtctttggtttgtttgaactttcttgtgtgtgtggaccataagaagaaggaatg

SEQ ID NO: 25505 - DNA, 3003 bp, Unknown; identical to SEQ ID NO: 25504
  misc_feature (1)..( 3003): 2750-1469P.txt file - cDNA_ID_2706472; gDNA_ID_2214495; Annot_ID_183801

SEQ ID NO: 25506 - DNA, 3000 bp, Unknown; identical to SEQ ID NO: 11423
  misc_feature (1)..( 3000): 2750-1469P.txt file - cDNA_ID_2706476; gDNA_ID_2214495; Annot_ID_133551

SEQ ID NO: 25507 - DNA, 3000 bp, Unknown; identical to SEQ ID NO: 11423
  misc_feature (1)..( 3000): 2750-1469P.txt file - cDNA_ID_2706476; gDNA_ID_2214495; Annot_ID_183800

SEQ ID NO: 25508 - DNA, 3000 bp, Unknown; identical to SEQ ID NO: 11426
  misc_feature (1)..( 3000): 2750-1469P.txt file - cDNA_ID_2706480; gDNA_ID_2214495; Annot_ID_133566

SEQ ID NO: 25509 - DNA, 3003 bp, Unknown
  misc_feature (1)..( 3003): 2750-1469P.txt file - cDNA_ID_2706488; gDNA_ID_2214495; Annot_ID_133562
aagctctagggcggtgcatcgtgaggagaagatctagatcgtttatttaagtgggacctattaataatcaatcggacggtggattaattttctccagcgattgacgtttgttttttatttttattttaaattagcttgcttgtccgttttaggaggacagaggaaaaagaaacaagtgacttgttagggaagtcataccggtcgcatgtgttggaatttagttggaagattttaggagtgtttggatataggtacagatataaactcggcattgagcccattgtagtactattgttatcgccatttgggtcactaaatggaccctttttgaactttggttcagtatacaatcaaaatacagaaaccaacttttgggtaattttattcctgaaatagctaaacattagtacgtgagacaaaactggtcatttgctttgaaggtgacatatatcacccctttttatacgtgtctcacaacatttacagaaattatttaactttataaagatgaaaaaaaaaaaaaaaaactttataatttaatgatatatgaatgctttgaatcaacaactttaaccaaaataaaagaaaattaatgctttggatttatatccatattatgtgagttcaatttttttgcaacaaaatcttactcaggataagttatatttatgaatagagagtttttttatttaagatattactttataaaagaaattaaagatatttctgtctaaagttattactgattacacctaaacattaaatattacagattttatttttattagatgtaaatctttaccatgtgaaaggagtagatactttcaaacagattaaagcaatttggatatccgatacaagaaattaatactatgacattgcagattattaacattgctgacattgtatcagctatatctctccatgatgattttcatttaccaaaaccttgaaacattttgggcatgccaaactaggtgaccactaagacaaggagatagactgtgtccttccacgttaaggaggcaaatccgtgctaccattcgcaatttttttgagtagcatgtgagaaaataatttagaaacaagcagtaaatctgaaaatatgatattactcttgatataacaaaatatgatattaattactcttgggtaaaggaaaacaaatatgatagttagtactctctgtgtttggacaaaaatatttttgcctgcttgcatcggattaccgtaatacgactgtttgtcttcactccgaacaaccggagatgagtacaatacgactacattaaatataagattgtaatatgaattgagagtcaaattaacaagggggaattcagttatttctttgtatgtttaaggaataggtgatgggttagcctggtgtaagactatatatgtttgaatataggaattatttggacttttcttaacagtaatgcattgtgtgggggtaaataatgattgggtaatacaagggtattgctacttattacagtacaagagttctgaatatcaatagtttggactttacaacgttcaatttctggaatggatcaatgagattcgatgatacatatttctatcatgctcataatttaaaatgttgttgaaaaggtatgcagatcgtgttgtgtggattaaaatagcgttggatatcgtttaaaacaagtgctgccgcgatataactatcttgtccaaaaaacgataatagctaggtgtccaaaaaaacgtttcatactttcatctcttttcttttcttgcaagagtgccataaaatgaaagtatgaaacaaattaccacctttgcttgtatacgttgttgttatcagttacaattaaattcaatttttaagtttagtcaatttcacggacgcggttaagatgttaggcggtagccgaccatcaaaatagagttaaacattggattattctctatatatagctacataacaaattcattatccgaaaattttcaggcaataaagaacatattggagcaaacaataatttatcgtaagagtttttttaaaattcgttggaacttggaagggattttaaatattattttgttttccttcatttttataggttaataattgtcaaagatacaactcgatggaccaaaataaaataataaaattcgtcgaatttggtaaagcaaaacggtcgaggatagctaatatttatgcgaaacccgttgtcaaagcagatgttcagcgtcacgcacatgccgcaaaaagaatatacatcaacctcttttgaacttcacgccgttttttaggcccacaataatgctacgtcgtcttctgggttcaccctcgttttttttttaaacttctaaccgataaaataaatggtccactatttcttttcttctctgtgtattgtcgtcagagatggtttaaaagttgaaccgaactataacgattctcttaaaatctgaaaaccaaactgaccgattttcttaactgaaaaaaaaaaaaaaaaaaactgaatttaggccaacttgttgtaatatcacaaagaaaattctacaatttaattcatttaaaaataaagaaaaatttaggtaacaatttaactaagtggtctatctaaatcttgcaaattctttgactttgaccaaacacaacttaagttgacagccgtctcctctctgttgtttccgtgttattaccgaaatatcagaggaaagtccactaaaccccaaatattaaaaatagaaacattactttctttacaaaaggaatctaaattgatccctttcattcgtttcactcgtttcatatagttgtatgtatatatgcgtatgcatcaaaaagtctctttatatcctcagagtcacccaatcttatctctctctccttcgtcctcaagaaaagtaattctctgtttgtgtagttttctttaccggtgaattttctcttcgttttgtgcttcaaacgtcacccaaatcaccaagatcgatcaaaatcgaaacttaacgtttcagaagatg

SEQ ID NO: 25510 - DNA, 3003 bp, Unknown; identical to SEQ ID NO: 25509
  misc_feature (1)..( 3003): 2750-1469P.txt file - cDNA_ID_2706488; gDNA_ID_2214495; Annot_ID_183811

SEQ ID NO: 25511 - DNA, 3000 bp, Unknown; identical to SEQ ID NO: 11436
  misc_feature (1)..( 3000): 2750-1469P.txt file - cDNA_ID_2706492; gDNA_ID_2214495; Annot_ID_133560

SEQ ID NO: 25512 - DNA, 3000 bp, Unknown; identical to SEQ ID NO: 11424
  misc_feature (1)..( 3000): 2750-1469P.txt file - cDNA_ID_2706502; gDNA_ID_2214495; Annot_ID_133554

SEQ ID NO: 25513 - DNA, 3000 bp, Unknown
  misc_feature (1)..( 3000): 2750-1469P.txt file - cDNA_ID_2706506; gDNA_ID_2214495; Annot_ID_133553
tttacaaagatctagatgaagctcccagtggagagctccctgatggaggctatacaatggtagcagttgttggaatcaaggatccagtacgtccgggtgttagggaagccgttcagacttgtcaagctgccggaatcaccgtccgtatggtcactggagataacataagcacagccaaagcaattgctaaggaatgtggcatatataccgaaggaggcttagctatagaaggttcagaattccgggacttgtctcctcacgaaatgagggccattatccccaaaattcaggtcctttgatatatgatagatagaatgaattgttattgtttatctgtctattgaaaatgtttaagtatctctaaaattccttgtttctgcctttaggtaatggctcggtctctgccattggacaaacatactttagtcagcaacttgaggaaaattggagaggtagttgcagtgacaggggatgggacaaacgatgcccctgcgttgcatgaggcagacattggactagcaatgggaatagctggaacagaggtaagctatagttattctctgttattggtttggttaataaaaaaatctcgagattaacattttcgtttggtgctaattcccgatatgcaggttgcgaaagagaatgctgatgtgatcataatggacgataacttcaaaacaatagtaaatgtggctagatggggacgtgctgtatatataaacattcagaagtttgttcagttccagctaactgttaatgtggttgctctgatcatcaactttgtctctgcttgcatcacaggtacgacagaaaaaccaatcaaacaccatctttcttctagcgtttggtcaaatatagtaaccatttcttttggtttcttttccaggatctgctccactcactgctgtgcaactgctttgggtcaacatgatcatggacacacttggtgcattggctctagcaacagaacctcccaatgaaggtttaatgaaacgtgcaccaatagctagaaccgccagctttatcaccaaaaccatgtggagaaacatcgctggtcaaagcgtttaccagttgattgtcttaggaattctcaatttcgcaggcaaatcacttctcaaactagatggccctgactccacagccgttcttaacacagtcatcttcaactccttcgtcttttgccaggtaccattcgcaaacaaaaaccaacccaactcttatataaaagataagtaacaagagaatcaaacggtgtacaaacaggtgttcaatgagatcaatagccgggaaatagagaagataaatgtgttcaaaggaatgttcaatagctgggtgttcacttgggtaatgactgtgacggtagtgtttcaagtgatcatagtggagtttcttggagcatttgctagcaccgttcctctgagctggcaacattggttactatcaatcttgataggatcattgaacatgattgtagccgttatcctcaaatgcgtacctgtcgagtctcgtcaccatcacgatggctacgacctgcttccttctggtccttcttcttccaactctgcctgataccgtttctatgttcactttttttttgttttccgggtaggagtacacaaatatgtaagttttctatttttgctacttcaaattctttttttttataccacgaatggaattttgttttcgacttactccaatactctaatacgattttgcaataaattttgcattttaattgaatgttatctatcaagagctgtgctaagtattagaaaatctagagagatgctttgattagtagattctcaagaatttatgatcagaacatctaccttttttcgtataaatataaatctatattgtttttgataaaagttatagtagcatctaattagatttgtgacatgtataatgccagtatttatccttgtcgtaggtgagtctataatgttgaatcagaacgcttacgtaaagtataaacataataaaacgcaattgtgaaaatagaatgacatattattctctggatgacatgttaaatcaaatcatatagcataataaaatagaagaattttcctctatctcacatcaatgtacatgaagctttcgtttctgtatatacacgtaaataaaacatcggaaaaagatggaaagaacaccaactttgcttctccaatacatgaaactttaacaaaaacaaaaaagaacaccaactttccttaaaatgcttttataaaagtaaaatattcatgcataatttacttgaaacttttcgacactttcatttatttattgaagttaaagaagttggtcacgcgtatgaaatctttggaaaagcaataactgtacggacgtcactctcagatgttaagttcaataagcaaaagaatagcgggacccttcggttttccactttattacgattgtgccatctgactcgtcatttactcctagccgtccgatgaaaaaggcagaatctggagagtgtacagtaactcgaaaacacaggaacatatattcgcatttatacagtacgagtcaaataaaagtcaatgaatctgacggttgagattttcagttggacgaagagtggtccccatgagttaataaaacggcttagtttggtatccacgcgcctccgttggtttatccatttgtagcaaacccgttcaccgtttgaaccgacctctttctctctctctacactctactctaaatactgcagagtgttttgttcgtcgctttcactgccagcctttttttttctctctctcactaaattctctcgccgaccttcttcaaaccctagaaaaacgcttaatttctggaagatccatcgacgaagctcacaacggtatggttagaactttgggtgttcttgtgattgtgcttcttagtgagaattgctttggagattttggaaatgtgggtgaaaaggctgatttttttttacagaatgaattttgaggcttatcgtagtgagtgaccaccatg

SEQ ID NO: 25514 - DNA, 3003 bp, Unknown
  misc_feature (1)..( 3003): 2750-1469P.txt file - cDNA_ID_2706509; gDNA_ID_2214495; Annot_ID_133550
aacaacaagactttcctcggaatcttcatgatcttagttctaagctgtataccaggtagaaccaatctttgttccaatcattctgttagtaccccaaaagaattaccttcttcaaatccttcagatattcgttcctcattagtttcactagatttggagggttatataagcttcgacgatgtccacaatgtggccaaggactttggcaacagataccagttaccacctttggcaattctacatccaaggtcagtttttgatatttcatcgatgatgaagcatatagtacatctgggctccacctcaaatcttacagtagcagctagaggccatggtcactcgcttcaaggacaagctctagctcatcaaggtgttgtcatcaaaatggagtcacttcgaagtcctgatatcaggatttataaggggaagcaaccatatgttgatgtctcaggtggtgaaatatggataaacattctacgcgagactctaaaatacggtctttcaccaaagtcctggacagactaccttcatttgaccgttggaggtacactatctaatgctggaatcagcggtcaagcattcaagcatggaccccaaatcaacaacgtctaccagctagagattgttacaggtatttcattcatgctttatctctgcggtagtctcaaaaaaatatgcacctgtaaagaatatccatctcttcatgagcaaaaacactgacgactttaaataatttttgactataaaacaagagtgcataggcacaaatgtgaaatatgcaacacacaattgtaacttgcaccaagaaaaaagttataaaaacaaacaactgataagcaatatatttccaatatttaatcagggaaaggagaagtcgtaacctgttctgagaagcggaattctgaacttttcttcagtgttcttggcgggcttggacagtttggcataatcacccgggcacggatctctcttgaaccagcaccgcatatggtaaagttctatcttgaacaaagttcaaacaatatacgctatgattctaagaaccactttcctgacacagtcaaataacttttaataggttaaatggatcagggtactctactctgacttttctgcattttcaagggaccaagaatatctgatttcgaaggagaaaacttttgattacgttgaaggatttgtgataatcaatagaacagaccttctcaataattggcgatcgtcattcagtcccaacgattccacacaggcaagcagattcaagtcagatgggaaaactctttattgcctagaagtggtcaaatatttcaacccagaagaagctagctctatggatcaggtaagatgtgaaagcaatatataactagacttagtttccacagagagctccaaatcaaccgttggctactagcctactaacataatgaatggttgccgtgcaggaaactggcaagttactttcagagttaaattatattccatccactttgttttcatctgaagtgccatatatcgagtttctggatcgcgtgcatatcgcagagagaaaactaagagcaaagggtttatgggaggttccacatccctggctgaatctcctgattcctaagagcagcatataccaatttgctacagaagttttcaacaacattctcacaagcaacaacaacggtcctatccttatttatccagtcaatcaatccaagtaagtgagcaaaatgccaaaagcaaatgcgtccagtgattctgaaacataaattactaaccatatccaacattttgtggtttcaggtggaagaaacatacatctttgataactccaaatgaagatatattctatctcgtagcctttctcccctctgcagtgccaaattcctcagggaaaaacgatctagagtaccttttgaaacaaaaccaaagagttatgaacttctgcgcagcagcaaacctcaacgtgaagcagtatttgccccattatgaaactcaaaaagagtggaaatcacactttggcaaaagatgggaaacatttgcacagaggaaacaagcctacgaccctctagcgattctagcacctggccaaagaatattccaaaagacaacaggaaaattatctcccatccaactcgcaaagtcaaaggcaacaggaagtcctcaaaggtaccattacgcatcaatactgccgaaacctagaactgtataaaagtttcctgtgtccgtccttgtaaccgctcaggctaggcagcaagaaagtgaaaaattctttcttttttgtttcttttggtgaacaacaaattttacagtctgaaacagattgggacaattgtataggatctccataaaaatcctacgcagtgtcattacttttggtgctccaaaaactcaaaaaacatcatttttaaatctactataagcaaacaaattacaatagctcaaaaaatcaccaaatcagaactctgggtgcaaagcgatttaccttgaagaatcgattctcaattgggtccacgaatctcgttaatggagccaagctacgatttttccaatcgatttttgtactgaaacaacaacgattatcccaatttctcatcaagatggcagaaatttggcgcctttccgccatgaatagtcacgacgagattattttctctcttcagattgtgatttcaaatttcacttcgtttgtcacacgcgtgaagcaacaaaacacacgtgtgtgtatatttttattttattttttgctgggcggtcaggcgaagcagaggctcctgaagaaaatggcgcaacaaagtttatttatttcattaatattacttcttcttcttcttcgttggtaataataataagcaaatcccaaaaaccctaacggtactgtgtagaagctatatacattcctcttacttcacctcaacacgcaagaccagattcgtttccccgagagattcctttccttaagccctaaagtttcgatttttgatttttattttgaaagaatccaatttttggatg

SEQ ID NO: 25515 - DNA, 3003 bp, Unknown
  misc_feature (1)..( 3003): 2750-1469P.txt file - cDNA_ID_2706513; gDNA_ID_2214495; Annot_ID_133567
acacagagctcgattacttacactgccaaaaaccttaagaaagaagcaaagaggaactcctcaagtacctcctgaagaagaagaagacggagaattggcggtggcggagactctgaggcggagggaatcagaagagcgagttcgggttggttgacggaggagataggagccgccgtgacgtgtggtagtagtagtagtgagaaagaagagatgaggaggaggagaaagagcggatgaggcggcggagacacggtgaggcgatgagacggaggcaataccgatgcctatcttgggagacgcagccatattttttttgattgccttacctttaccagagaccatacaattgtctctttggctttgcagttaaaaaaaaacatcccgattttctgttggcgactgtgcctcacgcgcctcagcattatctctttgcttccaagtccacaggcttagatgattttcagccgttggatatatgtgatgaagcgactgaacggtggagatgtgttttgactgattttacttcgtcttttcaacggagggataagccaatcgctttttttttaagtgggaaagatcgccaagagtttaagtggacggacgacgctttttatattgggccataaatgggcctgttttggtactgaatatttagtcacgacgaagattcttaaacccaccggaaaatgggctaatctgtgtgcggattgcttcgccaaaaagttagtactaataatttataaagcataactagctaaatgcgaagactatatagtttacttagttctgaagaggttgaagtggaaatgaaatgaactaggagttggtgagggaaggtgacagactattttttcttaagtcaaaaagttaagctgaccaaaaaagagcagcccaatgaaagcaaggatctttatctttagtctagtgtctgaattccatgcacttccaatgttttagtcaacaaaatgtacttacatttgatgacttgatgttgtatagattcgttaggaagccacatcactaaacgttaagcataactttatggttaaaaaaaaacccccccaccgtgttcttacttgtcatccaaattcgatctgccatttgaagtttcctaagctgttcttgatgactattcttaaattcgatgtttatatcttaccatctaaattaagccttacaagagctacatatccaagtagtatatgctggagtagttttgtgatcccttaatcttattgttcaacaaataatttcaacaggacatatatatggatcactactgttaaaacgatatagtagagcttaagcgttaggatttgtattattagttgtctctctcttttacagacgcgtggaaggtacgcgccgtcataggaacattgtcggtaatccccttcaaacaccagtagtcagtagatcgatgacttgaattacatcactgtcccctactttgaccaatagagatctaaaggtttcctttcttgcattattgtgctaaaaccgacatttacttaagttacttgattatgtcttggaaaaaaaaaaagattttaactttgggaacttttattcaactgaaattttaaagaattatttaatttggaattccttctataaatttactggcttttaccgttatacgttaccataaacttatatatatgatcaaattcgaccgtgatgaatgatcacttttttaactttccattcagatcaactgaacccccttactttttctatatatactcttttaagcacttgtttatatattatcaacaaattaaggtgtcgaaagtaacatacaattagacaaagcatgtatagtcaaaaagatagatagtcatcaattttgaaaaacgagcaatttacatgatcctacaaaacaacaaaactaactatatgaaatatcaagtttataatcatttttaaaaataccattacaaaagatttgtactttgaatataatttaacatgaaatttagaaaacgatctgtttaagaatataacttctgctatgtggtattttaactggtactttatagagaaaaaaagattggtaattaatgtgatatttttgcaatccatattatatattcgagagattttactaatgatagtacttgattaatcattagagaaaactaaatcttacaaatataggtagacatgatgaataatatgcatgatttgcgtttcgtaaattgatagtaccacctcacctaaagggggtccaaacgagttgcttcatatcacaatatccaattttaccaacatacattaatatatgtgtattcacatatatacctcgtgattaatattttttttaaaatcatttttcgtttgtttcctatacgtctaatcaaacacacacgttacaactaaaattatattgacaatatagctcggttggtaaaagcaacgactactgcagtttccctgaaaaacttaagaccagtactaaatatcaactatacaaattaagttgatatcagtttttttgggggtaaagtaatccaatatcattctaaaattaaaagcaaaatgtcgttagttatacatgttagagacgagcgttgtgtttgagaaaaaaaagagttatgtcgtatagtggattcgacgtaaatattatcgatggttggtttcaaacctgaaaaattacatgtcatattgtcatcaaacatcgattttcatttgatataagaaaaatatatttacaaacacaatcgtgtgtgtgtgtatgcatcatgattatatgcatgttagtgttagagttacatattctatagaatatgtaaatagttagaagcgtacgttccttgaaaattgttcaaagtatttctattattgttttcttttgttaaagtatttctattattgtctcaaccacctaattaaattaaataacgtctctatctctttctatggagtcgtgttacgtctttctagtttgagatcttctactacttgttttcttcaagaataataattttcgttttatatatg

SEQ ID NO: 25516 - DNA, 3003 bp, Unknown; identical to SEQ ID NO: 25515
  misc_feature (1)..( 3003): 2750-1469P.txt file - cDNA_ID_2706513; gDNA_ID_2214495; Annot_ID_183817

SEQ ID NO: 25517 - DNA, 3003 bp, Unknown
  misc_feature (1)..( 3003): 2750-1469P.txt file - cDNA_ID_2706525; gDNA_ID_2214496; Annot_ID_133572
gttctcgtcccgaaatcgggacctgaaccgccacaaaattggtgactttaccatcatctttcccaaaaacaggacacatatgaaacaacatccaaaacggagacccagatttacgataattcaacaagctcacttgcactgatctctcttcacgaatcgcttcacgaatctccatgatcgatcttcgattagtcttaggtccttgaaaaactttaccgtttcttccgatcacttcttctcgtgaatagccagtcattttcaaaaaccctaagctcgcgaaaacaatcgggtgacccgaaataaacgggtcggtgattgtgaaattgtgtggaagctcctctaatgcttctttgatccataacgtgtatcgaccgctaaaggaatcttcttcttcttcttcagtgaaaactgattctgaagatttcgttaaggacataatcgtaataaacactcgatgatgattactcttcttcttcttgtcagtctagtgtttagttccaatcccatgtgggttttcaggcgaaattgagaaactttttcttcaaagtgaattcgaaacacgaaatccagattgtgaaatttgaaatcaggaatcaagaaaatgttttcattgaaaaaaagcgtaactttggagaagataagacagaggagagaaagagaaaccagagatccttaagtaaaggagaagaagaagaagatgaaatgagagatacggaattgagaaattaagagtcaatttgattgtaatctctatctgttagaagaaacgttcttctttcttcttgtctgatttttgttttgtggctatcggaagaggacgattggttttgtcgcgtttctcagttcttcgagttgttaagatattaaaaataaatattttcagatatttgttttcctaatttggtaaatacaaaatttataaattaaattttcaacaatttatctaaagtgatttagggataagtacaaggtttatgtagggtagacacaaattggataagataagtgaacttaatagttcatttagtaactaatgtgttgcgaaaaaaaaaaaaatgtttttgataataatatcttaatttgccgaccaaacaaaataattaatttaaaaatttataatttgtgataacattaaacaatagtgtaggttaaaaaaattttaattaattaatttggacataaatttttttgatctattaattgattaaaagtttattaataattttataccaaaaaatttaaaattcgaatttcaaatattataatttattacaaatttacagattaataaaaataaatgtataaaaaatttacaacaaaatataattataatcgttcaccaaaattttattaaaaacaaattttattaaaaatatttataacataaaaaaagaatacattgtatatcataaatctaataaaattaaaaaaattatctataaaaaaattatatataacattttttataatttacaataaaaaaataaatattctaaaaaccaaaaaaaatcactccggatatttggactaatctaatgctaattgtatttgttaaatataaaattatgcacctcttatttaaggagtgtagtgggtcctagaaaccgagattccacgtaaacaaaggctggaaaaagacaaaagctgactgtccatacttatctatttctcttgtgtcgtgtggctttgtttgtgttatcaaatcgatgcaacctggcttacgtggcatttatcatttgtacgttactctccggtgctaacatgtgtcattcactcatcgcttattattgattcgagtaaggaggcccattgggctgtattaagctgttttgtttttaaaacaggttcgcagacgaaaataacaaattgtcgccaatgttcatatcggccaactcaaatctatcatctaagagtaagaccaaaattaaaattcacagtacattgctacactactactatagaaaatggtgaaatacctaaaatgtgaagtctatgttcatgtttgcagttgctaaagactgataccaacgattgcgatcatcaaaagttattgcgcgcaacacattttttgttcgtttggtagtcgaacaaaaaatttggtcgttggtcgttatataacattttagggtgaaggattcgaaagaattttttataaaatactaaaatgaaacactttaattgctcgttataaatcaacttttaatcagaattttaatttatgtttcaaaagttaaaaatctcaaaacagtaaaacgaaatactgactagatatttgtttaaacggaatcatacgttttttttttttttttttaaatatcaggaggttttggactgaagcccgtaatcccctaggtctgaaaccacagcatgtaatattagtttcgtctcaagcgtcactcgaatttcgccaattgagctaacaacacttggtggaatcatacgtttatctgtttatattttcaacaaaaattatcattccgtaatcttatgatttctttgtaagtgcaagtggtctttgaagtttttgattgaattttgttggcttttagtaagaaatgatttgttactgaattcattttgtaatcaatcctaagttaatcaaaaattataaacaagaaaacccaaataagagtaatatttaggtttaaagacaaaaataactgaatatattccacaaaagaaggacaaacaaagaaagaacaataaaaaaaaccacacaaactataattggtttacaggaaaagtaacagagatatttacaaatcaatggtaacctaataattactctgttaatcgttaaatcctccattaatgtctttcattttccctctctctttcaagttccttgttatttaagaaagccatgaatccgattatctatttctaaccctgggccgaccagaaaactttttggacgacccaaacttcaagggttctaataaattcatcaccggaaaaagatacatataaaataaaaatctctcaccactgctgattcaaatg

SEQ ID NO: 25518 - DNA, 3003 bp, Unknown; identical to SEQ ID NO: 25517
  misc_feature (1)..( 3003): 2750-1469P.txt file - cDNA_ID_2706525; gDNA_ID_2214496; Annot_ID_183833

SEQ ID NO: 25519 - DNA, 3003 bp, Unknown
  misc_feature (1)..( 3003): 2750-1469P.txt file - cDNA_ID_2706533; gDNA_ID_2214496; Annot_ID_133581
tgctgtaagaatttatgcttaagcttgaaggaactgtggaacgacttgtcttgctagaaactcttgagctcaatgaagctaaaagagatcccaaataaaaatatctatgtcagattgatttctaacttaacaattctataaaaattgattactaacttaaagcatgatcataacttgatttcgaatttcaatcctcaacgttaaccaattcaacaatctaaaaccaaatttaagataactattgaagatttaacaatccaaacagtcaaatagtgagataatggagtaacatatagattcaaacaccaaatgtttccatatctaaccccaaaattactaagagaaatcagacataagcagaaattggtatttcgaaaggtttgattttgaagatgtcagacaaagaacaaaagcctaaaagtcgaatcttaaccatcttagagaataaggagaaattttcaaaaacagaaacttacgcagcaacgaaatttggataaaggaagaaactttagaggtatggagaaaattaaaagaaagttaccagaattagcatgaggactgtggctgctactatccactttagctgatgaatctaagcaattacccatttctcactcgataaaacaatcaacagattcaaaggaacaaagccaacgagctttttttttgtttactctgcggcgcaaaagctgattgtaataattataatcactaaattatccaactaaagaaaagaaaaagaagatttttgaaaccagaattagagaagaagaagaagaagaaggaaggaagaaggaacacagagaatcacagcacaaccatacatacaaaaagtcgtggtgttggtggtggggttttgagaaaattacgattctgccctttgtttgcttttgttcgccgtggtccgtggctttttctcttaaatgactatactacccttcctttcggcgaatatttttggtttaacgcgggtatcaaataaggggaatcagggatagtttggtaaaatactgtgttagtagatctggaccacctggcaacgtctttgcttgcgtaagcagatccacgtcagattttttcttcaaagcttttttacattcacctttaagcaaaagcaaaactcctaaaagatgcatcaaatctaaagattaatttttggtaaaagattccattaaatttttgtcatttttagataatgtaaaattttttattaattaattcgaattggagtacagatggtttagtactgtttaattatagaaagagattagttaacacgcttttggaatattttaatttcaagtgtatcaaaactttattcatattaaccaaaaaaaactttatttcatgcattgaccccaaaaagaattcctctatcattcacattatgtttgaccgacaaatccaagagctttttttggacactacacattgacacgtggaaatgatattcgaataatgatttttttttgcaaattactatttcctcagtttctttttaagtgatgtttaaggttattacacacagattaaaaaaatatataatttttctcttttctatacaaatattattaaatagaatgaatttaaccaataaaaataattgttcaaaaattattaaatatatttaatatttgcataaaaagttaaaaacatcacttaaaatgaaacaattttttttgaactaaaacatcatttaaaaataaagaaagagagtatcataaagcattgtttaccagaacaatcactaaaaatagattatcaaatgagtaaaatgtgttatttattcgtccattttatggaattgtaaaatttgttaacacaaatcatgattccactaaaagttgtcatagaagaaaggcaaaaaaaaaaaaaattataattgtaaacatgtaatatacggggtagtgttgaaatcatccattatgagttgatgaagttaaaatacatatcatggtcatcagtcatcactcatcacaatttaagtttacattttactttttcagtgagacaagttacggttgtgccgctcagattactaaaattgtactataacaattcttttgtcggcaattgaatagcattaaaagtttaatgtccgtattttgcaacttgatacatatatatctccaagtgatttatataaatatcctaaggttttaacacgaagcatgtgaatagtataaacacgacaaaaagaagcattcaatagtaatcttttgactatttcaaactcttcttatatatagatttgtcaaccatattatctatccatgccatcgatgcattatgatatttatggataaaaaagatcatggactaaaaaagtagtaaacgtagtttatagattatgtttgagtgcatattattttatttgctatcatatttatactttcaatcttttctttgtcaacaattctatctttgctttacactctttagtatcttatcatctttggtttaatattttatcaaaatccataaattgaacatacgagttttattcagtttgtcgctttgaagtttggatgattcaatcaaaacacttaagtagagattaaaactcttaaaactccatctaaatcaaagattaacgacccttaaatgatgtgactctactttttgtcaacttcaaagcacccaccgaaactttccatcattttgcaacttacaaagactagcgtgtggtttttacgattagaaaacggcgtgtagtttatatttataattcaaacacggaaaccatttcacgagctgcactccaaaagtacacgcgtcatcgttaaccaatcagaaacgtcaagtgagatcatcagtccagtgattagcttccacgtggaacatcgacgtatctattttcgcgcctttgtaacagcttcatcttcccaaatccaaaacaaacatttttagtttgcgattctcggattcgatcagtgaaattcgaatcgaagcgccgccggaagaatcatcgccggtgtgggagcgtttcccggagcggcgatg

SEQ ID NO: 25520 - DNA, 3003 bp, Unknown; identical to SEQ ID NO: 25519
  misc_feature (1)..( 3003): 2750-1469P.txt file - cDNA_ID_2706533; gDNA_ID_2214496; Annot_ID_183846

SEQ ID NO: 25521 - DNA, 3003 bp, Unknown
  misc_feature (1)..( 3003): 2750-1469P.txt file - cDNA_ID_2706551; gDNA_ID_2214497; Annot_ID_133603
taataagtcaactgaacacttgtcctcactggggaaaagaatctggcacaccaaaaagaagcttacaacttttagaagaaactgatgaaacctgtagcctgatcgatcgaacagtatcaagaggatgcgaaacaaacggaacatgcaaaaagatttctttccagagaatctgtaacacaaactaaacattgcaaaggatccaatggcatgtaaccgaaatccaatctataaccaatgctaataacaattgcatgttccactgtatgcgtaatcaaaatccagaggtaaccagatcaaaagattataactttcatcatgggttcagtaaaacaagttgggttcttttcacaaaaccataattttcaacgaacaaatctcaacaaaaatagctaaaaaataagaaaagaacagatgaaacagagtgagccacgcgacgaaattgatcaatgcggacgtaccggagaatatctcggtgagcggcattcacaatacgccgatcacgggagagattttccgacaaacggaaatcgagaggagctgattggaatcggtcaagcgttggatattgcggtggagacttgggagccatttatacacatctctctaatctctgcatgacacacttcaattattgtatcgaaacgaggattcaagcgtacatcgaccgacacgtgatcttatctaattggatgatttacttgactaactaggattaattaatctcgcctttctttggtaaggtttaagaatatgagacctcaattgcaagttttttttatatctttttactccctgaattttgtttcatttcatccttataagcattagattttaatttcaacctgagtaatattagttttatcatctcctcgagtttagatattatcataaacatatatcttactaaaaacctgacctgactaatttattttctttataaaagataaacatgataaatatgaagtgtgaacgcattatcaaatcagaattagtggatatatatgtattttgtttttttctgattaaaaaaattattgagatatatacaattgaactatgaggacaaaaaatatatatatatatatatatcttattatataaagtatggttttcaaaattgacttggcacagtgtcaagtcaaacgattagatgtttacatgtgtcattcaaaatttaacttttttattctttaaaaaaatagaaaatcttaaaaagtaaacaaatttacatatactaatttatatgtctatatatttataaacaattaacatttattcaacaaaagcaaaattaacaaatttgtctttaactcatgtaatcataagtgaaaatagaacactttgagaaaaatagcttagcttataggatttaacttttcaattattttcatttattaattttaactcatttaatattaatttgcatgatgtaaaattaacttacgagattacgtgggtgattggtttgtctgtaactgtagatttactgctgtagaatttttgttgtaggtgtgatgactgtagctgtaagttttattgctgtagaaattagactgtaggttttattaatataattattacttaaagaaattgggtagaaataagattttggttgtatgtatttttaaacaaaaaaatattatcgggtcgggttcggtttgggttcgggttcgggttcgagttatttatatattgaaatatcaaattttgtgtgcaaatctattaaattacttgaaattttcaaaaattcccaaaacaacatgagtagttttgcttgaatatatctaaaaatacacaaaaataactaaaatatccaaaaaaattctaatattttctatatataagtataaatataactaatatatacttatatttgagatatgtttgcatacctattcgggtttgggtttgagtttttcgggttttaaagtttatatccgttcgagtatttgaaaatttcgggtacacccgcctaaataggcggaccttatctagtatatatatacatttgaactatattgtttactttttagttgatttaggctatgtatgacattgacataaatctacctgttatttatcacgtgtaattcgtgtaaagtgtaaactagaaagttcaaatacgtatttgtttttgttctgttatataggattgtcatagttgtaaatctacaatttattacaacatgaataagtacacaagcaatgtaattggatttaattgctaaactctttacatggtcaatctaaatttgataagaaatacgtcacatattactaagactgatagtttttttgttgtcaccaattatttttgttaaattgacgaaaacaattccaaaaactcaaatgtacaaaatcatacagtctcacaaacatctcatagagaaagatataaatctcccatatgggaacgataacacgaggtcgaaatactattcgtaaaactaaaacgccttagttataaatcgttagttgtaaccgcggtcgagaatacatacagatccacgaaactactactacacatgctgctgaattggaatttggaaaagaccatcttctttaggaagagctcacccaatgagtgacaaaggtgtcggtggcttgttttctacccatatgtatacatcaaatggtagtttcattaacgtttggttttgagaaaagtaagactttggctagtagctaggttcgtatataataaactcttttgagaaagttcatcactggtggaaaatgttaaaccggttttttctcattttttccgccatgttaaccaccggtttaaaaagaccgtaacacattgaaagattaataagggtatatttgtaattacggtttgctggcaatttttaattattattttaattagagaaaatagagaagccctatcaatgtacatggtatatatataaaaggcaaaaccctagaaaacgatactcttcgactcagccgtcctttcgcagaaaccatttggagttggagctttggacgacgacaatg

SEQ ID NO: 25522 - DNA, 3003 bp, Unknown; identical to SEQ ID NO: 25521
  misc_feature (1)..( 3003): 2750-1469P.txt file - cDNA_ID_2706551; gDNA_ID_2214497; Annot_ID_183875

SEQ ID NO: 25523 - DNA, 3003 bp, Unknown
  misc_feature (1)..( 3003): 2750-1469P.txt file - cDNA_ID_2706557; gDNA_ID_2214497; Annot_ID_133587
aaatgaaatgagtatagtaaaatatcttctcgatatatgtcattataataacagatagattcccagtgctttaaatttactcgaaccatcctggcaaaatctgtgaccactagctttaaacctaacgtcttcatcaatgacagtgtctgatatatatgtatatgagaataaatttataatttctcccctgtacgttaacgttgtgtctcaatgtaattataattactattagctcacgtaatgagtgcaggattaagattattgaattcgaaatgaatatatttggactcacccatataacatatatatatatacaggtccaaataaatgcgggaggaaaattgtacctgtaaaataaccaattaatcatatttttctttctttcttgttgttggattatagtgattttcttatctaggaaaatagagttcccaattataagggctaactgtcccttgacagaaaaaaagaatcctatgagaagaaaattgaatgatatttgcatctatctataatcgtttcatttgattttactattagcaacaaatttatttgatttaatacaaacttcaaaggaagtcgaggcagaaccagaacatgtgttttttccacttatgcatttatttgtttatgatgagcctgtcctttttgtttttgccctcttcttattttatgtaccacaaactccatcaacgcgatatatcacgggtattctttttttccattgttttatacaaactattgtaactagcattatatatataaaaaaggactttaattttgtagtttttatacgtaacgactgttcatatcattgactttatacctttatacgaaacctttttcacgtatagaaaattatatctaagtttttattataaatgtttttgttattgttaacctactttaacaagaagaagaagaaaaaaaaataggaaaggttttgttgtaagaaattgtattaaaaaataacatatttacaacacgatgtgctgttataaaagcaaacttatgagtccgaatgtttttgatctgatttaaaataccaaaaactaaaaaagaaaagaaaacacacaatgactttaatatgtaaaatacaaacaaatgttgcaaaagaaattaagagagtttggtaatgccaaataggcaaaagaataatttatgtgtggcaagcaatgaacaaagctgagctgtacatgtaccacacctttcattcattggttaccatctaactgaaagtgacacgtgtcttataatcaacaaggcttttctgacgtggcagtgcatttaattatttgatttgacaagtttaggctatcgttgtcaaacaaattaacttaattgtatcaaaattgctcgcacagtacgtaattctattttaagtttaaaatcaacggagacactagtgtcctatttaattatctccaagtaaagaaaagaaaaaataaatatttgtgcttagttgattaaaaattaaaaagcacgattcttgtcttgagctccttacagcttacaagataattaagaaccaaatcactttttttggttaaaacaaatcataatgttagaggctagagatacttatgatgttaccatgcactttccccttaataactagctcacttaattacagtaataccatacagtaatatctacttgatgtgcctattgagtcatcgatccaatgaacttattcactgcttcaattttatgaaatatcattattttaacgtaaacatcattactagtgtttttatcatcaaattaccgatttagtgtaagtaaatcgaatcagtttttaaatactgttggacacatatatacatagacatgccaattactcaagtatcatgttggtttgcatatactctagttttaatcagggtttatattatttcaatttaagtaaacgcatgctaaatgatagatcatgaaatagaattagggtatccattgtttaatgaaatgaatcgttgaactggtataacatgcaaaaagataatgtatccactatgtaagcattataaggtgccgctataacaaaaatatccacatggtcaagactgaaacgtcgcattatcaaacaatattacatgctcaattgttaaattttctagccaaattaataatatcgtcatggaggaaaaaaaatagagttgaataattggcaatgatcataatggatatgggtttctcaaaaacgcaatcatatatcgtgcgacaaggttacagtaatatagatatcatgcttattccaaaacgacgactaaaacgtaaaagattacagaactagtaaacgagtatataatgttagggaatgttctttaatttataatctagctagtataaatcacatatcctatttcatatgcgagatatgaacaacaaagtagtatacttaattgaatcaataataatccaaattaaatttatatggtttagatcatagagaacctaaatatctaaaactaacaaagtctaaaccacctcgattaattgggaataggatgataatataaagtctagattttgttttagttcaaaaatcgaaacaaaatcttactgtaattaacttactacgttcccttactgaagattgatcaccacacggtaaaaaaaacaccgttaaaaggttaaaccaaaaatattgctaagaagacattatttggttagttgaatgaaaaattagggaatgggaagtgtgaaacctacctaaaatatggctatgtagatgatattcattgaagagagagagaatatagaagtgtaaaaagagaaaatggtgccagctatgaattagaaggatcaaagctttctctgaagctgtcatctatctctctctttccttatagtgctctgtttctctccacattcacacactctccctctctctctccattattaaatcacttgttgttgtctttcttttttcaaaccttggaagcaaggaattcttttttgatgatttaatcgaaagcttcttcctccaaacaaacatcaatg

SEQ ID NO: 25524 - DNA, 3003 bp, Unknown; identical to SEQ ID NO: 25523
  misc_feature (1)..( 3003): 2750-1469P.txt file - cDNA_ID_2706557; gDNA_ID_2214497; Annot_ID_183856

SEQ ID NO: 25525 - DNA, 3003 bp, Unknown
  misc_feature (1)..( 3003): 2750-1469P.txt file - cDNA_ID_2706561; gDNA_ID_2214497; Annot_ID_133589
attgaagtggaagacgagagagggttaacggcgttggaactagcgagggagattctgaagacgacgccgaaggggaatccgatgcagttcgggaggagaattgggttagagaaagtgatcaatgtcctggaaggacaagtgttcgagtacgccgaggtggatgagatcgtagagaaacgagggaaaggcaaagacgttgaatatctggtcagatggaaggacggtggagattgcgagtgggtgaaaggtgtacacgtggcggaagatgtggctaaggactacgaggatgggctggagtacgctgtagcggagagtgtgatcgggaagagggtgggagacgatgggaagaccatcgagtatcttgtcaaatggactgatatgtctgatgccacttgggagcctcaggacaatgtcgactctactcttgttctactctaccaacaacaacaaccaatgaatgaatgattgattttgatgattacattcttctcaatttgcttctttctcatatgtgttggttcatctgaccggttcggttggtacgtaccggtacattttcattttcttttaagatgtgatcttgatggtttttggccttttggggacactatttgattttatatccatgctttgaattttgcttccctttttggggagattcatgatgctggctgacttgctctttatcgtcccaggtttagagaatacatcgtcttaggcttttctttatctcaaaacccatttacatttaattgggcctatatatttcatataggaagagagtacatgtaaacccaatacacaacttttatttatgggtccgtttcttgtaacatttgttggtgataaaaacaacttctgaagagtgataatgtacaactgcactttgcgattaaggaaattatagaaagatacaaagtctgaataaatgactagaaaatatgaataagtagtatccattcttctctaattcaacatcatttttttttttttttttttttgacgatattcgatgcattgtgtctatatgagagaaattttggtttgtcagttaatggctagacttttattattatgagcatctagattttcagtgcatgtgatgttacgttgatgatggacataaggagacaaaaaggacggagttgatttagtacacattttcgtttctttgtgaatacaacgatcgcctatttttcgtttgtaattttcctcttaattcgagaggggcctctagtcatgtgtgttacttctagttatagtgacatgaacggatgagaaaagtttctttttgtaaacaacatgcgtacgtaaatcaaccaaatatatttagtataacaaccaaattactgttggacaaccaaccaaacaacaattatgtagattatagattagagaaaacaaggaactaggtcgattaaccgcgaccacattagccaagtcctccagtcgattaatataaattgatgccaaatatattagttttcactgggttttatattatactatcagaccacagaagacatcacgtcacagttaacaacactacatatttcagattttgtatgaaacgtaactaggtttatatatgagaccttttaaccaattaaatgatagtgatatggtttgtaacattgtattgtatgtattttagttgatgtgtgtggttggtaaggtataaattagctagtgttacgaaaaatgacttcttgctttttctttcaaattgaacgacgctctatttcacttaaataaaaccacatttagttatttcaatgacaacatactaagttttttcttacataaattaaaaagtaattttggtttcagtccaaatttttctagttataggaaagaaaatgaaagagttgctttcaaaatattgaatccattgtatttaattttgaatattgaatagtatgtactaaagtcttttctttagtagaccaatctaaatacgaacgaaagtaccaaaaccatacgaaacggcaaataatgacatgtggggaacacgtagttagatgagcagtaaatgggaaacatattttgatggttgtcctcatattttcgtgtatcgagttagataaggaaacctgtgaaaatttatttctcaaaagattccgtaagattccgtcgaatataattgatatttcagtattttggactggcagcgaatatggcagactatacagattgatcgtcttccggcgttgttatagacattaacaaactttaactactcgtttgcttaattaggaccatctgatgactttattctaagttcaaatttagatgacctctctttcttgaacatatacttgttacatacttaattcattgtgttattgcaataagtgaattgtgtggttatcactaacacgctgacgtaaatttacacgtgtttatatgaacgcacacgtgttttgtagctcgagcaaaagaccatctggtcaacggactaggaggatccggcgtaaatcctttatataatttttatcaaaattataagaagaacaaaaaatgtgcgattactatctgatctacgtattcacgtgacaaacaacaattaatttcaataaagatctactaactttagagaaaaaatcttatgtgttaataaaaaagtaacgtcaatgatctcggcacacactagaattagtgtctaagagaaccacgacgaacctgcacggaccgaccacgagtctctcgacggtgaataagccacgacttcagtctccttctaaaccaacgtggcgcttcttacaccacacacgtgtcatcatctccttctccctcgaacccgcaagctcttttaatccctttcaattaattaattaactatatatcacctgcccctatatatatctaaatcagtcactttttgcttctgttgtctgtcactcagtaacttctctttctcacttacacactctctctctctctctccattgccttgacttttgtggtcagtggaataaacacatataaccgccggagaaaatg

SEQ ID NO: 25526 - DNA, 3003 bp, Unknown; identical to SEQ ID NO: 25525
  misc_feature (1)..( 3003): 2750-1469P.txt file - cDNA_ID_2706561; gDNA_ID_2214497; Annot_ID_183858

SEQ ID NO: 25527 - DNA, 3003 bp, Unknown
  misc_feature (1)..( 3003): 2750-1469P.txt file - cDNA_ID_2706565; gDNA_ID_2214497; Annot_ID_133592
tttatgtttcataaaaccaaaacataaagacaagtaccttatattcagatatggagtgagtggattcccaacattgaaattcttcccaaaggacaacaaagctggtcacgattatgacggtggcagggatttagatgactttgtaagcttcatcaacgagaaatctgggaccagcagggacagtaaagggcagcttacttcaaaggttcggtaaaaacatgtcttctgcagaatcaccatttcccactaaaaattgaaaacttatgttgattctatcacactctcaataggctggtatagtcgaaagcttagatgctttggtaaaagagttagttgcagctagtgaagatgagaagaaggcagtgttgtctcgcatagaagaggaagcaagtacccttaagggctccaccacgaggtatgttagtagtaactcttaatcgatacatggagtgtgagtgttgaaagttgcctctttaattattgggctttcatgatgtctctataggtatggaaagctttacttgaaactcgcaaagagctacatagaaaaaggttcagactatgctagcaaagaaacggagaggcttggacgggtgcttgggaagtcgataagtccagtgaaagctgatgaactcactctcaagagaaatatcctaaccacgttcgttgcttcttcttaaaagtcatatagcttgaagctaagagaataggagtcgagagagtttataactgatactgttttgagattttatgtttgtcaagatcaagaacgtctgtggttatttctggttagttctgaaactcttttgaacccaagtttatctgtctctggtgaacaagcgaccacgataatcataaacttcattcgcgttaaaaaaaaaggttcagtaatgggccaggctcgtattcattattaatgggctaggctcgtgttcataaaaagtctgtaatgggtcattgaggtatacaaaggacatccaataaataaaacatttgtctcatttttaaaagtacatatcatctccgttactgtttcgtctatgaaaaaagtaacacggaagcaatgtgatatactactaggcaatagctaatcaaataagtaaattaagtaggactacaaagaaaacataaccaaaacaaaaaaagtctctcaatggtttttaatccggacatgcaccgagactgctgtttctaactcagaagtcagaaacgatggacaatctgacagcatttgtttttaatccatcggaatccattcttcaaagtcgatttaactttaccttcaactgtataagctttatacctcgcgattctcttcttcctcttcatctccgcatcgcttaaacctccgattcgcaaagacgacgacgcgttgctccttcccgccgctacttttcccggcggaggcggcagtgacggaggataatcccgagtcccgtagatctgatttctcttaccactcacgatttccttcctccgatcaacgccgtaagttctctgacccgacccgtacccacatccatcgtgactatccatttccctttaaaccggagctccgatcagattatttattccggcttgaggaaaccaaacaaaaaacaaagagcaaaagtgaacagatgatgatgatgattaacacagctcttatttggccttttttcgttttttaaagtttttactcctacttaaacaaacatcaaattaagctctttttttcttttcaattagtagctgtaattaacacacattttataatagtgaggaaataacagcttagggatacctcaaaaaaaggtttgaaccacctgtcacatgaaatctactgtcacatatccttgttgtggatattcactgattttttttaaaaaagttttgcctttggtaatgatacaactattcacttgaacaaatgttgatattggcagctgttagtttgcaaaaattaaatatgctaacatgcgcatataagaaatgaattatacgaaattttgattcgactctctgaaaacaaaaatattaggaaaatggtcatgtacctcttgcttaatttaacactagagattttattcaaaagaaaaaaaattaacactagagataatcagaacataatgggccagacatcaggcctttttacgaattacatatgggccacattggatactccgcaatcacataaatgacgtgagaggaagaggttggtggtggtagttttgtgagtcgtcactctttttatacttttaaaacccaaaaaaaaacgtacaagaagcagcgtgaaacattcaaattttgatggttctttgtttcttaattagtactagtattaattaaagtctgcatttatacgaaattgtctgattataggtcctaagagtaagagacaacacaaatcgtcaatttaatctaaaaaaagggccaaacatacgtataactgtttaaaaaaacttttttagttgtttaaaaacttataatcatgaaaagagaatccagcggtcagaatttgttcaggggttgagagtattactacagcttaaacacatctctgccatttattgcaacagcaatcatctcgcttgtaaaccgcatctgattgcgtcctctgaatttatttccccaaataaactctgtatgcttcataaatttgagcattgactttcccattttggatatgatcatattgttgttgtcggatgagaaattcgtacgtagcaataatttaatgttttcccacatgaacgattaataatttcggaatgattaaaaaagatactaatatatatatatatatatatatatatatatatatactttaacaacaacaaaaaaaaacagataatatatactactatatcgaacattacgttatcgaatgcatatcgatccgtgctctttataaagaaacctagagtgtctccgtctctctcactacattctccactgttcacattctctctctctctctggatctctagacaccaatacgcatagtgagcagagatcgtgatg

SEQ ID NO: 25528 - DNA, 3003 bp, Unknown
  misc_feature (1)..( 3003): 2750-1469P.txt file - cDNA_ID_2706569; gDNA_ID_2214497; Annot_ID_133593
ctttggttgcaccacaagtcaaatgcagtttatttgtgaaattccctgattaagctaaacaacaagaaaaaaaaggaaacgaggaagggaaaataaagttatagggaaaaaacgaaacatatgaatcgaaagtacatcttttgtgatggcagcaatttgtaattcccccatacgattacaatcatgtttgtgggatcgggattcatgtgatctcactgcggtgagtttaatttttttaatacatatacttcattttgtttttaggatgttttacagtaaataaagtcaatactagtagttagccaatatgcttttaattagtagtatgcctaatcatctcccatgtcgtgattccagttcaatagcggccataactgcttaaggatgatgtgtaaattttagctcacgtacgccgttatgtttcaccataatgctagctagaataatctaattcacacttgattataagattttcaggttaggtttcattttatgaaaagtgtgtagtcaagattttaataaaattgttattttcagagttgtataaatgttgttttgtgctaatctctttacaaaaatggaataaaagatggattattaggggaataaaagatgcttaaaaattaactttttttttaaaaagggcaaaggtattgaaacatcaaaactgtcatggaactatgattgaatctcacatgctctgttttttcttcatctttattctttctcctctattttgtttaatggaaaagccttttctaaaagtaattacagtaaatttgttatgtttacataatgattatatatcaatcgttctactgtttaatcaccaaaattgaattattttttatattagccggctcctatgaaatggttgcatttcgaaatttcaatttggataaagaaaaaaattctttaggttctaatttatttatgcttatttttttgtttggttaggcgtgaagtgggcgagacacggtcacgcgccaagtcagccgagtggtcgtttctcttcgaaagagagaaaatgtaaccgaaaccacgtggcagatatcgattcgttcgtgttattgacttgggtgacagtcggtcgtagcaccaaccacattcgattttctttgtgagacgtgtgtcctcgtcaaagacgctctacgtggggttacatgctaggctcggtttccgaaccttgattccgaggctctgatttgaattttttgaacgttgaagccaacccactttggttcgtctctctatcttcaccatattttccctttttgttttagcaattgttttcttcaatttgaaattccattcattataatatcaatatgtgcataatcggactcacaaaatatcgccgtcaatgtttggtggtgtgatgatctcatttgacaccgtaggatgttgactcgttgcccatatacattgtttattatcgatcgacatggaattcaaaaccgtgattatagatatatatgtcactaattaagtgcgttcgttatgttatgagaaaaaaaatgaaattacatgattaatcttgtctggagttacacactaagatacatgaactaagtactaaccatgcgttaatacaacatactcttcacagaggagttataagttttcttttaacatttctcgagttaccttttaaatgttctctagtaaagtcatgtatgaagataatttttttttacgagaattttacgtaataaatacaacgattatagtacatatttcttttaggatgggaaagaatcctatatatgttagttaccaaataatgaaatggacgttttattaggaaaaaacgagaatgaaatagtaattgggtaatggacctaattgcagtaactttcaactaactctatatttctcaagggataatttggaaaggaatgtctcgcctaacattcttcttctatataacaacattataaaataacaaatcattgcaattaattgttgtttcgctcaatactaaagtatcactttttataaaaaatttctttcttagctttgcttctaaagcattgcaaagacacatggaatcaactaattcacaactactgtgctactagctacatcgatttgtggaatgttttaatgacacatcctcttgtctcatatttacaatcttacatataagagaaaaacaattactaatactaatagaaaatacaaatgagataattatatagaaaaaatacaatttggagtaattcacaatactagtattaataatcacattacgatttccatggttactataataaaacaaaacacgatcccactaagttttattgaaacggaaaatctgaccattttccaagaaaagtatacaatgatcttggattcaattaaaaatgatactagtaataatgaaacatcagtagtatcatctagatctagtaataatatattaggaacaaatatcattgatgagtgatatataatccaatataagcaacaatagtaaatggtaacaaacttaaatagagagatataaatagtaaggtttttaataaaatccaaacggtagaggctaaccgaaaaagattctcgcgtgatcgtgaaaaaagaattataaagaattataaggtttggttagggagggaaaaaagaaacgaagcaagaggttcggaaagaatagagagaaggagaaagagtgaagaggacaacagagtataaagcagttatagctttacaaccttgtatttgtgagaccattcatggagcttatgagttctcaactttttttcttttctaattaaatctctcattaccttttaaatctatccccaaacttgttaaccaaaaaaaacagagaagaaatctcccaaatcctctttttttttgtttgttctaccgtttctcatatatctctctgtctccgatcttatttggatcggactagtgtcattggcagtgaagtttcattgactttggggttttcgcttttgatgctgtgagcttattattattgttattacggagttgatg

SEQ ID NO: 25529 - DNA, 3000 bp, Unknown; identical to SEQ ID NO: 11459
  misc_feature (1)..( 3000): 2750-1469P.txt file - cDNA_ID_2706573; gDNA_ID_2214497; Annot_ID_133595

SEQ ID NO: 25530 - DNA, 3000 bp, Unknown; identical to SEQ ID NO: 11459
  misc_feature (1)..( 3000): 2750-1469P.txt file - cDNA_ID_2706573; gDNA_ID_2214497; Annot_ID_183866

SEQ ID NO: 25531 - DNA, 3003 bp, Unknown
  misc_feature (1)..( 3003): 2750-1469P.txt file - cDNA_ID_2706582; gDNA_ID_2214497; Annot_ID_133598
ctcgtctaagcttttgtttgatatatgtggacaggtgcagtggcgagagtgacatgtgagagaactgatgaatatggttacgaagcggaggatgtgacggtgcttagccaagcgacggatgcaaagggttatttcttggcgacgctttcttcgtcggaggtgaaggattataagaaggtgatcaagatcaaagagtgcagggcgtttcttgagctttctccatctgacacgtgttcttttccgacggagattaaccgtggaatcagcggagccattctccaaaactatcgtctcctagaaaacaagcttaagatgaagcttttcaccgttggccctttcgtcttctcctctgaggaaactcaggacaagtctatccccaacggctactaaatttaacaatgttttttttttttctttttcagtttctaatgccctaatgggtcatattggcccatatatcataatatatttatgtatttagtggctttttgattgcataactcacacatgcaacaattactgaaaatatactgaatatctattaatgcacgtgatttttaacttttatacacactatagataaatcaaagatcaaaattgcaatataattacggaatccaatatcttctaaatttgaaattgtgagtaagaatatatatttatgctgcataattatagtgtttatacagtgcataattacctccgtacgttaatgtagtttccaataagcaaactatcaaattattacactttaatgggacaagtgcttcgtataatagtgattattaattactacagaagggcacaagacaaaattgagagtcaaataattaataaacacaactcgaaagaaacttgccttaaatatgaagaaggcacatgctttttccgcgtaatttgaacaactagtgctagtgggttttgcttaacagcttaagtagatacattacacaaaattttgaaaattgagtcattaaaatatacaaattatcttaaatatgcttgacttttacaaaagtggtttaaattttcttgagttacgcaaacgggccaattcctttggcattgcatgaattttcttcacgcgttatactttcatatcaaataaaacgtcgccgttcagagatacactttttattcagtccttggacttggatatggaacacggtttttagttgatcagaagtcaaactcattgtcctatcttgccgaatttagaggatttatttaaaaaatattaaataaataacgcatgataatgataatttataaaaagtataaccaaaaaaatatctcttaaagaaaagaaagaaaacaaaatgtagttttgagtttattggttatctggatttcggaagatatatatgattcataattttttaggagttaaatttattttttaagactttaaaagaaaagaaaaaagttagtagacattgtttcccataaaaaaacaccaggtctcttaagtctcaagtctaaaccatttttccttttctggtcagataattctatcacacatgcttgaatttgaatagaaagacaacaaaagatggtttaaaaaaaaaaaaaaaaaaaaaaaaagacaacaaaagacaacactgggaacatatttacccaaaattcgataatggacaagctacattcaatctatgcttatgttttcgttgcatgcgaatgcatgttgtattacgtttatgagggttgtgctctacgatgtatactcttcacatgacaatatgtacactaatctacattgataatacatatatttgttaagttcaaatagcattatcacaaatgattaagctatatgtatgttgtggtgaattttccataaataatttgtcatctgtcaataaaattttaatgtatattctataacggaattacggtcagatacatgtgtaggtaatgaattaagtaagatattaatatctgtcgacaaataaaagcatcaatatgtatgtacattctcttaaaactgattcgatttcattgtgtcactgtgtatattgtatagaaacatatccaaatacgtatctcatgcctgtcctctaacttaaaaacaaaagaaaaaattatcataccagccaatttaatgcacaagattaactaattgatcaataattggatacgttacaactctataaaatcatatccattacgctttgggcaatggcaaattggcaatggaagtaaaatcaaaagttaaacaaatgaattaccatttgaaacactccaaattggtattcgtgtccaaaataatttttccaaatgtcccatcattctaaagtttttcaccttatgcatggaaccttcctagtatatatacagttctaaaacgaattttatttgcaatggtctatcagagattataatgtcaagatcttgactttttgctgatgtgtagtgtaatgtgctgttttaccaacatgttatatatataatcgaattttttcttgaaatgcctaacgttggttgacaattttatattacgaaaacctttccctgattatgcatattcaaattgcggtaacagaagtttggtcaaaatttgactttcatgtaaaaaaaaaaaaactcaattgaccttaaacttaaattaaacacccatttatatataattatcacggatggaatttactccttaattacagtgattatttatctaatttttggtgagagacagatctatgcgtgtgaatattatcacaatatggtatatatgttgaattttttgacaccgccacaattatatatgtagtatgtacacacacattatcattgacttgaatttgtatgtatattcaaattcaacgttctcaaaaccctatatatataatccaaaacatttagcaaaatatctccaaaccaaaacacaattaagctaaaaaaaaaaccaaaggatgtctcagaaactcatgttcttgttcacccttgcctgcctctcctcgttaccatctccttttatctccgcccaaataccggccattggaaatg

SEQ ID NO: 25532 - DNA, 3003 bp, Unknown
  misc_feature (1)..( 3003): 2750-1469P.txt file - cDNA_ID_2706590; gDNA_ID_2214497; Annot_ID_133600
tctacttttcttgcttctcaatgttcaacagcattacaattattataaatatacaaaaagttaacgtagttttaatatattggccaaggttagtgaaatgttgtttaaaatagtatttcgatgtacaagttgtttttttaattcacgggtttgctcatacgtcggccgcagaaatagcgaatctatgggtattcacttaagttgccatgttgggtaatttatttgattattgtttaaccaacagcaataagagagagaaaagattgtattatgatttgatgaacaagataaggttgcccattggtcaaaacattccccaagttgggatatatttctattttcatcatccttccatgtgatgtgccgtgcggcaaatctagaataatgtactatcaaagttgtcaaaaagtaaaaaaacataccaaaatatcaaaaacaatctttgttagtttgtttcctttccgatggaatcaatttacgacacaccaaaataaaatgcaatctaggaccatgttttgttgtttgaatttcattcagttaataaaatgatgatacaagaaataatcattcacatttctatgaaacttcagatgaccactttctctttttaaaattttcttagaaaggatattggtagtcaagaaaaggcaagagagaaaaacatttacaaaagagttaggctgaaaatagggacatttgtgaaaaagtaagaattgattttacagaaaaaggaagtaaatacaataaaataaagaaggatagcgctactagtatctattttaaaataaaataattccctattttagtaaattatttatcaaaaacacaatttatttcacaaattattttataattaaggtcacttttatatttagtaaaattgtaaacaaatgatatattaagaataaatagtactagataaatctaagtagtttcgataattcttttttcaaaattttgattttgtaatatgatgtaacaccaagtcaaggtttatacattgagcctagtcatggccaacgcattcctctccctttcttcccctttattactttcttttttccttgtaacgtttttttgcctcacctttatttatttattttggttttctttctttcaagtcatttcgaatccaaaagattaaagaaaaactggaacaataacacgtaccagcttacttattagcaatcagaaagaaagacagtgactgacgccaatatcttagacattacaaagatgaggaaacccaacgtacgttcttcacttacacaatctaatcatagcgtgagaagatcttttggatcaattaaaggtattgacaaagagagttacccaaatgaaaaaggatcaaacatttgatctaatccaaaacccgataatgcgcaaataaaaaaggaaaagacaagttttgaaagtcgaaaggtaaccgattacttcagaaaaatttcaagtattactctagttcatcagaaatccaatttgccatttatgataactaatcaaatcaaatactataaggagcaaaagcagaactaaaagagagaaagattttctcctacttagttttcatatatatatatcattatagcaatgtaaaagtataatccataatagttaaaagataaactcaagtcatacacagactgaccatgaagtttcgtagctaggcttagaccttgaaacctctgctccttcttcttcctcttgctatctcaatttttttaccagtttgacgtacatacggtttggtgtggctgtgaggcacaccaggagctggtccaaagtgcttcactgcttcacgtgtgttcttaggacctctaagcagaacctgcaatcattacggaatgctacatcaatcgctactgcaataataaaaagtgaaaatataacccttgtaaactgagtacaagtggtcctcgagatagatattctctaattttcatcgagatagccttttaaacaaaggcttacaagccactagattttgaaagttaggacagtaacctcaaattccaatcatcatgaaacgagacatagtaactgaactaagctacatacgtcacgaacaagtaaacgattagcacaagtttccacatttcgacaactgaactaagagtgaaacaagaatgggatataccgtgttctctgaccaagtggggcacggaagagcgagctgatcaaaagtgaggcactctccaccagccttgtggatcctagctctagcgctctcagtgaacctcaatgcagtaactgtaagagccggaacatcttcgattctaacatcatcagtcacagtaccaacaataacagcaatctttccatcctaataaaatcaaacacacagagcattagttcatgagtcgccaccaagtaacataacatcgaactcaatgcagtaacaacctaaacaacaacaaaattcaaacctttccgtccatgtatcggaccagacgagagagagacagtggcgctttgttcactttgctcatgaacaaacgcttcaaaatcacggcattgaacttgctttctgttctcctcaccagatatcggttcgcctaaaaaaaaaaaaaatttaatctctgacggatttttagtcaaatcctcaaccttgacaaggagcttgagatagacatcgtcggatttaggctcagtacgtttcgtcttcttgctcttacctccggctatcaaatcgataccctaaaatgatgaaacacacagaagaagcccaaagtgagagtcaaaatctagaaagaagcagaaccgaagattgcttgggagtgaagataagaagtgaaactactaataatatgtatcagtttagggtttttgatgggctaaatatattaatcggcccactaataagaatattgggctaactgatgggcttattagggctttaggaggaacagagttaaacctcacttttttttattaattcgattttgggtggttccggctaataatcttctccgaattcgacggagagatttggtgaagacgatg

SEQ ID NO: 25533 - DNA, 3003 bp, Unknown; identical to SEQ ID NO: 25532
  misc_feature (1)..( 3003): 2750-1469P.txt file - cDNA_ID_2706590; gDNA_ID_2214497; Annot_ID_183872

SEQ ID NO: 25534 - DNA, 3000 bp, Unknown; identical to SEQ ID NO: 11482
  misc_feature (1)..( 3000): 2750-1469P.txt file - cDNA_ID_2706594; gDNA_ID_2214497; Annot_ID_133602

SEQ ID NO: 25535 - DNA, 293 bp, Unknown; identical to SEQ ID NO: 12369
  misc_feature (1)..( 293): 2750-1469P.txt file - cDNA_ID_2706598; gDNA_ID_2214546; Annot_ID_134566

SEQ ID NO: 25536 - DNA, 3000 bp, Unknown; identical to SEQ ID NO: 11488
  misc_feature (1)..( 3000): 2750-1469P.txt file - cDNA_ID_2706616; gDNA_ID_2214498; Annot_ID_133618

SEQ ID NO: 25537 - DNA, 3000 bp, Unknown; identical to SEQ ID NO: 11488
  misc_feature (1)..( 3000): 2750-1469P.txt file - cDNA_ID_2706616; gDNA_ID_2214498; Annot_ID_183904

SEQ ID NO: 25538 - DNA, 3000 bp, Unknown; identical to SEQ ID NO: 11494
  misc_feature (1)..( 3000): 2750-1469P.txt file - cDNA_ID_2706620; gDNA_ID_2214498; Annot_ID_133616

SEQ ID NO: 25539 - DNA, 3003 bp, Unknown
  misc_feature (1)..( 3003): 2750-1469P.txt file - cDNA_ID_2706624; gDNA_ID_2214498; Annot_ID_133613
acagatccaaaacccaaatttgccaccatttatatatatatatatatatatacatataactaataataagaaatttagcaagtatttgatagtatttgcatcagcataaatcaaaattttctcaaaatgtctgtctagctatttcagaacctagacgtagttgtaaaactagtcaggggttaggagatcgatcaggtctttagtttcagggttaaaccaatgcagccaaacaagtggaaaccactttcactaaataaagctaaacaaaaagaacaaatcaaaacctaaacctataaaataatactatactacagtttacacagactctgatggatgatgtctatgactccgatttaacttttcatacttttcattataacgaatagatctttctttagatattgtataggtacaaattatcaaaaataaaaaaaagaagtccaaaaataaaactaatttggctttaactagcaaagagaaacaaacaaactcaaaatcaagataataattagaagaagaaaaaacccatttttgtatatttaaacatgagagaaagaggtttaacaaataaaaataagagtactgaattcatttatagggttgcttgcacatctgccgacaccaactagttcccttgaagtgtcacatcttttgttgtgttccaataactgtactgctcatatttcagtctttaatacttttaaccttttcacgatcagtataaaaaaatttcttatcatattcgtcgttactctttaactaactacagtatagaagaagaaactacctatttatagaactctgatctcctcggcagtttcctattggttaccactgctgagtatatagaatctatggagaatagtatttttaaatttagaatgttactattaacttaagtacaaatcaatatcagattatcaaaattggtatagttggatgttctatggctatggggagtctgaatattgctccctggtctcagatagatgctttcaaaatttaatactacttaaatttaaacatacatcgccacatgacccatcactatcacggttacttatggatatccaacattaaagagtaccacccaacactaggactcttataaaacacataaactccaaaattttatacctaatatccctggacaatatcaataaagttttattggtttcttttttgcaacaaacgcaagagaaatttttattcgtcacggattgaggttttacgcacaccggtacaaaagtgtctatgaagaaaataacaaaccatgcaaacgtgtttaacgggctttacaaatatgttcagaaattactcgcatgcgagattaaagaaatacaaaaaacaagtttggaaccggaggattgcaattatcatctattctatatcgcgtgtgtgtgtgtgtaaaattatgatttataatgtatcgaggtcttagattttaccttgcgatcctagagtttcgtacatatatatcgactattcaagttcttctttcatctttttgtatcttaataagttccacaaatttcgacgatagagaccatacatttgttgttatcctctactcacgaagacaaccagtctaacgttattgcataagttccacgtaaattaaaattgtgtttcttttgttaatattgaaaataggttaaaatgtcgccaaaaaataagctttgaaaacttgaggtaggaaaaaatcatggttcttttgcacatgctccggaccaatcatgtttactactaaaattcttactgcttttataataatcatctcgactggcgcgtgtagaactctagatgaatgccaagtcttattttctaattataaacgcaaataataaaaaggtttaagaatatttaaatttcacatgacaatatgacacaataaatactacttgaaaaatgatctttgaaatttcatattttctaatcaaaaacaattccttcatattttgaaatataatcgatctctcatatttaatttccaattagagaattatatccacatgatttgctttcaaatatgtctatttaacgtgtacgttgaacttgaacctatttattatttaattcattcccaaactaaaaatattttattttctaaaaaatatagtcgtaagcgtacttgtgtaaatatgttctaaagttaataatgggtttagacatttagtagaaatatatattttttggtttttggtttggttggttcggataatcaaaattttcagtattcgactaaaatacatttttgagttatatttctttacttaattttcataattgtaagtatttaaccttgtgtacgattaaaaaaaaaaaagtattttaaccttgtgtatcattcataatgtaggttttctttccattttgaaaaaaagttttgatattggttcgcattcatcagttgaaaaccaagtcaaatttatggtagattggcaatggacaaacacaaaatatcatctccatttattgccaacctcataatgccaaatggtggaccaaaaggaaaaacatgcatttatttattctcttgacataagagaaaatgcatttaacttgtcaaataattgcaaggaaaaactctataaaaagatagaaatgtgaacagtataaagtaaataaagaaatatgtgtacatgaaagacctctccaatgttcacttgctccagtttctccaagattagaaactgctacgtctctctctatagctccctcgttttgctatgtggtaattaacaacagacaacagtttttgtttgtccgtaccgttttacttactctctcactgtctttgtctattaccactctcgtctctttcttttttccttctgttctgtttctctctctaaacccaaaacagtcaaaatcagggaagccgaaattttctttgctttcttctcctttggtcctttctttaaacccgagacagttaggtttgtgtgagagagagaatgatgagtaaaaccctttctgtctgagtaagaggaaaccaacatg

SEQ ID NO: 25540 - DNA, 3003 bp, Unknown; identical to SEQ ID NO: 25539
  misc_feature (1)..( 3003): 2750-1469P.txt file - cDNA_ID_2706624; gDNA_ID_2214498; Annot_ID_183899

SEQ ID NO: 25541 - DNA, 3003 bp, Unknown
  misc_feature (1)..( 3003): 2750-1469P.txt file - cDNA_ID_2706632; gDNA_ID_2214498; Annot_ID_133609
gtagtagcttcaatttccatagttttgtagaagaataaaaattagggtttatgtgatcagaagagagagttggtgattttttttggtaagtgaaatgtgataaggttaaggttatataggagaaaagatagaagaaaatggtaaagaaaaatcaactattttagatgtacaagttttagtgacaactaggtaatatatgtttaatccttttccttttctttttcttttttgtcaactcgtatttctagtttatatcgtagcagaacgtaaagatcctgaatatattattaataaaggcaaataatattgattgatgtcttgttgagattcaatagataaactatagtttgaataattaacatacaatatgagattacacttatattgaatattgatgaaagagatgtgtcaggctgtctccgaagacatgagatttatgaatccaaaggaagtccagggacccctccaactataacaaaatcctcgttttggaatgtcttaagacattaattcattatatttttagcatattgtaatttagtatcattgatattaaatttttgtggtcagagatccacgtacgatattgcatgtaatttgtaatcgttttcgcattcatacaagtaaatgtgtacacatggtgtaaaaacgatacaatattaaagttggagtttatataattcatgaaggtgacacatacaatatttccaattgaaatgtattttttatctcaacatagtcgaaataaagtaaaagttgtcattagtatatttggcaatgtgtgtttagttaaggtattacgcataaatccaggtggcttcaattaaataaatgcctataggattgcagaaacttgtccccatgtaatgtacacaaactcaaccaccttatcatttgcaatctctaaagttcaacataaaaatacaatttgtgtggaccactaccaacactttttataatctatgattacagccttaacaacgagaatctcagatagtacatgtttaactaaactaaattggatgacataatttgaaagaattatatatgcaaggtgtaaatttaacgtatagacatgtcttgataattaagaaccacaaatgtcacagctagtggtatatataaaactaaattttaaatacgtatatatgtgtgtgaaatgtcatgataggttaataaccatttaaacgaacttatgaatagtaacaagacgaacttatgaaatgaacttgtgaaatgtcatgagaggttaataaccatttaaacgaacttatgaatagtaacaagacatgaaaagataagaattaatgtacactttatcaccaaaaaaaggaagataagattgtacgaaatcggacgtaataatgtaaggacatggaaatggcatgaccctcgggtgcacgaggcagttccacttcctgacgactctccattttacttggtttacttttatcttatctcttttcctttttaccttgcgaatcaaattgaccttttaacaaattcaattcctaagtgtttttgtacaatatttgtgaattataatgtgtagtgtatgtctatgcttgtttgattttctaacgcttgttggatataagaaacaattatcttgaaatctctacagtacttatcacatccaaacacactatataatatattggacaagcgatacactgtcttatacaaaacaaaccaatcacaaacaaatagaaaacaatacatctgtttcgagtcaagtaacgtcctatatattttatatagaaagtataaatatacacacactagttgaaaaacttgaacaagaacatgttagagggcatacatatatcattcttactaacaagagatgttttgtataattaagccaagactttctaatattatatttgtgtggtatagatatcataccaacaattgaactagaataagcaatatatttaccatactatatcttgtttacctaagatttaaaacggataatagccatcggatgtacatgtacacgtgaagagttgggatatgaaagaaatccaaaggctgagaaaaagaaagagaggtgaaactccaatgaaagaattgggtttgtatacggaaacacgagtcttgtgctctcttttggatccggaccacacgagcggctaaagaagcaatgttgtcaaaaacgttagagccgtatgggttatgggccccaccatctctttacttgacgtggttcccagttccaaacttgtgttgtgtatatatcttgtttggctggcaattaatttttgaaaattttaattcgatttctgaggacaaaagtggttgctgattaatcaactaatccaaatttgcacaatgctaattcaacactcgtgctgcattaggtgaaaacttattcacactgggaaacctgcctttttatatagtatagattgtttctcatgattattgttgattaattaaaacattttttaaaaattagtgttgcaaaagaaaactaatcttatatgttgttttattatatgaatgtagatgcggatatatgattgagtcccacatgctaacacgtattgttccctgctggggaagaaggaaatcaaaatcatgggagaattataagcatattcactcgcctacctaccttgattactcatcattcataatttcatagaatcattttccctaaagaattaaatacacccttgatttataaagtttaaacgcttaaaaagtccaataacgagagggcctttgaatcggattcgcaattatatttgtaacaagtaaataattgggccgactaaaggaatgaatatacttccaaaacaacattctcagtcggtgcatatggtacggacctaacgaatccaaacctaacaataaaaagaaaacgttacaaaaaaatatgtaacagagaaaataacaaaaatataacgaagggaaagactaaagaagagacacattcattaacaattcatacacctttgttcaaatcaacgaataagcttctttattttaatg

SEQ ID NO: 25542 - DNA, 3000 bp, Unknown; identical to SEQ ID NO: 11484
  misc_feature (1)..( 3000): 2750-1469P.txt file - cDNA_ID_2706643; gDNA_ID_2214498; Annot_ID_133606

SEQ ID NO: 25543 - DNA, 772 bp, Unknown; identical to SEQ ID NO: 14096
  misc_feature (1)..( 772): 2750-1469P.txt file - cDNA_ID_2706651; gDNA_ID_2214700; Annot_ID_136835

SEQ ID NO: 25544 - DNA, 3003 bp, Unknown
  misc_feature (1)..( 3003): 2750-1469P.txt file - cDNA_ID_2706659; gDNA_ID_2214499; Annot_ID_133633
tttcattttctggtaacgacattcttagttctaccgcagcacatcaaaatctaaaggtttttacatatatatgttttgtctggtgttgaccgtctcatggagattaaggaaagaaccagaccttgatgaagattgaaagaaccatttgcagaccaaatgctgcagccattacaaccgtgatatcattgttcgtctcgaggtaagaccgtagattcagggcaacaaaacacgatgatgcactaccagctaagagtataatcacccatctcagaaactctactggaataagcaatggaagctgcaaaatagaacatcctgagtgttattatgcttaaacagtatgaagtataaagttgtgatatcaagttaggttgatttatgtcattgtacatggtcattgaaagtgaagttaccaaaccattgtgtatcaagtatatgcatttgtctttagtgttactgatcatcaattgattaattttaacagcaaaagagaccgaagttactgaagatacttacagaggttggaacgaaaatgaagagagagtatccccaaaggcaccagaatcttagaagatcagctttggaccccatataacggagtgcaaaataaaatcccagaggcacaattattgcatatccatatattatagatgctgccaaattcatatagttcacatcaaagatccaaggagcattactgtcggttcgtttcttcacgagatatgtagcacaatttccgagagaagcaagcacaaacacaagcgtagtgcagatccagacaagtccatacctaacagaagcacacacgagtcattaatcaagaataatttgtgaaaggcctagcttttagccaatctttagaggataacatattatgatgctttctgttcatttgtccaagagaaaatgaggatattttaatcaatcgcctgaagtaacataggagtaaatgaatagcaagatcatgctttcggaaaggtgcagaagataacacttagaacggtaacaaattaacggcatgactgagcaatggaccgattaaagaaattcgaaagaactctctcatggtaagtacaatcaccaagaagagtgaaggagaaaaaggcattaaaagacttacaaatcagggtttgcatcaatcttgttgaaaaaatctccactagtaggatataaagagctcattaatctgttcaaaacaacgtccgtgtccacgtcgaagtattgggtatatgagtagacattaaaaaagcccttccagttgtttgatggctgttgtgctggtccttctactggagcagataagatatatcaccatataagacagaacaaggtgaaaacaaaggtatataggatcttgacatccataagaaaaacgaggttgactcacacaagtattctttcaaccattgtactgattcatggtgactacagataaaaatatctcctaaaaaaggaatctaaaaggagcatatatacctgttgggctctcaagagtttgataaccctttgtattgtttcctagattcggtggaaatatttgcatgcttgcagaagggcctgcaataatgcagaagacatacaacactcaatgtctttcactaccggaaaagttctttgcaaaagataattcaagcagaaactagcaaaagaacacaccttcattgacgcttgctattggtacatttgtgcttctcttgtcgtcgctgatcacagcctaagaatacagatgtttgtatcagacataataacacggggatagtcaatccattcactcaaaacatttatcttagcggattcaatccaaaatgaagctatcatgcaagcatttaaactcaaatacagttttgtttttcatacgaattgtctcctaaaatggtgaaaaaacttaaataaaacgccttaacaaatatagaaacccagaaatgcaaataaggaaatcgtccattgttctatgagtgtgaagactttaggcatcatcgtggacgcgaaaaaatatgacaaaaaaatctgaaaagtttcaaaattctacttcctaatgtaacacttgagacagaacaacaaacaaaatgatggcatgaacaaaaaacgttaattttcccttcacacaaacaaggatcatagaaaaactcaatcaaagagcttattgatggtgaaatgaaagaagcaatagatgtaatatagacttaccggaactgaaccaagcaaatggcttgattgtagattagcgaacgactcatccatcgatcaaagagaaaaagatatcaaagaaaaacttagaagataggttcttctaatctcattcaaaaatcgataagatcggaaaaaaggtcgtccctttttctgaatttttaaggtttctgggtttgcttctcctcctccgtcgtcgtggaagcaattgggaaaggaagagaaactaaagaaagaacgatccacgcgctttcttagcaagtcggtaaaacacgcgctgttcactttcggacacgtgatttgccgacttgggcccagacaatcacaagattcacacaagacttcaaaaacaaaggcccatatttaaattttgacccgaatcgtgatttgccgacttgggcccagacaatcacaagattcacacaagacttcaaaaagaaaggcccatatttaaaatttgacccgaattaaacaatccgacttgacccgtttgaggagaaattcactcaacagtgtttcctctcttcgtcttccctcccgagaaagctcaacggagccctagactggttttatcactctcgccaacaccaaccacgctttttctctctttacctccatttttgtattcgtcaccggagtagatggatacgagagaaatcaacggttttgcctccgccgcgagatcgatatctcttcctacgcagcctaattacagtagcaagcctgttcaggttcttccgctttatacctttttatttctccactgaattagtttagctcaggtcttaggatttctaggttcagcttaaaaaaatg

SEQ ID NO: 25545 - DNA, 3003 bp, Unknown
  misc_feature (1)..( 3003): 2750-1469P.txt file - cDNA_ID_2706667; gDNA_ID_2214499; Annot_ID_133626
taagattatgttaaaagtaacattaaaccactaatggagattgaagtgtaccggagctctgttgatggcaccgacggtggaaactgcggcggccatatctcaagactgcgacgagtatgcgtcacaacacaagaagctgaagagaggaattagattggtagaagaagaagcttagagagatgttggtgtgagcaagaaactgagagatttataaagcgagtgatcaacaaccaattcgttatctcttcgtcttcaaggcttaactctctgatcgccacacgatgcggattggccaagttgccacgaggaagatgattaggaggattctattttgattggtccacgtggaatatgtttatgaggttgtcgtcaaatggctaatctgtgccaatggatttgttttttttttcaagtgaagattataacattatttattaccacatatgctttggaaaatcattgtttttttttttttttttgaggattgaggtaagccattcatatgtgatcaagatacttctacactcttcttcatacgataacattccaaaattttggataatgacattgcttatcgataataatgttccaaataaccgatgtaaactgattggtggagagaaattggcttagccaatagaatataattctaattttgttatatacaactctagatacaacaggtatcaagtatgtggttatcaaattaaccatattgtactaaaccgctaaaaactaattaatgcaactttttctttacacaaaatgtaaaaacaagtgatgcaatgcatacgtaagatttgataaatatatagtttagaagatgaagtaaagatagtcgaggctaagatagcatcatgcaaaatatcatatgctaaaatatgaaataagattatagtgtttaaattcatagtgaaaatatgaatatatcagaaattcatatgaatttacttgttttaaaataaaaatgataactatatcatagtttattgttccctcaaagttactataaaaacaactcatctaaaactatatattcacaatcacaagcaatcgttttctacactaagctataaaatgaaacacttcacttgtctgatcattataatttctcatcctcttcattattttcagttttctcaaccattctctcatgtggaacgagccatcatatcatcaatggacaaaaccaaattttaattttaggcttcattcgctgccgacgaagcaatatgtacatgttctacatgcaagacaagagaacaaagattactgatatgatattaaactattattgatccatatataagacatgttgaagaaccaaacgattgataataatgtggtggagctactcgcacaatgctaaatgttaactgtatgtgacaaaattagcaaaagtttgcgtgccaggtttgattcttagtacacatacatgacttttaacatactgaggttagaaaatgaagtacagtaaaacctttataaattaataatgttgggactgcaaaattttattaatttaaaaaggttttaatttatcgataaattaatattttttaattatagagaaattttcctaatttggtaactttttaaaaagttttataagatttttttcattatagaaaatatctttctaaaatcaattacaagtacaaaattatatcatgtctagaaaacaataccaaattttttttgatacagtaacacattagaactaaatttcaaataagaataactacaaatttaagtaaaaaaaaatcaaaaacatttcttacatataatgtatatatatagttgatacatttatgcaattattaatttatgatattgatgagactatatatttacataggactttcaaaaaagttattatcttattaatttatcgatgtgttacactttttacattggtcctaacttgggatctggtgaatttattaatttatagaggttactaatttatcgagtattaatttatggaggtttaactgtaaaaagagttgaggttaccattgcaataaaatatgagacaatgtgtagaggaggataaaagattgaacaaaaagaagaaagccaactagtttttgtcaaaaggataattttccatgtgcatgcaagtatgcaaccacatcaaaatcataaataaacattgtctaaaatgtttctaataaaaatagatgtaaagaaaattcatcagtttaataactagggtttaagagatatttacaaatactaaccattaacatcatatttaatatgactttgtaaaatctatgatcaaataacatgcaatttttttaatatgtaaaataaattatctcaaaatatttgattgaatatataccctttaatttagcattgattttaaaaatccaacaattttctatagtatattttgtaataatgttattggttcctaaaaaagatggtcacatcattcattaaataaaatgaaataaagaagtgtttccttcgtcgcattgaataaaataaagtaaaccttccaaagacttttcattgtcttcgcctgcgagcgctaaaattatctccgagcattctcaagttgggtgattcggtacggattactgatttgggagagaaaaaccctagattggaattagattctgggttcttgggctaaaggtttcttcatctccttcgaatcatccttttgtaagtccagtggatgtgaaaacccagtactcactgattctttttattaggaattttgtaaggttttgggtagagttttcacagttttgatgatactaaaatgtgggccactgggtctagagaatgaagaatcttgcttttagtgacaaaggttgttcctttggagtagtaagtgagcaagatatcagaaaaactgaacctttaatctcaagaatttactttgattggagcttgtgaagtccttgtgttattgttgcatgatgttttctttgagataacttggcaatgtgtgtttggtgttattgtagagggagcaagacgatg

SEQ ID NO: 25546 - DNA, 3000 bp, Unknown; identical to SEQ ID NO: 11499
  misc_feature (1)..( 3000): 2750-1469P.txt file - cDNA_ID_2706669; gDNA_ID_2214499; Annot_ID_133625

SEQ ID NO: 25547 - DNA, 3000 bp, Unknown; identical to SEQ ID NO: 11499
  misc_feature (1)..( 3000): 2750-1469P.txt file - cDNA_ID_2706669; gDNA_ID_2214499; Annot_ID_183919

SEQ ID NO: 25548 - DNA, 3000 bp, Unknown; identical to SEQ ID NO: 12166
  misc_feature (1)..( 3000): 2750-1469P.txt file - cDNA_ID_2706673; gDNA_ID_2214535; Annot_ID_134352

SEQ ID NO: 25549 - DNA, 3000 bp, Unknown; identical to SEQ ID NO: 12166
  misc_feature (1)..( 3000): 2750-1469P.txt file - cDNA_ID_2706673; gDNA_ID_2214535; Annot_ID_185049

SEQ ID NO: 25550 - DNA, 3003 bp, Unknown
  misc_feature (1)..( 3003): 2750-1469P.txt file - cDNA_ID_2706677; gDNA_ID_2214500; Annot_ID_133654
catcttctgtttggcgcaacattgttgaatgattttggatgactgaaattcccaaaagaataattataaaatactcaaaaactaatttaaatgattttttttcagttatatctctaacatgtctatgatatataacaaaacgtttaagacaaatgtttaaacatgagaatagaatcacgctttcaaaacgtgacaactaaagaaataccatttatcaatctaactctgttaaattcgattatctattgtttttctttgtacaaatggtattttgatgctatacattagcatatataataggaacgttcttttagatggtattaaattcatttcatcctatatatctatttctttcatcttctagatcgagatatgtcaaaaggaaatactagatccgtgatgttgacaaaagaaattgtccgcctaatatgttgaatattgtgaacgtaaatgatgtgatatagtgtgataaataaataaataaatgaatcaattaccagataaggatttttagtggcattcatagatttgccgaaaaaattatatctaaagttacaatttacacatttaggtttacttggttctatttttttagggtataatatttgttattatgtattttataaaaaaaaaatggaaacataatgaaacaaaattctcaaatacatatttttatttaaaaagtttctcaaaattttagcttttaagtggcagaaaatagttttttttttttttatagataaagtgaaaaatctaaaatggcaaaatcaacaataatccaaaacaacaaaatcaacaaatctaaaaaactcgttgattgttttgaagacaacagctatgtggtgaagaaaaaatgaagaaaaaccaaaatcgacatgtgggctactgtgtaagatgcattcatttacagctaccaaacgcacacgtgacaattttttttttttttttttttttgtttgtatatattatataaatttaaatacaatcgaaaacaaaaattcttcgttaaactcttttcaatgctgtatttgaagcttcctatttttattattaaaaatatgttgtttctaaaaaatatatatatatatatatataaaaattcttttcttgactctacaaaatttttgtttgctaacaattttaccttcactgtttactatacaaaaaatctctgttttagtgaataatatatgcaactaagtttttcgcaataaaaatacaataaaaaaattgtagctagctatagtctggtcacaaaccataggaaatgtagcctctaaaaataaaatcaataacaaatttgtactgatctttttatatcgacataaatttggtgaaagtccaaataacatgtttttcgtaccataatcaaccaagtggtgttccttcaacagatacataaaacgaggcaaaataaaagtgaacgaggcagacaaagaattttccaaacctcatttaagggactaggttgactttagtcctttactttagaagagagttgcagttttcatctattgtaggggttacacaaaatttgttcttatgtgagtccaattgccaaattgtacatcactcgaagacaaattgggcccaaactgtgtagaatgggtttgggctgccaacccataataaaccttaagttgaaaatgaattagtttggcacatgcttttttttgtcatgttcatgcttttaaaaaaattcaaaattggcctaacaagtttcacatctctagaatgttgttcctagctggctagttccacgcacgtgtcacactataatttgtcatttcgtgaatgaagaaatcattccaacacttttgttattttgataaccatacaaggaataacacgtgaaggaatttaggaaacgagagattctagagaagtcacctagttttgtatttaaaaaaggtgctcaaaattagaaaaatatcgaattttgttgaaaaagggaaaaataaacaaagacaaagtagtaaatagaaacttgggcatgaagctaaggatatgactggtcgccgagaattaataaccacacagtattattacaaaaagtatacaaaccgaaacttctcgcggtgatgatgaaacctcaacgcaatgttatcgtcacatcaatttgattcctcattatagtatgaatgaaaaagcagattaaacagaaaatacataaagagctctataactcaataggaaatatttaccactcacctatgtttttcttacactttcactctaatttattttgacaaaagaaaaattgtattatattatttaaagacttgactttctctttaatattttactgttttttatatttaaagcaatataaaaaattatcatcattttaattaaatttattatccctaccattttaccaaaccaactcagtaataaactcatttcatacacatatttgacaaatatgtcgactgtcagaatctagaatactatttgtcaaatgaaagtgattacattatgagataacgatagaaatatccacatctctcctgatcaccagtcaacatatcttttattaacgaattgactggtagtttaagacgctaattatcctttgctctataataccatttcaatcgatattttaactaattatatactattagaaatgaaatgacaaatctgccgaaagcttttttctttttaatattttgtcaaaagaagacacacaaaaaaaaagtaaattgtattagaaaaaatccaagacagagaaaaaagtaaacgcgtagacagatggcgacaggagaaagagagagtggagaagaagaaaagaattgcgatcaaagaaaattagacttctttcttccaacgttttcacattacaaatacacaaaaaccaaaagataaagaaaaacaagaaatattttgtttttcgatctgaaaaagtgaaagcttcttcaaaatctttgctttagagatcgtttggtgattttttttctttattttttttttatagtttcttcttcttgattctttcatatg

SEQ ID NO: 25551 - DNA, 3003 bp, Unknown; identical to SEQ ID NO: 25550
  misc_feature (1)..( 3003): 2750-1469P.txt file - cDNA_ID_2706677; gDNA_ID_2214500; Annot_ID_183965

SEQ ID NO: 25552 - DNA, 1151 bp, Unknown; identical to SEQ ID NO: 11529
  misc_feature (1)..( 1151): 2750-1469P.txt file - cDNA_ID_2706705; gDNA_ID_2214500; Annot_ID_133656

SEQ ID NO: 25553 - DNA, 3003 bp, Unknown
  misc_feature (1)..( 3003): 2750-1469P.txt file - cDNA_ID_2706717; gDNA_ID_2214500; Annot_ID_133649
aatggtatatcaggttctcatatcaacctagagaaattgcatatgtaatcggcacaggtaaatatttcaatcttttcaaagtcaaattcatagcattggttagtttctctataacatgtagtattattgcatatgcaggtgtggtgatttgcttcatgttggtagctatacagttctgcaacaggtttcagtgcagtggtggagagggacatctaaccgaggatgattcagcgagaacacgtctacttgcagacaaagatgacgatggttcaagcatgggttcgtgtgacgattcttatgcaaacgatgatgctgacttagaagagtttatgggaaatgatggtgaagcaagtaaccgaagtagacgtctctgtgccatttgttttgatgttccaagagattgctttttcctcccttgtggtcattccgtctcctgttatgaatgcggaacaacgtaagttattttgtccacgaaggtctttaagaattgataatatacaactagacatatcaaaatcacttgattgatctaaactttgaaacgttatgaatctgcaatatgtgaaggatgcaagaagctgatgggagttgtccaatatgtcgaaggaaaatgaagaaagtgaagcgaatctatacagtgtaagatgaatcaaatataaatctctgacataatgttgaatctatagagcattaataaaagttatattggtattgccaaggctcatttctttctttgcataactatttcatttcgtccctgaccatctttgtgataacactcattgtttgtcgactcacattccgaaatgggatcgaaaccctgaaccggtaagtccagtgttggtgcgtggactaaatgagttggtacttcttgatgactttggaatatgcgtaaaggtgggattgcaaagtccaaatctatctccacctccaacacacaaccatctccaatgcacaaatttctgtatctttgttggtgatccaacttattatttttgttctttattgatttctcccacggttcttatcttcttcttccttttttattgtggttattgttcaagctcaaagaaattcaagcatgtatcataacatttttgttagttgacatggtcatacttaattaggagaaaccattacataatgtttttaagcactgtaattttttttttgttaaaataaacattatgtaattaattgtgcaataatacattcaatcattgttaagataacacatatgaataaacaatttcacataagtatattgaaattgctaagttcaatcaatatagtttattttagaatactaattaaacactaaaacttaacagttgattaattttaacttactatactgttaaacttaacagtttaattaatgttaaccgaaggacaaaattggaatttcaagaaagaatctcttcaaataatataataaaaaaacaaaatcctcactgacaaaaacaaaagtctgaaaaataatgttattattttatataataaagttataaaaataccctcaagactctggtcgtcgttaccgttcaaacgacagagagaatagaagaagactagccggagaaccaaaatcgaacgataaccgttacactaataaacttgccctatcatcttatctttcatggattcacttcctcacaaattctcaggtgttttattttatctttacttatcctataaatctctagggtttcttctatccaattcatttctcacctcataaatttttttttgttatctctttctctaagaatcaccgaaatggggtcaattcgtggtgaccttcagccgctttttgtcatgccaccacctcccctcgatgaagattgtgatgatatcttcaattctgacgaatcttcatgggggctgttgagcttgtcctgcttcggtatcattatgggattgtggttctttggttggtttctcaacttcagttccaatttaaagtttttgtcttttttgattatatgagaatctgacttatttcgtggattgaatcagcgtcggtttgtctgatttttggtgtttacggtagtgaaactgtctggcttggacctaactcgtccattcttgttaaaccaagttccatctttgtcaaaagcattaatgttgtctcttgttttttttttttttttctcactctcttcttgtgtttcttctgtgtaccaaggctgtgctaatttatatgaaatgtaatttgtttttgttaggcaaaggagcttgatttttcaaagcctggacttcagctatatggattcaatggtcaatctactcctagtggttattttgtaaactggactgaatctcgagtgttatctgtctcacagaattcttacaaggcaggtttaagattccttaggatctttattgtattgttttgggtacttgccattgaaaccaaagatttgatctttgtctatatattttgtcagaatttattttcagctttgattattgacgttgaagtctcttttagactgatttttttgaactgattttgcttctctcagggatggccatactacttaaatagaggaacgcatatgaatatatcttataacattttacctaaaggttctgcagttcggcttgtgatcactgaaggttagtaaaatattgttgttttgtcatatgctaattgctatgcttgcttgtttgtttatcattgttaatgaggcttggaaagagtttttaaaacatgaacataaagaaaaacctaaaagatcttctttgttgatgtgaacacgtaaccgataaaccctcgggaaaaccgaatatttaaataaacctgtttccctcgttgttttctaacaatcgagacttcatttgtgtatagtatatacttgaataggaaaataactttgagtgaagtaagaggaaatagaggaagtagaagtgttaatgttagtgagttttttttgtttgaaagtgttgccttttagggatataaactgactatgttaaggctctcaatttataggaatg

SEQ ID NO: 25554 - DNA, 3003 bp, Unknown
  misc_feature (1)..( 3003): 2750-1469P.txt file - cDNA_ID_2706721; gDNA_ID_2214500; Annot_ID_133647
aattagcgtcgctataagtctataacacatgctttaagagtattctttagaatatcctaagggtccaaattgtgtcgttagtacgaatgcgatgttgatggttttgccatgtggctttttcggttaacgaggaggtaatagcttcataaaaggcagaaggtggctggtggcttttgttcgctagtgtttattatgtttaacttctagcatgatgttatttcatattcatctataaaattatgatttaaatcagggccatagaagctcacggctgaagctacggctgttcttcacgcaattcgtcacgccatcgctcttggaattttgacaaattcactttgtttctgatttgtctcaaatcagaaatattgactttgtcgaaacaaatcagtaaactttctttatcgttccaaatttattggatgtcatcgatatttaattaggaccttagatctaactatagggataaaaatagggttatctaaagtcaattacgctccaaaacattataatgactttgctaccaccatcgagtctataccattaaataagagtattggagattttggaaagatgtcatgaataaatcaaggatcgatgaatttaaactatactgtgtggtggtgcgtaattaaatgatattttaactatatataattatatattgtgcaacaacgtaaataaatccttttaagatgatttcttatacattgcgtaatgcatccctatcaattgttcctttccttaagttctttctcctaactcaatggcctagagaatcttagattatagcgcccctagtcccggataactaaattttcattataaaaaaagatcataagtgatctatctatgctttgtccaaagagaaaaaagtgttctatttatgtagtcctcgtccattgataacgattgagcctgagaatttaaatagatcaaagattcaaaatattagtatttaatgaattatggtgtgtaaactgcactgcagtactcaagcggatgctgccgaagatacgagaattaggctatatagtattgaaacaaataaagctcaagtaaaagattctaaaattatttcataaatatttatgcatagtgcatccacatatacccccatctattgtacatttttataaatctttctcctaactcagtggcgtagagaatcttaattagattatagagccagtagtcccggagaattaaatttggttgtaaaaccgatagcataagctctctagttatgtagtccttgtccactgacaatgattgagcctgagaatataagttaaatctatcaaaatataagtacttattgaaattatgatttctaaaaccatacttaagtactcaaccgtacgcatactgccaaagtttagagaattagggaatccaagtgggtaaataaagacgcaaacacagctgagaaactcatttgtcttgtccgaatacagaacaacattattaaagccccacaaatctttagtgattttggaagttacacaaacttcttgatttggttcaatcttatatacgtatgggcaacaataaacgaaaggagtaggggtcacaatgatgaaaaggccaagaaactaaaaaaatgtaatcaacgataaaagccttaaaggaaacttcccggaagctgccttcttgaggatacgtctatgcacttctcacttgcatgtggttagatgttgttatcgacccttcttggttagacaatctattaatatatttttgtctttgttatataagatttctatactatatgggaatcaaagctcctacatgcatgtgttcttacagtcttacttgttatggcatttagcctaacgtggtcacaaaccatatgacgagtgggtcctctaatgtgtacggaataagaaacttatgttatcatttagatcatatcttcttagaaggtatcgtaatcatgcctcataaaaaatcatatcttcttccaaagaatcataatcataaatgaaaatgaccattaaatccacgaatataaccgcttattcatttataattgtttatcactcctgcatcaatctttgaacagatcgatagaagcatccgagatactctcttcactagcaaatatcctaagagtaagagatgtggttgattgcgtcttagtggttgatttgtttagtttctgtctggcttttattttaattcctcttttgccaaagaagtttcttgttaagtaatttgccattagaatttacatataaggggacgacgctgaaaatcaagctgaatgattgtacaaaattcaagatgaaaattgcgttctacttccagcaacctaaagaaaatatgcttaagcttgatgattagtgatgctcatataaaataaaacaaacatataaataatatgtgacctaatcacattatataaaacaaaattatatcacattattaaattccatcatttaaggtagcttgattttgttttatcagaatgaaatatgatttataaacctaatggagcaggtgaaccaccccaatgtgagaaccactcaaacctaaaaaagcatgacaactttaaaggtactaaaactgtattggaagttggaatcaaaattgtttattcactaaacgaattttcccctaggatcttctgatttgactgattcgtttagtatattgtttaatcttcttttttttttggaacaaaagaagaactgttgagtactagagaattaaaaaaaataaaaattgattctttgattatttttatttttttgtttacctgaattgattctttgattattttaagaattctttttaaggaattttggtcctgatgtgttgctttttttcagtagtgcgatctgacgactgtcacaaaggcataaaccctttatgcatggactaatcaattaaattaattaaatagcttctcttatttttcttataatctcgaagttggtcgaagcaaagcaaaagcaaaattctcttggccgagagaagaaacattgatcgtcgatcatg

SEQ ID NO: 25555 - DNA, 3003 bp, Unknown; identical to SEQ ID NO: 25554
  misc_feature (1)..( 3003): 2750-1469P.txt file - cDNA_ID_2706721; gDNA_ID_2214500; Annot_ID_183957

SEQ ID NO: 25556 - DNA, 3000 bp, Unknown; identical to SEQ ID NO: 11531
  misc_feature (1)..( 3000): 2750-1469P.txt file - cDNA_ID_2706737; gDNA_ID_2214501; Annot_ID_133660

SEQ ID NO: 25557 - DNA, 3000 bp, Unknown; identical to SEQ ID NO: 11537
  misc_feature (1)..( 3000): 2750-1469P.txt file - cDNA_ID_2706741; gDNA_ID_2214501; Annot_ID_133669

SEQ ID NO: 25558 - DNA, 3003 bp, Unknown
  misc_feature (1)..( 3003): 2750-1469P.txt file - cDNA_ID_2706745; gDNA_ID_2214501; Annot_ID_133671
tggagccaacacttttactacgacttttgttttgtggtataatcacaaaatcatacagtataataaagacaaccagatactctcaaaatcactaaactcggcattgctgtttagtgattatcaaaactatataaactgttcatagctaatataatgtggattttagtttgcgtgttaaaatattacttaaataatcaaataaatatattttaatcataaattgcaaaattagatgaacgttggttttcatgttaaatagaactatatttcctaataatgtacagaaaaaagccataaatacaaactttcactataaatagaaataaattcgttatcgattcacatgggcggagacaaagaatatatttagacacagaatatattttatacgatatgatttttagtctgttgtcctttaggtttgaagagaggtgggaatgattggatcggcttctcatctccacttcttccacagtgtccaacttgagaaccgaaaaataattggagagataggaatcgtttctcatcaaattcccacttacttatgttaagccacttaagtagtggaacaataattcaaaacttataataatattcttttacccaaaactcttttcatttgaccaaattagtaatcgagttggtaattactagttatgtatacattctgacattcactatccaagttgttttccaataagtagaaagtttaaagtatgcgtagctcgacattaattaattagcttctgttaattatatgattaaggacggttcataaaatagtatttaaactgctttttacaagtagtttgagttttagcaatcatgtgatgattcagataaatttatatattttaaatttatattgaagcaatcgttaaacgaagttgaaaatgcgttaataaagtatctgacatatggtaagtttaatgggtgtaagaacaatatccactatctactaataacattactcaagtgtaacgacatggtgttaacaacattacaacaaattttaagcatgtatataagaatatacatgaactcaattttccttgattaaactagtcatggaatcaagtaaagagatccaatattgaagttttaattatcaacaagacaaggcaatataaattctaatgatggtatcaaatatgaggtgggataatattgagagaacgagagatagaccgagatcaacggtacaaatgattaccaaataaggataattgttttttgacaattatatcgatcaatctttgattttaccaataaataatgttagttttcaaaatattcttagcaaggaatggtaaaattagccattagttcccaaacatttgtttagctcaagtgtcattacaaaattcatttttatttgctgagtattatatcgatgttattagtttcagttctcgttcaattctgtttgttgataaaaccttttatgctcgttcaattctgtttcgaaagagaagtatgaacctatttttaatattggttggaagttggaacagtctatagatcaaaactctaaaattgcttggtacggttaaaaaaaaatattcccaagatttgtaaaaaaaaatagtaacaatgaaacaaaattagggttttactgtacattcttaagtcttaatacggaagctctttacggtgtggagcccagctcagctcgggacccaaaacctttcctaatctgaagcatattccatagaatgtaccttttcaatttctccattagtttattttagtattttcttttcataaaatctcgttacattttcaaaaaacagttatatagacatagacggaaaaaaaaaaactaaattttttttgtcgaacactttgcagcatgtgtattggttcggagctcatgagaggcccgtacaggcatacaatcttttatatgtctcttgagtcctgactcttgtttttcacaatatatattgatggactactaaaaatagtaggagaacattagttgcttaaatggtttgaggagttatgtgaacaactgaacataacatttttgttaatcatacatgaagataagtcttttttgaaaatatatctcaattaatatatagagaatttgagaaagcgttagcgttcctaatttcatatatggagtatagcatagtttataacacgggactgctatagaacatctataataatcccattaaatttttagcgatcgatttacaaattacaaatctatagtaattgttcgatcggttgatggaattactacaacgagaaacaacaatttgattttgttgactagttaaattctaatatacatatatatatatataaaattatataccaatattagctttttgtcggtatttaccaacacaattaactataacaatagatattgtaataaatcacatatcatatagatatatcttattaacacgatatgtaagataattgctctaaaataaaaacttctatagtagtttatttttgtcaccaattgaatatttttccttttggggtggaaaatatttgtggtatctcaataagcttcttgtgtatcccaccccccaccatggcattcctacaatttaataaagccgtattttcactttcactctgagtcatttttattatattgtcattttcgacaaaatcgaatttagattgtgcattatatattctgacgaaaacaaagaaagattgttgcattaatttaatttaaaaaagttgattgaaaacgcaagtctcgttcatctcctccaaatgttctttttctttttttatgttctttctcttctaaaagtccaacagcgacaacataggtttctctctctaccatggcgtgtctatataaagcaaggtcgtcgattcataacgaccatctccattacttctccataacctttcaagaaacaaaaacaagataagatctcttcagattcctacactccaacaaatataagtttcattagattctttcttagctagagaatgaaactgattgagaagacgatg

SEQ ID NO: 25559 - DNA, 3003 bp, Unknown
  misc_feature (1)..( 3003): 2750-1469P.txt file - cDNA_ID_2706753; gDNA_ID_2214501; Annot_ID_133674
aagcttgaatctttcttaagattgtttttaataagattgctctgagaagcttctagcttatggcacgtttattaattgtaaagtcgaaacaatgtgagaccgtcggtgggagatttatgaaatatggaacgtctagaagcaaaaaaacatattttgatctaataaaaagttcttcactttatactaaaagactctttaatatcaaagatttgacagatctggttattaacatatttattaactaaaaacattgggatttgattgttacatttatttattttataccttgcatttaatattctgcattattatggatcgccaatttttttattctgcatggatttaagagagagagggagagaaaacaaaacccatgcatagaaatttcatcgaccgactcttgtcatatgaatctaaaataattatcaagaaaaataaacacatcaaatctgcttaaataaacaagaatttaagttttcccaaatgaaattaaaccatcctttcccaaatgaaagtttgaactcagcaccaacaacaagcaaaattcaatccttctcgtactcaccaaataagctagacatatggggttaataaagtttattcgcagctcatttggttcctttatgatattatactcaagctaagtaatgggttcgattcccatcttctcatttctttatcaaaaaacaagtaataaagttccttaaatattgtcttaaaatactatcgtagtaactagtaaggtggaatatatagtgtaactttggagcttgaggtcgtcggtgatgtgctggtacgaagagacacgtggcgctcaatcatttgaaaataatttagtttttttctttcttttggaatatgggaaccaccaacgacaacattattaattccatagattcggagttaattgagcgggttgcacgaaccacaccacacaccagatgccgaataaaattttatgcataagctaagcgaataatcaatgcatagttaaactttataagactgatatttaacgactggattatcacaactaagaggcgttttatttgttttaaacattttaattaagttattaatggtttgcgactcaagacgataggaaacgaccatctttttctactcatgaatatttgaaagaatattgttcttgcgacaactgatcaagctactatctttgaaaagaacgttcttctgccagtctactgaagaataactcaaaaaatgcacttggggctcactgatttttaacaacatttctttttatatacatcctttgaaagaaaactgaatcgtagcaaaaactagactaggaaactgaaaaaaaaaaaaaaaaaaattaagaggaagactaggaaaactgaaaaagaaagctttattaaaccagcatgcaacacaacttaatcatatgaattactttgtttttttccacattagttgccgtctgattaatttaacacatttgaaactatagtcatctttttgaagaaaaagttcactaataaaaacagagaaaatccatttaaaaaaaaaagacattttaaaagaatatcgagtaggatttttaatgtaaactttatataaattttataatataacatcaaatcgaaactaattttaaaaactaactttattttataaaagatacagtataatgaaagtgtataaacgaattttgttgtggatcaacatgaaaattaattagtttgtcaacagctattcatatagttaaatgatacaagtaatgataaacaaataaacgcatgttccccgttaacaatttttacgtctccatgcttagtggcgctaatcacctttttggttcgctcaagtcaaattattttgaccaagttgtcggtcgagctagctcgaaggtaacaaatagttaggcccactttgaaaatgtcggtgctcggaaaaaagataaaccgctaaattaaaccggtcatcatgaaactccggaaacctgaattactgccaaatttatggttgtaggcactgcacacgtgtaggtgtctcttagtccccattgtcatacccctcagtttttattggtggtgggcaaacttatattaagatgacccaggtccatctttcaaacccatttagatccatcctatatttttgaatgtttggtgtttttgctttagatatcaatagaggtgaataaattagtattcatactctgcagatttgagtttaacatttgtgatagtttttgtaaactttataatttgtaacagtgaacccagccaaaaccaaagttttgatttgagaaattagccttactattcacgattctctcgcctaacacagcagccttaacgacagaaacagaaacgaatctctgcctagcaatgacattctacggttccgaaaatttattagtattaattggaccgtttcatggaaacttgaaataattaagagaaactaattaagagacaaaatcgtccactttaactgttacactatcaacaactgacactctccttctacttttcaaaattacacaagatcgctaaatacattgaaattatcaccaccttttgaaacaaaaattgaaatcattaggaaaagtatcataaaacaccctctcacacagtacaaatgtaaaatttcaacaattgtaaatagtatgtaaaatgactttactacatgcacttttaattaattcggtctagatttagcacagtaaaagcaataactagctgcataaattacggccattaccactatatggaaaaagcaaaagtctccacattttctcatgtggaaatattttagattaaaaacaaaagttaaccataaaaacaaagtcacgtcatctctctcctccaccactccacagagctttcaaatatatccctctcctgcgagagcagagaaatagagagagactagtgagtgagagagtccatcgctttctttctttctctctctcgctctctcttcatctccaacagagacttctttctagagaaagagatcttcacaaatatg

SEQ ID NO: 25560 - DNA, 3003 bp, Unknown
  misc_feature (1)..( 3003): 2750-1469P.txt file - cDNA_ID_2706753; gDNA_ID_2214501; Annot_ID_184000
ttaataaagtttattcgcagctcatttggttcctttatgatattatactcaagctaagtaatgggttcgattcccatcttctcatttctttatcaaaaaacaagtaataaagttccttaaatattgtcttaaaatactatcgtagtaactagtaaggtggaatatatagtgtaactttggagcttgaggtcgtcggtgatgtgctggtacgaagagacacgtggcgctcaatcatttgaaaataatttagtttttttctttcttttggaatatgggaaccaccaacgacaacattattaattccatagattcggagttaattgagcgggttgcacgaaccacaccacacaccagatgccgaataaaattttatgcataagctaagcgaataatcaatgcatagttaaactttataagactgatatttaacgactggattatcacaactaagaggcgttttatttgttttaaacattttaattaagttattaatggtttgcgactcaagacgataggaaacgaccatctttttctactcatgaatatttgaaagaatattgttcttgcgacaactgatcaagctactatctttgaaaagaacgttcttctgccagtctactgaagaataactcaaaaaatgcacttggggctcactgatttttaacaacatttctttttatatacatcctttgaaagaaaactgaatcgtagcaaaaactagactaggaaactgaaaaaaaaaaaaaaaaaaattaagaggaagactaggaaaactgaaaaagaaagctttattaaaccagcatgcaacacaacttaatcatatgaattactttgtttttttccacattagttgccgtctgattaatttaacacatttgaaactatagtcatctttttgaagaaaaagttcactaataaaaacagagaaaatccatttaaaaaaaaaagacattttaaaagaatatcgagtaggatttttaatgtaaactttatataaattttataatataacatcaaatcgaaactaattttaaaaactaactttattttataaaagatacagtataatgaaagtgtataaacgaattttgttgtggatcaacatgaaaattaattagtttgtcaacagctattcatatagttaaatgatacaagtaatgataaacaaataaacgcatgttccccgttaacaatttttacgtctccatgcttagtggcgctaatcacctttttggttcgctcaagtcaaattattttgaccaagttgtcggtcgagctagctcgaaggtaacaaatagttaggcccactttgaaaatgtcggtgctcggaaaaaagataaaccgctaaattaaaccggtcatcatgaaactccggaaacctgaattactgccaaatttatggttgtaggcactgcacacgtgtaggtgtctcttagtccccattgtcatacccctcagtttttattggtggtgggcaaacttatattaagatgacccaggtccatctttcaaacccatttagatccatcctatatttttgaatgtttggtgtttttgctttagatatcaatagaggtgaataaattagtattcatactctgcagatttgagtttaacatttgtgatagtttttgtaaactttataatttgtaacagtgaacccagccaaaaccaaagttttgatttgagaaattagccttactattcacgattctctcgcctaacacagcagccttaacgacagaaacagaaacgaatctctgcctagcaatgacattctacggttccgaaaatttattagtattaattggaccgtttcatggaaacttgaaataattaagagaaactaattaagagacaaaatcgtccactttaactgttacactatcaacaactgacactctccttctacttttcaaaattacacaagatcgctaaatacattgaaattatcaccaccttttgaaacaaaaattgaaatcattaggaaaagtatcataaaacaccctctcacacagtacaaatgtaaaatttcaacaattgtaaatagtatgtaaaatgactttactacatgcacttttaattaattcggtctagatttagcacagtaaaagcaataactagctgcataaattacggccattaccactatatggaaaaagcaaaagtctccacattttctcatgtggaaatattttagattaaaaacaaaagttaaccataaaaacaaagtcacgtcatctctctcctccaccactccacagagctttcaaatatatccctctcctgcgagagcagagaaatagagagagactagtgagtgagagagtccatcgctttctttctttctctctctcgctctctcttcatctccaacagagacttctttctagagaaagagatcttcacaaatatgactgtgatgaatcaccgacacaagcaatgtcattttctcctcctccttctgatcactgtcttctctgccgcgttggatggtgtttcttccgagacagacgtcggagggtttgactacggtgaagcattgtctaaaagcttactctactttgaagctcagagatcaggaagacttccgtacaaccagcgcgtgacttggcgtgatcactctggtctcaccgatggtcttgaacaaggggtttgttttctgttcaaaactcttgtcattttattttttaattaattttatttttgaattcaaactaattcagtttactatcattagtttgaattttaataagagaattgaaatttattgtttgtattaatttataaataatacataaatttattgtagatttccatttaaagaaattattttctttggtttggaatgagacttgaaaaccttttgtgaattaagtattgaaattaattatttgttttattttgtgatgtgactttaattttaaaattttggtaataaaggttgatttagtgggaggatatcacgacgccggagaccatgttaaatttggacttccgatg

SEQ ID NO: 25561 - DNA, 3000 bp, Unknown; identical to SEQ ID NO: 11536
  misc_feature (1)..( 3000): 2750-1469P.txt file - cDNA_ID_2706773; gDNA_ID_2214501; Annot_ID_133667

SEQ ID NO: 25562 - DNA, 3000 bp, Unknown
  misc_feature (1)..( 3000): 2750-1469P.txt file - cDNA_ID_2706779; gDNA_ID_2214502; Annot_ID_133685
aactttgatgataactttaagagttgtctcaaaacaactccctttctcatctttatgaaagtagtaattgaatcatcgtgttctttgtgataacaaagtaatctttcctcttttagtttctttgagtaataaagctcttaatgagctatctaatttcagttttatatttctcttaataagctcatttgagcataaatatcattgctttagaaatgataacaaaaacattagtcggagacatattaaaaacgagatctaacactataactagagatgacaaccgaaaaaatgatacattgacaatttcccccaaatttccgcatgagaacattgagaagaaatcaagtgttgaaaagtacattcgggacaaaaacaaaatctccagtcttaatcattgagtttgggtctttcctctcatcagcggaattcctgccaattattctaatcattccacaaatttcttataaagtagaggaaagaagataaatcattgagcttgggtctacaaaactgattaattgataataattatctgacctttttcatactgatcaatatgataatttaataatgttgtgattgctgaagacaaaactatatatgacaacaaattaattatatgtcttataacggaaatatcaaagttttgtattcttatttatcgtttaaagattccacagtaaccatgattaaaaatgtaccagaatgattcaaatatagtcattcgatcgaccactagatcccaatgaattggtcgacaaataatctttaataacagatcaaacgtttagttgtttcgttagagatattaagctattaaataaagagatacgagtttaaattccatgctaaatgtaattttgagtcacgtacatacactttcaaagtcatggtcaacatcaaactcaaagtcacattccatagtgattccttctaattgagtattgccagtttcaaaatgaaacatgtgtaatactatgtgaatcgaatcctatagataaatggaagaaaaataaattgtaaagcgaaattaaatgtttaccgtatataaacatttacgtgtatagtaaggcacgtatttatcattctcgaaaaggaaaagaatagaagtcaatgggtgcaagtaatgagggtatttatgtcatttaggaaatggattaccccagctcacacggcaagtaagtcgataacgaacaaggctcgtgaccggaccatgactagagtcgatatccaaatccaacgaactgacatataaacgggttttgcgtgaaacaacgaataacacgttcacactaaacttatattttatttttaattgatgtatatggttttcactttttagcttatttaaaattcgctttcatagttttgtttttatgcatttacattgagtttttagagtatttttaccgtcttttgttcttcgtttcaaattagaatcttgtcagtaattgtgaaattagaatcttttcagtaattgaatgtgtgtgcagttgaaaacaaggttatcgatctctagtttgatttaacacaaaacatgagataatgctcaaaagattttgatccatcaatttgatatcctcttattgatcattctattctacaaaaaaagtagttttacttttgttaggacaagaagcacaaaagaccaaatttggttagataacacaaatgatggtttgagcggttcaacaacacaaatttggtacgtaactactctgtttgcttataacaacaatactcttaaatgtaaccaccaatatgctaaagatattgttccacttttcaacaaagtaataataatattgttcgaccaatatactagcactgcaaatgatcaggtgaaaataaataatttttcatctttttcattttaaatggtaaaaattagttgaataattttttgtctaaccaatgtaatggttcgagtacatatatatatgatatatgtaataaagaaacatagaacaatatgtttgtaattaaacttgtacatgtacatatatatatatatatacataatacataatcaaatttcatctcacgaaaaaggtggataatcacaatctcaaatattatgttaataagaattttcggaagatcaacatcaatgatccaattttctcaatcagacattattttcctaaatttgcatcaattttgttctagttgactaattgacccaacaaaaaaaaacaatattattcgattcaatagaagtgtatattctaataacattgttttctttttataataatgaaaacaaaacgactttgatcaaattgttatgctgtccactcacacacgcatcatcaataaataaagaaaaaaaaaactcaaacccggtcaaagatatcccaattgctcgttgaccatgataaggacatatccgtcattttaatcttcccacgcttttcctcaagggcttattcgtctttaaacaaaaaaatagacatccactgggcacgtatcttcttcttcttcctcgtctttaatcaaaaccaatttattactctgattgttatttcgcaattcggtataattcaaacgggagatttcgttttccgatcatcaccgatcaacttcttcgccggagaacaaataagtttcaaagcttcttttgacgattaaagtagaataaacagaaattgaatccatgaagaagataaagagaaacctcagagaagaagaagaaggtaattgataaatctaaaacactaattagactctataatatcggccattaatggaggaatcagtttctctctctctctctctgtttctctatgtgtatttattttggtgtgtaccgttgggaagcttgagagcttttaatagctcaaccaatttccaagtggtctctctctctcgaggtcttagggttttagctgttgacttgtcgcagcttcactggagaattgaatgaattttcttatggtttcaggaaggtgatgaatgttgagatcgatttttgatttcaatcaacgttcaacgaagatg

SEQ ID NO: 25563 - DNA, 3000 bp, Unknown; identical to SEQ ID NO: 25562
  misc_feature (1)..( 3000): 2750-1469P.txt file - cDNA_ID_2706779; gDNA_ID_2214502; Annot_ID_184017

SEQ ID NO: 25564 - DNA, 3000 bp, Unknown
  misc_feature (1)..( 3000): 2750-1469P.txt file - cDNA_ID_2706783; gDNA_ID_2214502; Annot_ID_133699
ctccacaccattttattcaacacacaataaattaaaaattaactcccacaatttatttacaaaactgaaatcataaatatatataaattaattatatttctccacaccatttttttcaacacacaataaattaaaaattaactcccacaatttattttcattctctcatttcctaatcccctttcacagtatctcaaatattgttttgttttgttttaagttttttctttgttgttgttatgagtttaaaaaatattattgtaaaagctaaattctaaattttaattttagattatgaaccttacactgttatttttttttgtttaaataaatttttaaaacaatttaagaaaatataaacttggagaagataaatcttaaatcatttcaatatgtcactcctataaaagaatctattttttttttgcttcaatataattttctaatgtgtattatagacatagatttttgtaatttgtatgagtgaactaatgttgatcatgttttcttcagaaactaagaattgagcttcattatattaaaaatcagaaaacaatttaagttttgttttagagagcatataagtcaacaaaatttggtaactatttatagcaaaaattaattcaaaatatttaatttggaaagacaaataaatagttatataattattgtggtcatacctgttattatcgctccatcattttttgagactaactaaaacacttgcctgaatttttgtattttatgaatgatcaaaactttgattctttctttctcttgtaattgactctactatccatagtatgctaactttttctttcatatccatttaaatggtttaaagtgcatttgatgcctacaaaaaaaaaactaacaaaaatatataagtaagactcaatataactaatttagaaactttaaacaatgtaaaatcatttacaaaaacttacaaagaaaaacaaaatctgaaagctattatgaatccaaactttaaatgaaggagacaaattgataaggttgagactcttgcctgttttgcttcctctttcatattcatttatggtttaaagtgcatttgatgtctacttccaaaaaaaaaaaaaaaaaaaaatttctcgatttacatttagaacaaaacaaaaacatgtaagtaagactcaatataaccattttagaaacattaaacaatatgaaatcattcacaaaaactaaaagaaaaagataaaaaaaaactgaaaggtaatatgagtccaaacgttaaatgaaagagacaaattgataaggttaggactcttgccgtaaacgttggtgataccgtaaatgttggtgatacagcaaaccatctttcatttttctttcagtaattgaataacttcaattgtcaaaggaaacaaaagcacttgtaaatatgtgtgtgttgtgtctgtgtaaatatttgctatttatattagaaaagtagattgttagggtataactaataaaggttaataattatagaagaacgtttataacatgaacgttacatgagtaacaaactaataatttctttttttttaaaacattacatgagacactgagtattcaatctcattgagccactaatgaccttaatgaggtttaactgcatggtgtttaatcctaattttctttctctcgttgtttttaaccgttatcaaaactatggtcatttgagtcttttttaatcaggtgagctttacatctactcatttattttttattaaatcatatttttaaaagcatatgtagtatttaaatattgataagtgatacatcataaaatatatactataattactattcttttatcattgttttgaataaatcacttacaaaataaaatgttttggaactattatgtatgagtttatatcaacaaattattttttaatttactttatcatacatttattttgtaaaaataagatatgatatgtttattaatatatacatgcataaataacatataaaaagaaaaactgttaaaatatgagcaaatgtaagatatcaaattttaacagcttttaaaaaaaattaatcatataagatcgaaacaaaattattttaattaattattgtttaaaagaactaaaaatggaaaaaaatcttataaaattggagaattatttgtagttgtgaactattaatgtgcagtctaaaacataatatcatgtcaaaatttaaaagatttgattttgtaattagttaagagagttgcaattatgatagaaaaaaaatcatttcaaaattgtagtttaatatgtagtatttttatagtttaatgactattttctaaataaatgttatatttattaataaattattttagtcaaactacaattaatgataagtacacatgtcatcaaaatagagtgccaaatgtcgtattggtaggcaaagttagaaaaaaccttctcttattatataagaagatatatgtagttgatgaagagtagaaaaaagtaagagaaaggaatatgatagattgataagagtaaaaaatacaaaagtgtttaggaagaattataatagactctcgtaagattaatgtcacataatacatcgatatatataaagaaaaagactaaacctaatttactcaatgtaaacatttatgtgttatgtgtggatgatgaagagtaggaaaaaaataagaaaagggaatatgataaattgataatagtatgaaacacaaagtgtttgaaaaatattataatagactctcgtataattaatatcacataatacaccgatatatataagaaaaagactgaacctaatttcctcaataaagataaacttaaatgtaaataatactattttacgtgttactaccgtaaatctagtcattgtgctctgtcttttttgttataaaggaatgagagaagaaacggagagagattgtagagtcggacaatgaccacgtggcttaattgtttggatacgtgtttgataatctaaatcagaagagtaagaaaaatg

SEQ ID NO: 25565 - DNA, 3000 bp, Unknown; identical to SEQ ID NO: 25564
  misc_feature (1)..( 3000): 2750-1469P.txt file - cDNA_ID_2706783; gDNA_ID_2214502; Annot_ID_184034

SEQ ID NO: 25566 - DNA, 3003 bp, Unknown
  misc_feature (1)..( 3003): 2750-1469P.txt file - cDNA_ID_2706807; gDNA_ID_2214502; Annot_ID_133686
gttttcaactgcacacacattcaattactgaaaagattctaatttcacaattactgacaagattctaatttgaaacgaagaacaaaagacggtaaaaatactctaaaaactcaatgtaaatgcataaaaacaaaactatgaaagcgaattttaaataagctaaaaagtgaaaaccatatacatcaattaaaaataaaatataagtttagtgtgaacgtgttattcgttgtttcacgcaaaacccgtttatatgtcagttcgttggatttggatatcgactctagtcatggtccggtcacgagccttgttcgttatcgacttacttgccgtgtgagctggggtaatccatttcctaaatgacataaataccctcattacttgcacccattgacttctattcttttccttttcgagaatgataaatacgtgccttactatacacgtaaatgtttatatacggtaaacatttaatttcgctttacaatttatttttcttccatttatctataggattcgattcacatagtattacacatgtttcattttgaaactggcaatactcaattagaaggaatcactatggaatgtgactttgagtttgatgttgaccatgactttgaaagtgtatgtacgtgactcaaaattacatttagcatggaatttaaactcgtatctctttatttaatagcttaatatctctaacgaaacaactaaacgtttgatctgttattaaagattatttgtcgaccaattcattgggatctagtggtcgatcgaatgactatatttgaatcattctggtacatttttaatcatggttactgtggaatctttaaacgataaataagaatacaaaactttgatatttccgttataagacatataattaatttgttgtcatatatagttttgtcttcagcaatcacaacattattaaattatcatattgatcagtatgaaaaaggtcagataattattatcaattaatcagttttgtagacccaagctcaatgatttatcttctttcctctactttataagaaatttgtggaatgattagaataattggcaggaattccgctgatgagaggaaagacccaaactcaatgattaagactggagattttgtttttgtcccgaatgtacttttcaacacttgatttcttctcaatgttctcatgcggaaatttgggggaaattgtcaatgtatcattttttcggttgtcatctctagttatagtgttagatctcgtttttaatatgtctccgactaatgtttttgttatcatttctaaagcaatgatatttatgctcaaatgagcttattaagagaaatataaaactgaaattagatagctcattaagagctttattactcaaagaaactaaaagaggaaagattactttgttatcacaaagaacacgatgattcaattactactttcataaagatgagaaagggagttgttttgagacaactcttaaagttatcatcaaagttctcatcacataactatatatatgagtgatgagtcactatcttgttaatcctatttatatggaccactacatgagcttttaagttactcatgagacattatattgggctttatatggatcctctaatagttttgctagattaatgtgaatacgtctttaggaatgactagatcatgagcacgagataatcgtcaccgcttgcactaatatagtataagagggcaatggtgactaattttcaaaaatttagctccaaggtgattttggagttttacgctcatttacatttcagaaaaaaatcaaacaatcatgattgggtcgtgtctaaacaattttgcatacacatcaaaacaaacatttgcaaaagtttgaagaatgatactaagctaaaaagtgaaaatttccaaaacaaaaattagggactaagaaatgcgagattttaagctcacaaagagtacttaattgattgtgtttctttttttgtttatcttcccgtagatttcatgtcaatttccgaatgaacctagaaaatcaccaccatatttcctcttatcaaacaaattttccatccaatcatattgtctcattctaacttgagcgtaaaaaggtatttgaaaacaatttattttagttttctcggacactttcatgagttgaagacaaaatcagagaagtctccgaaaagacaaaaatggatcgtcagtttgtcaccaaacacctacatgaaccttacttgattcgctccaagtgttcaatcacttatcatatgatcaccaacaatccaaaaataatcgaagtttccataccataaacaaattccataatccaaaaattcgaccccttgacacacactgacacacactgacacacacacacagaaaatattcccgtagctatgcctatatgggcaacttcctgggctaatggtcccatgaaaaactgatgagctcatagtcaaatattatgcacaaatgggcttatataaatgtcaacttcaaagcttaccagaaacccaacaaatacacaagccctgaagtaaaaaacaaaaacaatatttatatcaccgtaaatttcggaccaaatcagagaattcagagtgtttttactgttcatggatcccacgtgatcagacagctcaaattccgatctcgtaacgacgtcgaataagacaatttcggttttgtccctaatcccatcttaaactgggtcccacgtttttctcttcctcccaaaaagcaaacttaaaaccaaaaaaatattatcggacaagattccagctactagtggttctttctttcttcttcatctttttctcaatcactttcttcttctccattctccttttcttttggttctctctcccacttgtgaagaagctcctcaagaagaaccctaaaaaaatgattcttctttgattttgtgtatttttacctgttcttgttggtgtttgtttgcttagttctgaagcaaaagctagggtttttcttcttcttcttgaaaatg

SEQ ID NO: 25567 - DNA, 606 bp, Unknown; identical to SEQ ID NO: 11567
  misc_feature (1)..( 606): 2750-1469P.txt file - cDNA_ID_2706818; gDNA_ID_2214502; Annot_ID_133701

SEQ ID NO: 25568 - DNA, 3003 bp, Unknown
  misc_feature (1)..( 3003): 2750-1469P.txt file - cDNA_ID_2706826; gDNA_ID_2214502; Annot_ID_133694
ttcttcagggagatcaccattctgatcttcgttcgtgttttcaccttcttctttctgtaaggaatcatcattctcaagcattggtacgtcttcatcaccagcaatcttttcttgaaaggaaagtgatctctttgcagacgcttgacttggtgttgtgtcatcagttggcgcccgtttggtttgaatcagataatgtgccacagacttatacccaagtgcagctatctggaaacaatccaaagaaagaaagaaatcttcagctctagattctattcaagaatcaaaaacaccacaagataatacaaaagaacaactgaaaaaaacgcacccttctgtaaatcgggccagttggaacccatcctttattattccggcacaaactgcaattgcagatcccgcgacaagcgggacaaatccagtctggattctcaagagcttcaagcacatgttcaccatatctgttcatcaaaaatattaatatacattcatcatcaataacagaaaaactaatagcaaccaacctcatgaacaaacaatcaccacagaactgtccttgaaccaaattgcattcactgcactgtgtacgatgccccatcgtcttctgcctgtaagaaacacacaaacacacactaaagcattacagaaaaatcatttcagagagttgcaatatcaagttctcaacacatatgagtttggttattacctgcattggtgacaagtcttaccgttaaacggatcataaatccgtttcccattcttatcatagccatcaacaaaacaagtccagcttctttctgtattcccaagaagcttctcatgttcctctgtgtaaatctcagctcttatcccttcaccaatcacaacactctctcgtttagatgctttcttgcccttctcattgatcccatcagtgtagataactggagttgtgttctccaatctaacaatcacagaagaaaagaatcaataataaacccaaattcttactttaaaatccaaattcttaaaccctagttttgcctcaaaaacccaattcctccagaaaaatctctcctttaaactgatacaaatcgaatcataatccctaattccacaaactcatctttcaaatccaaaaccccaaaatatgatggaatgagagaaacggagacagagaaaggaagagattaccgagaagatcggcgagaaggctgaagaggaggagtcggattctgaacagaattacggttaccgtaagatcttttaacgggtcgggtcttgggtttgagtttgcgagagagatttaagagacccagattgttcatcctctgaagattctctttgatcctctcttccctgcattgttcgtaaagagagacctttggggtttctttgattagttccggattagggtttgatttaggtactgaatcttgtgcttcagttctcatggtgagcatgatgatgatgaagatgatactgggtttcagatttcagaactctctgtcactctctttatggctgctctctggagaaatgatagtaaaagtttaggtttttatattgttttgagttgatgtcctgatgttacagcaacggtcggatttattatttgaaaagtgtgcttatggaaatggggaatagtgtttggaaatgtttactagcttctgtatcataaatccctaatgatgggacttaatctttttaaatatttttgtttccttctaattgcaatacagctaagtagagatagtgggaatatggaaagttgtaatcttttaagagaaaattaataaaccattctacaaaaattgttcttggtgcactttattaagattacgaatattaacatttaaacaaatttccaatagaaatataaagtttgacttttgagtaaagtttagggactgtccataagattgagagtctcaccttgtcaaccaaattaacaccaaatcccttcacatttaggaggatgtattcaatatagcatttggaatgatttgtattaagatgaaaaatatattttattcaaacatgaattctaaaaagctttctaaaatcaagtgttattggattaataattttaaaatctagaatcaaatctgctgttattagaaatattttaaatagtggatttgaattgacttgagagattttgggtgaaatttcaatgaatttttaaaaattcaaacattccctgtctcatagtttgaggtagattttaaacagttttaataacaaattttcgaattcactaaaataatttcaaaactcaataaaactcaaatcactccaaattctttctacaatacactcccttaatttttatttttttttcttttttcctatttttttacacccctttattaattactgtgctttactaaacttaccacacatacaaaaatatgaaatttaagttactaatatagaagaatactgttggggactagaatcacatgatcgttgttgtcataaaatctatcgctagttaaagtattaaaagatcgagaaaaaaaattattagttccccaaactcataattgtatgttaacattttctacccattttcttagatttgaataaggaaaaataatattttggttgtaaattgtaataactaaattttttccggatttgattatttgttttattttcttgacagtggtaactctgctcaagtgcttgccttcatctataaaattggagagacttttcattaattactgttccaacaaatttgaactacttttaattatgagtctaattaatacagagagagttcaagcgtccaacgaattaaaggtctcgttgttattttctcactagctaaaggaaaaacttggccacgttgatgaaccaccacttgaaaaatcttgaagcctccatttacatcaaaacagtcaaaccaaattcgcaatctcacaagtttcccttccatcccaaacaacactttattatctcttgttatatataaatctcaaacaataacactaacatttctcaaaatcaagaaatatg

SEQ ID NO: 25569 - DNA, 3000 bp, Unknown; identical to SEQ ID NO: 11556
  misc_feature (1)..( 3000): 2750-1469P.txt file - cDNA_ID_2706834; gDNA_ID_2214502; Annot_ID_133692

SEQ ID NO: 25570 - DNA, 3000 bp, Unknown; identical to SEQ ID NO: 11562
  misc_feature (1)..( 3000): 2750-1469P.txt file - cDNA_ID_2706842; gDNA_ID_2214502; Annot_ID_133687

SEQ ID NO: 25571 - DNA, 3000 bp, Unknown; identical to SEQ ID NO: 11554
  misc_feature (1)..( 3000): 2750-1469P.txt file - cDNA_ID_2706847; gDNA_ID_2214502; Annot_ID_133679

SEQ ID NO: 25572 - DNA, 3003 bp, Unknown
  misc_feature (1)..( 3003): 2750-1469P.txt file - cDNA_ID_2706866; gDNA_ID_2214503; Annot_ID_133707
actttttattttaatccctttatttgtttacgggagaaatacagtgatttgctcaaaaaaaagcaaagtagaagaaactccgtttttgagattctccataggacagtagtttacgcataaaaaagcatgccagtgttgtttattgactaaccaagttggtagtagtatccaatggtatgaagattcatatgatttgtcctccaattatttcgcaagactgataatgcagtgtgctaagttgtttcaccctttcatgctcacaatattaaccaccttctcgttatgtaatgattccagtttaatttttttgcaacactattggtaaactgttatagcttatgattttcttgtttatcattactcagaaacgactgtcttttagatgagcagatttttgaaggcgaagactgaggtctaagtaacagatacaaacttataactatgtgcaacggtattagagagacccggaaggagaaacaaccaaagagtaggaaagactctccgtagaagatgaaggtataagttctatttttcagacttcctagtggggttattatggtctaacatctgcttcctattttctaatctcttctgtagtttatataagatatctgattgctgcgtctaaaatgttctaactgctggcattatgtagctgtaagttcatcagatgtttgcaaaaccataaggggcattgttttcataaaatttggattttgaactaaagaaggtatccgtgaaaaagtacttgtttccaattgttataggtatccagcatccacagttagaacgtgttaggctataacatcctcattcatgtcgctaataaacattggtttttcagtattggttcttcataaaatctattgtcggtaatcatatcctgaattccattgtcaggtcagcaaatggtgcaacaacatctgacattgatgagtaagaaggtgggctctaagatatttaaataaggtctctctcaacaacctcactattataaggcactctgaaaattctggggctatagcaatcaacgaggacaagactgagattaatcaacttcgagattctgcaaacgagactgcttcactcagcaggcaagtgtctctttttcttccttcaaccgcagatatttttcttgtttaactcttagatgcaagcgaaaaacagaagttgaaattcgtgatagcgctgctctcatatttttcctgaccattgccattagtctcgcacatgcttttcgcaacttctaagatgtcacatctttgtcattgtctgagttttgatgagcttaaagcaacttctagaagacaaagagacaagaagaggacgagtttgaagcactaatggagaagctttgtttacacctgaggcactagccattgagttttaggcaagtcttcttgttttactcccaagaggactcaatagcagaggcttttgagcttctaggagaaatgttgttatgttgcagaatcatatgtatagttttgtattgtttgatcctcttggaataaacaagtctaagtcttgacacatgtagctttgaactttctgcaacagtgtaacacctatgtatgtaatatataataaaaatgccaaatattttgtggttcttcattgtgatttggttaacaaatattgaatctgtgaatcttctctactgatacagttcagattcagggatcagaatgcaagaaactaaaaaaagagacccattttacacaagaacaaaaaatctgagcggtttaattataaattagattttgaagttatatatataaatttttccacaggaaaatcaaagaaagttgttttgccagtgagttagagagagagagagcgatagagcgagagagagagagagcttgcgtcagtggaggagtcggaaacttgagaaacttgtttagaagaaacgccataacttggagaagcccaaacgaggattttgctcttgtgtatcttcgtagtccatctggtaaatgcgagattgttcttcttgttacgaaattgtttgtttgtgtatcgctgttcattgtattgtttgttgttttgtactggatttggctgtgctttgtgaggtatatgaaggtttctgcaattactggaattggattttggtgtttagtctccgatggtttgattgtgttctagggttttcataagaacggaagtctgttttgttgtgaatttctcagaaaggtaaaatttgttcagagattgttgagattaagacttgaattttagcataggaagagaaatttatgtctagcttgaatctaggttgaagggtgcatggtgctttaaacgactgaaagattaagatttctcagagattgagacttgaattttagaataggaagagaaatttgcttacttcacaaacgttttgtgcaacctggatttaagatgatatagatatgtagcttgaatctaggttgaagggcgcatgggtttccagattcgagtcactttagatccgaatttttgtagttttctaaacttgggtgctgaatttggatctgaatagcatccaagaacatcctggattactaacttactgaggattaaaggtttttctgaatggaaagtttgcattttatcactagttaggaatccgatttgtttttctcagtgagacttggagatgatgagaacagtatgtgtccgcttaatgcagtaccacaaaattattcaatcacgaatcaggagagcaaccttttgagcgcctgataagttactggagttagtttaaaacaatgggtgaaattgatccaaattagtgatcagaagataacttactgtttcttcgttatggtactcatggacttggttttcttgcattttgactctgttccatgttttgctttcgacatttaggtgatcagaaggatatgagcattaccattccagagggactacatgaagaagtcgaccaacagattcattggtacttagagaagtaatgtgctttcagatacttttttggtttctcaggaaaacatg

SEQ ID NO: 25573 - DNA, 3000 bp, Unknown; identical to SEQ ID NO: 11569
  misc_feature (1)..( 3000): 2750-1469P.txt file - cDNA_ID_2706885; gDNA_ID_2214503; Annot_ID_133720

SEQ ID NO: 25574 - DNA, 3003 bp, Unknown
  misc_feature (1)..( 3003): 2750-1469P.txt file - cDNA_ID_2706889; gDNA_ID_2214503; Annot_ID_133719
cattgacattctgattcctaatatttcctttaagcttctcctcaattcttagttcaaggtagaaacgagtttgctcatcattccacgcaagattcttagttgatcatgtgtttttgtacaaaatcagtctaaattacagaaaatattacagtaaatctaagtttagaggagaatatactcacatcggtaccattgatagttgtcatctgtagcacacaatgaaaacaaacgttttgtagttgtgtttgaacaagatcaaagataccaaacaaataaaacaaagatcagagataacaaagcaaacaatacacaacttatgataacaaagcaaagcaaataaaacgtgtacaaagatcagagataacaaagcaaagcaaagaaaaactatttgatattgaacaatcatgagatattattcttgactatttctacagtatttgaactcaaaccttagacgaactcatgctactactacagaaagccaaatgcaaccactaattaatactatttaatatcgaaagcaatatatttacagaggacgtactcgagaaaccaaagctttcttacttggagacaaaacttgctgaaacaaggactgaagagaaaaaatcttttataagatgaaattctcccttataaataagcagttataagctataaacacaaaaacaattccactttggatgcaattgaacacgtcaaggaggcagctgaggtttgtaactatggatggtcaatctaaagagggctaaagtgcagatgctaaagtggcagcaccaaatggttatgttgctcctaatgtagagacaacaaagcctcttaagagcaaatcgaagactcaaaagcaacacaaagcaagcaaagcaacacaaagcaatataaggaacacaagccgtaaactaaagctaatcgaagaatcaaaagcaacacaaagcaaagtaaagcaaacccacaattaaacaatgtaaccatggtggatcaaacccaagaacaagtgattgcaacaaggatacaaagagaaacaacgtgagagacatggagcgagagagaggaagcgagagagagagagagagagagagagagagagagagagagagagagagagagagagagagagagagagagagagagagagagagagagagagagagagagagagagagagagagagagagagagagagagagagagagagagagagagagagagagagagagagagagagagaaacacaaacctgctacactggcgaagaatcggcgacggcgatttgtgaagaatcggcgacggcgagatcaccggcgaagaatcagcatcattgacggctatgaatctcaattttgagtgttttgtgtcgaggagagggtgaagaagagatgtgattttgggtgtaattccatatattagattagggtattatttttgttataattttggctgaatcagcttcagcagaatgaacaaatcaaactcagtcagattttttttattttttggatgaatttagaaaaaagcattcaactgaatcattcgaatgatctattaaaacatgaaaaacaaacaacaattttcatcttcattgagatggttcatccaaatggacaaacaaacaggaccatagtactcaacttgaaaccattgaagctggttggcaggttttagtctttcttgcaatatttgcatgtttatatataaatatattctaattttcttatattttattcattgttttgttattgattaggtgtgcactgtactttataatgatactaaccctcgatactttgtctactggactgtgagttaacttccaaagtattgttaaattttctttgttttttttgttgacaaaaaatctcctaactattttttgttatgtgtgttgtttgattacgtgaaaacagaatgattcatatacacaacatggttgctataacaatctttgctccggctttgttgttgtcaaccaagcatttgctctaggcgcggccgttcctgaagtttctatccgtgatggtctacaatacgaaattttcacaagtatatggaaggtaaaaataagggctctttttcatcatataatttcaagaaatactcttttatatatagaaactgaaactaaatatgttctattgttataggatcgtagttcaggaaattggtggttgaaatttggtactcatttaattgttggatattggccttcttcattgttcaatcgcttaggagatgctgcgagccaagttcattggggaggcgaaatagtaaacgtaaaggagaacaaccaacacacgtcaacacaaatgggaagtgggtcgtttgcaataaatggatttagaaaggctagttattttaggaatattttagtacttgatgaaaacaatactacgaagcaacctgtaggtgcttctacatctgagacggaaggaagttgttatgacatcaggtatcgcactgatcaagcatggggaagtttcttttactatggtggtcctggtcgaagtcctttttgtgcttgattagatatgcatcttatatatgtaaaatattgtgtatcaatctatctatgtcagttatcaccagcatatagtattatatgtggtggtgaaaataaagtttaagatatcattatagttttgagactataactagtgtaagctagtgtaaaaaaaaaaaaaaaaaaagaaaaaaaaaaaaaaaaaaaaaaaactagtgtaagccaaattcatcaatagggttaaaaagatagtttaatggattgagtattgagttctcgaggaagttatattcttgtctaaagtgttatcacatttaacaaagtgaaacggcaacgttttggttgccacaagataaacaaaccatgtcgttttcgaattgtgaaaacagcacgtagttagaaaattcatcaatctgaaaaggaaaagggtttcaaactctctctaggcggtctccgaattagcaaattgaaattggcaaattgcaagagttttcgattcaacaatg

SEQ ID NO: 25575 - DNA, 3003 bp, Unknown
  misc_feature (1)..( 3003): 2750-1469P.txt file - cDNA_ID_2706901; gDNA_ID_2214503; Annot_ID_133714
tccggcagctgtggcggcgacgaagaagcatctttctcaacgaacacgacaagaaactcgtcctccatccacgccgtgacctgatccgtcaaggcgttgttaggaagcttaaatctgctcatgaacttgttgtcgccagtacagatctgaagatatccttcttcatctacgaacgcaatcacttcgtcttgatccactcccggaagatacgctttgaaaacgtgagccgtcggagtctcggtccaattgagctgcgtattgacggtggatgatgaagtttgtgggaatatttctcgagaaagtgagggaaagtggtgagaaagaaagagagctggtgatgggaaatcaagaaaggtgttcatgagttcaaatggttcccagattctatcgccgggagatagtctccggcgattgctgatcggaatcatcgacatcttcttcttctctattcttagaaagtaacagaagctgagttataaatcttgatcttcttactcaagagaattctagagttttcttgagagtgacgtttgtgatgattatgaagcacagtaactgggcctagcgtggaagcataaagcccaatagaaaaggcctttttcttttttttcttcttattcccggaatccgacaatgttcaaagtgtgtagtagattgatgaagaaaaccagtgtcattttggtagataatcgtatggaggaattttttcttgcaaaagtgatatatatggtggaaaaatatatatgtaaacatagatgtttattgctcttccgcatttgtgttaaacaaatagtgtaacaatatcaaacagtttttttgtttcgtccattcgattgataaagacaaagatcattacgcattgcgaaaatcgaacattttgattaaagactacaaaacagaacacctgacattaactactactcgagggacgaatcgatctttcgtacggttcttgagaaagcaagaatgtcctctggcttgctagcgccatggtcgttgtctttgttgccatcatcgtcgttggaacctctgtcttccactatagattcacgaatgatggttcttatcgtgttgtcttcggcttttcccgcctcgttggtgacgactctctttttctggtctttctccattctctctttcgttgcctccatatctctctcgttctcttttctctagctggtgcaatattttcttgaaagacttctcgacacgagatttgagaacacgtggcacgttagagatgataacgtggtcgtgttcgatgtgaaggtgttttcttcgactgatacgtggagggatgagtcaaacgaagagaaaatgttacaagaaagcccctcagaccatccttatcaatggactcttacatacaattctaaacaattttgatatacaaaataatgtttaaatattaaaaagattcttacaaaagtaaaaaataaagaagaaaactcttaactaagagccattttccatctcttaagcacactttttaattttttaattcttattttgtttaatataatattttgatattgttaacaatctattgataaggatgctctcaaacgagtgatgtatttcgaaaatgaccttttgaacgatcgttaaaatgagtttcattcaactttcatctaaacaaatcgttttgaatctacgtgtgaaagttggtatccgtttagaaaacaaccggactgctaacgtttaactcaaaccggttttaatattttccaccaaaagaatttgttttagcttctttgtagtatttataatggagtaactcaaatgaatttgacgtttattaagcttaattagggttaatcatttagggaagcaattttgatactattttgccaatggggtggtacttaaaatggagcttgtgaaatttttggccatgaatggatgttcttttccagttcagtttttggatttggtttttattttttttaattattttaaacaaaatttagattttagttttagattttgttattagatatttgtttttttttaaaaaaaaattggttttgaagaaaataatgtagttaaagtaaaaaatagattccttaaattatagaagaactaaaaatctaaaatcttttaacgggagattatatcaaaactctttcttaaactccaaggaaacaaattttacaaacttgattggtatgacaattattttttgaagaatgaaaaccaataactctgtcaaaaattgcaaaacattcaattcgtgtattcacacttatgaaaaactccacgaacaaagctaacaaagttgctttactttttagttacgtcaatttaagttgatactatatatttttaaaaatatatattcgtatagttagttgatatattcgtatactaacttgatctcactcacctcgaacattatcggttttggtgggatttgaaagtgaatagagatgaatgagatcatgaactttattttacaaaaatcagagtaagaataacaaaatttggtaacgggtacatatgattagttaccgattaaagagattgacgtgtcaactatattatcaataggaatattcgtaatttttttactcaagttccagttcaatgctttttgatagttcttttttaataactagtgagaacaatccttttgatttggtcaaaagatgccaataaaacattaaacactgatagaaagaaaagagtaatttgcgttagtatttgactttttttataatcaggtggttaagaaactttgaccactaataaaatgccatacttctttaattacctaattttattaatggcttggatatttggattaatttaaattgattacttccttttaaaactctccaccgtacatgcatctcctatttccgtacacacacatttgttataccatattaagcttttaaactctctttcttctctgatcattctcttcttcttcaaacaacatatacataaaatcatacacacacgtatatatatatatatatatagatagtgtgaaagatg

SEQ ID NO: 25576 - DNA, 3003 bp, Unknown
  misc_feature (1)..( 3003): 2750-1469P.txt file - cDNA_ID_2706901; gDNA_ID_2214503; Annot_ID_184054
tcctccatccacgccgtgacctgatccgtcaaggcgttgttaggaagcttaaatctgctcatgaacttgttgtcgccagtacagatctgaagatatccttcttcatctacgaacgcaatcacttcgtcttgatccactcccggaagatacgctttgaaaacgtgagccgtcggagtctcggtccaattgagctgcgtattgacggtggatgatgaagtttgtgggaatatttctcgagaaagtgagggaaagtggtgagaaagaaagagagctggtgatgggaaatcaagaaaggtgttcatgagttcaaatggttcccagattctatcgccgggagatagtctccggcgattgctgatcggaatcatcgacatcttcttcttctctattcttagaaagtaacagaagctgagttataaatcttgatcttcttactcaagagaattctagagttttcttgagagtgacgtttgtgatgattatgaagcacagtaactgggcctagcgtggaagcataaagcccaatagaaaaggcctttttcttttttttcttcttattcccggaatccgacaatgttcaaagtgtgtagtagattgatgaagaaaaccagtgtcattttggtagataatcgtatggaggaattttttcttgcaaaagtgatatatatggtggaaaaatatatatgtaaacatagatgtttattgctcttccgcatttgtgttaaacaaatagtgtaacaatatcaaacagtttttttgtttcgtccattcgattgataaagacaaagatcattacgcattgcgaaaatcgaacattttgattaaagactacaaaacagaacacctgacattaactactactcgagggacgaatcgatctttcgtacggttcttgagaaagcaagaatgtcctctggcttgctagcgccatggtcgttgtctttgttgccatcatcgtcgttggaacctctgtcttccactatagattcacgaatgatggttcttatcgtgttgtcttcggcttttcccgcctcgttggtgacgactctctttttctggtctttctccattctctctttcgttgcctccatatctctctcgttctcttttctctagctggtgcaatattttcttgaaagacttctcgacacgagatttgagaacacgtggcacgttagagatgataacgtggtcgtgttcgatgtgaaggtgttttcttcgactgatacgtggagggatgagtcaaacgaagagaaaatgttacaagaaagcccctcagaccatccttatcaatggactcttacatacaattctaaacaattttgatatacaaaataatgtttaaatattaaaaagattcttacaaaagtaaaaaataaagaagaaaactcttaactaagagccattttccatctcttaagcacactttttaattttttaattcttattttgtttaatataatattttgatattgttaacaatctattgataaggatgctctcaaacgagtgatgtatttcgaaaatgaccttttgaacgatcgttaaaatgagtttcattcaactttcatctaaacaaatcgttttgaatctacgtgtgaaagttggtatccgtttagaaaacaaccggactgctaacgtttaactcaaaccggttttaatattttccaccaaaagaatttgttttagcttctttgtagtatttataatggagtaactcaaatgaatttgacgtttattaagcttaattagggttaatcatttagggaagcaattttgatactattttgccaatggggtggtacttaaaatggagcttgtgaaatttttggccatgaatggatgttcttttccagttcagtttttggatttggtttttattttttttaattattttaaacaaaatttagattttagttttagattttgttattagatatttgtttttttttaaaaaaaaattggttttgaagaaaataatgtagttaaagtaaaaaatagattccttaaattatagaagaactaaaaatctaaaatcttttaacgggagattatatcaaaactctttcttaaactccaaggaaacaaattttacaaacttgattggtatgacaattattttttgaagaatgaaaaccaataactctgtcaaaaattgcaaaacattcaattcgtgtattcacacttatgaaaaactccacgaacaaagctaacaaagttgctttactttttagttacgtcaatttaagttgatactatatatttttaaaaatatatattcgtatagttagttgatatattcgtatactaacttgatctcactcacctcgaacattatcggttttggtgggatttgaaagtgaatagagatgaatgagatcatgaactttattttacaaaaatcagagtaagaataacaaaatttggtaacgggtacatatgattagttaccgattaaagagattgacgtgtcaactatattatcaataggaatattcgtaatttttttactcaagttccagttcaatgctttttgatagttcttttttaataactagtgagaacaatccttttgatttggtcaaaagatgccaataaaacattaaacactgatagaaagaaaagagtaatttgcgttagtatttgactttttttataatcaggtggttaagaaactttgaccactaataaaatgccatacttctttaattacctaattttattaatggcttggatatttggattaatttaaattgattacttccttttaaaactctccaccgtacatgcatctcctatttccgtacacacacatttgttataccatattaagcttttaaactctctttcttctctgatcattctcttcttcttcaaacaacatatacataaaatcatacacacacgtatatatatatatatatatagatagtgtgaaagatgatatgcgaggaggcatatcatcagcaaccgcaaatacaaaaggaacaaatgatgacgatg

SEQ ID NO: 25577 - DNA, 3003 bp, Unknown
  misc_feature (1)..( 3003): 2750-1469P.txt file - cDNA_ID_2706915; gDNA_ID_2214504; Annot_ID_133722
agcgctatcagccaataaaagacgacagctgtaataagactcgagacgagggaatcgggacttcaatatccgtaacggccgtacgggttcactctcgcagacaccttagcatgtggcaccgtcggaggtcgggcacatcatcgaccgatcgaccgacgtcggagttgtgctcggtctaaacaacattggtgctatgtaatctctctatgttgtgcatttgtgctcggccttaaatgtctacaaaatgattcaaatcatgacatgattaccatggttaatggtttatacggtgaattaaatcttgacttggtttaactgttgttataccatttttcagtttaaaatgttctattatatgttgactactacgttagggccggccaaacagtcaagaatgcagtcagatgaagccaccgtttgtgactctttaagtttaacaatcaaatgcatttgaatagagaaaaatataaaacaagaccaattagctcgtagttttaaaattaaccgctggattatttttaccagctctgagatggtcaaaacaagggtagacagtgtcaatggaaacaaagaatgaaataataaacaaaaatataaagcatttgatattaaaatgtatctatcaagaaaaagtactagttagacatgaatatgtcaatagtttgtcaacttttcgcatagataaatctcattttctttttgttgtggagaagttcacaatgatgtggttggttccgaacccaagatatcttcacatctgtatgtggatggaaaagcatatagaggaacggtggctgtatgtgaaaagggcactctagttactttattcttctgatggtcaatatgtcccctaccgtgccatagaatataaattgaaattgagttgcaactagcaatgaggcactatatattatcctggattcaaaaatccgattggatttgtttttaaagtttaatgtttgaaatgttcagatccaatttaattaaaaagacaatgacattggtgtggagatggtgaaggcaaacaacaaacaaaaattggaaatagaactaaaagactagaggtgagctaaactaaaggttttcgtggtaaatttgggatggagttaatctaatttgtgatatgttttttttagcatgttaccatgcattatgtacattcttttagttaaaaaatgttgagttgaagttaattatttttttatagcttaatatttttttttggtttaacaattagcttaattttgttatttgataaagactaaaacacccctggatgctcacccaccacatgcccacaaacggagattgccaacccccgggggagatgacgacagacgagaggagagaacagatttggagcttttatagcttttatagctatattgttaaaaaaaaatcaataatataaattaaactgcatgcaaaatcaaactcttgtacatctagagtcttactagattaacgtgtaagaacttagaacttggaaaaatctatatggacaaaatagatcagtcttttttcgaacatcatcaaccacacgaaatacgctagctaacttttaaacctcttctgtatcaactatcaagagacaaacgatataaaaaaaaaacaattggtgtatttttgaattttcattgcacgcacgtgaacagcataattgcttgattggaaacaaacctttttagaattcattaatcagttttaggtgttttggaaaattaacgaactatagtggagattaattaattttatattagtcttttttagtacacaaatcgaagtttcctagattttttcaaagttgaaaataatattgataatatttatcaacaatgaatctacaaaaacataatttttttgccaaacaaataacaccgaaacaagattcattcactatttttggtttaaaaaaaaaaatcaaaattacactattatgaagccaatttttgtatgcaaaaaacctgtatgtatcaatttgtttgtattaaaaagtaagcatttatgtcttttttttataaataatagaaacacttactagatgaatagattttttggttttagaacagaatactataattgtatttatatagcttttttatattattcgatatagaaaagtgttataataggaaaaatgtaccatatactgtcaataacatatttgattctaaatataaatagaattgttttaaagaaatatgatcgtttataattaaatggtttttaatgtcttttcttggggcaaaaaacaaagcttctctttcgtccatatatttgcatcgtaaggggtgacgtatcactctctctttctctcaaatattattcttcaatctctttttggggaatcttcgagcaaattagtgagagaacccacccactttctttctcatatgagtacataagatcccttttgagttttcgtgttttgccaaaatctccaggtaaagcttctccctttttctctgttttctctgttttgttattctcccttttctccattgtagctttttcctgtaaagtgggattgatagttttgtttcatggatttcaaatttgtgttatttgactcgataccatcttaaatgcagagtcttttcgtgataataaaattatggattcgtttcaaagttttttttttttcgtatggaaaacacttgagctctctcaatcttgtagtcttgactcttgatgattcttctatgttctcgttgtgattgcttgtcactgttctatcttttatatatgattaaatgcaattttgcccctttttacgcgcgaatgtatttattatctttcgcactctgggtccatttcttgtcacttgagcacataatgattgatttatgactttttaaagttatgaaaatttattatttttgttgctatggttttttggaattagaagctcatttcaaagttgttgattttctttgcagggtagggaattggtgtggtagcttgtgatgcactgtgtttgagggaaaggaaaggataacgatg

SEQ ID NO: 25578 - DNA, 3000 bp, Unknown; identical to SEQ ID NO: 11584
  misc_feature (1)..( 3000): 2750-1469P.txt file - cDNA_ID_2706923; gDNA_ID_2214504; Annot_ID_133724

SEQ ID NO: 25579 - DNA, 3000 bp, Unknown; identical to SEQ ID NO: 11586
  misc_feature (1)..( 3000): 2750-1469P.txt file - cDNA_ID_2706931; gDNA_ID_2214504; Annot_ID_133727

SEQ ID NO: 25580 - DNA, 3000 bp, Unknown; identical to SEQ ID NO: 11586
  misc_feature (1)..( 3000): 2750-1469P.txt file - cDNA_ID_2706931; gDNA_ID_2214504; Annot_ID_184072

SEQ ID NO: 25581 - DNA, 3000 bp, Unknown; identical to SEQ ID NO: 11587
  misc_feature (1)..( 3000): 2750-1469P.txt file - cDNA_ID_2706935; gDNA_ID_2214504; Annot_ID_133728

SEQ ID NO: 25582 - DNA, 3003 bp, Unknown
  misc_feature (1)..( 3003): 2750-1469P.txt file - cDNA_ID_2706939; gDNA_ID_2214504; Annot_ID_133729
accctcagaaaattgttaaaggtctctccttttttgttctaactaaggaagagacgaaatgactaacagaggcctaaacggctagacccaagagggacacaccatgtcgttttttcagttcatagcctccgtccttctctaatattcattaacatcgtgccgttttcatgttttccactcacactgtagtgataggtcaactcagaaccacgaaaatgtgtaggagtggtaaacgacacgatgtgcaacagtgaaaaggaggctaatacaatgaggacaagtgtcgaaacaacgatcgagattgtaggaaaagacgggcagatctgaaaagctgcccgaatatgttatcgattgttcaactccactagttttgcctgaccctacttgtgcccgttgccctcaaatatatctttcgttgtgagtcatcaaagaagcgtcggtatcgaaaccgaagattccgttcgcttttggttttgttcgaatttcagagacattaaaccagctttggtatttagattggtttgacttcggttcagtgacaaaacaaaacctacttaaacgaacgagtgatgagtgacttcagaaaaaaacagtacatgattccataataagtaacttattatttataagtttcctaaaaattttgcccaaaaaaaaaaaaagaaaaaaaaaactttcctaaaaaagtatttgctaattgctttgactcgaaaaataattgaaaactatcacttatgtgtaaaagaccaccaaaagttgtaacgcctttgatcacttatacgaggtcacagtattcgacaagtaactataggtcaaaatcaagtaagtatgcattcgacaagtaagaaacgtttaacgtaaatgaagtgagtgagcagtcattgaacaacaaattagcgtttggaaatggacgaaaactaactagtaaacatgattaatacacaagtaaatgaagtgactgagcagtcattaaataaccatgcttacttaatcacctatacgattatatagtctgctttcatccctaaactccttatcatcatgattcttgattcgacacctcaaagtcctcaagtgcatgtcagcacgtataaagttataaatataaaaaaaaaaaaaaaaagttataaatatcaagcataatttagcactgagattaaaagagcattcctaacaaaaccaaagattataagttcatgatattggaaaaacccaacacaagttcatgtaattaggttaagtagatgagcaagtagtctcttatatataatcatgtagtgagaacagtgagactaacgtagagagttgtcacttaactccatagtctatccccttctttgaaatcaaaactaaagtcattctattcttggggacaatctaaatcttttcccctcatacttttgttttgtgcaataagcttaatgaggtctcttattttcagttttagatttctatgttagttcatttgagcacaaatctatcctagtttggtttttcctacaaagatcgcctcaaaagaacgattttagttaataagacttaaaccccaaccatcaagatcaaaccgtcataatctagtttaatccatgatacaaaaaaaaaaaaaaaataccacttacacaaagtaaaagcaaaagaaaaagatagagatgagaccaaattcataaatttgatagaaagataaggatgagattcttttataattgtgaagataaatatactaatttttatcgaaggggtgttcaaaagtatattgattcaaatagattatagagaaaaattaagtaaaacttagatttagaaatacctcttgttatagttgtcatataaatcttaaatttaacatcaatcatattgtcaaatctagctttattaccaaaaatatatctagaatagaaatactaaaaaattaaaatgtcatccgaaatctataattaattaatcgaatgtcacaaccatattagtcatataaacatttttcttgttccaagaatgacatcttgaccgaagaataaagctatgaaaagtaatagaccaaaaagttaagacttctaaaacagaggctccgatcttttattagttctttaaaaagaatccggattaatttaatcatcggattagttggattggactaaacaatgattttgaattaggtagaaaccttaatgattatgagatcaactcaatgaattctttccaattattattgtcttagcaacacattctagtatatccataaaagaaatattataattcccttattttagtcatataagtatgaataaccctaatgaattgaagtattgaactaaaattaacgaatgaataagctctttccaacccagaaaacaataaataaatccatgaaaaactgaatttgttggattgagcttgacccatttgaacaggctacttatattatatataaatgtgaacatctttgcatgaaaaaataagtctcgtcaacaaatgttagccgaaataatgatatagtttaagatagagccaaacacataatatacatacacatgtacattgtattttctcaaaaaggtataatgacaaaagacaaaattaataggggtaatatcgtaaattcaagggtaaaggagctgggcataagctttgttctcgagtctcccgctccgctcaggtgtagcgtagcgcctcttaaactttctctccctttactatgcgttttctttggaaaccctaaaactctgcaagaacaagaagaaagtctcatccttgaaatcgacgctgtgattagctcttcttaaggtcaattcgtcactttacctcgacttgtaagtttgcttctccttttatttggtcatggtcgttagagttttcttataggatttgtaatctcaattcattagctgggatagcttaattaaggagtaaattttgttgtaaagttttgatttttattgaacactgttgtttctctcacagggttattgtgagaaaagagtggtggaattagttaataaccttatg

SEQ ID NO: 25583 - DNA, 3000 bp, Unknown; identical to SEQ ID NO: 11589
  misc_feature (1)..( 3000): 2750-1469P.txt file - cDNA_ID_2706945; gDNA_ID_2214504; Annot_ID_133731

SEQ ID NO: 25584 - DNA, 1291 bp, Unknown; identical to SEQ ID NO: 11603
  misc_feature (1)..( 1291): 2750-1469P.txt file - cDNA_ID_2706949; gDNA_ID_2214505; Annot_ID_133746

SEQ ID NO: 25585 - DNA, 1291 bp, Unknown; identical to SEQ ID NO: 11603
  misc_feature (1)..( 1291): 2750-1469P.txt file - cDNA_ID_2706949; gDNA_ID_2214505; Annot_ID_184100

SEQ ID NO: 25586 - DNA, 3003 bp, Unknown
  misc_feature (1)..( 3003): 2750-1469P.txt file - cDNA_ID_2706977; gDNA_ID_2214506; Annot_ID_133772
agtgactcgcaagatggcgttgaaacatagaatgataactaaatgggccgttaatacaatcttaggcccataattatcaatatttaagaagtatatagtagaccgttaatacaggcttaggcccataacattcaatattttgggctcaactgtctaaatgtatgaattatgatcctagatgggaaatatgagtttgttcaaaaaagaatcagtatagcatcttctttacttttctttttcgtagtttttttgggaagtgaacttgtgattggtaggaaggttactggtgatcgacgtttcctttaaggccgacaaagttaatggaccacggggagttttataaaggaggttttctttctttctttctttagcttaaaaaggtgtaatgatgactttttcaatctcaattttaaaaactttttggtgtattaatattgattcatatacgtgcaatctggagatcaagacattgaatactaacaccaagacgaatttttcggattgatggtttttgagttttcaaaataagtatgttggaatggtgcattggcgaatgaagcattgaccagacaaaggtcattggaaagtagtttttttttttttttttgcgtaaagctaaaggaaggtaataaaatacagtacatgaaaacgaaataagtagtgatattaaatactttagttgacaaaattgacagcggaaaaaacattacatgaaggccataaactaagagctttgaccaaatctgaaggtaaatcaggtttcagaatcagaagaggatatctattccaactggtgcaacggtagttgtacctgttgtgtcactattgcttcatagtttcgtatttatttattgtttctatgatgctgatatttgataatatatagagatatattgtgtttgcgttaattggtttggtcagtcgacaacccaagatttacttgtttgttattcgttcatcaacaatcttatagttttctctgtcaaatattctctttaagtaattttttaattaggaagtttagggattttttataggtcataggtgtaggttaaattaggtttgacaatgtataaggtgactctataaaatattataagtttttctaaatgaatatatcattagttggattaccaatttgaatatttttatgagattttgattaagtacttgaagtgttacgtgaaaatatatatagttcatgttttatcatggcaatttttttaattatgactaaccattatatgaatgttttaaagaataattctcgtttctattataaattttggtatgaaatctctatttataaaaataatgtgtatgtttatcaacaaaaaagaagaagatatgtatatgttttcttgataatacccgtacatagaaaggctattactttgacttcaagtaaaggtgtagcaattatctatgttcttgcttttttccaagcatataaggataatcgttggaatctaggaaaacttttaacgcaactcaacttcagataacaaacgtaaattttaacatggttaaatattcgatctaatttgtatatatacttagcgacaccagctttcacttatataaaattcacgaataaaatagttcatatgatggtagctaaattttcagtactttagaaaatatgaaatgcaagtgaagtagaattcagataaccggccaattgaatagaaaatttgatttagttggatagaggaaaagaatgttctgaaaaagagtaatgatgtgcatgtgctcgcgaaagtttccatagtgttgatggtagcgaccagtcttgagttccattcacgctaaatcacgtggactataaagattacacgtaccataaccataaagctctataaagattgcaattcaaaaaaaaaaaaaaaaaaaaaagaattgtaataggggctagtttctgattttgcttgctgtaaatgtaacatttcctcaagttttgacatagtttttaaaaaacctccttatagggacatgtcacatgtgttggatgattgattaacaatccggtggaccagaaaacaatgagtaattatacggaggccggctttagttaaacttcacacatcaaaatatatggcccatccctcgccttttgcaattgtcgccgaccggcgcgtgacgatctacaaaatttcgattttaaactcagaaaaatacataatacaatatacgtcaaaattgcatctacttattctaatggtagttgaaggaaaaaaatcagaactctatgacttgtgttataccatatattacgacaaaaaaaaagggattaaaaagtcgttgacgtttgacttaagtgccaaattaattaaccaatgcttaatgacctaaccaaagtcactttttattttagtccggtatgacttgtgacggcgacgctgaaaacgattgaagtacacgcgcggggtcctccagcctaattgccacctgtacaccagccctgtccgtcgtaactataaaaatctcattttccttttttattttatttccaaacctccaaacaattaaagaaacggcaaaaatttatgctgaaatctttttttcttccttattctcctctttcgcttgatttcgccgtccgattatctctatcgccgataaatatccggcgtcactcagtagatcttgaagctgttgctttcttgctttgctcttcgcgcaagattctctttctctgttttcattgaggattcgaagttgatcgctatttgattcgattggttttgagttttcgatcctcgacggtgattgaattctcctctttactttatttttggtttttgaagctcgctgtatcaatcgtgacgttttttgtgattcgcattgtgtctgtagtagttgatcaggtttccgattggtttcttattgatttgattttaaaaattcgattgctgatgaaattatctggttctgcatttgattgttcgcaggatggagattttgaagtgaatcggaggagcgaataagagaaagtgagagatg

SEQ ID NO: 25587 - DNA, 3003 bp, Unknown; identical to SEQ ID NO: 25586
  misc_feature (1)..( 3003): 2750-1469P.txt file - cDNA_ID_2706977; gDNA_ID_2214506; Annot_ID_184136

SEQ ID NO: 25588 - DNA, 3000 bp, Unknown; identical to SEQ ID NO: 11625
  misc_feature (1)..( 3000): 2750-1469P.txt file - cDNA_ID_2706988; gDNA_ID_2214506; Annot_ID_133763

SEQ ID NO: 25589 - DNA, 3000 bp, Unknown; identical to SEQ ID NO: 11625
  misc_feature (1)..( 3000): 2750-1469P.txt file - cDNA_ID_2706988; gDNA_ID_2214506; Annot_ID_184127

SEQ ID NO: 25590 - DNA, 3003 bp, Unknown
  misc_feature (1)..( 3003): 2750-1469P.txt file - cDNA_ID_2706991; gDNA_ID_2214506; Annot_ID_133759
tccctaattctcgagctcgaagaaagagacgaaaatggcactgagaaatgcaattcttcgtcacctgagggttccggtgcaaaccctaggattgaatcagtctaaaattgggttccttggtacgatccggtcattttcttcgcacgatgatcatcttagcagagaagctgtcgtcgatagagtactcgatgttgtcaagagcttccccaaagtcgatccctctaaggtcagctcgatcttcataaaatttggccaaatcgtgattcttatcttttgttttcctcattattgggaacaaaatgattattttgccttgaatatttgtcaatgtaggagcttttggttgatttcgtattgatctagtggaaatagagaccaaatgtatctgaaacgatgttgcattagtgttgttagtaaattgaaggttattgatctcaatgtggtttagtaagtgtagcttatcgtgttgttgttcctatggatttgatttgatatggtcattcttatggattttgcatttatgaatccttcatcaactctctctaataagggttgtttggttagggttatttttgttgatggctttgtgataaatatcgacaggtgactcctgaggttcatttccaaaacgatttgggattagatagtttggacacagtggagatagtgatggctattgaagaggaattcaagctggaaattccagacaaagaagctgacaagatcgattcttgctctctcgccattgaatacgtttacaatcatccaatgtctagctaatcgctgtgtgctctctcatggtttctccttcctttttcttgtatgaggttcttctctctttgataatgccataatgggatttgcaaaaaaatcacttttatttggagagcattgttattgactcttttaacggttccagtttcttaaaaagaaaacctttttgcttgaatcttgtgaaagttgacactttttcttgagttaatactttaatacgatttgtatataatacacttgattcttagcatggtcttgatcatacattgaagacgaatctttgaaaaacatacttgttttaaaaaactgatcgtctctcttggatacatatgcaagaccaagaaattggatcttatatactacattacatcataacgtgctattaactagaattgtttgtcagccatcttttggatcgaatacagacagtagttttcatttggacaagttttctgcttcatctcaactacagcatttgtaccaaaatacaccaatatctctatccacaagttagatgttttaattaggagatacatttcaggtttcgtttgaatcgattttttagtaaatgggacaaaatgggtgaacttacaatattaaaaacttgctaagctaattatgcaaaatggatagggtggaaggaacaaagcaagatgctgaaaccgcaacagcaatgaatcttgtaaacacattgtagtgatattgatcataatgactaaagaaagactaaataaacatctaacgtcaacaatatatctcttgattaagtttaacccgaaagagacagacaatggcgcaaactatagttgttaggaacgattctgagaagttgagacggttcttcagttccatgaattcctacttcactcctaagcaagccaatcattctacaccaaatctctttgctttcactaacattacttggttttccccatataaacgccaactttccgtagtattccccgatcccaatgcatcgagctttgtcaagatctaaaccataaaccactctccacaacatcagctcagagtcataccacattaacccaaatctaaggaagtaaacgaagagcacattgtcaatcacgcattttcctgtcttccaccaattatcttcaggtatcgtatatctttgataagaaccatctctagtatcgtaagaattcatgtattccctcgaatttaaagcataaaccttcctatcaagtgaaacacttgcatgcgtgaaccattcgtttctatcctttgccttaggaatcggcgctgcttcccaagtttgtgtctttaagtcaaatacttccgctaggatctcttcgcctctgttgcctccgatcacatagatcttaccaccgactagtcctacggtagctgataatcgctccacttgcatactaggtccttgacgccactgtccagattgggtgtcaaagatccatacgattgatgatgagggaaaattatatccgggaatgcagtaaatctctgtatcaattgcgatattggaaagagggtaagaagcatgcccgggacgataaggaacatcgatggagacgaagacattctcagtcgtattcatcttgttatcattcctccggagagtgaaccagtgaaaagtcgtccggttccggttcgggtatgtagttctggtcgagaagcatagataaagagagtcctttccgtgtaaagatcgcgtcttgtgaatctccggcgagcgaattagactccgcaaggacttggagacgcaacagaggattgggtaatatcgttttggtaccaaggctaagatgttcaatacgatgtccaccgggagtgagaacaatgacggcggcgtcaatgaagacgacggtggttggttggttttctgcggtggttcgtcggcgttagacatcgagagctattaggaggaggagactagagaacaactgagtgaatcaatcaaattgagggctttagccaaaaaccaaaagccggttaaattcttctctgattctgctttaatcggttaaaaccggtttatatttcttgtcttgatcagggaaacacacagagttttagaataaggcccaggaataagcccggtgagtgaatctttctaaggaatcgattttaaaacaaggcccattaaagggtgaagaaaaggcccatgaaaatgcttaaaccccctttgtctcccagcttcgtacacaggagagactgagataaggaaagaagaagaggaagaagaaaatg

SEQ ID NO: 25591 - DNA, 3000 bp, Unknown; identical to SEQ ID NO: 11617
  misc_feature (1)..( 3000): 2750-1469P.txt file - cDNA_ID_2707002; gDNA_ID_2214506; Annot_ID_133752

SEQ ID NO: 25592 - DNA, 3000 bp, Unknown; identical to SEQ ID NO: 11617
  misc_feature (1)..( 3000): 2750-1469P.txt file - cDNA_ID_2707002; gDNA_ID_2214506; Annot_ID_184114

SEQ ID NO: 25593 - DNA, 3000 bp, Unknown; identical to SEQ ID NO: 11616
  misc_feature (1)..( 3000): 2750-1469P.txt file - cDNA_ID_2707006; gDNA_ID_2214506; Annot_ID_133751

SEQ ID NO: 25594 - DNA, 3000 bp, Unknown; identical to SEQ ID NO: 11640
  misc_feature (1)..( 3000): 2750-1469P.txt file - cDNA_ID_2707006; gDNA_ID_2214506; Annot_ID_184113

SEQ ID NO: 25595 - DNA, 471 bp, Unknown; identical to SEQ ID NO: 11613
  misc_feature (1)..( 471): 2750-1469P.txt file - cDNA_ID_2707010; gDNA_ID_2214506; Annot_ID_133747

SEQ ID NO: 25596 - DNA, 3000 bp, Unknown; identical to SEQ ID NO: 11647
  misc_feature (1)..( 3000): 2750-1469P.txt file - cDNA_ID_2707024; gDNA_ID_2214507; Annot_ID_133777

SEQ ID NO: 25597 - DNA, 3000 bp, Unknown; identical to SEQ ID NO: 11647
  misc_feature (1)..( 3000): 2750-1469P.txt file - cDNA_ID_2707024; gDNA_ID_2214507; Annot_ID_184158

SEQ ID NO: 25598 - DNA, 3003 bp, Unknown
  misc_feature (1)..( 3003): 2750-1469P.txt file - cDNA_ID_2707036; gDNA_ID_2214507; Annot_ID_133782
tctctctgatcctgctagtgctcggcatttaaagtttgcgaggagtaatgttctcaaaagcatccagctcgggaatatttggccctcctttatcctattctcgattctctctatccctagatagttccctcctttagcataacactgaagcatcaaggaataagatgtttcagtaggtttgaaacctttacttttcatgtcggaaatcacattttcgcctgatctccaatctccttttcttgccaaggcattaagtaacgcgttgtaagtcgtaacgcaagcgttgaaccctgctcttgtcatctcaccatacattttcgatgcatcaacctctgaaccacatcgcccataggcactgatcagcgtgttgaatgtgtccctatcaggttcaaatccgcagctcttcatttcacggaacacccggttcacaaacttatccatacccttattcccacacagagcaagcattgtgttccaagtggcacgattaggggaacatccattagacttcatatcacataacatctttatcatttcgttggatctcgacttcttccccaacagactaagcactgcattgtaggtgcaagtattcggaacacaaccagcttctttcatactataaaacagcttcaaagcctcgtcctcctttcccgcctttccatatgcatctatcactgtagtataagtgattgcgttcggcattacaccctttttcgtcatcatctcaatgacaccagcagcttccttgctaaaaccagctctaacataagcagcaacaagctcattatatgtcacagaatctgctgggcagctattttcctccatctctttcaaaacactcaacgcttctgtataaactcctgctttaccaaaaacttgcaacaaagcattgtacgtaacagtaccaggttcatagccgcatgacttaagttcagcgaaaaactccttggcctctcttaacaaaccttctcttgcacaagcagagagcacagtactacaagtaaactcatcaaacttcaatcctttgcttctcatttcatctaaaacccctagaattttccgccaagatcgacccattttcccgaaaacatcgagaatcacattgtaagtcaccaaagtaggtgaaggacccatctctttcatcctctcaaacaaatcgatagccttttcatacttcccagtccgtgaatacgcatgtaagatcgtcgtgtaagcccgaacatcgaggagatattcttgtagaggaattttatcgagcaacttagctgcaacagagtactgagattctctacctaaaatcctaacaaagatttcgataacttgatgatctagcttcaaagctccagaatttgaagacaaaactaaccattcaaacaaaaaaacagctctttcccaatgcccagaatcatctagacccttaaccaaactaaccaaatcagttctaagcaattccgatttcacagaatcaaaaaacctactcaaaccagtcaaaggctgttcaacaatggaattaaccaagacaacttctttcttacacaagagtttcaaagacccatttctctcgttctcaatttcaatacccagaatgggtttcgacgatgatgaatcagtcgagacttcgagagaagggaaacgagcggcggcggagttggagtgtctaggaggcggggaagagaggtgaacgagatggtgaagaagagaatcgagagggaaagaaggaggagaaggaggaggtaagtgaagagtagcggaactgaatttgatagattggttagaggattgagatggtggaggtctcttggattgaattgggtatggaggtttgtgagggaagagtgctccgtccattgaaagacgttatccgaaattgggattgaaggagaagaagagtgagtgaaagttagcgcctttgggttgaagttgagattttgaatggccgtaaaagggactcgtccctatcggcacaagattggcctttccagatgatgcgttacgaacatttttgttctaatccgtatgactgaatatcttaactaaaccgaaccgaaccgaatttgaactaaccggaatgtatacacgaagtaaaaacaatagataaaatgtgaaaaaaaaattaaaatccccaaactgtaaaaaatacaaaaaaccataatcagattttgaaatttgaaatatttttgcgattttattgagttcatgtgtattttaaacgaaaaaaattacttgattagaccaaattggttcagacaaccttaaatctataaattggtttgttagattttacaccaatttgatcacttaactaaattaattaaattagatgattatcccaccatatttttgagcattaaaccataaaaccatagttataagtaactgttttaatcgaatatgactcgattaagattaggaaaaatttataaccggtaattaagaaaacattaaccgtagtaaccgtaaatgccgattcctcccttgtctaaaagacagaaaacatatattttattttgccccatatgtttcactctatttaatttcaggcacaatacttttggttggtaacaaaactaaaaaggacaacacgtgatacttttcctcgtccgtcagtcagattttttttaaactagaaacaagtggcaaatctacaccacattttttgcttaatctattaacttgtaagttttaaattcctaaaaaagtctaactaattcttctaatataagtacattccctaaatttcccaaaaagtcaaattaataattttcaaaatctaatctaaatatctaataattcaaaatcattaaaaagacacgcaacaatgacaccaattaatcatcctcgacccacacaattctacagttctcatgctaaaccatattttttgctctctgttccttcaaaatcatttctttctcttctttgattcccaaagatcacttctttgtctttgatttttgattttttttctctctggcgtgaaggaagaagctttatttcatg

SEQ ID NO: 25599 - DNA, 3000 bp, Unknown; identical to SEQ ID NO: 11648
  misc_feature (1)..( 3000): 2750-1469P.txt file - cDNA_ID_2707040; gDNA_ID_2214507; Annot_ID_133778

SEQ ID NO: 25600 - DNA, 3003 bp, Unknown
  misc_feature (1)..( 3003): 2750-1469P.txt file - cDNA_ID_2707091; gDNA_ID_2214509; Annot_ID_133809
ccgtcgtcacaaggtcctcagcatcatcagtcattcgctctcgatccagccatcgcagccattggtcctaccgtcaataatccttttcctccgtcgaattggcaatctaacggtcatcgacccagtaatcataaccctccttcttggccactcgccttttcacctcctcataatctttcccccaatttcttagggtttcctcaatttccgcctagccctttcacgacgaaccaattcgacggtaatcaaagagtatctccagaagatgcttatagattagggtttcctggaactacaaatcctgctattcagtccatggtacagcaacagcagcagcagcagctaccgccgccgcaatcagagactcggaagcttgtttttggttctttctcgggagatgctactcaaagccttaatgggttacataacgggaacttgaagtatgattctaatcaacacgaacagctcatgaggcatccccaatctactctctcgaattctaacatggatccaaacttgtctcatcatcggaatcatgatctccatgaacagaggggaggtcacagcggaagaggaaactggggtcatattgggaataacggcaggggtttaaagtctactcctcctcctcctcctcctggattttcgagtaaccaaagaggatgggatatgagtttaggaagtaaggatgacgatagagggatgggtaggaatcatgatcaagcaatgggcgagcattctaaagtttggaatcaaagtgttgatttttctgctgaggctaatagattaaggggattgtctatccagaacgagagcaagttcaatcttagtcaacaaatagatcatcctggaccacctaagggtgcaagtctacattctgtatcagcagctgatgctgcggattccttttcgatgttgaacaaggaagctcgtcgtggaggtgaacgtagagaggaattggggcagctcagtaaggcaaagagggaaggcaatgcaaactctgacgagattgaggattttggagaagatattgttaagtctttattgcttgaagatgaaactggtgagaaggatgccaatgatgggaagaaggatagcaagacttctcgcgagaaggtacgtttcagtttttgtgtaagcttgtgatataggatatacctaatgacttgttgggaacattcagtgatggtgtttagctcgtgtaatcaattcttgaactagaaaggatgtttttttagattggaaagattgtttaaatcagggttttgttatcaggagtcgagagtggacaatcggggtcaacggctgcttggccaaaaggcaagaatggttaaaatgtatatggcatgtcgaaatgacatccacaggtatgatgctacattcattgcaatctacaagtccctgattcccgcagaagaggagctggagaagcagagacaactaatggcacatctagagaatctagttgccaaagaatggcctcatgcaaagttgtatctttacgggtcctgtgctaactcttttggtttcccgaagagcgacatcgacgtttgccttgcaatcgaaggtgatgatatcaacaaatctgagatgttgttaaagctggcagagatcttggaatcagataatctccaaaatgttcaggtaaagtaaatgagtttacttatagaaacacattgctttggtacttgatacgcttttcttgctttgaatctggtgcctatattttctgaaacattgttttttgtgtaggctctaacacgagctagggttccaattgtaaaacttatggatccggttactgggatatcttgtgatatctgcatcaacaatgtattggctgttgtgaacacaaagctcttgcgagattatgctcagatagatgttcgtttaaggcagttggctttcattgtgaaacattgggcaaagtcaagaagggttaatgaaacttatcaaggaacactttccagctacgcgtaagttctcctccacactttgaaatgaagttactttggattgcaaattacaatcattacttatatttgatacttttgcaggtacgttctgatgtgtatccatttcttgcagcagcgtaggccgccaattcttccttgcttacaggtgtgtataatcatatcctcctaaaatagtgtactgattactgaatgctcttcatttattgaagttattacttgatgcaggaaatggagccgacttactcagttcgggtagataatatccggtgcacatactttgataatgttgatagactccgtaacttcggatcaaacaacagggagaccatagctgagctggtctggggattcttcaactactgggcttacgctcatgactatgcgtataatgttgtatccgtccgcaccggttccatacttgggtaaactagaaactcaattatacttactgcaacatctgtgaagcaacaatctcagagatgaaacatgaatatgtgtgtgttgcaggaagcgagagaaggactggacgagaagggtggggaacgataggcacttgatatgcatagaggatccgtttgagacgagccatgatctgggtagggtggtcgacaagtttagtatcagagtgttgagggaggagttcgaaagagctgcaaggattatgcatcaagatcctaacccatgtgccaagcttttggaaccatatattcctgaagataataatggacaaggccacaactgaacttttaaaacatttgaatggcggattcgtgtggcttgtatatatttatgggtagaagattcatgctctgttctttttgcttttttggttgtgatttgaaatcttgcttgtgacccaacaaaaagaaaggtcttagttttgaagatttttgtatgatggtgatgtgggtggatttcttaaacgtgtcgtgttatttgcgtgacttgaaaaaagaagtgagataattttgaaaacaattttttaataataatgcaaaacagatcaatctcgcaagtcgcaacgatg

SEQ ID NO: 25601 - DNA, 3003 bp, Unknown; identical to SEQ ID NO: 25600
  misc_feature (1)..( 3003): 2750-1469P.txt file - cDNA_ID_2707091; gDNA_ID_2214509; Annot_ID_184202

SEQ ID NO: 25602 - DNA, 3003 bp, Unknown
  misc_feature (1)..( 3003): 2750-1469P.txt file - cDNA_ID_2707094; gDNA_ID_2214509; Annot_ID_133808
aataccttcatccgaatcttcaagccacggaatattccgccggaatccaaacttccgatcctcgtttactttcacggcggtggatttatcctctacagcgccgcttcagctcctttccatgaatcttgcaccaaaatggctgatcgtcttcaaactataatcctctccgtcgaataccgtctagctcccgaacaccgtctcccggcggcgtacgaagacgccgtcgaagctatcttatggctccgtgatcaagctcgtgggccaatcaacggtggtgattgcgacacgtggttaaaagacggtgtcgatttctcgaaatgctacgtcatgggttcaagctctggaggaaatattgtctacaacgtggcgttgcgtgtagttgacacagatctttctcctgttaagatccaagggctgataatgaaccaagctttcttcggtggcgttgagccgtcggattctgagtcacggcttaaagacgataagatctgtccgttaccagctactcacttgttgtggtcactttgtttaccggacggtgtagatcgtgaccacgtgtacagtaatccaattaagagcagtgggcctcaggaaaaagataagatgggacgttttccgtcgactcttatcaacggttacggtggggatcctttagtggatcgtcagagacacgtggcggagatgttaaagggacgtggagttcacgtggagacgaggtttgataaagatgggtttcatgcttgtgagttgtttgatgggaacaaagctaaggccctgtacgaaaccgttgaggcctttatgaagagttgttcatcaactggcccatcgtccaactccaacatgtagtagtctgatctaatcatgttttacgaactatatatatatctagctaataattaaattcctacaactattacgcaatttttgttgttttaagtcacatatgatatgtgtggtgcaatggaaaaatgtataccctttcaataaatatagtggatgcaatttaatctatttactaatactaattttaacgatgtccaaagagaattggatgttctgtgagctacgttttattaacattttaaattatgaattccaccaacaaaaaaagatagattttaataggtgaacatactatcattatcatattatgattagctatttacagaattgttttgaataattcattaagaacattgttagattctttttgtatatatacaacaataaaatgctaataattccatctagtttagtttgtagaacatgattcctcatttagacaaaatataaaaacatttcttaatttggtcaataatcaatatagctaaactgcgtaaaatcatgaccacaaataatccgtatattcatcctaatcacaacttaagctccattaaacgtaaaacagttacacacaacaacaacaacaaaaaagtaagaaaagaaacgaaaaaaatcctaaacatttcttcttaggtcaaagttaacttcctcttaatcacgcaattaatcataaaaccatgtcacgtgactctcctcccgcatttgatccatacaaacacctcaacataacaatcaaccccaacggctcttgcacgcgccatttcgtttggccgagggttgaacccgacccggatccatgccccggcaagctcgccgcttccaaagacgtaaccattaaccacgaaaccggcgtgtccgtacgtattttccgaccaactaatctaccatccaatgataacgccgtggctcgtctcccaatcatcatccatctccacggctccggttggatcctttacccggccaattctgccgcaaatgaccgttgttgctctcaaatggccagtgagttaacagtgattgttgtctccgtacactatcgtttgcctccggagcatagactcccagctcaatacgacgacgcattagatgctctgctttgggtcaaacaacaagtcgttgactcaaccaacggcgagccgtggcttaaggactacgccgatttctcacggtgttacatatgcggttcgagtaacggcgctaacatcgctttccaattggcactgagatcgttagaccacgatttaacgccgttacaaatcgacggttgcgtgttttaccaaccgctttttggcggtaaaacgaggacaaaatcggagcttaagaatttcgccgacccggtaatgccggttcctgcggttgacgccatgtgggaactatctttgccggtaggtgttgatcgggatcataggtactgtaatccattgggttacttgccgcaaaaggagaaagttggacggcttggacggtgtttggtgatcggttacggcggagacacgtcgttggatcgacaacaagatttcgtgaatttgttggttgcagctggagttagggttgaagcaaggtttgacgacgccggtttccatagcatcgagctggtcgatccacgacgagccgtcgctcttcttaatatgattagagattttataagttgattattcttttcaagttttcatctaagcattctataaccgttaattttctcattttctattttgtatacatatgacattttacattgaacgttgttacatagcacaaatgttacttcttttgtgttttttgataaaatgttaacattgttacttcttattgtattcatttttacaattccacaattccgtaatttcacaaatttactaattgaaatccatttcattctcaatcatacttaagtaacctactgtagttgaattttaagtccaacttgtgatcagctttaaaaacaaaagtcataacatcggacggtcaggatatcatgtgtgaggctgtatcctttaaataataaaatagaggacacacacgagatccgttaaaggttaaaccttgaagaaagaaagatctctcggtggtggtcattcaacattgtaagatcttcgacttggcaaaattgtttcactttcgctctaaaaacttcatcttcactttctctcctcctccatg

SEQ ID NO: 25603 - DNA, 3000 bp, Unknown; identical to SEQ ID NO: 11669
  misc_feature (1)..( 3000): 2750-1469P.txt file - cDNA_ID_2707105; gDNA_ID_2214509; Annot_ID_133803

SEQ ID NO: 25604 - DNA, 3000 bp, Unknown; identical to SEQ ID NO: 11669
  misc_feature (1)..( 3000): 2750-1469P.txt file - cDNA_ID_2707105; gDNA_ID_2214509; Annot_ID_184196

SEQ ID NO: 25605 - DNA, 3000 bp, Unknown; identical to SEQ ID NO: 11670
  misc_feature (1)..( 3000): 2750-1469P.txt file - cDNA_ID_2707109; gDNA_ID_2214509; Annot_ID_133802

SEQ ID NO: 25606 - DNA, 3000 bp, Unknown; identical to SEQ ID NO: 11670
  misc_feature (1)..( 3000): 2750-1469P.txt file - cDNA_ID_2707109; gDNA_ID_2214509; Annot_ID_184195

SEQ ID NO: 25607 - DNA, 3000 bp, Unknown; identical to SEQ ID NO: 11664
  misc_feature (1)..( 3000): 2750-1469P.txt file - cDNA_ID_2707117; gDNA_ID_2214509; Annot_ID_133800

SEQ ID NO: 25608 - DNA, 3003 bp, Unknown
  misc_feature (1)..( 3003): 2750-1469P.txt file - cDNA_ID_2707121; gDNA_ID_2214509; Annot_ID_133797
cttacctgttacatggacacatctgttgatcaaaccttttaaactcaaacacacttcaacattaatttgagagactgagaaatttagtactttatttgcttggatcgttagaatatttgcaccgagttctctgattggcatcattgcagcttcttcacacaatgcttggagatcgcttcctgagtatcctgtaacatagggatagcttacgcttatcagttacttgacttatgaatctgtgtttttttatacaaagtctatagagcttgccttcggtttctttgacgattttatcaatgtcgccatcggataacgagtgaggctggcactttaatttagttttaaaaagtagttttctgacgttggaatccggcaatggtacatatattctcttcacctaacaaagtgataaaatcaaatcatataaccagatactttcctagcaattggtggacaagaaaaattctgatgacaataatgttcttaccaatctcctaagcactgcatcatccaactcctgtggcttgttagtagctcctgcaaaacattacatcaaagtaaatttttaggaaaggaaaacagactatatgtaaactgatactccgagatgttaaacagaatgaagattgagtttgatgtggactgatttagcagaaatcataccaatgataatcaccaaatcatcaggattagaagtcacaccatcaaactggataagaaattctgatttcagccttctgcttgcttcattctcactggttgaccttgttgacattatactatctatctgataaccagagcaaaaacatattcagatctccaagtgacaatatgttgatatgaaaaagatcctttttcagggatctttaggtcttcagtcaaatacaacttatatggtattatctagaactctggtaagagtagttcttcccatataagacagaaaaaggaaaaagtgtgcatacttcatccataaatataacagacggttgtctggatattgcaacttgaaacagcgttttaactagcttttcagcctcacccacctgaatcaatacagtaaagtcagtttgtctattcgaattgacaaataaattcaacaagccttgttagttattacaaaagacagtacagtgacagaataagcacacacccattttgatgtcaaagaagatgctgagacattgaaaaatgttgcctgtgactcagaagcgactgccttggcaagcattgttttcccattgccaggtggcccaaagagaagcagacctaacaaagaagttactttaccaaggacggcaatggagaagataaagaagaaaccaagcttgaaatgttacctctcgctggtcttcggagaccagtgaacaaatctcttcgttttgccggtaaaattaccatctccaacaaagcttgtttagctccattaagtccagctgcaataattaagcataagcttgtttccacatactgcgccgaaaaggaaaaacaagaagaagagcataacattgacactcaccgacatcatcccatttcacagatgggcttctatccactattgttgtatttatcatctcaaccaacttatcatcatagacatttccagattctttcacaggttttgggcttgcagcagcatctttagggttccttggcgttgcaacgccacctctggcaaccggagtcttttgcgataaagttttcctataccttgacgctgtagaggaaactgaagctgaagaaggatatgccaccgtcctctacataacaaagaatcaaaaaaagaattgaagtatacaattaatgccttaaaaatgaattatgttaagcaatcaataccaatacagaaacatatcactaataatctacaaacatcacattctccttccaacatttatgaacaaaaaagaagcaatacattaccttattctcagacattccaacacctaaaatatgaacaccattgatgacagaaacaagtaaaacaaacaaccattagtgtgaattcacttgtgcttcttcatattaatatgcaaaaaaggtcaaaaatttaaaactttatcacctgtacgcttacccaaagcttgcaatctctcagatacttgattttgccaatttgaaatcttctctcggtacgatctcaccttctccttttcactaccatatcattcaacaaatcatcatcactacaactttatttttcaacataacatatataagtcaaaacaaacttatcaaaacctggaactaatatacgaaggagaaggagtagaagtagcttcattcatgatcctttgagcatttctataatgaagaagagcatcatcatgtaaaccccactcttctgctctaacccctttagcgatttcctctttcgctaaatcgaagtatcctttaagcttatacgcaattcgttcgttagtaaccggaactccatcgataccattcatggactcagaagaagttgatgatgatgaaacactaggatctttcttagattcttcgttgagaatagagctaaacgaatcaattatacctctgaggaaactcatatctaagcaataaacaataaaatcgatcatcacttccgagtttaatcaaacaaaaaacaaaaaaacatcaagaaggcaaaattggtttcacgcaccatgttgtgctcgtatatataactcatgtcgagaagattcgaatcaaaatcgaaatcaaatccagcgaattgaagaaatttgatgaaatcttatgaactgggaaatacgcaaacgatgaacaaaccaaacaacacacggtcaagtctttaaccctctacgtagaaagaaggttctaatgggctttacaaggcctatacatatataatcttaggcccaatgatattttatcggtggcccagttttgttttgttttcgatcatcttcttcgccgttaaatattttattctctacggtaccttttgtctctttgtactttcagatactatcgttgacttcgaagtaagaaaagaaaatg

SEQ ID NO: 25609 - DNA, 3003 bp, Unknown; identical to SEQ ID NO: 25608
  misc_feature (1)..( 3003): 2750-1469P.txt file - cDNA_ID_2707121; gDNA_ID_2214509; Annot_ID_184190

SEQ ID NO: 25610 - DNA, 3000 bp, Unknown; identical to SEQ ID NO: 12074
  misc_feature (1)..( 3000): 2750-1469P.txt file - cDNA_ID_2707132; gDNA_ID_2214530; Annot_ID_134247

SEQ ID NO: 25611 - DNA, 3000 bp, Unknown; identical to SEQ ID NO: 13007
  misc_feature (1)..( 3000): 2750-1469P.txt file - cDNA_ID_2707172; gDNA_ID_2214589; Annot_ID_135387

SEQ ID NO: 25612 - DNA, 3003 bp, Unknown
  misc_feature (1)..( 3003): 2750-1469P.txt file - cDNA_ID_2707186; gDNA_ID_2214511; Annot_ID_133833
ccgcctcctagaccaccaccgccgcctaaacctccaccaccgcctaaacctccaccgcctcctaggccaccaccgcctcctagaccacctccgccgcctagaccgcctccaccgcccaaacccttaccgaaacctttcttgtaaatgccatgcttgtggaggaatggacgaggtttgtgtaaaaatggacgaggtttgtggaaaaagtgtttgtcgtcgttaacctcaacatttccgaacgaaaattcagcgactagagcgaatacaaagataaacacacacaccttcccggaaattaaacccataattaactggttcgttttatatggtgtatatgaaagagagatcgaagacagtagttgtgtcagtgaagcttagtcttgacctctatatatagacatatcgtccactcgtgagtacgttacatacataaccggttttgcttcttctttttctaggtttcttatcaattccggtttagtttagtttgttgatttgttcatatatactcaaattattctatttcagaggttgaaatgcttggttaaggcgtaaccgtgaggaaaagtgggaaaccggaattgattaaaccggacgtattaacttgtaagaaggcgaaaaaaataaattggttgagtaaactaaattaaatgaggttcacctgtcataggacaatttatttatgtctgccaactgcccagttgatctcatccaacataacaataaaaatgaaatcaatgtacatttgatgaattcaataaataaataatatcgatgtatatatatatgcacatgaaatgaaatgtatatcttatttccgattaagaaaatgagcaaacgattctagtgggcgccgatggtgaaaaaacctgaaattgatgaaaatatatactacaattggttcatgtactttgtcaaataataataattggttcatgttctaaaaaccagactgatcatattcgtagaatgcaatcatcagttcaccatatgtatatgattcctcataaatcaaccttccatggatttatagcaaaaagaacagtgtgtttctcttttagtgtattttcataaaagacgtaccataaatgaataaattgtgtcgttatcaaaaaaacaaaagtttataatcgtggctgttttatttttccttttatagttgaaggacatgtctactacaaagccattaataatatgagggctcttttgcattattcaagccctaaatgtgatctcatttagtgaaaaaaaagtgatctcatttattatgtcattaatggctcaaaccaaacacatattaaacctttcattttccaaactaacaaataaagaaaaacagataggcttatacattatacatgcatcacccacatagatttagattattaaaaatttgaggttgactggtttgagctgtgaatgtaatcttttatttaatttggactgtttgttgttagaataatggttgggacttaaattttaaagtcaactagtgatttgaaaaaaaaacgaggcttaacaagaatatttaactagttaatctagggctaacttgttagtaagaaatttaagaaatacgtttaatacttcataacactacaagtgtggattgttcatttcacatcataaagtactaaaacttcaaattaagtgccaaatgaatatcctatgcattttttttttgtaaaaaaattagattggttctattgagaatatgcatgcaatcttttggttacagacctctagttaaaggattttaattagttcttattttctatttagaatttgaattagtttcataaaacatatgcagtgatcagtttataaggtcaaatctcaccctcaaaatacaaacatatttcacgagtttgcccaaaaagaaagaactagtatttgacgcaagttttcattttgaaccattcgtaagctataactagaagattaaatacggtagaataatgaatgtattatgggaaaaatgttaaaaaaatcgccaacttttaaaaatgggacaaaaaaatcgccaactcctgaaatgtcatttaaatcatatacttttggttgacttttccagaaagataataaagcaaagattcgtaatcaacaaaactttgctctgttatctttctaaagaactcaatcaaaagtatgtgattaaaacgacatttcaggagttggtgatttttcatcccatttttcaaagttggcaatttttttgacattttttccaatgtattattgagtgtagctacatgaagtatgaaccatttatcttgacatagcattgcgtactttgaaaataatttctttactaataaaaaaacctacacttttttttataataaattttttcactctgtttagaaaccatgaattggctgctctaacgattcaagagaaatttcggcctaccttcgagttgactttagattaaaagtcaatcacaggcccaaaagtaagcccataactaggtccaaatatcgaagcccatgaataaactttttcatcgaatcctaaagctaagcatcaaaccaaacatccgatgatctctccaaactcatcaatctgatctatctctctcttccagctgtttcatgatcgatttactcttaacttacagctgattacaattcactgtaatctctcaagaaccctagattcttttttttccttttcaattgtgatccgtcaggtatgtgaattcgattactttctatatcaattcaacgaattccaaaagtcatgttcgcgtataagcaatttaaccttgtcgatttctttatattttctctgtatgtgtagcagcaatgcttgatctttaaatttactgatatctgaagatcgaattagggttctgatctacttgatatttatttgtttgggcttttattcaggttagtgtctgtttattaaaacaatcgaattattctgagttcatatcatttctttggattgaagatttgaattccttttatagcagctcgatcttgggctgaagctatg

SEQ ID NO: 25613 - DNA, 3003 bp, Unknown
  misc_feature (1)..( 3003): 2750-1469P.txt file - cDNA_ID_2707190; gDNA_ID_2214511; Annot_ID_133834
gtcatggccctaaaacagctatagatcatttataggtaggtaacattttgtttgtttaaaaacagataatgtggatgcaaatttatttttgtcagtaggtatttatatggaacatggaaacactacaagttgagagcactccggaagaacatgctcatatcatcacagatgttcgcttcagaccgaattcaactcaactggcaacgtcatcattcgacaaaacaatcaaaatctgggatgcttctgatgtatactaatttaatttgtttctcttttatttgttgcaatttttcgtgttctgctgtgactaactactaccaatttgtgcagcctggttacttcctacgaacaatttctggtcatgctgcacctgttatgtccattgattttcatcctaagaaaaccgagcttttatgctcctgtgatagcaacaatgatattcgcttttgggacataaacgcctcttgcgttcgtgctgtaaaggcaagcccctgaccttttgtatggtttctctgggatgtgaactctgtttgctaatcgttgaattttccaagcacagggggctagcacgcaagtacgtttccagccaagaacaggacagtttttagctgcagcgtcagaaaatactgtgtcaatttttgatattgaaaataataacaaacgggtcaacatttttaaggtagagctgaagatgatatattgatatttttgaattccccgggtcaatccacataaaagactaaaagctttgttttttacttttaatactttgaatcttcaaagtccagtgcatttttcttgttagatgcattggggcatatgtttagatgtcgtaagtgttgatcgttactcatggctttatttacttttgatctggcagggacattcctcaaatgtacattctgtttgttggagcccaaacggagagttggtggcgtctgttagtgaagacgctgtaaaattatggtcactgagttcaggagattgcatccacgagcttagcaacagtggaaacaagttccactctgttgtttttcaccctagctatcccgatctcttggtcatcggtggctatcaggtataacctatatccccatttctcaaacaaataatgtgtcaaacaatatctagtcttatgttcaaatgtgtgatgaggtgaatgtgtctctcagttgttttaactttggtaaacgaatctgtgacaggctatagagctgtggaacacaatggagaacaaatgtatgacggtagcaggccacgagtgtgtgatctctgccttggctcagtcgccttcgacgggagtggttgcgtctgcaagtcatgacaaatccgtaaagatttggaagtagaaatatttctatgttcgtctgaaaagaaaaggaaaaaagaagaaatagcagagagctcaggactttttttgggtctaattttttttttttttttaatgttacattaataagttggttttttttttaaattgggtttgtttatgtcaaaagcaaagagacttgtgatatttccaatctttgtctaatgatcctacttctttacttcgttgttttgatctctagtgtttagagtgaaagagagatgtaagtaatttctctagaccaactacattgttgaataataatttcttataatcagccaaacgcttgtttttaaggtctctttacgaatatcttataatgacactgcatacattaagttggtttaagatgaatacaaaactctaagcatgcacattgaaagtactcgtacgttaaaacttaggattaaggatgagtttattatctgcttaggcttaaattgtctttgttctgggttacttattgaacttctaatataaccgcatctttcttgaatgactctgcctctctttcaaaattatttgtttcagcatcactgtaacatttattgtaaaaatagtttttttgggtttgaataaatttaactttcaactcaaaaaaaaagaaaaactcgatattatatatagaaaacggaaatgtgaaacataaggagaagtaaaaagcacggttacgtttgtgtttgtttacaatttacaaacacgtctaacttggaaaaactaaaataaatgtacttttttttttttggtctaaaataaatgtacttttttcttaaacatgaacttattttttgtaacagttgagtggttgaatgaatcattaatttaagttatctttagtttctcaatcgataatatatacctactcaaacctttatacaatactataagatataaaatactcctactccttcccaattctcaaaactgcttaaactttcataatcatctaactcttgtaatttatataatctagtcattagattcatcagtatattctcaatattacaaaggctaaatatcttatgctacattatccaagcaattcgcagaaaacaataaaaataaaattgtcaaacatcataagcctagtagagaagtagaagttgacattccaaattcgtccaatctctacctcaactagatttaaaactttttatcctaaggtaagtaaaatacacaaaagtagagcaaaatacgatccttgaattaattcaggttgtgtaaccgttcaatcttttctaacgctgtgacacatatttgaacccaactaactcaaatttttttattttaaatataatttataaatgtggaaaaaaataataaatttataaataaaaatatatgtcatcatttctatttataaatatcgaaattattacactcaagttctaaaatattttttttttttaaaaactaaagtgaaaaaatagcaaagtacattactcacagtagtgaagaagcagccacctgaaaaaaaaaataacacacacaaaaaaagagagagagagagagagagagagagagagagagagagaccccacaaagagcactaatcttcacaaccctaactccgatttttctcacacctcccaatctctctttctttctctctgatgaaaagctaacggaaaatg

SEQ ID NO: 25614 - DNA, 3003 bp, Unknown
  misc_feature (1)..( 3003): 2750-1469P.txt file - cDNA_ID_2707198; gDNA_ID_2214511; Annot_ID_133839
tgatgaaaccagttccaaagctttgggttgtcatctcaagtgcctttgtgttctgtcttttagttctgtttcaaatcaataaatcagatttgatcgaagcaaatctccaaatcactcatcaagttaacaacttcctcatctccttcgttgcttcttcaaataatcaaatcctaaatcacaccaaacatgcgaatgagagtgatggaatcagagcgaaacagcttgaggaagaagaaacggatacttgcgccggaagatacatctacatgtacaatcttccaagcacattcaacgacgacatcatcaaagaatgtcgtccactcatcaaatggttcgatatgtgtccattcatggtcaattccgggctcggtccacagattttggtctccgataaaaccacagctcgagtcttaaccgtgaaaaccggttcttggtactcaacgaaccaattcttgctttcggttatcttccgagagaggatgaaacactacgagtgtttgaccaacaactcttctctagcctcagcgatctatgtcccatactacgcaggatttgatgtgagccgtcacctctggggatacaacgtgacggttagagacgaattggcgataaagctggcacaatggctgagagagagacctgaatgggggaagatgtacggccgagatcacttctttgtgaccggacggattggttgggatttcaggaggtttcacgatgaagattcagattggggaagcaaactgatgctattacctgaattctcgaatctgacaatgttaggtatcgaaacgactgcttgggctaacgaatttgcgattccttatcctacttatttccatccaaagagcttaacagagatttggagatggcagaagaaagtgaagagtgtgaagaggaagtatttgttttcgtttgttggaggtccaagacctaaattggatggatctattaggggagagattataaagcagtgccttgcatctcacggtaaatgcaactttcttaactgctttgttaatgactgcgataatccggttaagataatgaaggtgtttgaaaattctgtcttctgtttacaaccttcgggagattcgtacactcggagatcgatattcgattcgattctggcgggttgtataccggttttcttcagcccaggttcgggttacaaccaatatatttggtattttccaaaggattataccaagtactcggtttacataccagagaatgaaatgagaaatggaacggttagtctcaagaatattttgggtatgatcgctaaggagaggattttgaggatgagaaaagaggttgtgaagattataccaaaaatcatatataataaaccagggtttggaccggagaagattgaagatgcgtttgacattgcagtggataggatgcttgagagggtagcaatggttaagaggatgatggaagaagggaaagatgttcaaagtcagtattattcacagacaaaggatttgaaaaaacttgagattatacatgaaaaaactgcttaagccttaagacattgttaatgaatgcacattcagtatttatagcatgttgaatcacatttcagatacattttggaattgtaagtaaatcaatcgattttgttttacaaggatgcataaattacaaatttctctctttctcgttccttaagatgtggagcaaccaaaaactatatgaatatgatctctcgaaagaaacttaatttcgaatactatataataaatggattttgatgtatgaatgagaatgttttgaaactatgacaagagaatttgacttttcgttagcaagaatttggatggctaaattagatatggaagttaacatacacataaaaagttagctgaatgttaaactgtagtctattcgaaatatgaagtttaaagtagaatgtgaatggtaaatgttaaagttaaattaagatacataataattggttcaaacttgagataaccaggacgaaataattggtttggtacaaagtacaaaacaactttggttaaaggaatcatactttccacgaggaatcgccagttcgccaccagttggccggatcgaacggtgcctactgcttaacccggtctttagataatacccacctgttaagtcattcgggtcatctctgacccggaagtttctaatctctctctctttcctaaagtaacaaactttaaattttctgcaaaatcgaacaacgaatcatcagcccgagaagcttcttcaatcctgtaaatttttcattctacgtaccaatctctcatttcccagattcgtttcttgcttccattgctcttcctttgtaccaatcatcatctccaggtgatcggtttattaaaaattagggtttttgattgttctaatccgatctctcggttcctttaagattgatgatgaatttcgaagcgtgatatgaaaagatctgaagacttgatgtcagaacttgcgttgcgtgggttccgagataattgttgatggaaagagtatcagagcgaagtttgtcagaaaatttgagaagaagcgatcgagaagatgggaagattatagaatgggaagaattcgaccatgagcttacgaggttatggagtctttcttctgctatgaaattagccacagagaggaaacaaatcctgcaaccgaaacttgagtctcttattcaggtttttctcttactcatgtgttttcttttgggcatgtctgaatttgattcatttctgagtgtaaagcatagatttttattagtggcattgtcttaagggtggatgaagatagctagaagaagaaactctattcaaagaaaatttatgctttcttattgtgttggttaggaatgtgttgtttagtcttattattcttgcttatctcttactttatctactcgatgagctttaattgattagcccgcggattagcgggcggcaaaatttcgggcaggttagtactgaatcattgagacgcactaatgaacttgaagaaatg

SEQ ID NO: 25615 - DNA, 330 bp, Unknown; identical to SEQ ID NO: 11695
  misc_feature (1)..( 330): 2750-1469P.txt file - cDNA_ID_2707214; gDNA_ID_2214511; Annot_ID_133844

SEQ ID NO: 25616 - DNA, 3003 bp, Unknown
  misc_feature (1)..( 3003): 2750-1469P.txt file - cDNA_ID_2707226; gDNA_ID_2214512; Annot_ID_133876
atacaaatatttgagcacaagacttaaaaagccttccaaaactattatacaaactcaagaagaacaactgcttcaagttctgtgaaaatcactatttcaataatcgtctcctttggaaataatctctttgcaagttggtcgcaacaggattgtatgctcaaactgagaaatatagcttcctttgacatcacacactggaggacatggctacaaaagttaacccaaagaaacttactttcatcaaaatgttcttgaacataagtcatcagagtatatatatagttttaaggagtttacctcaattatgccagaatcacaaagattctttaaagccatcaagtattttgtttcaccaaggcggtccaaataacgtctgcagaaggctagcgtggagaagttcttgttaatagtggcaaggagttgttttgcccttggtaacctcaaaggtacatgacccacatcatagtttttcatgtaatggctacattctaagtcttctcttacatatcctttccctgcaaaatgacacaagtgaaaaaccaattttactctgaattcgtaaaaatccacatttcttgtatagtttcatgtgagaaatgttgttgttacctgttgatccaaaagtttcaatggcatataattcaccctcttccattttcgtctgctcgcctcctctaacattaggaactgatttttcagcgtgtatctgatagcgtccaatgctgtgcccattcaggtttctgatacttttgactgcccccaaaagacacaacattgttttagttttctaataatccaaatagaaaccaccaaaaaatgctgccacaaacgtaatcaattaccttggtagacttttccattgatttcaacctcataagactccatgacctcctgaactgcagcaccaacatcacagagccggacatctaccccggcttcctaaaccaacaaaattaataacacaatggacttattcagttggattgaacgataaagatccaaaaaagaagctcaatatggttataagaaaacaatgcaaacttcaaagaagaagtcactacagaatgaatggctgcattcaccatatccaagaacagaagaatcccacaagtagcaacagaaacagaatgagcaccttgataccagtatatgttgcgtcacgcgaggctgctaaaagaggatcaaacataggattgaacgcaactgtaaaagcagaatcaacaatgtgccctgccaaaacaacataataattgttcttatgagacatctacgttgagaaaatacaacaaacagatgataagtttttgtttttaccataccatcaatatgtgttccaaaatccagcttcatcacatcatcatactgaaggacagtcttatctccagagtttggtgtccaatgagcagcaacactgaaggttcaagtaaatttgagacgcattgatagagccaaagatcaaagaaatgcagaaagaatgaaaaaggttgaactaacttattcagtgaacatcctgtaggaaaggcgataccagcttgaagaccattctctgatatcaacttacgaacagtgttctctaaagtctcacagagatcaatcatcaacattccaggcttcaatatacttctcatatacttcctaacttgacgatgaacttccgctgcttggcgaagagagttatatatcggcttttgcagcctctccatctctctcttctcttcagatgttgttctccacaaattactacatcacaacatagacttagctagcaaaacaaaatgtccttatagaaaatctagtctagacttactcatcattgtactgttggatttcaccttgaggaaaatctccagaagggaagagctcaagaacaggaattgaaggaggatcagtctgttgaagagaactcttcttcttcctaaaaacaatcatcagatttttgagcaagatcatcaaagcaaacactgaagattaacagaaaaaagaaacaacttctcacttgcttttacttttcttcttcttcttcttcgttgaagcctcagctaaaatgaaaagactaaaagtctcaacaacaataaagctagagaaactctaaaccaacttcacatacactagttcctagaaagttacaatctctgatgacataaccagattgattaatctaaactagtaataaacaagaacacacgaaagagaccaaagttccatctttttcccgtcataattacatacttcaactacaagatctatcaaaaacacgaaatgatttacctttcagtccatcttcttcttcttggttattatccttttcgtcttccttcacttcagccagatcaagactcttcgttaagtcagaacttaactgagactcgtttccattagaggactcggcttcagtgttctccttccccatagttgctacttctgggtttcctatcgccatctcaaattattttaacaaggaggcttaatgagaagaagtgcagaagaaagttcatcagaagaagtcaaagtctcctcttttcacctctttttcactcccaacttttttcttcagtctatccaggaaaatgtcggaaggttaaaacaattgcaaaatgatccaacaaaactttcatttatacatttataacccattactttaaagaacacaaacgctccttattgggcccaatattaataggcccaccaacattaatcctgcttatcttttttttcaaaacattaatcttgcttatcttatctgattaatttaatttaatcgagaaagcaagacaaaaaaaaaacctatcgtttcacggacaagaagagaaccgttgcgctttgtgaagcatttactcaacggctagtttccttcttcttccccttttctcttcctcttcgcctagggtttcgaaaatttcaatccgatttgaataatttctgttttcttatcggaacaaaaaaatctccggcatctggaatctccggtgattttgtcaatttcgaagaaatttgattgaaatg

SEQ ID NO: 25617 - DNA, 3003 bp, Unknown; identical to SEQ ID NO: 25616
  misc_feature (1)..( 3003): 2750-1469P.txt file - cDNA_ID_2707226; gDNA_ID_2214512; Annot_ID_184308

SEQ ID NO: 25618 - DNA, 3000 bp, Unknown; identical to SEQ ID NO: 11701
  misc_feature (1)..( 3000): 2750-1469P.txt file - cDNA_ID_2707257; gDNA_ID_2214512; Annot_ID_133847

SEQ ID NO: 25619 - DNA, 3000 bp, Unknown; identical to SEQ ID NO: 11701
  misc_feature (1)..( 3000): 2750-1469P.txt file - cDNA_ID_2707257; gDNA_ID_2214512; Annot_ID_184272

SEQ ID NO: 25620 - DNA, 3003 bp, Unknown
  misc_feature (1)..( 3003): 2750-1469P.txt file - cDNA_ID_2707261; gDNA_ID_2214512; Annot_ID_133873
atgcctctgtttttatttcacttttcttgatctatctatttcagcatttcattgatataagaccataattatctgcttgtttaagtacattgaactggaaaaaaccttatcttttgtgttaggatgctattctcaagctgttcctcaagttgcaagtgtgggagtgagtgtaacaataagccgttccaacaacgacatgtcaagaagatgaagttaattcaggtaatgtgtgattggttttggttggatagagtggatttttgttgttgtcggtttgttattttagttgtgtcttgtagacagaaaaatgcggatcagggattgtggcagaagaagaaatcgaagctggagagtttatcattgaatatgttggagaaggtgatgtgactatttgatattttgtctccctactgaatatactgcgaccatggtctaatttgttttcttttttcgtacctttgctcaatgtagttattgatgataagacttgtgaagagaggctttggaagatgaaacaccgtggcgagacaaacttttatttatgtgagataaccagagatatggttattgatgctactcataagggaaacaaatcaagatatattaatcatagctgcaaccctaatacgcagatgcagaaatggtttgttgttaactgtcaacccttagtgcttgtttcctagtttagaatacttgagagagaaaagtcatcatttggtttacttttgcttgcaattaggataattgacggcgagaccagaatcggcattttcgccacccgtggtatcaaaaagggagagcatttgacctatgattatcagtaagtttatatcctccttctccagtttactttgtaacatatctgtttttatgttgagttgtgacactaagaaatagagcaggtttgttcagtttggtgcagatcaagactgccattgtggggctgtaggttgcagaaggaagcttggtgtaaaacctagcaaacctaagatagcctcggatgaagcttttaatctagtggcacatgaattggcccagacactgcccaaggtattttcaaattttatctgaaaagaagaatcaaatatatatctcgtctttgccctggcatagtttcacagtcactgaaaaatttgtgtgatgaggtctaagtgactctttttctttccccacttttggttaggtgcatcaaaatggacttgtaaatagacacatagatgcaggtaagtttggattttttctgctcaatttgcgagagtagcttattgtgttttggttgtaagaaagtaatttggattcccatgtttctccaggaaaatcatggaacaatcttagtcaaagggatacatgttcgcgtaattgcattggtgtggtgatcaggttatctcgccccacgagtgataggtatttattgagttttgaactcgtggattagttttatgactcattctatgcttttctcatccaatgttttatcttttgagattttcaggtgttttggcctcgttagacattttgatgagtattcaagaaagcactcggtattacaattagccaatacttgttcctcaccatcgaacttggcaaaatcattctcaattaagacctctctgttaacatctttaaacttggtccaggtgatgttcgaggatggtgttaccgagtttgtcgacatgtcgagagaagactgggagattgtctaatattgttttcaggtgatttatactcttcactctcttaatgaaacattaaaactcccagaagcatagagtattaaattaccctggctgctatgtttctgcagattgctttgaagttgagaaaccaaaataacctgtcttggtaaactaaaggtatcccaaaaaacccgggtctgactgactgggattggtgcagtgacattgtttgttgcgtctaacttgtgacctgtgtttgtacaaccattataagagatatcatatatctacttgtgtaaccacatctgtactttcttctccttccttcttttttcatggggatctcaaatgatgatgtcttgcaagaaccttcgtggtgtgtaattgactttgtaagaaccggtaatctcatatccggtttagcttttaaaaatttgtatccaaagaccggtttgttcttgtttgcatgtgctgttcttattcgtgcatctgtgtgagtgtgactgtgtcggtgtcgccgacaaaagccggtgtttgcaaaatctgaccagttttgttttagcgattaacgtttcaaattccttcaaatgcaaaatgagttaaacaagtgaaaaattactaaaacaacataacagttttaaattggaaaaagttttgtaaagtttaaagatacactgtaagtgaaaaacggaaaattttaattagattttttttttttttttttttttttggtaaaagtagattatttttgttaaacaaaagtgatggatcattggttttttggtagtaggtgggtgatgtgggtgtgtggttctggttcaccaactcaaaaagcatagactgcaggggttggggattgataacgacaaatctaattgtggttggtaaatcttttactaatcacattcctttaaaataattatgtaactcatcttgtttactaatatcaactcgactatcttaatatcaaataactcggattcttcatttttttcactttagaatggtttggtaaatctcttgaataataaacactttaataaaaatgtttttttttgtcaagcataaaaatgtaactcatgttgtctaactacatggattttcgcacaaaacaatgattaaatgtaaattatgtaattatactttatttaaagtatgattttgtcttaaaaatgaaaataatataaggaagtggacgggtaaggtaaagtctaaaattcaccaaacattttggaatctctctgtttactataaagcagtgagtagaagaacctgaaagaactcgcctttgtctctcattcttcttctccatttcgaaaagaagatg

SEQ ID NO: 25621 - DNA, 3003 bp, Unknown
  misc_feature (1)..( 3003): 2750-1469P.txt file - cDNA_ID_2707265; gDNA_ID_2214512; Annot_ID_133867
cttccacgagctgtcctcttagcttttgtgagagcagccggccacccgcatccacacactctctgtacagtggcatgtaggcgattgccactctcaatggtgctgggagatcctttagacttattgcagactctccgagtttcaaaactctcatgaaattcatgtaattttcccggctttccttcaatccttggttgaatgcagcttctgaccactgttcttggagaaacgatttgaggtcggaaggaacagactcgtcttctgactttgcaatggtgtctgcaactgaatatgtggctgctggatccccgaggaaatctgatttaaggagaaactctactccgtggagggaaccaccacttctttcaccggctgctttgaggatttcaatgctgagagcagtaaggacgggtcttggaacatgaggaaggagataagcagcaacctcaacctggctgcttgaagtggcggctgtgagagctaagcatagctccatttcacgacagcctcgtttcacaaaccattgaacaacttgcatgcaacctctctccgctgctctcatcaagggacccaagaaagcaattgcatgaccttcttctacaaggcaatccatcgtttcgattttactataatgcgaggcaaaaccaagggctaagtcaacatccacgtctaagctattcctttgagcaatctgcaccaggaaaaagttcagttagattgcacaaagtaacttgcaagcagtcattaagaattagatttacctgcaacaagatgcgcacaagttctgtgctcccaaaacgagaagcttcaaggaagcactgatttacattatctgcgcctccttccaccagcataccgagcaatccatgtatgacagtagctgaaattccagaagcccagccaggattaaacgaggtagagaacagcgtaagcgggaagcaagctgcatcaaaggcttctgtgaaatcctttcctgatagatggtttcctgcaagatctaagaacatcttgaaagcagaaagctggagttggatctcagcagctgagtcttggttagctttatctctagggccctggcatcgggagtgaaaacctatacatttgagtgcccattcagtaaacttttgaactttagcaccagcttctgctttgaggacctcatcaccgttacactcttggagacgctcgtgcaacctggaaacgccgagatgggaaaaaatggatttatatagaaagggtatctcacccttcccagctaaccaaagataaaccaggaggaataagaacataagagatactatagatttaacaaaaagcgatttctaagaaaagttaacaacactaaaacacttgcagatgtaaccaaccaatgtaacatgtaagacacaatgtagtgatcatataaagcaaaaacaaggtatcataacagaaaccaacttctccaataatccaaaagtgttttaccataattatactgagaaaaaggggaaacatcttataagagaaagtatcaaatgtgtacctttgagccataacagttacagtatcagcaagactcacagtccggctatggcaagatgaaacacaagaagcaagaaaggaagtcctaagtgtagctctagtatagtcctgagcaccatgacatatgatcttagcaatcaattcagtgattccccgtaactcatgctctgtgctcaagaaccaaatagaatctaaactaatacacaacagatcattcaaagtttgtggatcagccagctgaataaatctctctgaaagttgccaatcctgtgagctaacagcaccttggaaaagccgtcccaattcgattctatcctgtctattaagcttcttctgttgctcaagacccctgcatttcagtatctttgcagtagatccagagcatttggtcggttgagtgatgatacctacaagaggtgactctcttgcaaaaacaacatcactctcttgaggttccaagtcagaacctacaggctcatcaggatacatgtcatcgttctccatccactcagatttccaaaatcaataatccaaaaacttgttttgacattcgaaaaacctttgcaataacaatactgtataccaacaaatcccttcctccttgtacaagcaaatgtcttgtaccaaaatcaaaatccagacttgcgcaatcaaccactccaagaaatcaaacccaggaagaaaagaaaaaagagactagagatttcgttcagaaaatgcggtagaatcgattcacgagagcgaaaagggtctgaattttagcaaaacgtagtcaacagaagcatccaaaccttaaaataaaataaaaacagaaactgatcccaatcagaatccatggccgagcacagcaattgtgaattcggccatgaaaattgcatcggaaagaagaagaaagatgtgaatttgcaaattaccaaagaagaacattcgtagaggagatgggaagatgagcgaacctggacgagattttcattgagaggtcaagagaacaatgagagaatttttttttatttttttattgtaaaaataataattgacaaaattaattaaataaatttgctttgcactcacagaacagaacagaagatgacattttctctattttcatatttgtctttttggtttaatcgactggttatttatttattaccctaaaaaaaaacggaattgttttagaaaatgctaattgaattattagattgcttcagacagcaaaaacattattgtaaatctatttattacacacacaaaattacttttaagttttacttggtaataatatttagatttatccaaatttcaatagccaaataagaaaaaaaaaagagaaaaagcatataagaaagaaagcatctttggacttgtctgattttctctatagacgcaatcaccgccgattctctctctctctctctcgagtctctcgacggtcgcatatcaaaagtccatttctttcttctctttggaggatcagcaactatg

SEQ ID NO: 25622 - DNA, 3003 bp, Unknown; identical to SEQ ID NO: 25621
  misc_feature (1)..( 3003): 2750-1469P.txt file - cDNA_ID_2707265; gDNA_ID_2214512; Annot_ID_184296

SEQ ID NO: 25623 - DNA, 3003 bp, Unknown
  misc_feature (1)..( 3003): 2750-1469P.txt file - cDNA_ID_2707269; gDNA_ID_2214512; Annot_ID_133863
ttaaagagtttaaagctcatctccgtcaatcaaaacgtgaaattcgtaggtttcgaaacgtacccattcgtagccataaaggaatttactctccaggatacggaagttttgttctttgttacgacggagtcaaaagtttaaatctttcacttttgtctgaaaatttccggccggtgagagtgattggggatgtagggtttagcttatcccttttcatcaaaccggaaatctctaaccaaactaatagattcaatgaaaccgtaattttaatgaaaataataaaccggaagccttgaaccgatttgataagctaatggacctcacagtctcactcttaacctgaagaacgaagaaccgtctctaaaactccgacgaacgaaaaatgaagtcattagcttcgccgccgtgtctccgcctgataccgacggcacaccgtcagctcaattcgcgtcaatcttcctccgcctgttatatacacggtggctcttctgtgaacaaatccaataatctctcattctcctcatccacatccggtaagcttgctttctctcacttctcttataataactcaaatcgttttttcgcaatttcgtgattgagatgttaacatttggtgttaggatttgcgtcaccactagctgtagagaaggaattacgctcttcattcgtacagacggctgctgttcgccatgttacggggtctcttatcagaggcgaaggtcttagattcgccatcgtgagttctcagaatcgctttcttactttgtgcgctgcttagatttagtgacttggttctgatttacagtgaaatttgaaaactttgagctcaattgcagtgttgacttggttctgattcatttttctttctcaaggtggtagctcgtttcaatgaggttgtgactaagttgcttttggaaggagcgattgagactttcaagaagtattcagtcagagaagaagacattgaagtaaaagtcttttgcttgtagaacagaataaaaagttatgagctttcacaaagctaatgacactgtttttattcaggttatttgggttcctggcagctttgaaattggtgttgttgcacaaaatcttgggaaatcgggaaaatttcatgctgttttatgtatcggcgctgtggtatgattcttgttttgaaagaatctcaggctattccatttgtttttctcctcatatggcttcagaaagtagttgctttatgttgataacatatacttaaagagttggattttgatattactgttgtccttgttgtggtttagataagaggagataccacacattatgatgctgttgccaactctgctgcgtctggagtactttctgctagcataaattcaggtttacctcgatacttatttgctggatatacatctttagacatttttatttgacattgttttggaaacactgaaagattgattttgtatacttccgaacctaaaagagcgggtagttcatttttgcttttctttggattttggatgtttaaattccctcatcatgaattacttcttcaaattttgtgtttacgcactattgactctagtaattaaagcttataaaaaatccaatttgcaggcgttccatgcatatttggtgtactgacttgcgaggacatggatcaggtttaagttgtgttatgcaagagttgatgatatatagcttattcatcataatggatgaacactgaatttgttaatattgtggttaactgaaactctaggctctgaatcgatctggtggcaaagccggcaataagggagctgaaactgctttgacggcggtaagtatcattatgattcaatcctttattgttagaataagatgtagaaattcctgatcattccattgagcaactggtcatgttataaccattcgggttcttatgtctttttggtaaagtctttgaatatttcttcctcttgtttttcagctcgaaatggcgtcgttgtttgagcaccacctgaaatagctcggctcgttcgatggatgaacatgatcacgtatgagaacctcttgatgttgtcccatttggttacaatccagtctctgaaattgtttgtacctcaaagattgtcaaaatgttttacccttggttacaaaatcatttaaacgcttttgtaagcttctggccttgttttttttttttgaatcgtatgataataataattcctccgaattttgggggtctttctgtactaatcaaaaatgtgatcttctttgttgtaatatcttgaaattgaggtgtcgaaatggatgtcaattttaaaagccaataaggatcttacacgacgaaaattttgtcggcgagcgaagattacgcgtcacattgataatagttaatataaagttcaacggatcaaccaattccacaatctataatcattttgtgactcttggagcactctcttctctttgtctctgtgactcacattcatccaatccaggtaaaaatcaaatccactaagttttatttctcttcattgttgttcttgcgttgatccttcatgatttgatcggaatacatggaaaaaggtggtgtaattagatcgagctttttgtttctccgatctgtttgacatttaggttgatctagtgctatcatgtgtagatcgaacattcggatctgtatttcccacgaatcctcttgattcacgtgatatgatcattgtctcttagtacagagatgcattgtatgttctttggtttgggatattccactaggatcctagttgatgatatctaatgtgatgcgagttctctatggtctttggtgagaaactttgttttggtgattatagcctcttacaactactaaaaactgtgattacactttgtttgacttttacaaccattgtcctgctgtgattgatgaatctactctcggcgttgaatgcttgaagttttgtctattctttgatactctaagcttttgtttctgtggcactaattgacttttcttgctgcttaggaggcatg

SEQ ID NO: 25624 - DNA, 3003 bp, Unknown; identical to SEQ ID NO: 25623
  misc_feature (1)..( 3003): 2750-1469P.txt file - cDNA_ID_2707269; gDNA_ID_2214512; Annot_ID_184291

SEQ ID NO: 25625 - DNA, 3003 bp, Unknown
  misc_feature (1)..( 3003): 2750-1469P.txt file - cDNA_ID_2707272; gDNA_ID_2214512; Annot_ID_133862
cttattgcagacattgatggagcttactttccctcatttgtttctcatggcctatggaacataaaaccgttctttggtgtctcatgagaagcccatttaaagcccaaataagctgtcactgttacacatttaaaagactccccggagttcttcttagttgcctgccctaaaatgcataccgccaagaacagtcgaagtgactcatttgttcaatgagaataacaataaaagccaaaaatcttaacaacaccagattgaataaactttgtcgattaagattatatacaagatgatttcaatctctgcggattgagtggtcaagttccttactatgattatgcacttgatctcattttagatgttgaatcatcaaatggtaagtgaagggtccatttgatgaatttaggttttactttgtctgagaattgttgtggagaagtttgatcaataagacttcacttcaatgatccagaaaggagaataacattgaggtaaagaggtcaaaacatgaacaatacaatggcaagttcttgtatataccaaggaatttcaaaagcctgtgctcaaggcagaagaagtgggaaaccaaacatctaattttcacagctgatgatttggtaaatctaatctcagctcttctacaaccaccatttggtcaatgcactggcaaaactcgaaagctcaacgcatatttccctctctcaagacatcgatcatgttgtagattcgctgatctgctttcaatcgaatctgcatttcacaaaagtgttgaatcaacaattagcattatagagaagagcggtgagactcagagaaagctgagattcaatttcgcagaatcatgatgagcaataagagcaagctttagaacctttttggcgaggaagagcacggcatcaacagtaccctcagcataaattgatcggccgcagacattgtgctggaactcgaaggagacactgcaaagaaagacaaagaaaagggagctagttatggaacagagacacttttacaatggaaacaaagaaaagtataaacaatatcttagatattgcattacgtttcatcgggtgatgtcaagtgataaagatggaaagcgtgaccagagatatgctcctcaggtacacccaccatctccacttgctgttttggatcccgaatcaattgtatctgccacaaaagttgtatacacagaaaattcacattccgaggataaattaagtgattgccaagatgtaaacaataaaggatgaccaatgcacctgatccatgtcgtaagacacacccaattcctggaagcaagaaataacagcttttgctgttccggatgcatccaatttgctagcttgatgagactccatcacctacatatagattggcagttgattagatgtagcaagaagtaatataaaactaacagagaaagaaaaaagaatttgaatgtataaaagaagtaagaaaagtacatccaaggaataaccagaaaaggctcccggaaactgctcagccatgatctccatggccgcaagaaatgctacaacctatagaccaacaaagcacacaaatatgagcaaaaatgatcttaacttacatgcataagtaatcatttcttccagaaacattcaagtacacatacctgtttacccatctgtggagaaatcacagcataaatctttgcttcctcaacagtttcatacaatttgttcctatctccaccagttgttcccatgacgaaaggaacacctactttgctatacagctccgcattatctacattttgcgagaataccaaacttgaaatcaacaaacaatagacaaaaaaaacacttctagcagatgattttcacttgcacaaattctaaactaactcaatcaaggatcgttccgccaaccagaattcaaccataacttcaacaaatctagaatacaattgtcttttgatggtagaaatgagagattctgaagtttaccatttactgcagagggaattgtgtagtcgacaacaattagctccgggtgcttctcaaacaccgaagaaagaaccttttctctttcagttggaccgtgcacagtaatctcctttccacagacctcaactctctgaccatcctcaccagcagatccaaacgatatgggaacaatatttactcctgcagagtctgctgctttaattacagctttccccattttgccactacatccattcacctgtagaataagagataatgaatatagctaaatccaacataaaaatccccatttcaaaaggaacaagctttgacatttctacatttcaaacttaaatggtaatgcaaagtcaaatctcacaactttgagtctaagagaaatcatcagatgatcaggtttaccatgatggatatgccatttccaggcaaaacagatttcacggcctcctcaccggaatccgccatcgccgtcatggataaaaccaccggaagacgacgtgtcccaatgcccatgaaactaacacggcctttaccgtattttcctacagtctgattcgttctagaagcaaatgcgatacgcgggcgatgaagaaacacactggacgacgccattaacctgtgatcaaatcgtttaaattcaatagaatcctcttaaagagtttaaagctcatctccgtcaatcaaaacgtgaaattcgtaggtttcgaaacgtacccattcgtagccataaaggaatttactctccaggatacggaagttttgttctttgttacgacggagtcaaaagtttaaatctttcacttttgtctgaaaatttccggccggtgagagtgattggggatgtagggtttagcttatcccttttcatcaaaccggaaatctctaaccaaactaatagattcaatgaaaccgtaattttaatgaaaataataaaccggaagccttgaaccgatttgataagctaatggacctcacagtctcactcttaacctgaagaacgaagaaccgtctctaaaactccgacgaacgaaaaatg

SEQ ID NO: 25626 - DNA, 3003 bp, Unknown; identical to SEQ ID NO: 25625
  misc_feature (1)..( 3003): 2750-1469P.txt file - cDNA_ID_2707272; gDNA_ID_2214512; Annot_ID_184290

SEQ ID NO: 25627 - DNA, 3000 bp, Unknown
  misc_feature (1)..( 3000): 2750-1469P.txt file - cDNA_ID_2707274; gDNA_ID_2214512; Annot_ID_133849
gcaaaacaccaactcttctttctacctgaaaatccaactatcaagataagattgcacatagtttcaataagagcagtgaaatgattttggtgtgcagcttaaatatgttccctaagttcactaggccaaatgggtgacaataaagtttcacaaacaacaactcatacgagaagctcatctgtacaagaaaacagaaacatgaatgggataatggcagtcatggttttaaaaacataaaacttgcaatcatatattgtaataacctcatggatagaactggaagggtgagacatttttgacgactttgggggtctaaaatgctgaacaaccgatgtttttaatccactacatacttgaaggtaggagaagagttgaagatgacattggagcagaagcactatatggggttcagatgtaacatttccatgtccaagtgcgtttctgcagagagcttcaagtcatcaaaaatcaccaaccaccactaaatgtgaactttatagttatctaaaattatcactaccatcagatatcatctagaatcaatcgtaactaaaaaaaaaaaacaactttcaaaaactagataataacatataggagctagcaacatgtatactatttcactttttttagagtttctaagccaatcagaaggctctatttcacacccactcgcacaaagtgagcgttgagcacgtgagagcaattctgtgggtgtacccctttccaaaacacgcttttttcaatcgacgcatctgtctccaaaatccccatcgcgtgaatattttgtttgttacttcttctctatgtaaaccgaaccgcaaatcaattctaatttatttcaataccatttaaacctaaccgaaatcaattgaaattagtaatgactaaccgaagaatttaaggaaattccgacaacagaagaagggagtatacgggagagctcgcgaatcaccgccggagcgatggagtaaaattggtacgattttgaaaaagagaagcgtggtggaagaatttcggattaggattttgatagtgtgtaaacgacggtggtgatccatgagctccgacgacggcgaacctcactgagtttgtgtgtgattcgaaaacgtaacgtttcatgtttagcatagtttaattagatatagtgcccatttaatcaggcccattaatattattcggcccattggtttccttttacataacatatgggcaaaccgtatgcaagagcttttataacattaatgtttcctgtaagaagcatctctctcattacaacacatatatcgtgattctgaaatgtttctttattgattatgttatgcagttagctgatcgcgttggtgggtctccttaccaagaatcagtctcagcgtttaaattttcatcttctccttggaccctaacctttttcataactctaacaactctcttaattaatatctcactttggttaaaatgttttgtagctatgaagagcttttgattcccttgggatttgaggtaatctctattgtggataacgaacttgctcctgatacacgcaaagtaaacaagaaacagtctctagtttctttgtgaacaagaaagattttaaaagaaaaagtttaatatttgaaatcaatatttagggaatggaaaaagttggcagatggaagaagaagaattcattgtaatgatcctcaataccatcacaatcacactataccatggctctctatatacatcaataaagattacagttttggatctcctatagtaagaaccgagtgtactatttacacgtctagatgaataaatgggtccaatgtttcagttttttaataattatatgtgtagttgcatataccttataaacaaacatttatgggtgactttgttgtgaaattacaagtccctttctctttatggtatatgccaaattttcatccataatataccttactgaatttggcatataccttaaggagaaagaggtgtgtaagacaacgcagtcacacttcaaatatatttttgtcgttatccgttttataaaccaatgtcggcagtttcacttttaattttaaatcgagagagattggaagttatgccatactctgttttggagataagaatgttcaccactagcaaatggaaatagtgttgtaattgaccgctaaatgctcactttggtatcaaacttagtgatgttttagccaaaaacatcttgtgaacattttagcaaatcaaattagtgtgtaaaaatcgtggatagatattgtgacagaaaaatatagatattggatatattccttacaccattccccaatatattttcatactaaaaatggagttctctaatgataagagcaggtggaggttttcaccaaccctttactttatttcggaagatcatcttttccataaacttccgattccgacaaactcatacactgatcggtgttaagaaaccgttaatttttgctgacatggatgcgaagtagataaaaagaaaaaaaaacgatgtttctttgttcaaatcacagaattagaaacaaaatcaaaagtctaaatagtcgtcgttaacgttagtataaatggcatagacagaaattccttcagaattcaaaggctgctatcagtaggtgaacagttgacaaaaagttgaaagaaaatataataggcccaagaaagcccactggtcatatttctttgaatttgtttagcttaccctaatgcgttgtccaacttatcctgtcgttaaatttgtgatagacgttgccgttttatattaaagaatgactttcttttttggtgcaaaatattaaagaatatgactatgcaaatatctctctatacaaaagtatgtatatagttgggtgaaagagcacaataataatcaatacaaaattaattttattcagtcattgtttaatatgtttttgttaaattcattaattaatctgttaatctctctataaatagatatcttgtgcttgaagcttcccacaactactcaaaatg

SEQ ID NO: 25628 - DNA, 3000 bp, Unknown; identical to SEQ ID NO: 25627
  misc_feature (1)..( 3000): 2750-1469P.txt file - cDNA_ID_2707274; gDNA_ID_2214512; Annot_ID_184275

SEQ ID NO: 25629 - DNA, 3000 bp, Unknown
  misc_feature (1)..( 3000): 2750-1469P.txt file - cDNA_ID_2707292; gDNA_ID_2214513; Annot_ID_133897
ctcccagagttgaaaattcaaattctctctctctagctatggcgctttcttcagctttcaaggagaggctcgatcaaatggagttcaccagaaaccaacgactcaatcttctccaggtatcgatcaatttagaatcctagcttctcttcgttccactgcatcatcgagtttcaatgtcgctagtatgtaaatgtgagaatcgctatatccatgtgctaatcgagatctctggtttgatgaactattgctctaattcaattcgaaatcaagagaattatctaaaaacagatcattatcatattctgcatcaatttatcgatcatcactataacagtatttttcaatttgaaatttctgaatccaaattgttgatcgttttctggttctgtttgattataatgtttgagtaggcggagaaagaactacaagtgaacaaagcacagattttagcatcgaagcacgcaactatacaatccattgaacgcagatgtttgatgctagaacagaaaatagcagcacaaaacctgaagatcacaattctcagatctaacatcgatgatctcgactccaaataccacagctatatacaacaattgaggttaaatcattcttgactcttggtttgatgatggttgtgatgtcataataatgtttttgattggtttctgttgaatggtattggagaataggacactgaagattgaggttgaggagctgaaagagttagatgaagagagggagaagtattacaaggtgaaatgttcagagatgaatgagtttatgcaaaatgttgagaggtttagatcagagaaccggttacaaatcgagaacctgcgaaaccgaatcaaggaggtaaaatcacagtcaagtgtgtggttttggattaagtagtgatttgtagcattgtatgctttagttatgtattatcaatctttgtgtttctcagcttaactcaacgttcgaggaaagtcatcagaagaacatttatctacagaacataaattaaggtatgattctgaattcctaatcatcatttgaagagagatgtaaaagtatattgagcacggttgtggcctgtgggaattacatagggaaggcttttatgagattactaaatgatattatctttataaaaaaagagattaaaatggatacagtattcaagacattttacatcactagccaattgcagcctttagatatattatgaaaaagaaattaactaaaataatagataaattacagaaagaaacaatgtaataatcattgtgagttgtgacaataaatatttgtaataaaaaaggatctcacaaaaaaaaaattgttaaaaaaggaaacacatatgtaagcaagatgccctatatattacggttttggaataaaatgttaaaaatagtttaatagatttgattcactaaatacacatgtacatatttgatggcatgatgatcaagaaagtaccgtaaaatgttaaacttccaatgttccttagtgaaaaaggtaaatatgtatttttcacaaatgttaaacttgtcatttgtgtgtttgacaggacgtgtatataagcataatctataccggagaagaagaagtcacgaaacaaagttaaaaagaagaaattttttggtgtagtgaattcgaagagcaatatgatgaatattggttacattttaaccatcgtgtttgttggtctcatcctcatctcggcttttgtggcgtgtttctattgcgccaaacgattactcaaatgttgtggcggagaggaagattcgcctgctactgctactgcgtctacgtctacctctacgtcttctgcgtctgcgtgatcaacttttagttatttgttttggtttgtttctttttctttcaatgattttagattagtaacctaaaggcatagcagatcgataatgagactcggcaaaatttttatctttataccgctgcttaataattaagttttcacttatttaatgatattgtacctctattcttgatctttcaatgattttgttaaacattaaaaatttgcaatgttattgttacatgttacttctatatatatagaaccaaaacgaaagcaatacaatactatgcaaatacatagtagagatagcaaaatcaacaaataaaaacatgtaagaagagacatgagctcatgaaaagaattcaagacagatgtaccaagcctgcctagagttcaagacatgtcatgatgacatgacaacaaatttgttagcttcttctttagatctagcgcaattgcagggtttgataggaacaaataactgattacttgttagattctggatctacataccaaataaaagaaataactcattggcaaactgtactttgaaaacatgttttccattttgtctccagcttacactcttctcacattagtctagtcaatgttaacttgtcattggagcactgtgggtgatcataaagagaaagaaaaagtgttcaaggtctgcaaagataaacatactttttttctagtttgtgtttggtgaacagcctttgtggtttttcctaaaggaatttcaaatgataaacagactacaatgcaagatgaagagtactggactcatgacaactaacaagttgtttgataaaaaaaaaaaaaacaagttgtttgattctctcgctaactgttcaagttggaggtcgagagcagaatcctattagcctccaacatttttgcaaaatattaatataattcagttgaaattgttaccttacaaacaattcaaaatttaggacaaaaatcgaaaacataggttagtaagtttgccaattatttgttttttgatgacgatggtaatatcaccaaaacgaaccaagcaaaccaataaaaaccgaaatttccaaattaataagttaatcggcggtttatctccaccgaacaagaaaaaaaactaaaaccctaattccagcgtcgtcttcgcgctctgagaaaaatcgcagagtagagactagaaggagaagaagatg

SEQ ID NO: 25630 - DNA, 3003 bp, Unknown
  misc_feature (1)..( 3003): 2750-1469P.txt file - cDNA_ID_2707298; gDNA_ID_2214513; Annot_ID_133902
ataaaaaatcaattgcatgcttgttatcttcttcaattaggttgcataaaatggtaaatagcctaaatgttagaccactatacacgatctttttttaatgaaagatacactctacacactaatctctaactttgaataacaaataaatttatggggaaaaaaaaagcgcgatgatgcaagaatagtcgagaaattagccaaattaagataatcataacacttgtacgatgaattctagaccagccgccaatgtgtgagctcatatgaatttcgctaatgccacgttatacaaaacttaaccaacaagctgatagtcaatccaaattttctatgattacaatatgatgtataaacatattttggcttcttatgatgatagaaaaaaattaattaaatgtctggcttagtaatgaattttatttgctgacgacccaaaaatttgacggatttgtcgagaactgcaacaattcatggaaaaatgactgtaataatagaggtttgaaagattaaaataaaaacccattcgagttttactttcactccggataaagaaacagataaactcacatcaatgatcaatccttttgattgaatcttcaaattttatttttatatatgtaaaatttgaatcattaggtgatgcaacaaaataaacttcacttttttatagatacgtggaagcaaatctatcatatatatgttgttttgattttactttgttgtgctgtcaaagcgtggtacattatttttcttatattgtacatatcaaaggtacctaatgtaatgtataaatataagaaaaataaaaatttacggattcctgttgttgtcacaaggttacgtgttgacgttatgcggtactaagcctctgtaccttgacctaaaataattttccgatttgcttatatcacccgatatcgacaataattttaattttgtaattatcttaatacaaacattaaatgtaatgtacattttccaggtaaacaaaaagaaaatcattgaataatacttgcagaagacgattggtatttccacgtaactcaacatgaaacgacaaataccgaatcgtggcaggatccgcaagtaagatatagtagttgaaacaagggtaaaatgggaaattcacacactcaataattcaaacttacgatcacaatataaatagctccaaccatgaccaatccaaagatcatacacacgagacctcaagtcctcaaggttcaatttttcaaatccaatgcccaacttatcaggagctatccctgaaaatgacagaaatgccctcgtacgttgtcgaaacccccctcttcgagccttacaagcccaagaaacaatacaaattgtactcttcgttgctcccgatcatcttatctatcttcacctacattttgatcttccacgttctcgacgtgtctcctttgtcgatcttcaacgacacgaagatcttgttcgtcatctccaacgcacttatcatcatcattgccgccgattacggtgcattcactgacaaagagaacctcgatttttacggagaatacacagccgcgatgagaagggatgcacaagaaaaccctagaccggaaaagtcggtctatggggtgagtatggcggaagaaaccaagaaccgtgagaaacaagaaggaccagtgggagcgagagacttacaagatcagtatttgcctaacaagaaagcgaaagttactgagagaatcatacaagccgtgagcaagaaccaaccgagaaacaaagccattgaaaagtgtgagccagtgactgagcaaaatgttcatataatagctgcaaaagaagaaacttgcaacgcaagcaatctgatgaactctaaagcctacgggcgaagcaaatcggataaggctcgtgggtcagtgatatccaaggaacgtcgtcgtcaagagatcaaacatagacataaaagttacgatcggagtcaatcggatagctcgaaatggatggttgttcacaaggggaagaaggctgacgaggagatggaggaggcgacgaagaagtgggagaatgtaaaagaagagtcggaggagttctcgaagatgtcgaacgaggagttgaacagacgagtcgaagatttcatccaacggttcaatcgagatatcaaacgacaaatttagtttaatgtaatttgttgttgtaccaatacggcaaatttagtcaacctttttgtgtcgtttccttccctttttttcttttgtcattcttgcatcttgtttattagagttggtaatgagatcatggagatattaatcgttagtttaatttcaagggttaaaataaataaaaatttaaaagtaaaaattgttgcgacttttttaaatcgatggaaactgattcaaaaacaaatttactttacagaatctctcggtatttcagacagatcacactagtacattagataaagcgttggatcgaatcctcgtatatgttcaaagaacagttaaaatgagttacatgagtctttgttgttgttgttgactaaatttgccgtataggtacacctcaatttcggcactcttctctcggatccttccatggtatgattctgttttttctcgtgacttgcgtgtttagatgctcaccattggagctcgctaactgcaattcctatatgttgattttgaaacttgtatcatccacttttgatttgattctagaatgttattagcttgagcaaagcaaaatcaattctgaggaagagactcatcagacgaacaactatctagagaagatcaaacattagaacactgatgacgaattgtaacctcaaatgagccaatcattgcacaagaggagtgccacgtgtttggatgtgtgttttggattatccaaactacaaaaaagggaaacactatctaatctcaccaatcacaaaagagaatagtgccacgtggaaaacaaccaccttaccttcacacttcttcttcttctccttcggcagaccatccaaaggccacatcatctctttccaccatg

SEQ ID NO: 25631 - DNA, 3003 bp, Unknown; identical to SEQ ID NO: 25630
  misc_feature (1)..( 3003): 2750-1469P.txt file - cDNA_ID_2707298; gDNA_ID_2214513; Annot_ID_184352

SEQ ID NO: 25632 - DNA, 3003 bp, Unknown
  misc_feature (1)..( 3003): 2750-1469P.txt file - cDNA_ID_2707314; gDNA_ID_2214514; Annot_ID_133920
agtacttaaacaaatatgctttaccaatatttagatcttggtgtcacaaaaagaacaaacaaacattatactctatgttagaatcgatcacactaacgatgttggattttacgaacgaccaataagaagtcaagttaatcaactatccatccaattcagtatagcactactttccattatattgttgtttattgataatgagaaatgttatatcgtgctagagctttacttctcattgtctcaagtcaactctcacacgatttaacacatccttgagttaaaaaaagtataaacaaattttggttcatttattagtctaattggcctcatcgctcaatgaagctatactatcgcaatccaaaatgtctcaatgaagatatcctactatcaatgaagctatactctctataaactataccgaaagttttttactagagatttcttaatgaaatctctatcccttcgattcatatatgtaggatatcatgtaaattataatacaaaaagaccgttgagctaaatattaatactcaatctgtatcattttaaatgatgtttacaagagagaaaaattgtttcatttaaataatgtaatacagtaaaaaccttaaacattccttgaaatgaagagagtatattattatgggctatattaatgtatatgcctgaaagacttgaaaattagatatttactataaatagtttaatattaggtaagaataaaagagaaaaaaattaaaactataaatatcttttctatttatttaatttaccaaatttgccattgtctcacaacattatttattaccggatactttaggcatgatactgttcatcatatacctgacaactctattcatccaaaatttacaacactattcatcattggattgcataaaatatttatggtttatgtagataactatttgattaacatgttaactagtatgatatcgtgctagatacagataaatgtttgattaacatgttaactagtatagtatcacgataaatttatatataacgtattaaaccatttaccatattatacaaattaatatgaaagaatcaaattcggttgacaaaaaaaaaaaaaaaaatcaaattcaaattagaataacatattatactgaatataacgtgctaacatattaaatatttgaataatatttttatataaatgtggtaaaatatttgatatatagtgaaattataacaatagtttatacacgacatatttggtaaattaaacaaagtaaaaaagacagttatgactttaattttttttctcttacatacttacccaatattgaattatcaatggtaaaatctagttttcacattttctgggcatatccattaatactagatgagtacccacgctacgcgtggatttattttgaaaattgttaaaaaaaatatttacattgattgttatttttgctaatttttgtttattctttgtttattcttgtattgttaataaaattagatccataatatgtacttataatttttatggttagattcatttgtgactaatttatttataaagctgattatttataaaattttaatattttcacttcatgaatacatataacaacaatatctgatattctgatagaattatgtataattatgttacttgtgtggtttaaaatttgcttaactcgattataaataaatcaattccttgttttatgtacttcaacgatattgtgataggttcatgattaaagtttggattgacatcaactgaataagatctgaaaaatattcatatgtaaaaataagaagatggcaaaaattgaatatcatttaagtcaacaattttagattttctatcattgcatatatcaatattagaaaaatgatcatgtcttggatgatttgaaaattgtctaacttgattacaaataaactatttctggtcttatatattctcttgatataataatcaacaacattgttataagctcatgattaaatatataaaattgatataaactaaacaagatttcaagcgtattcatatgaaaaaataaaaagaaagcaaaaattaaaatatcatttaagtcaatacttttagatcttctctcattgcatatatccatataagagaaataatcatgtattaaattatttggtaggtctaatgtttcaaaggtttattatttgaaaaaatttgaatgttaatgttatcaaagactcaaaataaaattactaaactaataagaggttaggtagcaaacatcttcaatgcaaaacattttagtcattaaaatagtgattattgataataaaaaattagtaaaataaaaataatataatgtaagtagtgcttaatttattaacataatttttattttttatttttattttgaagaaatcaattaaaattagtattgatgatacatttaatttacttattaaattttattaaattttaatttaaaaaatataaaatgacacatgtcatttcttgtgtaatgacgtgtcattcatatggagagagttggtcaacttttatatatatgatttttctattatatattacattaaatactttttgaaacagagtcaaaactattacagtaaatattataaactaacgttagttggatttaattatttttaatttcagcttagctgtattttttgtcaaccaacgtcaacgtggtaacgtagctgtaatatataacaaaaatgacttctacattaatataacttaattcgtaataataatgtgaaaattagctagcatttagcgcccatagtttatttgctactatatgagtcattaaacaattacgactagatcatatcattctaaaataatatcaaacaaattgcaaactggagttgtttaatccttgggaagctaaaagtgaaatcttaacgaggacaacacctttcagtctttatatatacacatatgtaggggcaagaaggataacaacatcccaaaaccctaaaaaatactctaatcgagcaaccatg

SEQ ID NO: 25633 - DNA, 3003 bp, Unknown
  misc_feature (1)..( 3003): 2750-1469P.txt file - cDNA_ID_2707326; gDNA_ID_2214514; Annot_ID_133907
taataataagggaccgtaataataataaaatactaataatagcaacaaatagtcatgtgatgttatacattttcgtcggcgtatccaacggaccaaacattaaaacagctaacacatacgattttattttacagtaaagacatttgtcaggacaaagattcggcctttcattgctcataaaacactggtgagatacataattatcgaattttatcaatccatgtcgtacttatggacatttgtatgtacaagaattgaagtatatagccaactagttttgttggaattgaatgtgctaattaacatgagaaactaagtttagtgatctctagagctcttgaatcatgaacaaaataaaatgatcataaaagtgttgttaaagttataacaagctaatttttcaactttcaagatatgtttttgatttagtttctttttctatttgctgcaaattgttgttgttgttctttttttttttcttgcaaattgtttttacatatatttactaagtaggagaataagatttagggtttatgagaaaccctctcatctttgcataagttattcggtgtctgttaacaacaagagagaattttatcgatgatggtattatagtattgatcacattaatggaaaaagctatataacactatatactgatgttttaaggcttaaaaatatggccaaattattattattatatatatatatatatatatttattattttttttgaacggaaaaaagccagaactgtagtcatatacatatatctgaatatagcgtttaaaaaataattgtgttatcattgtatgacactcaaaattttcattttttgccaattttctttttagggtacattgataacataagatcaataaaaatatattatggcatcagttaggtaacatacagtatataaacaaaagccacatgttgaaaatacgtaaataagtatgcaacaacactatatcgtgataagaactaatattcaacaacactactttattatcgtagcaaagtatgataatcataaacatttattttcacacagtaactatttttttaaagataacatcataaaagtcaacattatattaaatatagttataacataatgtatattcttttttatttattgtactgtaaatttattcaacaaccaaaaaacttccttttatgaatatgaaaagaatttgagaagctttgaaatggtaatctttatattctacaataaatctttatattctactataaaaaaatattttcactgatgatcagatgatgcatcaaacttttttttttttttttccttttgcagaactcaatatactgatatttcaaatctgaaaaatacgaccaatttttttttattttttttaaacgaaaaagtgagaattgtagaattgtagtgatatagtgaagatcggattttaaaataattatatcattatacgatatttagacaaatcacttttttttttgcaaatgttcttttaagtttacatctaaatttgaagatataaactcgataaaaatatattatggcattaataaagtaacatatttaaacataacgcacatgttgaaaacacgaatgtaagtattcaccaacacaatataatatcctccaaaatgcgattcaacatttttctgccaaatacgatttcacatttgttttaataaaacatgatttcatatttttccacgaaaacatgattccgtggtttttccactaaaaatatgatattaatcataactatttatgtcactaaatattattcaatggtaataattattgattaattattctatttaattaattaattattttattttcaggaatcaactcatttaaccattaaaccatcaaataattggattaatgaattgactcaatccgttcaacaaatgaattgaatcaactcataaaccatttcagcctaaacttggattatggattggtttgaatgagtttatccattttgacatctctaacaatacatatctacatatgaactaatattcaacaacactatttattctcatagtaatgataatcttaaatgttcatttccataccaaactattaagaaaagaaaaacagtataaaattcaacattattcctataataaagatagttatatttttttttttgcaaaataagaaatatagttattttgttttgtgaaattaataaatatagttatcacataatgtctgtccttttttctttattcctgataatgtaaaatttgttcaacaaaaaaaatacacttccttacgaaatagagatgtaacgtctataagtctgcaaagaattaccttaatgtatagttcttttcattaaggtaagcattctattctaccatatacaaatattcccattgataattcactaatcttttctctattagtattcatcatgatgtttattttatttttttgactaaatttgttagtatttttttgagaaaaaaagaaagaaaaaactaagtgtgacgagacacgaaaacactagacaaggaggggctttgacgagacccgaacaaacaaatgtgaatttaaaaaaacccattaaaataattaaaaataatggaaatttaaaaatagaaaataatagtgtctctcgctttccttcatgcgttctctcgcagtcgcaggcgactatcaagtttcagaactcgagattcatcattctctgttccacttccggcgatgtattataatccctagaccttagttccggcgaactctcgaagaacaaacaagtatatattattattttcttcttagtgtttcgtgctgtttccacgattccttcgttttatcttggatctacagttttacattcttctgtttttcttcactttcattgtttccactgcgttgttctgattaggtattgcacaggttttgaaatgtcagtgaaaacgcgaagctgagagaggagaaggaagaaatcgaaggaagctgattcaaatttaggaagaagaaaaaatg

SEQ ID NO: 25634 - DNA, 3003 bp, Unknown
  misc_feature (1)..( 3003): 2750-1469P.txt file - cDNA_ID_2707354; gDNA_ID_2214514; Annot_ID_133915
tattgcttcaaaaagaaaaaaaaagaataattgtaagctatgggcttcacaagtttgtactctctctatggaaaatccaaggttctgaaatcaattagtttttccgctctcaacagtaaaactctcgcaattgacgcttcaatgtggttatacagaggtgctttaaataatgcccggaaattcttggaggaaccaactacacccaactctgaacatataatgtttgtcatcaaaaaagtcaaacaattcatcgaccgtaatgtgaatcctattcttgttttcgatggacatcgtttacctattaagtcaccgcggaacccaataaaaactctagaatacgcaaaggatcttgacgcatcagcacaacttatggctcccgatgaccctaagagaaaggacaaagagaagaatgctactaagatctttcaaagtcatatacacatcacgccttatgtgatacatgttttcattgaggtaacatttacggtaaataattatttttaagaattttcacttctttctaattttttattaacctttcttttttctcccattgaaggtttaaaaaaaaaaagtatccgaatattgagtttatcgttgctgctcacagcttgtatatttggctaataataaagataaaagcgtttatgcggttctcactattaacactgacctcataccatttagatgttgaagagtaagttctttaatacacttatcaattattattattttaaaggtttttctcatgtagacataacattaatttttactaccactttaaacttttgtgtgatcacaaattattttcgccagtaaagactttgaattgcttgaactcgaaatgatagacttattgaagcggtttcatagtagcaagaaaaataaagacaacgaaaaagaaactaaagaagaagcaaaatcttacgatttttcagaattcacagacgataattttctggagatgtgcattctttgcgattgtgactattttaaatggccattaacggagggatccgaaagagcatatgaaataattggtactaaaactatacgtggtagagaggtactttttacttggtttagttcaaaatagtagtatactatacatttagattttgtatttgcatgtatgatgacatgatgtgtgttattcattttctttcaggtaatagaggaactactagaggacagcactgacctaacttctcatctgaaaaaattcataattttgttgcttttcaaatattagtatgtctataatcaagtaattgaagagcttcaacacttgaatgtgcctgaggtgtctaaccttccattcttgcgtgaccgtgagtctggcgatgaatttgtcattcgaaagtatgaagattctacgggcacatatttgtcaacaactaagactaaggaaatagcataaggaagacttaatcctgaaacccacgaaaaatttacacacgtggaagtggaagaaacagatgacgaagaaactacttagacaaaagtatctaataatttgaatttcgaagttctagttcaaaataaaggaagtctaatttcgacaaaaaatctcacatctataccatattttacggttttagttttttttagtcgttagcaacaatgacaatcagttatattttgttaactttataatcgttagcgatgactatcgacaatgaaatcatgtttatttggtagtcgttgggtcgggaacatttaacaaatgattttgattcaattttttttttttcttataaaccttatcggctgatctggttagccctagtaaaaacacaccgaaatgttttcgagtggacttcttcccgaaaaaccaccatactgtctgtctgtcacgagtttgaaatgctttctgactaatgccagggggtagtcaggcggccgcctacatttctaattaccaagtaaaccaattaaaccaagacccaacttatacacttaccaactttcaaggagaatcgaactcgggtctaagagtttcatccttcccaaagcttcccctaccactaaaccacatatacttggcctaggttgaaaactttcagtgatacaattttttacttgctaatcgttcaaaaatattgaccataaattgtcgatgaaccaatggctaacactatttagttggttggtcgcaatcgcatagcatgtccctgacacaaaaaaagcaaacaaaaaaagaactacttggatcaaacaaagaaacccatgcttgggctcagactgaaaacaaagtaattgggccaaacccatttagtattaaccgactaatcaagtccaacaatgtacagcatgaaataaacgctacccattaaccgactcaaatcgcaccaagtcaggcccaattaatcctacacaggcccatttagaagaaagttaacttcctccttaagaagagagaagggctaaaaatcaagctttcacgagtacggaaatttacagtatctcctccatctttttttactttcctcagagctctctcctctccgcaacttccaccaccaccaaatcggaactctcggcgttctactccgtctccggcgttacctccgtcgatttcatcttctcaggttacttagggttacctcttttttgctttttgatcgataaagtgtgatgatgtctagcgttaactcttttcgtcttcgtagtcgtagtcttagggttttggtggcgacgatactttgatttatcaaaccgaacttcttctttgtgatcttcgatgaatcaaaagttttctaagggatattaattaggttttgttaccggcgataattaatccatcttcgatgcttcttctttacacttctgactttgtttctgatgttttaacctctgtggagagcttgatagagtgacattgctctgactaagcgttttagttcaacgcatggttgattctctttttactaagtaatgaattttgagatccttgtttgattgcagttggaaggagtgaattgagaaggtcgggccaatatg

SEQ ID NO: 25635 - DNA, 1592 bp, Unknown; identical to SEQ ID NO: 11442
  misc_feature (1)..( 1592): 2750-1469P.txt file - cDNA_ID_2707368; gDNA_ID_2214496; Annot_ID_133568

SEQ ID NO: 25636 - DNA, 3000 bp, Unknown; identical to SEQ ID NO: 11754
  misc_feature (1)..( 3000): 2750-1469P.txt file - cDNA_ID_2707372; gDNA_ID_2214515; Annot_ID_133933

SEQ ID NO: 25637 - DNA, 3000 bp, Unknown; identical to SEQ ID NO: 11754
  misc_feature (1)..( 3000): 2750-1469P.txt file - cDNA_ID_2707372; gDNA_ID_2214515; Annot_ID_184412

SEQ ID NO: 25638 - DNA, 3003 bp, Unknown
  misc_feature (1)..( 3003): 2750-1469P.txt file - cDNA_ID_2707379; gDNA_ID_2214515; Annot_ID_133947
aacaacaaggaggctatggaaatatgcagacgaatcagcagagtctacagcctaataacatgatgcagaatgctcaacaaaggcaccaaaatcctcaataaccccttttaaataatttgggcttgtaatgggccgatgcctgtattttgtagtaccaaaggcctggcccattctttaacattaatacactcaccagatttctctagttgtatggtactttcacactacactagtacactttgtttacttgtatcattgtatgaggttaaaaacgtgaagcagagattggacggtggaggattgttttcgttctgacatgtttattgagaattcgacacgtggcatcgacgtgaacatctcgacgccgttgatggggttatagagacaaaacgaagacgcgtttctgttgtacacgggactcgagagagcgacgtgtctatgaagtttacctgttttctgaactttaaacagagagctttaaaactgcgactcgaaagctattaaattttctgacaatttgttttgtttcttgtcaacttaattttatatactcattttttatgtacttatttagctcaacgactcgtttagttacctcaatcaaattttgaaatttagttaccatttcttttaaattttttgtttgcttttgttacaaatatgaaaaactagtttactttggtttttaggaatttgcgaaaaaatcactcaaaatcgcttatttttacaatttattgtgcacattcaaaaaatgcaaaataaatttataaaatttaaaataatacacaatataatttatttgtgcgattttgcatatgttataaacgttttcactataacatatatttgtattcaaaagttttaaagatataattgaactcatcatctcaaaggctttgatttgatatattattttctttaatataaatattcaatgcataattttctttaaattaattttatataaaataaatattttactatatattatatgaaataaatgctttattatagggaaaaaacccaaaacaaacctcaacttgttatgaataaagatggatgctcattataacgcccatcatctaaactcatcatctagatgtttctaaggttttaccctttccttgtaatcctatataaagaaccctttacctcaatggaataacacactcattttcttctatctctttctctgtttataacacgttatcaggacgctctaaaaggtagatatagagattcttacatttttttaagaaccatgtttacttatcgactcatggttcatagtatttattttctattattgaaacaaaacaatatgagccgatcgatgattatagtatagatcggtaaaagcatgttttcaatgattcaataaagaagagaatcatgcttatcatttgtttctataattactatcgcatgattcaatgattctacaaagaaaatcgttaaagaagataatcatgcttattaattgttaatttttgtgatttattattacaataatgaatatataaattaccaattttataattatataactaattttgtaactattcataacccggtggtaggtgatgcaaacatgtattaatgttttagcattccagttttgaatagttgcatctatattcaatatcattttataaatattatattgtctaaaatccatttatgattgatatgatatcccttatttaactcctttgattaaaacgttatacatatcttatcacttttagatattgacttttccatattaaatatttgatttccatatatttgattgtgttattattatttttactaaaaatgttgcaagataatttttctttttataagattccatatatctaaatctttgtgttattattatctaaaaatttttataagatttccatatatttgattgtgttattattatttttactaaaaacgttgcaagataatttttttttttataagattcttttctctaaatctttgtggtatctaaaaaaaaaaaaaaaaaaaaaacaaaaaaaattgttcatggttttgccctaattttgcacgaaatcattttacccaaatcttgcacgaattcatattagcctaaataaaagttttgtcaagatatatgtaaaatccagattttgcacaaaatagttttattctgattggttttacaatattgcattaaaattgtattagtatatcatacttgattattttatgaaataaattgattgataaataacttaatttaaaggtataatcacttatagaaattttcatgaatgactagtttaatgtatcttaagaagatatcatatttttgatggtcaaaattttttcaagaacttaaattatcaccaaaagttgagaaaataaatatggtaaaaaaaaataagaaattttgaaagaactattataaacttaaatcgagtgtttttcaaaggctaagaaaacagatgagttatcgatgataagtagtactcatattctgaagtgaatataagatcttacatagttagtcaaatttaatatcgtttatactagaatataaaaatttaattattatctcgttattgttttattagcatatgattgattattaaaatacatggaagtaattttgattataagatcttattaagggagtaactgataagcaatgaaaagtaaattaaaagttttgaaagaactagaagtttcaaaagaattaaaagtttcaagagtatatttggcttaaccggattggtcatcctggtttaatgatgatgtgaaagtattgagaattatgtggacattaggtgaaaaactagaagattctccctaatgatttatcaaatgttacttgctcagaaagcaatatgataatgtgatttttaccagtgtaagtaatttggactttatctattcgtaagtatatatacaaggagatgattatgggttgatcacccactatatgacatttagatacctaatggttataaaagatgcatcgattcaatg

SEQ ID NO: 25639 - DNA, 3000 bp, Unknown
  misc_feature (1)..( 3000): 2750-1469P.txt file - cDNA_ID_2707383; gDNA_ID_2214515; Annot_ID_133943
gtagggttgccatacagaaaataacatttatcactttgtttagttggtatatgaccaatcttaggtttgatgcatgataaactggtaatggttttctacatttttttttttaacatctaaacaaactttattaatgtgaatcaaagtatacatgattatcaatgagattacaaatacaaccaattgtttttgtaacgaaaaaatgatgaagcaatacatgccgcattcttagtcaagtactttatcatcttcgtcatttccgtcaatttggtgtgactttcttgcttagggatcttcttctttttactgataaaataccggtaatgcagttgagagtcatatgcaacgatccatatgttacatcacaaagcttttggattgatcgagactctcatatagaatgagatgtcattggtcttggttgtgcttaaaacccattgttgtgtacatgacataaaccatcttccgatcattctcctccatagatagttgcttattgtcattatccattcatcccgaattgtctctttttccatggtagtttccattttccaaagtagatctgtttgtatagttgtaaagacaccaaattccgagatctccatttatatttgtaaatctgcaagaacaagactgcatcacatcgaatcatgggtttcagtgtggggataactgcggaagggtgggagagatgtcccaagaaaaccatatcatcgacaaagagaattacaatcatcaccataaaggtgaagagaaatcgaatgaagaaaataaatctgagaacaatctgagataacagaaaattccccatcacaattattgaaagcagaagaaaaataaagcaagtaacaaaatagaaccaccggcaaatgtcggcggcccgaaaaccaaagaggaaaaacggttttatcagtatccccttttgtgtcgacagagagataggagttgtttggccgttttcagggttatcgtctttaccattgggttttctacaaatttatttgggttaatttgttcatgtctttttctttttttaattatctttcagattttaatttttatttacatttttataaaatgataatatatagatatattaataagtcagaatatttgtaaattataatactaaaacttacaaaataagaatattttaaatagtttttcttttggaaatatatttaaataggtcatgaaataaataatctatgaaatatatgataatatacaattatagaaaagttagaatatttataaaaatgataatgataaaaaggatttttctgttttaatgataaaaaggataaaaaggatttttctactcgtcaaattaattatttaactatcaaacttttttgtttgttttaatgttaacttatcaattcagatttttaggattgtaccaaagcccctataaataaagagacaagcccgagttgcatcaaagtttgagagacaaaatgagaaggtttgggaagaaaaacaaaaaaacaaacaaagagacaagcccctcctctgaatgataatattgaaaacaaccaaaagttaaggataaaatacaatttaaagttttatatgagcttttccttggatattactggatttaacgtctacaaatattttaagaaactaatacaaccacattgatacaaagtatacttcgtccgtattatataaagttatgttttagtttaaaaaatggtttcattttaaatgatgttggtagaggaacaaacccacaatgttttacatttttaacgtaaaataattgttttattgtttcaagacttgttctattattgactgaattgtggattaaatattaacagctttttaatatatacacaaatttttaaaatatttattatttaataaaaaagattacatatcaaactgttaataaataactcaacagtcaaatgaactcgcgtttgtcaaaattaaaggttaatcgggtctgggataaactttttttttatgctgagaatcgtcttgttataatacacctacttttatataagattattcgaaaactatcgaaatttttgcaaagatggtatttttcaaaattagaaaaacttgaaaatcccaacagattgatctcatctttatctctcttttggatcatcatcatcatctttgtagcttataaaaatatatatatatatatatatatgtatatatagttggacataaaatccgaaatccaaaaaccgatccgaaaaatccggctccgaaaccgaaccgaatagtcacaaaatccgaacagataatgaattctcctacctgaattacccgaactgaatccgatccgaaccgaaaagcaaacggatatctgtaatccgaaataaaattatatatcttaaaatattagtaatatttagttataatttatacccaaaaaatactaaataacaaaaatattcgctataaccttaatatccaaatttcttttagttctatttgttataattttactttgttttgcaaaattaaaccaaattttagtaaaattaaacgatttttgattaaaattgaacaattttttagtttttttttctcaaaaactgatttgaaacccatacaaatccgacaccatccgaagtgaaaccaaaccgaatagtcatataatcctaatgttaataaactttttcatccgaattatccaaataaaaaaaattcgaactgaatccgatatgaaatctgaatgtccggacctatattgaaaatttaaaatttaaatttcggatatattaatctatataagcccaaatattgtgccaagtgaaagttcattacaaaactaagcccagttccatatacaaagcccatactatgctcatgacaaagaagacttgctcacgtgtcttcaccaataaaataattacacgtgtgcaaagaacgtctttgactcttttgtcttacccgaaacggcaaaaaaaacattgactactgcaagattttatctctctctctcttctcttttccggtgacgccatg

SEQ ID NO: 25640 - DNA, 3000 bp, Unknown; identical to SEQ ID NO: 25639
  misc_feature (1)..( 3000): 2750-1469P.txt file - cDNA_ID_2707383; gDNA_ID_2214515; Annot_ID_184425

SEQ ID NO: 25641 - DNA, 3003 bp, Unknown
  misc_feature (1)..( 3003): 2750-1469P.txt file - cDNA_ID_2707387; gDNA_ID_2214515; Annot_ID_133938
tttataatatttatacataaaaatatcaaaatttataattttcattctctataaatagatactattttcatttgatttgaatacaaaaaataaaaaaccgtgttggctatcatcatgagatcgtgtatcatattgcataatatgattgttgaggatgaacgagagacatatgctcaacattggacggattatgatcaatttgaggcaagtaggtcgagtacacaacaaccattctcgaccgaagtgctacccgtatttacaaatcatgtgcgtgctaggtccgagttgcgtgatttaaatgtacatcacgaattgcaagcagatccagtcaaacacatacgagcacaattcggaatgttccatggtgaatgaaatttttaagtttgtgagttgagattattgtattaattaaattattagtgttttcttacttgttgtgtgcttattgtatttttgcattttaaatttatgttcattgtatgtgttttagtaataataatttctatttctcgtttttattatttataaaagtttttaaaaatattatataaaataaaaacaaatattaacacaaaaataatttataaaattattttaatttaatttaatattaacaatgattaataatatgtaatcacaaaaacataaacataaataaaatgaaaaaaatgaaataaaaatggtggggtaaggtattgtaattttattaaacaaaactattgtaaatataaaagggagatttgcaaaactaccctttttttactaccttttgcaacaataccctttcgtgttgtccatttttaaaaatactcatttccttgaccagaatgaccaaattatcctcatctaataggaacatgtaattggaaactgaaattttcccgccaatttttctttccccgccaaaaaaaaaaaatttcgtcaaacatttttcccgccaaaaaaaaatattctcgccaaaaatttttacaaccaaaaaattgcttctaaaaatccttgtaattttttttttgcgggaaatagatttacaagggattttaaaagggttttaaaagatttacaatggattttaaaaggttttaaaaaattttacaagagtttttaaagaatcttcttgtaaactctttaaaaatcttttaaaaacccttgtacatatcttaaaacccttttaaaatctcttgtaaatctttaaaacccttttaaaatcccttgtaaatcttttaaaacccttttaaaatcccttgtaaatcttttaacacccttttaaaatcacttgtaaatattttaaaacacttttcaaacaattttgaaccctttaaaaatctttataaaacctttgtaaatcttttaaagccctttaaaatctcttataaatcttttaaaacccttttaaaatcccctgtaaaacttttaaaacccttttaaaatcccttgtaaatctttttaaacccttttaaaatccttgtaaatattttaaaatcccgtgtaattcttttaaaactcttttaaaatctcgtgtaaatttggcgggaaaaatatttttggaaaaaaaaaattggcgggaaattgttttttcaaaattatttggtgggaaatttattttggaatattttaggcgaaaaatattaatatttcattttgtttacctaaaacaatttccaaataacggtaaatggtcattaaaatttaaagaaggtaaaaataaaaatgacaaataggaaagagtagaattgaaaaagggtaatgtgaaaagggtattctcaacaattattcaagataaaaattgtataggtgttaaataataatgtgtaaaagagaagacgatgtgaagtattaaaagaaaaaaaaaatggatgttgtatataagtaaccattgtagatagtttaagcaagaaaaattgatgttgcattggaaattaaaaaatttcaataaaattagaaaagcaactctaaatcattacttattttattattttcaagaagttataaagtattaaacaattcgttgacaaataagtttgatcgacattgtgtgacaaatttaaaacacatcattaataacaacgaggacaaatacagttcagatatcgtctactattaaaacacttcttctataggagcaaagaaaaattgtcggcaacgaactggggaccaataatattccgagtttgagttcaaactgagtaattttattttgagaaaatttgccaagttaacttataattctggtttacgtgtagtaatttattaagttgttataggaaaatgagaaaatactaagacacatccaagaaagtttcacacgaaatttacttacaaaaagattgtttatttaatacttccgtatatagatatataaatatttaacacattaattataaagttcaagataattgattatctatctttttttgtcatctgaaattattatcgctcaaacgaagtaattctgaggaaagttgtttacaaactagttatttcattattgtctacttatataatagaattaaaaaaaattattgcttaatgcaatttagttttagataaaatcattaaacttaatagattatataagttagatatcaataattgggcttgcttaaaaacataaatataaaatattattgggccgttacgtgcatacaaaacgaaccttctaacaaacaagtgtgaacgttacgacttcaaaattaaaaaaaaacacaacaactatgtccacacgtaatctcatatgattcagattccaaggagaacaaaattaaaaacaaatctcgtaaacatacatacacttcacataaaacaaaaggtacagtatataccataaatctccgagattcttttgatgtatctgtccatttcattattacacaaactaggaaactgatatctctctattcacattcctctgattctatttctctttatatatattcacccattaaccatctcaatcttataaccctcaaaatcacaatcttctcttacaaaaaactttgaaagatg

SEQ ID NO: 25642 - DNA, 3003 bp, Unknown
  misc_feature (1)..( 3003): 2750-1469P.txt file - cDNA_ID_2707394; gDNA_ID_2214515; Annot_ID_133930
attcggaaatttgaagacttgttaatttgggtttgggattgggattgatctgaaaatttgtagtttttggaagatatgttggaagatcgatcaccagattcgtgtttgagtacaagggttttctcaagctctcgtctttctgaatcaaactggtctaactcttacatgtatccagaggatgatgataagctcctcggtaatggtaaaagagctttggaggttgttggtgaggttagacagaccaaatcacttaaattaatgggtttttcgattatctatgatagcgattcttctgactattcattgagtggtggggaggagcaagctgatgctgctattggtgatggctcatcatcaaggcaggagcaagaacagcaatctgattttaatgacaatggtggtgattcttcggattctcactctcttatcaatgagattgggagggacaattcgatcgactgtttgatccgttgctcgaggtctgattatggttctattgcttccttgaaccggaatttccgttctttggtaaagagtggagagatttatagattaaggcgacaaaacgggtttgttgaacattgggtttacttctcttgccagctcttggaatgggttgcgtttgatcctgttgagagaaggtggatgcagttgccaactatgccttccagtgttaccttcatgtgtgcagataaggagtctctggccgttgggacggacctgcttgtcttaggaaaagatgatttttcttctcatgtaatatacagatacagtctactcactaattcttggtcttctggtatgaagatgaactctccgaggtgtttgtttggatccgcgagccttggagagattgctatattcgctggtggatgtgattcccagggaaagattcttgattttgcggaaatgtataattctgagcttcaaacttggataactcttccaaggatgaacaaaccgaggaagatgtgttcgggagtttttatggacgggaagttctatgtaattggaggaatcggtggtgctgattctaaaggcttgacctgcggtgaagaatatgatttggagaccaagaaatggactcaaatccctgacttgtcgcctccaagaagccgtgctgatcaagctgatatgtcaccagcagcggaagcaccgcctcttgttgcggttgtgaataaccaattatacgctgctgatcacgccgatatggaagtgaggaagtacgataaggagaataagaagtggttaactgttggaagattgcctgaaagagctggctcggtaaacggatggggacttgcttttagagcttgtggagagcggttaattgttattggtggaccgaagtgctcaggaggtggtttcatagagctaaattcttggataccgagcgacggtggtccacctcagtggacactacttgacaggaaacattctcctactttcgtatacaattgtgcagtgatgggttgctaaaagaacacacattcataatactacgactatccatttgaagaccctccagattcttgttgatgggttttagcttacaagtcaaaagacaccattgaaggtcccacgctccaacctttatgcttcttcttcttcttccttatttgtttcccttacaaaattttcaatttgaatacaatcatctctgtattgttagaaaccagacaaaagtcccaaggagattccaaaaaaaaaaaggaaaaaaaaaaactgaaacaggtttataataagttcgttaaaagttgaagctttttagagtttgccagatctggttaacattgttgtatgtgtttttaatcaaatttgttttctaataatcttgccatctttttggtctttgttcacggttttgcttttgagtttaattctttttctatttttgttttgctttacctttctttaattttacaggtcactttacaacgttgagtttgaagtgtttgtcaattttatgacgacaaacaaaaaagtgtcacttttgtttttttgttggggtaaggaggggcaaatgttatgtctttatagatgtgtcctttaagatatctcaatctgttgcttgcaagttatacaattttttgttaagaatgtttttggactcttgttttagttccttcagcttttagggtctttagattttttggtgaagataacaacatattacaatctaagttagtattttaccaatcggaacaactcatagtataagtaacattaaccaaagtaaatttttttcaaagagtagttaaaatttcttaattacaagataaccaaagtaatatgtttttagtgtttctaattttctgatgatatatttttttttgttatttagatattttttcttatatacgattatctaatgtcttttaactttatcgtctacaactcacacacgtgtactgcttgatttcaatcgaagttcggacacaatgacatcactagcatatgttatgcttgaaattttagacatgtaaaaatctcatagacatagatataaatactagaaatcaaaaattgaaactgaaatataaaatatttagaaaaatataaaatatttagaatagaaaaatataaaaaatttagcagaattctctaaattttctttatctttattttttcgtagcgtaaatgtaaaagtagacacattagtatgaaatatttgtatcgaacagcatcatgtcacatatataaacaatattctcatgattttgagttctaattaatattggttgacaaaaaagagaaagagttaaagatgcctctttcttcaacatatcagtatcaccctctcaattcgattttttctacaaagaaatatgttatgttctaagcaaagcccaactacaataaatttgggcctcataatgttaaggcccatttactctaaatctcgcagggttttaagttttgatttattctctactcagcaaacgccattatcgctctgtagaaaagcttccattttcgtagaccactctcactgagaagatg

SEQ ID NO: 25643 - DNA, 3003 bp, Unknown; identical to SEQ ID NO: 25642
  misc_feature (1)..( 3003): 2750-1469P.txt file - cDNA_ID_2707394; gDNA_ID_2214515; Annot_ID_184408

SEQ ID NO: 25644 - DNA, 3000 bp, Unknown; identical to SEQ ID NO: 11751
  misc_feature (1)..( 3000): 2750-1469P.txt file - cDNA_ID_2707398; gDNA_ID_2214515; Annot_ID_133928

SEQ ID NO: 25645 - DNA, 3000 bp, Unknown; identical to SEQ ID NO: 11751
  misc_feature (1)..( 3000): 2750-1469P.txt file - cDNA_ID_2707398; gDNA_ID_2214515; Annot_ID_184406

SEQ ID NO: 25646 - DNA, 3003 bp, Unknown
  misc_feature (1)..( 3003): 2750-1469P.txt file - cDNA_ID_2707406; gDNA_ID_2214515; Annot_ID_133945
ttaaaatcggaaagatattaaaatacaagacatgaacaaattaacccaaataaatttgtagaaaaccattaccggtttaccacgcaacaaacctaagattggtcatataccaactaaataaagtgaaaaacgttattttctgtatgcacgaccctacacttgtcttaaatttaagaaggttttgtttaggactaatacaatctccactttattgagtttaccaaaaatgaaggccactgagaacacaagaggagatgacaacatcaagatgtgctagaggtaaagccagcgcctcgagcaggacaattcagatggctaacaccaacaccaattacttcctgagctttatgtacggaaatgaatcagtatttgaggatcgtgtattcgcttctcgttaatccgactttaagttattggtttccaagctatatggttcaaaattatggaaggttacagttttcagtttgagtcaactcttaacaatttaggagagaatttgaaggccctgttctttttccagacgctgcgatcaaatccagcgaccaaaaaaacagttgtttaacacacaattacgttgaagtctatagaaagttatgtggagaggaatcactcgattctaaaaacagcgacctataaggcatatacacgtgttgccaaaaataacagcgactcaacatcttcactagagacgtcgccggcgtccatattgagcgactgtttttgtatctctgttaaaaaatttgtcttcgtcggagtcgttgtcgctgtcgcagcgattaataaacgaacatgcccgaagttacagagaacaacaccacacactatttgtaaaattatgaagcaaaaaacacataagctaatgaatactcaagtcttgtgaattacagagtacattgaaagaagctaacagaaccattgagaaagattcaaagtaatggacataatttgaaattttgaatggttaaacgcaaaacatttctaattcactcagctagggatatgtgatcatctactgaaacccacgtacttggtgcaaatcatcacttttgcagtcaattaccatctttctcatgtaaactttaaagcaactttcattcctcatcaactagattcttaattaccttaccaaaaaaaaaaaactagattcttaattacaccttcatgatctaacatattgaaacaaaaaactatatacaagctcatatgaaagtgtcttagcatgtcccaaagtacaaaacttctgcaattttcatctctcaaatctcaagtaccaagaacaaagaacatcaaaaagcttacattgttgttgttgatcatcatcttctttcacgatctcaagttacacattacatgatctaacgaaacatgtactcagcctaatcattgaaacagaaactatatacaaaactcatgtgaagtgtcttgacatgtcccaaatctcaagtaaaaagaacatcaaaaagaacgttgttgtttatcatcatcttctttcagcagacctaagacgaagttctaaaagccaatggttaaactgaccatcactaaccttcaacatctcagacaaaggcatcaaaatcccatgttccttaagcaatctatgccttggctttatcttcctctccaagctaaacgaaaaatactgagggaaacgtttcagctccttaacatctccacgcatctcctcaataaaaaactcaactttaggaactaaattgttatcaacactataagtcaacaacgccggagatctcacaaccatcttcgctacttcttctcttgtaaaccctaacccttcttcaagatactcaattttggggattagggttcgttccacattcgatacaagcaacaccgtgttccgtgacgtaatcgtgtcgcgacccacgaatcctagggttttgaggaacgttaatgcaggacgaagctgataatctacagatgaaattagcaatcgaggacaacgagagatcgatttaggtatgtcttgctctgaaattgaaatctcattggataagaagcgaagaactggtaagatttcagattcaggatcagaagttaacaaatctggaaacatgtcgaggatacgaccaacggcgggtcttgagagtccggtggaagagagtagagtctcgacggagacgacggaggagattggagcagaacggagagatgggtttactcggagagctttgtgaggatctacgttaaggtcttgaaggtaaataagcttctcccggaatagaatcccagtatctgaagtttctccggcgaaacatctaatcctcacggcggagaaacacggcggcggaaaaagagaacaccttgctatcatcatcgtcggtgaggtagaaaaaaaaagtttcaatctttaaagtgtggataaaacaatggaagaagggtaaaatggtaattctggtgtaacggtcagataaagattaaacgacgtagttttttggttgagagttgtttctgcttgttcttcttcttccaatgaggatccctattctcaagcggcttaatcataagaccggtttttgcgcagagtctgttaaccgcaatcatcttctctgtctctatctctacctctggttttcgattcttcgtttcgaagttttttttttttttccctttcttcttcaagaggtcctttttaagatctcgctcatggttagtatcagcttggcgtttgaatttgcctctttaggtaagtttccttttcttcttctctttccttatctcttcttaataagggttttcacaatctctctgttttcttcagaaaaagattgaatctttattgaaaacccaaagtgatgaaattgaaattcatgatctgggtattatagattgcagattctggaaacgtattatgttaatgattcatttcaagttttgattttttgtgttggattgaagagaagaatagtttattgatgttttgtgaagaagaagaagaagagattttgattttggtttaatatatagttggggattaacaggatg

SEQ ID NO: 25647 - DNA, 3000 bp, Unknown; identical to SEQ ID NO: 11755
  misc_feature (1)..( 3000): 2750-1469P.txt file - cDNA_ID_2707432; gDNA_ID_2214515; Annot_ID_133936

SEQ ID NO: 25648 - DNA, 3000 bp, Unknown
  misc_feature (1)..( 3000): 2750-1469P.txt file - cDNA_ID_2707448; gDNA_ID_2214484; Annot_ID_133323
tcgcagcaagcatgaacaacatgtccttcgtgctaccacgaagtaactccgtcatgcaagcatattaccaaggcaccccaggaatcttcacaacggattttccgcccgttccaccggtgcaattcgattacacaggtaacgttagccgcgggttatggcagcccataaaaggaaccaaagcttacaagcttaagtacaaatctaatgttcagattgtgttacaagacactagcattgtcacgccagagaatcatcccatgcatctacacgggtaccaattctacgtggtcgggtcaggtttcggtaatttcaacccgagaacagacccggctaggtttaacttatttgacccaccagagaggaacaccattggaacacctccaggtggttgggtggcaattcggttcgtcgctgataatccaggttagatgatcttattgactcgaaagcatttgatactttgtaaccataggttaaatgatcttattgactcaaaaatgaaaaacatattttgatatacttgtggtgtaatgcaggagcatggtttatgcattgtcacattgattcacatttgggatggggtttggctatggttttcttggtagagaacggtcgtggacagttgcaatcggtgcaggctccaccattggatcttccaagatgctaataaaaaacttctaccgttggatctaaagaatttatggggtttggttttttgttcttgttttttaatcaaaaaaagacttcgtgagtcttgatatgttaaagatggacaactgctctattgaaagtggttcaacctttgttttcgatgtacttttgttattttcctcgtaatagagtgagtgttttcatttttccgattaaaaatttaccaaataaaagctgtgttagttaatcttctttttctagctgactttcccaaacaactttattagttattaacttaatatgaacccacaagatacttttaattacattatcatacataaacttttcttgcaaaaatagcatcatatcgatctttaattggccatctttacgagaaaataattcttgaaaaagaacgtaaatagtgtggttgcgattccgttgatcaaaatttaccattaaactgaaaaaaaaaaatagtgatccatgaattacatttctgtataacttcttccacaaaaagatgattttttttggtcaactttctccaaaattctcaaaacaattcgccgtcaatgcctataactcgacataagtaaattgactacaactgccataagattgtaagtttggtggtctgttggtcatcctgatggaatgtagttgtaccattttgaactataatagaatctaatgagatagttttgatcgattgttataaattggataaccctaaatgtaaaagtacaaaaaatacattcttcgttgtggaatcctaataaacaaaattgtcctctggatacttaataattcaaacgtcatgacataagtgatccaaacatcacaaaaaaaattcataatctattggaacaaaaggttgatagacttacatgagtggtatccattccaatcgacactaagatttactgatcccaagttgaattcatgcgaaaatatttacactaaaatggttagaaataggatttggtatggtaaacatttttgggatactctttattggtctcgattttgcaatcaacgtcgcaaataattgatttacgatatcttttacctcacacgaaacgtgtacacaattgtgtattctttcttgcacaaccctagaccttagtttaaacttcaatcttctccgcaatgaaataaaatacacaattatacataatttccataatccaacatttttttttttatatctaaaagcacctccaatggagagaatctgtcgaagggttctctctatttttttatgattaaatttcaaaaaaattaacaaaagagcttttttcttttttttggttttttatagtccaatggtaggttcttttagaagaattctctggaaaaacaatattaatataaaattattttatttcatacaatttaataattattacaaagtataaaatattaaacatacattaatttgaaatattataaaatagatatgaaaaaaaacggaataaagatcagttgttctgttgattgttacaacatttagtcacgatatacaagagaaaatgacttgattcatacctaatttggagaatccgtcaacgattactctccaaatcatattttctattctccgattgagtttatcttccggtgatagtcatcaccatctgcaatgttataaaagtcatgcagtacgtacttaggtgctagagtaccgcctatttcggattaatcgtcgactaggcgttaaatcaaattggcaaatatgctatagtttatataaatatatagtatatataacttttaatcagtcatatttttaaaatttgatgtagcattgtggtctggaaggttgtttttggtagccaaagtgataagttcgatacctacaagtggacaatattatgcattttagttaaaacgaggggtacatctgtaatttcacgtacaaagtcaactgcttttcctacaaaacctaatcgccgtcgtcaaacctgagtttttttttgttctgattttttcgtatttcttctatttcctcatcattttatcgcatctctttaccaaaataacacaaatacaacattaatctttggatgattgaccacaaaatggaatttaacgtagtcttgaacacacgaatttttttgtttcttttgttaagctttacatccaatcaaatttggacacgtgtccgtttctctcctttcttcaaaaacttcccccagctaccatcatcttcgttaactccgctaaagcttttttaaaaaggattactactgtttacttctctgaatgcgttcactgcttcaccgtactatcttactcacatctccgtctcattctcttatccggcgcacttctctctccgccatg

SEQ ID NO: 25649 - DNA, 3000 bp, Unknown; identical to SEQ ID NO: 11779
  misc_feature (1)..( 3000): 2750-1469P.txt file - cDNA_ID_2707456; gDNA_ID_2214516; Annot_ID_133955

SEQ ID NO: 25650 - DNA, 3000 bp, Unknown; identical to SEQ ID NO: 11779
  misc_feature (1)..( 3000): 2750-1469P.txt file - cDNA_ID_2707456; gDNA_ID_2214516; Annot_ID_184449

SEQ ID NO: 25651 - DNA, 3000 bp, Unknown; identical to SEQ ID NO: 11786
  misc_feature (1)..( 3000): 2750-1469P.txt file - cDNA_ID_2707460; gDNA_ID_2214516; Annot_ID_133956

SEQ ID NO: 25652 - DNA, 3003 bp, Unknown
  misc_feature (1)..( 3003): 2750-1469P.txt file - cDNA_ID_2707463; gDNA_ID_2214516; Annot_ID_133958
agaaattgtgctacaaaatatgttctatatagaaaatgtttacatgattatttaaattgtcacaggagctaccagttcatcaaagagctgacgcggtgaatagtctggtttttgaagcaaacgcaagagtaagagatccggtctacggctgcgtaggagcaatctcctacttacaaaaccaagtctcgcagcttcagatgcaactagcagtggctcaagccgagattctttgcattcagatgcaaaatgagccaaccttacagtctcatcatcaagtacttgaactagaccaagaccacaaagctctcttactaaacaacaacaacatcaataactgcaacaccaacaacaacaataacaactttggttatgccatgtcttctggacagttcaactctaactttgcctcaccaagcagcataatgcaaatgcagatgcaaatgcaaatgcaagaccctcttaagcaagaatctctttggacttaatgtaataataataataataattaatgttcgacaagtttgctacttggttatgttgaaaaagagaatatgggaacaggtttcgtgtaaggaaagtagtataagtcaaagcttaaatgcatgcatgtgatggtgatgagatgtagttatgctttagtactggagatctgttttttttttttctttttctctctttaatttggtttctcacttccatttttcttttaccatcgtttgaacagtgaaaattagatctaattcaatccaatttttttgtaatatgaagtcgccaagacattgctctctaaccactacacactttttctcaaacaaaccgacacaactttgccgcgttcaaattaagagacatttagattgtcttatggaatagctaaaagactagctaaactcaaaatctcagatatacaaaaaaatttattaaacttatttaaagtagtcttagaaaacatgcaaaagcaatttttctttttatggaatcaattattttactatagactaaaaaagtagattgtatttctacatgcgataaactgaaattaaatcgaatagaaaaataaacctcaagttgcaaactacattttattcaaaaagaaaatctacatgattcaacctttacaatttgactcacaatagatttattcgaccgacctgatttgattaatcataagctacacgttagaacacaaagtcgcctctactgttgcttttgtactaatccttaaaaaaatcatatagatttaattcaccaaaattaagttaggaaagaagaggtggtggtgttgaatttgattatgttatctattgatagtattcatgtgatcagtagacgaaaaattttcaaaatattgcctgtcgacatgggaagaatcgaatgactaaaaaaataatcgatcatgttctttaatttcaaatttaattatatatctatataaatacccttaacttgtttttgacgatcctaccaagccagagaacttataactgtcatattcataccatatgctatataattagtgggatataatactctatctttaactttacgcgtaacaactttttaattaggatttaggaataagaacctttcttttgtttgttaaaaaattctttctctttctctctcaattttttcactatataaattattaagttagacgcatgtatatgtctttttactaacacgtagaccggtagacgtccatgtgctccatgcacgtgtgtaaatacatctttttttgccatgtgtgaactaatttttttaatttgccaagccaaagttataattaattaaatagcagaaagagtcttaagagaaataatatgattataatggcagaagaaaagttaagatttacagatacatccaatagtgtatagccgcttaattaatttatccacacctcaacgaaaatttccgttggtgcgctaacgaattcaggctgtgaagttaaaagaaaataaacaaaattatagcttcacataagcgatcgatcttcaaactctacacatgacagaagcaaataactaaattaaatagcgtaaattttgtaataatactagaaaacctaaaaaccaaatgtaaaaaaccttatgggaaaaaatgtgataaagcacctaaaccatagaataacttaaaatttcaatttcccaatcaaggtatgatataaaaaccatggaaaacaaattctcagccatatttctatctgaccgagtctttttcaaaataatatatagacggtagagtcttatatagtaaaaacatttttttaaaactaatttatcttctcatatgaaaatgaatgcaaataaaaatgaccatatatgctgtaatgatattcaaggaagagatatcacaacaaggtcgaagaaatatacaatatctgaaagtcgactatatggtccactttccaaattagagatggaaagaagaaacgattatgcagcaaacccattgatcggacgaagaaagaataaatatggaggcccattactatagtatttggccttgaaatattttggtccgagaaataataaataaacagttatggcttttcggatttggttgctttcaattttctcaaatgtttggacaagtgttattacactcacctaaaacaggatcattccaatttcttgggctcagagtctgtactttcttcttctttaaaccaaggtcttataagtattctctaaaccaagtcactaaacaataattggtcttgggtctggttcaaacttggatcaatgttgccacatagccattagccacacaaaacaaaaattgtcttgcctttatatggaatgaagaaaaatcgaattttgtaaccatttttgactttaaagtcacactcgccgtatacggcacaccaaatgaccaaaaacatttgaccaccaactttgctttaatgttaaaactttttttttgcatcccactactctcttcttcacctcctcaagtcacagtgaccaaaatcacacacttcacaagaaacaacctatg

SEQ ID NO: 25653 - DNA, 3003 bp, Unknown; identical to SEQ ID NO: 25652
  misc_feature (1)..( 3003): 2750-1469P.txt file - cDNA_ID_2707463; gDNA_ID_2214516; Annot_ID_184453

SEQ ID NO: 25654 - DNA, 3000 bp, Unknown; identical to SEQ ID NO: 11219
  misc_feature (1)..( 3000): 2750-1469P.txt file - cDNA_ID_2707474; gDNA_ID_2214484; Annot_ID_133324

SEQ ID NO: 25655 - DNA, 3000 bp, Unknown; identical to SEQ ID NO: 11219
  misc_feature (1)..( 3000): 2750-1469P.txt file - cDNA_ID_2707474; gDNA_ID_2214484; Annot_ID_183449

SEQ ID NO: 25656 - DNA, 3000 bp, Unknown; identical to SEQ ID NO: 11220
  misc_feature (1)..( 3000): 2750-1469P.txt file - cDNA_ID_2707482; gDNA_ID_2214484; Annot_ID_133327

SEQ ID NO: 25657 - DNA, 3000 bp, Unknown; identical to SEQ ID NO: 11220
  misc_feature (1)..( 3000): 2750-1469P.txt file - cDNA_ID_2707482; gDNA_ID_2214484; Annot_ID_183453

SEQ ID NO: 25658 - DNA, 3003 bp, Unknown
  misc_feature (1)..( 3003): 2750-1469P.txt file - cDNA_ID_2707494; gDNA_ID_2214517; Annot_ID_133984
gaattctcaacgacgacgccgttttaatcgaaccgggaaaaatctccggagatcccaccgtcgttaccgtcaattgtcctgatgaatccggtctcggttcaactctgtgtagaatcatcctcgaatttggtctctccattacccgagcaggtcaatattcaattttacttcgtatctgtttaggggaatattctctgtttgtcgtttagcttcacggaatattcttctttatgattcgaaaaattcaattctgtttttcttattttgagggtaattaatatgtttgtaaaaatggtgtttgcagatttttcaacagatggaagatggtgttatatagtgttttgggttactccagatattagctctcctaaaattgattgggacagcttaaagaatcgtcttttatcagcttgtccttcttgcttaggctctttctacttctgccttcaatccaatgtctctaagcctccttccctttatcttctcaagttcttttgccgtgataggaaaggattgcttcatggtatgtgtaaagttattgtcttttgtcttgtgcttggtgttttctttatatggttgattaaaagtttgtgtttttttggtgattcgtagatgttactaaagttttgacagagctagagtttacaatacaaagagtcaaagtcatgacaacaccagatggaagagttttggatatgtttttcatcactgacgcaatgtgagttttcttcttctttctaattctgatgtttcatttgagagaagaaccaacattaacgttgtggtttgtgactttgtgtaacagggatctattgcacacgaaacagagacaaaccaaaacgtgtgaccatctaacggctgtgcttggtgagcatggtgtgagttgtgagcttgaactagctgggcctgagttagagagtgtgcaacgattctcttcacttccacctttggctgctgatgagctgtttggcccagatgggtttgatattagcggctctagctctaacaaagcggttcttaccgttgataatcagttgagccctgcacatacgttgcttcagattcgttgtgttgatcaaaagggacttttctatgatatcctcaggacttccaaagactgcgatgtccacgtacgttaaaactgatctctctaacattaagagaacctaaccttacctctgctaagagaagttgggacttctatggttgaaagatttgtataactcaagtagttcttgtttctttatccagattgcatacggtaggttctcctccaaggttaaaggttataggaatttggagttgtttgttagaggcacagacgggaataaaataatggacccaaaacatcaagccaacttctgtgctcgacttaaggaggaaatggtgtgtcctttgcgagtgattatcgtgaaccgaggaccagatactgagctattagtagccaaccctgtggaactatccggaaaaggaagaccacgagttttctacgatgtcacacttgcgttgaaatcactaggaatctgcatcttctccgtaagtactgtataataatacattgtgttctctaagctttttgaacggttattttcggtttgttttaagattggcattgcgttttcttgtaggctgagattgggagacattcgactttagatcgacaatgggaagtttatagatttcttttggatgagagtcgtgaattcccattggctagcctccgtgcgagaaatcaagtagtagatagagtcacaaagacacttatgggttggtgaagcggatgagagtgagctttcatgaacgttatgctacactcaaggggacaaagaaacaaagtcttcttcgcttgcggcttcgggtcgatgaaaagagtgatgcaagggggttgtgattgctgttgtgtggagctaatagcgttgtaaagctttggaaattgtaaaaggattatataaccgcaattgcaatgaatgcttgtaaactcactttgcaaaggtaacatttccgttgactaggtggtcactacaagagagcgacagagttgacccgagccagaatcgcaaacatgttacatttagccatgtagtggcctttgggggataatatggtaattagacaaattgtatcgaaatatatttagagtgttgccatcaaagatctctgtgtttttgaattctttttaatcatatactgaaatttgttttagttgtcatcaatatattcatctactactgtactaatccctttataattgagtttatataacgaagaaaaaggagatatagatgcattgacaagtccataattatgtttagttgtttaccattggatctgaaatagattcgaaaaattaaacggttaagaaaaaggaaacgcgttaattaaaaataaaaaaacgaagcggtagggttaatttcgtcgtttcgttatccgttgtcgctcgctcgtgcttcatcggcggctagtaatccagtgcagcagaggtcctcctatcttaacgaaagctgtgattctccttcgtctttcaatatcattcttaggtttttgaaattcatgtgtcgtaagaaccgaggaagatgacgacaccaatcaccgggaaaaactctcctgttaccggaaaagaagaaggcgaactatctacctccgacgacgaagtatcaattctcgctactataacttatattttctgctattgattttcacagtctgcgaatctggattctgttgcaccctgaacatatcaactgatctctctcgatttgtgtggtttttgagatctgcctgtgttcaatttgtatgggtttatagatttggggtataaattgtgttagttcagagactagagcttatttcttagtgattgttcgttgattatttgatttcaaagctttcgtgttgcattaattgcggcaatccactgtttccagaatgttttattattattgattagcagatttcaaaaccctaaaatttcaacgattttgtttttcttaggtacaaccaatg

SEQ ID NO: 25659 - DNA, 3003 bp, Unknown
  misc_feature (1)..( 3003): 2750-1469P.txt file - cDNA_ID_2707498; gDNA_ID_2214517; Annot_ID_133983
aaaaaatgttgatgattaaggacaattaaatcagactaaaaaccggtttaattctattaatcattcctggtttttctctcctagacctcatcttcttgaatcttgattaccaaatccgattcttgaactgtgttttaccaaacttttaccacttgaatttactaagcttctgcaatctccatcactttcttcttgtaaagcttctcctctgcatcccttaagaacttgaatctcgacaatggcgaagatgacggtgaatgtgatgatgacaatggagatgatctcactagtctattaaactcagcatcagaggatgactcaaacaaactcgagatctcttcttttctaccattacaagactccattagcaatggagttaaaggaggcgtgaacaacgaaggagaagcacgaggagtgagatatggaggagttatgacaccactttccatattaagaaacaaatcattcaaactctttccttttgtggaaaccacatcttcagattccatttcttccactgtttcttccatgattgtgaacagaaacctcggcacaagccctggaccaccaacattctcaaacccattattaagaggacactgttgttgagtgtcaatgggtttagggtttgagaaagaggaagaagaaggagaagaagaagaagggtttgtgctactactgcaacagaagatgaagagaagctctctggttccaggggtagaatagtcatttcgaaaatcaggtcttctcgtcgtcgacctcttcttacaccaaagcaagtaataaagctcagcgagaagagctaatagcaagcaaccaaagactatgcttagagcaagtcccacactgctcagagatctcatctttcttcttctagataagattcacttctcttgttcatcgttactccaacacaaagagaagacctttttatccgattcgaccaaatgtgaaatgcagaaggaatggacactatggcggttgtttatgattctgagaatagcaagggtttttgcagagacggaagaagaaaataaagttgggatgaaagaaaagcttgggaatgtggaaaaaaaagaaagaaaagcttgggaatgtgaaaatataaataatttcctaaaaaaggtgttatatagccaagtgtgtaagtgtaagtgaaactctcactcatattttagaatcaataaatgcataagtgaatacgaaattttacccttaatgaaagactttagcttctgaccatttttttttcttttcaatttatatgtcaaatgatgattttatcattgaagatgtatgaatcgaactccatgcatcattattctgacaattctactaacaattaaaatatgggagagatgactcgcgcggtgttgtagtatatggatcatgttcacagtgattcgtgcatatatatttgaaacatatgaaattacgaggaacaaaacaactctacttcattacaccattctgaaaatatttggcaagtttatctctattaatcctatattaagaatagaactccaaacctagtacactaaattaattaataaacttattttggtataaccacgggatggatgatggaagaaggggactttcaattttgactactttatgattttctgatgtttgatctactacttaactttgttacaaaaagaataccattgcaacaaaaaatttctttaatcacaaaaataaacattgttttttttccttttatcttggtttcccttacaaagcatcatatggatagcacttcaaggccttatagcccatgtgatgtgacgcatatgaagtaagagatgtgaacttgaaactgattataacacaagtagcctgagatagagtgagatttgttttgttttgcggttcttcatgttgattgatatcaaagtcagagtcagattagcctaccaaatcgaagtgtcagtgattccacctcaataatacaatttcgtaatgtgcatcaacaactatctagcctcctccatcaaccaatcacaacttcatgtagtaggctagtagcattgataatgatatccctttttagacttgtttccattcgtcatataccacttgatgacttgtttaaatccctttattctctttagtccgtgtaccaatatttttgcaaagaaagtagaatcatggattactcataactaacagaaacgttgagaaattggaaaatatgttcatagtgctaaggaggaaaactacttcttcttctcttctcaacaattgcaaataacacaagaaactaaaactgtgactcagtcttggcctcccaagtcacaatttcatgtttacaaattttctcctgcaaatatcatttcattttgcaaattaataagtttagtacggtgattatattcccttggatttatcaaataaaacccaacatatgagtccattatgcatcctcacatgaagtattttgcatttccttttatacacaccacaaaatatacagcaaacttcaactaaaacacaatctaataaataaaaaatagaacacttagttcccaccacagattttattacaaaaaaaacaaaattatcattatccgtattttatatcgtgcatcacaatttgtgattattcattgtattaacgagcccacacataaaagatcttaattatccatctacaccttaaaatctacggaccgtcttacattaatacagctagttcaccttgtgaaatctcggtaataccctcagctgcaaaagatagaagtttcatagaacggtacgtgttcattacccaacccagctttaaattttcttcttacgtgtgtatgactagacacgtaggtcccactcagcaccacgacaacccaataataaacatataaaaacaaaaagaaattaattaattttttttctttcttcatatatataattcgtttcttcttcctttttccccgagatttttttcctctgttcggtcggccattgaattgttgttgattcattggctctaaaacgaaaatg

SEQ ID NO: 25660 - DNA, 3003 bp, Unknown; identical to SEQ ID NO: 25659
  misc_feature (1)..( 3003): 2750-1469P.txt file - cDNA_ID_2707498; gDNA_ID_2214517; Annot_ID_184487

SEQ ID NO: 25661 - DNA, 3003 bp, Unknown
  misc_feature (1)..( 3003): 2750-1469P.txt file - cDNA_ID_2707505; gDNA_ID_2214517; Annot_ID_133981
actggaactggtcgtttggaaagagcaagggatgagaaaacggataaaacggcaagagagacgaatgcgaagagaagaagactggccgatgcatatcctttactaaagaacttatccactggatcagtcgaatcaaattctattaatgctatgtatgtgtctttcaaatctttgctcactccaaatcctgccgccgaacccgttgcaagtaaatatgatattacctgtccaaatttgaaccagattttgttatatatcaatatacagtatgacttataattttaatgtatttaaagatagtatttcctcaaaaatgatataaataccttatcaccgtagaaatcgaactgataagtaagaggatgtgtttttccggtggcaaattgggagattgttaagaacagttgtacaacggcgtaaactagtccgatgacggcagcggacagcatgtatcttcatgaatgatgaatccaaacatatatgcaaaaaataggtaaaaatagttagtcaaatattggatacaaaattttcacagagaaggtaaataatttatttacctataagcatagacatcgttgaaaggcaatttgatagacgtgcttgaaatttcgagagtgacggtgttggtgctgatgaggaccaccgttatgaggaggaaagccgcggtcaaaaccctaaggagaaggagcactgtcctcaacgtaacggacggtggtgccggaggtggtggagccatataaatcttcccgttaattaatcgttacgctttaaagagtaagatgaaaatgattaaggctaagatgttcgaatgcaagacatggaatgttgactaatttatagccaaaatttacgttgactcgagttcgaagagttgatttttgttacattataatatttaaccataatgtaaaatatatatatgcacaaattgtattcttcaattcgtgctggagcttgctggaactcgatcaccacttctaagttctaacttagtaattgaagtcgtgatatattttattgacatatggtattaatttagatttaaaacagtttttagccaaggaattgtaagtctaaattcatagtcttcgtagccagaaggcaacctttgatattatttttattatctatatctttttttttttttggacaaagcttgtatctacatctaactgagaaaaaagaatgtttttctttgtcatattattgttctcaaattctgattatacaacttttgacatcaaatcataattatgcaatcaaacaaacaaaccaaaaaagaaatatgcgactagcgtaatttttgcgccacaatgtattttatatgcatagcaaatcattagaatcctagtacaactgtacaaagttcgagttggacacctagcagcgataattcaaaccatgtttccatctaatgtaacagtatagacttagtcgtctatcaattttaggtgcaatcattcgtattaaaaagaaaacttagtttttttttcatactgtttagaggaacaaaatacatgtaacaagaggtacatttttgtttgagttaaattttacaatttttgaatatatagtcaacgaagaccgaaaaagttgagtcaattcctaagaatcaatctgccacatgcatcgccgtgcttgaagggcggctcactgtcttcttgcttattactacagttaaatctttttttttcaacatctaatgctatacttttaatctataatatatattagatgtgacttaaggaatttcaatagttatacataataataaaaatgaatatttgttagtgttacaaactgtgtgtcataatcatcattcatcaggatttcaaaaatatctcaaaattgttgtaagttcatgtaattcgaaatgaatgtgcactataagaaataaatttacaatttaaaaaatgcttcaatactggttacaaaaaaaactttcaatactagtattatactacttacttagtcaaaaaagtttatgaatatggttttttctgtatgttaatatttttaactgaaaatagtaccgacataacaagtaaagatatctttatttaaagtaacaaacattaatttcacttcaaattctcactattaaggattcctctctttgtagccacatttcaccatcactactttgttttcgcatatctttaaattttgtatacgtagcaaactctttcgagaaaacaagatgaagctcgtggttgtacaattcttcataatctctcttctcctcacatcttcattttctgtactttcaagtgctgattcgtgtaagtgtttacttaatctagttaataattgtaggtcatgcatgtatcattttgaaacaagttttctgaaattctaagattttacatatatatgtgataaatgaattagcagcatgcggtggaaagtgcaatgtgagatgctcaaaggcaggacaacatgaagaatgcctcaagtactgcaatatatgttgccagaagtgtaattgtgttccttcgggaacttttggacacaaagatgaatgtccttgctaccgtgatatgaaaaactccaaaggtggatccaagtgtccttgaacgttctttgaagatcctcatcacatacatataacttctacgtactatatgtgtggaaatattaatcacattctatgtttgaaatatataaaataaaatcaatgcccccaatgttggaaatcttcaatgtgatatcttaatatatatcacgaataaaaaagtttaaatttctcaatctcatttttaatctttaatctaatttcttaacacatcaacgaatctttaatctttaatcatgtagataattatcagagcacctaaacattgcgccgttttgtgattatacaaagtaacatcgtgctgtttttgacttttgaaaaccacagatccaaaaactgtttactttcctctaagagaaagcaaagccgagtgagtccaagcgagttttgagagattcgttgactcactaccggagaacgacgctatg

SEQ ID NO: 25662 - DNA, 3003 bp, Unknown; identical to SEQ ID NO: 25661
  misc_feature (1)..( 3003): 2750-1469P.txt file - cDNA_ID_2707505; gDNA_ID_2214517; Annot_ID_184485

SEQ ID NO: 25663 - DNA, 3003 bp, Unknown
  misc_feature (1)..( 3003): 2750-1469P.txt file - cDNA_ID_2707509; gDNA_ID_2214517; Annot_ID_133980
ttattaatgtcaacgtcaaccatttttaaaaaaaatcatagaaatgcatattgtttattttttattattatttaattgcaaatttgcaatcgtgaaggactcaaaagccgtatataaacgaattatgtaaattactaataacatttttggaaaaaatgtgaatattcaggatataaaaatagtataatacttaaattattgttcgtacaagaatgacacgtaactgcaaacgcgttgacttcgtaggcctaattaaaacgcttatgaaattgccaataaacacacacgggaaaatagtaacatccaaacattgcatggaaaagagtttaaggtttgtgaaggaatttgagaattttcttccttactttttttttctttctgaaattaaaattgttttcttccttcaattttgatgaagaagaaaacacataaacgttgcaaaacgacactatacatgttgacttttggtaggcgtaaatgattcgttttactggcaaattatgaaaagttagggctttttaataacattttttaatgatccgacacaataataattttgcatgatgattagaaataagaagacttgaccttatagataggttggttacatatgttttcacagaaatagtactcccaaacatagccttgcgagatatgtagccaacaaagtaatatatgtatttggtaacgtgacccaaagaatcttaaaaagcgtataatcttattaaattccacgattggtgaattaaaatgaaggaagcataatgtagggttacaatgatcatatgtgtgtttatgagactggaactggtcgtttggaaagagcaagggatgagaaaacggataaaacggcaagagagacgaatgcgaagagaagaagactggccgatgcatatcctttactaaagaacttatccactggatcagtcgaatcaaattctattaatgctatgtatgtgtctttcaaatctttgctcactccaaatcctgccgccgaacccgttgcaagtaaatatgatattacctgtccaaatttgaaccagattttgttatatatcaatatacagtatgacttataattttaatgtatttaaagatagtatttcctcaaaaatgatataaataccttatcaccgtagaaatcgaactgataagtaagaggatgtgtttttccggtggcaaattgggagattgttaagaacagttgtacaacggcgtaaactagtccgatgacggcagcggacagcatgtatcttcatgaatgatgaatccaaacatatatgcaaaaaataggtaaaaatagttagtcaaatattggatacaaaattttcacagagaaggtaaataatttatttacctataagcatagacatcgttgaaaggcaatttgatagacgtgcttgaaatttcgagagtgacggtgttggtgctgatgaggaccaccgttatgaggaggaaagccgcggtcaaaaccctaaggagaaggagcactgtcctcaacgtaacggacggtggtgccggaggtggtggagccatataaatcttcccgttaattaatcgttacgctttaaagagtaagatgaaaatgattaaggctaagatgttcgaatgcaagacatggaatgttgactaatttatagccaaaatttacgttgactcgagttcgaagagttgatttttgttacattataatatttaaccataatgtaaaatatatatatgcacaaattgtattcttcaattcgtgctggagcttgctggaactcgatcaccacttctaagttctaacttagtaattgaagtcgtgatatattttattgacatatggtattaatttagatttaaaacagtttttagccaaggaattgtaagtctaaattcatagtcttcgtagccagaaggcaacctttgatattatttttattatctatatctttttttttttttggacaaagcttgtatctacatctaactgagaaaaaagaatgtttttctttgtcatattattgttctcaaattctgattatacaacttttgacatcaaatcataattatgcaatcaaacaaacaaaccaaaaaagaaatatgcgactagcgtaatttttgcgccacaatgtattttatatgcatagcaaatcattagaatcctagtacaactgtacaaagttcgagttggacacctagcagcgataattcaaaccatgtttccatctaatgtaacagtatagacttagtcgtctatcaattttaggtgcaatcattcgtattaaaaagaaaacttagtttttttttcatactgtttagaggaacaaaatacatgtaacaagaggtacatttttgtttgagttaaattttacaatttttgaatatatagtcaacgaagaccgaaaaagttgagtcaattcctaagaatcaatctgccacatgcatcgccgtgcttgaagggcggctcactgtcttcttgcttattactacagttaaatctttttttttcaacatctaatgctatacttttaatctataatatatattagatgtgacttaaggaatttcaatagttatacataataataaaaatgaatatttgttagtgttacaaactgtgtgtcataatcatcattcatcaggatttcaaaaatatctcaaaattgttgtaagttcatgtaattcgaaatgaatgtgcactataagaaataaatttacaatttaaaaaatgcttcaatactggttacaaaaaaaactttcaatactagtattatactacttacttagtcaaaaaagtttatgaatatggttttttctgtatgttaatatttttaactgaaaatagtaccgacataacaagtaaagatatctttatttaaagtaacaaacattaatttcacttcaaattctcactattaaggattcctctctttgtagccacatttcaccatcactactttgttttcgcatatctttaaattttgtatacgtagcaaactctttcgagaaaacaagatg

SEQ ID NO: 25664 - DNA, 3003 bp, Unknown; identical to SEQ ID NO: 25663
  misc_feature (1)..( 3003): 2750-1469P.txt file - cDNA_ID_2707509; gDNA_ID_2214517; Annot_ID_184484

SEQ ID NO: 25665 - DNA, 3000 bp, Unknown; identical to SEQ ID NO: 11796
  misc_feature (1)..( 3000): 2750-1469P.txt file - cDNA_ID_2707520; gDNA_ID_2214517; Annot_ID_133974

SEQ ID NO: 25666 - DNA, 3000 bp, Unknown; identical to SEQ ID NO: 11810
  misc_feature (1)..( 3000): 2750-1469P.txt file - cDNA_ID_2707520; gDNA_ID_2214517; Annot_ID_184478

SEQ ID NO: 25667 - DNA, 3003 bp, Unknown
  misc_feature (1)..( 3003): 2750-1469P.txt file - cDNA_ID_2707532; gDNA_ID_2214517; Annot_ID_133966
tggtcacttggatttcggctcatatgctttatctgtgtgacgaatttgaagaatattcatcctacagaaccaaaagaactaaaaggaacattcaaaagaatagagaatgtgtgaaaacaatttggcacaagagattatgcgaaagtcaactcttgccctataagacaagtaatcacaaagtcaaatttctcaaaatttgtctttttctcagaaataaattataaacaactgatgtttacatatgttcaacttcaaatttcaaacacgattacttaacaaaactacgatagtctctgatatattgcggatatatatcgccagcccccacctcttcatcttggtctaacaaatcttagtgaccaacaaagtgattcacacaagaggacatattttggtgtatcaattcttcttcttcttctttttggtcaaaatggtattatcaattcttcaaaatctcagattttttacctaatgattctctattggtgtgtaggtttcatatctgtcaacttatcttgcaaatcaccgcatcactttcgtttcttttaatatgattttttctcgggtcaaacatatgtacgcaattaaaagttttctaagaaagaatcacattgcctagagtttaccactggttgagtaatatgctagagagagtcatgtcgctgcgcgatcgagttgggtttagttgataagcaatgaactgctcaaggcaagatcgagttggagtgaagagtaatgtatagagatcactaccctaacaagctaaccctcaactgagtaatataaaagatgctatgatccaataatataacaatactgtttttctgaatcaatctttcattaagatgagcttttaatatctttaacaaggaaggaaaacaaagcaaaaactcacacgagctcaaattcaaacacaaaaattgatgtgatcaagataaaagcttacaccttaatagcatacttccttattggaaagtacatttctttcttcttctccctctctgtcttcaacgatgcctattcaaatcagccagcaattattccattcagtacaataaaacacaggatttgttcatcacttctcaatatcaatctgaatcacactaaagaatatacaaatacctgatgcttagtgagtctcctcctgatggctctagtcttcttgggacgaagatcaagaggcaaaagcttcttgttcttgtatgcctctctcaaagcagacttttgtttctgtgagatcactgtcaacacctgagcaatcgacttcctcaccaccttgctgaaatcaacataaaacataacccatttgagatcaatgtgattaaaaaccagtgaccgaacaatccaacagtgatataactaagcaagtaagctactttatctatctatagaggataatgataggacctaggatacaaaaattacactaaacaacttgcaaaacataagcagaacttaggtaataatatatgtccataacaacacataaacataattaaacctagctaaatatgattactacataaccctgactaaccactaacaccagcaagatcataaacaaagctatgaagaattcagaatccaaaaaaaaaaagagttaaccaaaatcagaaaaatgtaacatttgatcacacaaagtgtgtatagaggaaacacatacatcttagagagcttattaggagcacctccagtgaccttagcgacacgaaggagagcaagctctgccttaaattccttcaactgacccgaaagatcagcttttgatttctccctcagctcatgaaccttgattctcgctgttcagattccatttcacaatataaaatcaaatctcataacctaaacgtacgaaattgtgtgttaacagaggaaaaagtttgagaatttaggcttacccattgcgtcttcgagctctctctagcgtccctttactcttttgcggtgttgttataagagattagaaaccctagagaaaaatgaagaagaagacggctaagagttaataatcagattttaggttatatttgggctttgactgtgagtataaaacccaacacacatctaatgggctgagttttatatcttatgggccagggattataaaatcctagtagtgaaatcttgtaccaaaatcatttattaatgcaagaaaatactaaaaaagtgaatagagagttgtataattagacacgcgccgattgaactgttattttttgtttttgaaggagaattatttgatttcaaatataataataacataatttagcttttcagaataaatttcttctcttttctttttctttttgacatgtctaattagattgtgaatgaaggagtaatcttagaagaagttttggttaaagacgttatcgtaatcaataatgtgatggaaaagtgtaattatgagtcgcgtaatgaaccaaccatacatttgtcaacaagttgatacaaagacataaatgcatgtttatccatccccaagttcaatattcaaagactaaattatgagcatttcataatgactcagtatgccatttggtcaaatgaaaaaccaagccggtcaagcaccaacggctgaaacattcatattcaaatatgaaaagtaaaatcttggactcgttcaatgtttctggtgacgtcatctactacgaggaaaatatcccaaccaaaacgcagcgtaattgcatggtcccctgtttttttggggtcgctttattcctctgtgactcctctcttttcatcttctataaatcagacaacaactaactctttccctctcgctctccgcataaatccctttgaaacaagatcatatcttaactttgtataaaaacaggacaaaaaaacagaggatcatggttatgtatgaagaggttagtgtctttatatatgtttccaagctcatgtagagctctgtgactgtagaaaagtgatagttattcctttctttttttgatcctataatctcgatctagcagaatcattctattaggtctaatg

SEQ ID NO: 25668 - DNA, 2767 bp, Unknown; identical to SEQ ID NO: 11823
  misc_feature (1)..( 2767): 2750-1469P.txt file - cDNA_ID_2707544; gDNA_ID_2214518; Annot_ID_134014

SEQ ID NO: 25669 - DNA, 2767 bp, Unknown; identical to SEQ ID NO: 11823
  misc_feature (1)..( 2767): 2750-1469P.txt file - cDNA_ID_2707544; gDNA_ID_2214518; Annot_ID_184530

SEQ ID NO: 25670 - DNA, 3003 bp, Unknown
  misc_feature (1)..( 3003): 2750-1469P.txt file - cDNA_ID_2707548; gDNA_ID_2214518; Annot_ID_134013
aactgtaaagctgggagggaacttctcttctgagaaagacatgaatatcaatcaatgtaagttgccaattgccataactagtgtaaggaggatcacataaaaacaatcacatacttccttcagtctgcttccatagccattctgaaaccgcagaatcatatgcagcaacatgctgaaaggccttccacgcaagttttctgcggaattgttggtcgctctgtcctcctttgagatactccaaaacagcttgataatctcctgaatcgacaacaatgagaacgtctttgtggttctgttgaaaaaacaatagaaaatatacatttataatcttgaaaataatcttgcaagtgtaaagaaaaagtctcatatgcacagatatatgtattaccttagcagctgctctaatcatagcagggccaccaatgtcaatgttctcaatcccatcctcaaaactgatcccacctggagcagtaactttttcatagaacgggtacaaattgacaaccacaacatcaaatgtacctgtcatagaattaaaaaaaaaaaaggtacagttaaacataaggagacactataaatgacttagtctcaagcttaatgtagaggatcaatcaaaggtcaaaactcaccaatcccatgctcattaagagcttccatatgatgctccacatcccttctagcgaggataccaccatgtatgtttggatgcaaagttttcacacggccatcaagctttaagagaagaaaaaaaaaaaggagagctaagtttaatatactaaactcaacaaaacaatggtataaaccaaaacttaaatataaatatcagcgagatcacaagaccaaaacttttagcaagagcagcgagcataagagaaaagaaaaacatgccatttctggaaaatgagtaagcttctccactttggtcacagagactccagcattctccaaagtagaggcagttcctccagtagaaacaatagtgtatctacacaaatatcaatgaaaaaaggaatcatttacatataagatagaaacaaaaccaaaatttgtatagttctaagtaagagagagttgtgaagaacacataccccaattcttgcagaccgttgccaagagaagccaagtccctcttgtcagatagagatatcaaagcttgcttctcccctgattcaattaaagcccgattatttgaaaatcactaaaacgtaactgaaaatcgatcactgaatttgaaattgcagcaaaaagaaaaattgtaaaccagaggagcctgaggattgcggctgattcctctgagcagtctgagactctgccatggctcgaacagcaacgaaacttggacacagcgacgtacgatagacctgctcattgaaaattccactaatattaaaaagtttagcagaacatgaaacaaagacacaaaggaacacgtccacacacagaggagaactcacaggctgagtaaaacgaaaaggcgcgacggattttttgcgaaacaagccgcagagaatatcgccggagcgagcactcacggaggtggcggtggcggctgagctgagcatagtagtctgattttgaaacagtgtgtagtgttgagctctgttaggttttgtgattttgcggctaattttggaaataaattagaaaaaaaaataaaaaaaaaaggaaaatatgtaatttattattggcgtcaggtggaattatgtatttattattatggccttgacagttagattacacctggaatatttggaaaattggaataaagcttctctttttatttcccccaaaaataaaactaaactattttaactccaaattttaaaaaatttagtagaaaccaaaattctcaagtgtaaactaattagtaagaaataaaactttattggatcagagtggtaatattacaaaagactaactatggagatgacgaaagcttcttatgttttatatgatattttatttgcttttcagaattttaaataatgtaagtagataacaattattttattggtaggcataatagtttttttctcgagaatatagttttgtttttcgaattgtcaaaattagaagagagattttaaggaaggacttggcttcttctcctactcatcgatcgtcaaaccgaggacgcttcacagtctctggtgccgcctttcctggtataaacctttttctctacttctctccttctttgcttactcgtcttccttttaggtgtatgctgtttttgaattttgatcattattatcgaaaatctctggatccgatgtgtttccacctgaatttcgggtaatgatactcagatcttgcattttctagagtttcagtggttttgatggcttgatcggcttttgttttttggttgggtagaggtttttagctcagtttttggttcgaaatgacgcttatttgtttcctttttgaggtttggaattgtttcacggacttgattgaattttggatttagttctatgttttgatctgttgatttacactctctcaaagttacgatgggtttgctaatagtttggtgaagttgatcgattttagtttcagcgattcctgttagtttaaacttgaagagactagaaagtagtcattttagctagtttcatgttggaaagtatgcacagtcagatatttgtactggatgatctgtccctgctagagtaaagagttttattggtttgtataccgaaaatgttccttaaatagtatggttttctgagttttagccgtatgctattttggtttttttgttcttgaatatgtttgactacttgagtaaagttactcttctcctatttcaggcacctcaatgagagtttgagttgttcatgatagaagtcgtcctgttctgcagccaaaacgttagaaatttgcgaaggatgcttatgcaaagattttacttgggtcatgatcatgatatgtcgcctacaagcgtttgtgagggagcttatgaactagatagatagacaccttgagaaagaaaacatg

SEQ ID NO: 25671 - DNA, 3003 bp, Unknown; identical to SEQ ID NO: 25670
  misc_feature (1)..( 3003): 2750-1469P.txt file - cDNA_ID_2707548; gDNA_ID_2214518; Annot_ID_184529

SEQ ID NO: 25672 - DNA, 3003 bp, Unknown
  misc_feature (1)..( 3003): 2750-1469P.txt file - cDNA_ID_2707552; gDNA_ID_2214518; Annot_ID_134010
aataattttatggtggtaggaatctaataatattcagttatctagacaaagcaagaaaaacgatatcaattgacatcgtgacaactataactatctattatacacatcgtttaaaaaaaataaaacaataccattaaaatccaatcgacgtatgtaaatcatcatcgttgacttgccaaaataaataataggaaaccttataaaatttgatgctaactaactcgggcgggtttcatccaaattaaatagaaacattgacggaacatggagtgtccaatacacacaagatccaatcattacttcgaggagtcacttcaaaactccaaataacaatgacccaaacaaatttcattggacaatgaataattaacacattattatccacaatcaggatcgtataaactaaaaacctttaattcggggctagtttagaagtcatcactttcccgtgggtcattttgtaatttacatttcccaaattatctcttttagtttctccgacgatgcctgaaaaataccaaacattagttacagtcggaatttcgaaaaaccctaattcagctaaagtttgatcgttgatctaaaagctcgagtgatgaagggaaattggtcgatcgtacgaaaggttcttcatcgccagttctccactctccgttcctcgacaccatcgtcgcgattatctacttccatccgaccgcttgttctggccccaaactcgatatcgtcgctaatcgctagaaattcgttgttcactgcctccaacattggtccatccatcgattttaacttctccaacacttcgcttcctcatcggagaagcctctgttcggaagctggaggtaattaatcaattggttctgctgcttcctgcgtatttgcgtaaatgtctgtgattagcatgatcttggctggaaaacgagattgatcagaggaataagcttgagtttatagtgctaggctgctagctttttctatgggaatcaaaattactaagctctaactctaccaaaagccatttcagcgaatttttttttagaaattgggaatttatctgtgcaagtcagttggagaaaactaaagtttgcatatttaaatgagtatctatctataacgtctctgtgttagaaatgaatctaatcctgcaattatgatgttaggtgaaaatggtgttgttctagtgaaatcagaggaagagttcatcaatgcaatgagcaaagctcaaggtaaaccattacacttactttcttacctcacgctaagtggatgtgtttagtatgatttgctgcttatgtcctcttcttgttatctgtactcagatggatctttaccatcggtcttctatttcactgccgcctggtgtggaccatgtatgttaattcttctgaaagtgagttttgttctgtatggtaatttttttttgtgagtggccttattagtttgtgtttcattttactttaggcaggtttatctctcctgtaatcgtggagcttagtaaacaatatcccgatgtaactacgtataaagtcgacattgatgaggtattttcgtcttgcttttgaactctatgcatatatgtctattttcgttgggtttctgtgattagaaccttctacagtgttttgagattgaaacaaaggagacgattatttggtgtgctgtatagaaccttactcgccacactctgtttcaatgttatgtatgcgatagagttagcgagtaaaatagctgaaccagacaatattagtcaagcttctttacggctctttgcgcaatcttctgtgctcatgaatttttgcttaaaacttaatcctttcttgcatatctgtagggcgggatttcgaacactatcagcaagttgaatatcacggctgtggtgagctttcattaccctgtctttccaactataatctacattttacaattagcaggaataactcatgttgaaacggggatttttatatttgtctcatgaacatatatgatgcagccaacactgcatttcttcaaaggaggctcgaagaaaggggaggttgtgggtgcagatgtcacgaagctgaagaatctcatggaacagctctacaagtgaagacctaatccgttctagtaaagaacgtgttgaatagctgctagttaagactgtccaatcaaatcaaggttaaaaaattcttgcttcctttttcaacaataaggctttatgtagttttctccaaataatgatgagatgtttcatatgatttaaccgatgaattgaagttgggtatgcaaaagacattcctctgaattacaatatacgctaatgatatcattatcattagactcacaatttgagatcaatctagaaataatgaatgcgctgaatcagtttcgtctttgttcccccttgttgttcaggattgtaattgcccttttgttttgtttgttttctccatttcctttgggcttagtttccggaaatttgtttgtgtccgtcggtgacaacttcaaaaaatatcgacaagtcataactttttatcaaaattttgactaagttgtcaagcccttagtcgacactcgacgcccctgacattaaaagtattgactccagtgccctgtgccggcctaaaagagggcctattttgggactcttttgctggcaaattgcgccatatgtagtggagtaaatgtgtaaaaaaacagttgaatcaacataaccattatttgatcagaaaagaaaacaaaaatgtggtgtaatgagaggaggatacggtatgtggaaacttgatttacttaatttcaaaggagacctacggagtcaaagagagagttagaccaactaattgtccagagggattgagattggaggaagggtattatggtactttacgaatactattacgttgattaatttggatactttgtcttcttcttcgtctctctcccctcgcgcatcttcggtgctataaaacaaactcacgactagatcatttttggagtgagatttacgtttgatagactactacaatg

SEQ ID NO: 25673 - DNA, 3003 bp, Unknown; identical to SEQ ID NO: 25672
  misc_feature (1)..( 3003): 2750-1469P.txt file - cDNA_ID_2707552; gDNA_ID_2214518; Annot_ID_184526

SEQ ID NO: 25674 - DNA, 3003 bp, Unknown
  misc_feature (1)..( 3003): 2750-1469P.txt file - cDNA_ID_2707556; gDNA_ID_2214518; Annot_ID_134009
gtagaaacataattagcttaccataaccaaatttgaaataaaaaaatcttcagatacagatatatataaggaaaatacctaatgcatatgtttgacggtttgaccagtttgttggtttccacaaatgcttaataaggaagtcactgtaattgcattttgatgggataagcgttattaaaataaaacccaactccatttatccatcaaatgtgtaaaacccatctgctacatttcaaagattcacaatctcacacatacttttttctttctgaaaccttcaaacgatttgttttgacaaaaaatagttgtcatttttgttggtcatgctcaaaagaaaaaaaacgcaaataagaggcatgacaacattaaatcccaattacaaattgtaaaaaagaaaaaaatatatattatttacactcgttcatctggtcggagccgttcgaaagaccgttcaccagcttcaatcgatgtcggaagattcttcggcgcatctccggagaaagtagaccgtacggaaccactccggaaagagaatgaaaaagacagcgaatgaagccgtcgattgttattattactcttacgtccgtacgggaaagcgcttctctcgctcccgacgctaccgcttctataaccgctccgtgaactcctcgcctgaggtagtaacgccacgtgtcccatcgtcctcgatgtcttcataagttgccgtcgtacatcatccggtaacctcaacgtaaaccggtctagattcccagccggttgaattaacgaatgtccggtcgagtgcgatctcgggaacaaaattccggttatttgccagctggataaccccgttgactttgaccgaggtgttatgttactattgctccacgtcacagcatccagcaaatgcgcgtccgaagattccaaaaccattcctctctcaggatccgtactcgacgaaatcgtacctggatccgtacccgagtagctttcagtgctgtcgtcgtcgtcaccttgttggtttaggacaagatccgctctacagagaggacacgtggagtgttctgagagccagacgtcaacacaatcggcgtgaaacacgtggcaacaaggaggcatcaaacgcagcgtttcgtcgtcttcgaattcacagagacaaaccgcacactccacaccacctttcccgatcctcaccgccttcacctccgagtaaagaaacgtcgggaaagtttctatagcctccgcgtcgagcccacgcgccgtcaacctcctgatcctgacgacctgagactcggcgtctgcgtcggtggatcggaaaatggaagaacgtgaaaactgtgcgttgcttcgacgacagaagatggaaccgaagaccatgaaaaagatcactaaaaacaaaaccgtgattacaacaacaactggatcgttaggtttcgtttttgttgttccgggtggtgtggtctgagtctgaccgaatccatacggtactgactggagcaagagcaagaggagaagaaagagaaggttgtgtgggatccaacggctggactttgtgtcgaggatcgccatttgaagatcatcgtatggaaagtggagaagaaaagggttttggtgtgaaaaatataaggtcgatagagagagtcaacgtctggtttgtgaaatccacggaggtgtaagagtcattgcgtaactgtggatcatagcacttgcttattgtttattgataatattttttttagttaaaagggaattttatttgatttgatctgttcacaccttttgactttgaagaagtctagtgtgtctttttgtacttttacaactaggaaataacaccacttctaaagatgaaaactttcactactatacaattagtggtgacaatctcttagaaatgattagtatatagagattttaattaaaaatcctaacaattgtttttgagaattatatggtgatatatcttatctaaaacttcaaaatcttttctaaatgagttaatataagctaatgttttgactcctaacatcttatacattaaagtttctgagataaatctctattcttagtaaactaaactaataactgatccgcctaatcaagtatcataataaattgcaaaattttctaatgcagaatcatcacaagttaaatttttgggtttttatgtttagtcttcttttactttttatattacaggagatacaatagtttacacgaagcctgaaagtgattccaacaataatgaaaattagaaatttcagctgtgttattactcatagttacttgatgatcaataaccaagacatctaatatagaataggcatccaaaattaacattggacaattcgtatatatgatataacgtatataaaacttaatctcgaaccataaaacgagtattatctctaaccatttataaatctaataattttatggtggtaggaatctaataatattcagttatctagacaaagcaagaaaaacgatatcaattgacatcgtgacaactataactatctattatacacatcgtttaaaaaaaataaaacaataccattaaaatccaatcgacgtatgtaaatcatcatcgttgacttgccaaaataaataataggaaaccttataaaatttgatgctaactaactcgggcgggtttcatccaaattaaatagaaacattgacggaacatggagtgtccaatacacacaagatccaatcattacttcgaggagtcacttcaaaactccaaataacaatgacccaaacaaatttcattggacaatgaataattaacacattattatccacaatcaggatcgtataaactaaaaacctttaattcggggctagtttagaagtcatcactttcccgtgggtcattttgtaatttacatttcccaaattatctcttttagtttctccgacgatgcctgaaaaataccaaacattagttacagtcggaatttcgaaaaaccctaattcagctaaagtttgatcgttgatctaaaagctcgagtgatg

SEQ ID NO: 25675 - DNA, 3003 bp, Unknown; identical to SEQ ID NO: 25674
  misc_feature (1)..( 3003): 2750-1469P.txt file - cDNA_ID_2707556; gDNA_ID_2214518; Annot_ID_184525

SEQ ID NO: 25676 - DNA, 3003 bp, Unknown
  misc_feature (1)..( 3003): 2750-1469P.txt file - cDNA_ID_2707609; gDNA_ID_2214518; Annot_ID_133995
agcaagcaccagagatccgtccatgctcactgagttcaggtcttggagcttcacctagtctaccctcaggatcagacccaatcacattgaaatatctgaagaaaaccaatttgaagacagaatgaactcaacttcagggcaagagaaaacaaacacagaggtcacacacacacacacataacagaattaactaacaaccttaggatcataactgccataatagaattcttggagaaatccaagatgatatcttctgccatctttttagcctttccatatggattgattggaacctgtggagtttcctctgttattggcattttctcaggctctccataagtagcacatgtgcttgaatatatcaaagtcttcacaccatgagcagccattgtctctaaaactaccaatgtgttcgatgtgatattgtgataatacttgcaaatgacagaacacaaaatattatttacatcaatcttacagcaaaggttaaatcattttgagaaggaacaaaaatactcacttgagaggaaactgtgtgctttctccaacataagcaacagcagcaaaatgcatcacagcgtcaaatgcgttttcagaaaatattttgttaacctgaaagaatttcttatcaagaaaacacacacaaaaaagcttgtctgtgtgtttatggtggtcttatatctaaaatcacaatgaaggatcatacagcatttgcatctccaagatcagcataaatgaattgaagctttccaggttccggaaacagttgttgcaagatcttgactgcaccgaggttccctcgagatagattgtcctgccaaaacatgaaaagatttacttctttacttagatacaacacgagaagcatgaatctatgtaaggcaatggagatgtatgtataccacaatggtgacacggtatgaatcttttagaaggcgtaaagctgcatgtgacccgatataccctgcaccaccagtgactagaacatgtgtaactcctggttcacttcgagaaaactgaaagatgaagaaaacattactactacaaaaatgagacactgtatcaatatcaagttaagtacatataagaagtaataccacgcttggggtattgaaggttggggattggttgagcaagagaatgcacattgctgtaagtgtcatgaccaaaacaatcttccccatgtaattgttgttcttctttgggtctgcaaaatccaatcctacactccaaaaatcatcaacatgtgtgaaattttgaatccaaataagaaacacaagaaaagcttatgactttggagctaactaataagcccccagaaaatctaaaatctctatcaacttaccaaccacttctaaacaagtaagcaaaatatttcagacaaataaaaaaaaacagtagaaaaatcaggttttatcataaaagtctaaaagatattcctgtgtgtaccttcaaaagacatagatctgttttgcctcccggttctagctctgcctaaattcagcattttgattctgaaagtacacggcgtagtccagtttcagctgtaagagattaacaactcgaaatatttagaaaactcgcacctgcaaaaacctcagtaactccagtttgggtgggaacatgtaggtctttcaaataaaaatgaaaatgcagaattcacaccgacacagaatttcacaacaacaaaaaggccaaagttcagcctgtacatgaggaaacagaagaaaactgtagaaagcaaaaatgttgtataatctggacttgaccaagaatctctcttctatagtaagaaagattcgatctcaattctaagtggaaaaggttagaacgacttacgtacaaaggaggaaagtaaagagagtggtcttgacggtgaaagcgagcgaagggaacacgagacacgagacaagagaagagctataaagttgaattaaatgattactttattgagatttttagacacaagtaacgaatgaaattgcaacaagtattataagggacgcggtgattggaacgagggagctccggcacctgtgcgtaccgacgaactctctgctgcacatgtcggcaaaagtctctacgtggcttttactttatggccaaaacttgactacctcttgaccaacatattatagtacaacaaaaatttacggaaaatattagtataatgaatgataagcaaaacaaaatctattgtttttggttgtaatatttgtaaatgatttttagatagttcgataatttgctagttataattagaaaaatttcgaatagagttataaagagtagacctttttgtatatagtaataaaaataattggctataaactatgttgacttcataacattactacgtcttcttaaaaacaaaaacatgactacatcttgatcaagaaaattaaagcaaccgacagttccatgcacattgactttactagatctcgagaccatttattcctcagttgtatagatttgtttatcttttttgaatttaatgttagaaaaaaaagaagagaaattgctttcattgagagttgaactcaagacctcctgcatactatatatttgtttatcaaatatacattcattgattaaactaatttcatatatcataaaatttgaatcgtacaaagatcaccacaagtcagaagactaataaaacaccactaacctgaacaagcacatgttctttgtattaaaaatgtgagagaataattcatcatgaaaaagtcataatcaaagtcaaagcctaaccctttttaagtcttttcggggccgtcttggagcaggcctaacaggctagcggccttttaagacttactctactacatttagaggtcaagttataatggatcaaaaattgaaattgaagagaaaatgtaccaatctaataaactaatcaaactatgtgtaccaaaacgtaaatatcagaaacatcctatagatggttcgggtcctctggttcgccagtaaaattatgaccgcagactgaaaaaaatg

SEQ ID NO: 25677 - DNA, 3003 bp, Unknown; identical to SEQ ID NO: 25676
  misc_feature (1)..( 3003): 2750-1469P.txt file - cDNA_ID_2707609; gDNA_ID_2214518; Annot_ID_184507

SEQ ID NO: 25678 - DNA, 3000 bp, Unknown; identical to SEQ ID NO: 11818
  misc_feature (1)..( 3000): 2750-1469P.txt file - cDNA_ID_2707619; gDNA_ID_2214518; Annot_ID_133988

SEQ ID NO: 25679 - DNA, 3003 bp, Unknown
  misc_feature (1)..( 3003): 2750-1469P.txt file - cDNA_ID_2707627; gDNA_ID_2214519; Annot_ID_134028
gtcaactttacttgctcaagccatccccgcaaggtagaaacttctgtggtctttctcgttatttcttatgtaccatgtttttggtcgtttgtgtagtttcttctaaccttccacacacttgtcttgcgaattccttccacagcagagatgttaaatcaggaatattcaggatgtagaaacttctctgctctttctcaagtagaatgcacttgtggaatccctcagatcagatttcattggtaacgttcgttaacttcaacaacaacactttactaaacatgtgctaatcaattgtcatacgcttgtatttcttcgattcatttttatcttatgcaagtgttttctctattatgatttatttagttttgcataaataaggacactccttcggagtcagtataagaaaactataacctaaaatataaattaggcaaatgtccactcacccatccaaaattccattgtaaataaatgtttctttcaaataaatgaaaaaaaaaaaaaaaaacaagttggaagaaggaaccaaccaagtaattgccagtcaaaggaggcgactcacacttgaaaggataagctgacatggcagacaacgatcctgcgtagaaattgcgtgaacgtggaaaagtttgaggatatagccgtcatttcaaataattcgggtactattatataaggcttcaagtcctggttcgtagtacaaattgtctcacaaactcttctttcagtcatcacagaaaacaaaaaaaacaatggcggataagctcactgacgatcagattacagaatacagggaatctttcaggttattcgacaagaatggtgatggtatggttcatcaactctttccatttaatcgtaatgttggatcatgatcatcttcaaagcaatgaaatgactaacacaagtccttgattactttttgtaggttccattacgaaaaaggagctcggtaccatgatgcgttcaatcggtgaaaaaccgacaaaagctgatcttcaggacttgatgaacgaagcggatttagatggtgatggaaccatcgatttccctgagttcttgtgcgtaatggctaagaatcaaggtcatgatcaagcgccgcgtcacactaaaaaaacaatggcggataagctcactgacgatcagattacagagtacagggaatctttcaggttattcgacaagaatggtgatggtatggttcatcaactctttccatttaatcgtaatgttggatcatgatcatcttcaaagcaatgaaatgactaacactagtccttgattactttttgtaggttccattacgaaaaaggagctccgtaccgtgatgttttccctcggtaaaaaccggacaaaagctgatcttcaggacatgatgaacgaagtggatttagatggtgatggaaccatcgatttccctgagttcttgtacctaatggctaagaatcaaggtcatgatcaagcgccgcgtcacactaaaaaaacaatggtggattatcagctcactgacgatcagatcttagaattcagggaagccttccgcgtattcgacaagaatggtgatggtatggttcatcgtccctttctcgctaatcgtacatattggatcctgatcatcttcaaagcactgaaatgactaacataagtcattgcttactttttgtaggttacattaccgtgaatgagctccgtactactatgcgctcccttggtgaaacccaaacaaaagctgagctccaggacatgatcaacgaagcggatgcagatggtgacggaaccatcagtttctctgagtttgtgtgtgtaatgactggtaaaatgattgacactcagtctaagaaagaaacgtacagagttgtgaatcaaggtcagggtcaagtgcagcgtcacactagaaatgacagagctggtggcaccaattgggagagggacatagcggtcggggttgccagcaatatcatcgcttcgccaatttccgacttcatgaaagataggtttaaagatttgttcgaagcgctgttatcttgaaatgacacgtcagtaactttatgccaatagggtctgacaattatgttagatctctctcaaaaggcgtttcatctaatgacaataatttctatgtaataaatttattgcatgtgttagtgtgttaccatcttcagttgtgtgcaatttattaaaatgagtttgtaatatggtttcagtatcgaatataattggggtattaatgtatcttttgagaaaaacattgaaacgtagcagaactaatcattgaaaactggtagctcactactaaaaattgatctaatatgataaatcggttaatgatctggcacatacagtgatcaaatcagctaagcctcatatcttaccatgttaatcaattgtcataagcatgtatttcttcgatttgtttttatccgatgcaaatttttgctttgtgattgttattgcagaaacaaggacgttcgatgcacttccaaaaaacatataatgttacagacaatgtagtattaaaaagtagtagttaaaagcaaaatctttaataatttagacaaatgtagcgacagctccacttaccatccaaacgaatacttcacaattgataattctaataaatgtttttttttaaaaaagacagcatttaacaataacgagaaaacaaatactaacgaattggaaccagaaaccaacgaaccaaggaaaatcaaaggaggcgactcactggaaaggaaaaggtgagatggcaaagtcaacgatccgcgtagaaaccgcgtgaacgtgtgatccatctcttctcatgtcaacctggcgcttaaatttaaaactcaaatttatggcattctcgtaatttcatccccaaaccgaggtccttcccgacattaacaataatccaggtaaataaaacgcctcaagtccgcattcgtagcacacgaatcgtctcacaaactctttcgtttttccctttttctccaatcacagaaaagaaaagaaaaaacaatg

SEQ ID NO: 25680 - DNA, 3003 bp, Unknown; identical to SEQ ID NO: 25679
  misc_feature (1)..( 3003): 2750-1469P.txt file - cDNA_ID_2707627; gDNA_ID_2214519; Annot_ID_184553

SEQ ID NO: 25681 - DNA, 3003 bp, Unknown
  misc_feature (1)..( 3003): 2750-1469P.txt file - cDNA_ID_2707635; gDNA_ID_2214519; Annot_ID_134027
tgtttttataaactatttattaaaagttagtataagaaaactataacataaaagtaaaatataatttagacaaatgtagcgattggtccagttactcatccaaaattccaaatgaatcttccaccgttgataattctattccattgttttcttctgtagaagaccatatattattaagtctctagtccattgtcaataaatggaaatacaaaaaaaaaaaaaaaaaaaaaaagaagaagaagaaaaagacagcatttaatgaacgaaaataatattaatgaatttggaagaaggaacgaaccaacgagaaaaatcaacgaaataatttagacaaatgtagcgattggtccactacccatccaaaagtccaaatgaatacttcaccgttgataattctattcaattgttttcttctgtagaagaccatatattattaagtctctagtccattgtaaataaatgtttctttcaaataaatggaaatacaaaaaagaaaagaaaaaaaagacagcatttaatgatgataacgatttggaagaaggaaccaaccaattagagtaacaaaccaaggaggcgactcacatgaaagcaaaagctgacatggcagtgaattcagttttataaaaaaggcttcaaggccgagagttcgtagtacaaactcttctctcagtcatcacagaaaataaaaaacaatggcgaataagttcactagacaacagatttcagagtttagggaacagttcagcgtatacgacaagaatggtgatggtatggttcatcgtctctattcctctaatcgtacatattggatcctgaatcatcttcaaagcactgaaaatgactaacacaagtccttgattacttcttgtaggtcacattaccacagaggagttcggtgccgtgatgcgttccctcggtttaaacctgacccaagctgagcttcaggaggagatcaacgattcggatttagatggtgacggaaccatcaatttcactgagttcttgtgcgcaatggctaaggacacttactctgagaaagacctcaagaaagatttcagactctttgacatagacaagaatggtttcatctcagctgctgaaatgagatatgtgaggactatcctccggtggaagcaaactgatgaagaaatcgatgagattatcaaggcagctgatgttgatggtgatggtcagatcaactacagagagtttgccaggcttatgatggccaagtgagatttaaacaacttttccgcttcccctttttttactacctcttatctaatttcataaagaatgttcctctcttgttcttaaatttcattctgagttcttgtgtgtatggctaggaatcaaggtcatgatactaaatatgacacaactggtggcactttggagagggacttggcggccggggttgccaaaaatatcatcgcagcgccaatgaccgacttcatcaaaaatttgttcgaagcgttgttttcttgaaatggtacatcagtaactttatgccattagggtctggctggtatgttagatctctctaaaaaggcgtttgatctttgaaaataatttctatgtaataaatttattgtgttaccatcttttcttgcatgcaatttattaaaatgagtttgtaatatggtttcagtatcgaatataattggggtatcaatgtatcttttgagaaaaacatttaaaacgtagcagaactaattattgaaaactggtagcattactaaaaattgatctaaatcggttaatgatttggcacatacagtgatcaaatcagctaagcctcatatctcaccgtcccagagttcttcaagactcttataaggactcatctaatgaataatgacatgcctcgcaccaacctgccctgcaacattgaaaacacacgtctacaatttcgataacccaagtgttttgagcaaaacaaaggacgccctttgacccatttggactacaatgtgtggaaaattactgcatgttcaatatcagaaaacttggataacatgtcttcgatatgggcttttcttattttgtacccgtgtaatttcgctggcccaaaatccaaagcaacaagggtaaatttgtatgcagtacatgtggcatgttgggtcatatggaaacaggtcacaagactcagattctttacattgcggcgggtagtagtagctttctagtctaccttgagattgcccctgcccgtgattcttgagtcgggcacaggaagtggttttctgtcaactttacttgctcaagccatccccgcaaggtagaaacttctgtggtctttctcgttatttcttatgtaccatgtttttggtcgtttgtgtagtttcttctaaccttccacacacttgtcttgcgaattccttccacagcagagatgttaaatcaggaatattcaggatgtagaaacttctctgctctttctcaagtagaatgcacttgtggaatccctcagatcagatttcattggtaacgttcgttaacttcaacaacaacactttactaaacatgtgctaatcaattgtcatacgcttgtatttcttcgattcatttttatcttatgcaagtgttttctctattatgatttatttagttttgcataaataaggacactccttcggagtcagtataagaaaactataacctaaaatataaattaggcaaatgtccactcacccatccaaaattccattgtaaataaatgtttctttcaaataaatgaaaaaaaaaaaaaaaaacaagttggaagaaggaaccaaccaagtaattgccagtcaaaggaggcgactcacacttgaaaggataagctgacatggcagacaacgatcctgcgtagaaattgcgtgaacgtggaaaagtttgaggatatagccgtcatttcaaataattcgggtactattatataaggcttcaagtcctggttcgtagtacaaattgtctcacaaactcttctttcagtcatcacagaaaacaaaaaaaacaatg

SEQ ID NO: 25682 - DNA, 3003 bp, Unknown; identical to SEQ ID NO: 25681
  misc_feature (1)..( 3003): 2750-1469P.txt file - cDNA_ID_2707635; gDNA_ID_2214519; Annot_ID_184552

SEQ ID NO: 25683 - DNA, 3000 bp, Unknown; identical to SEQ ID NO: 11842
  misc_feature (1)..( 3000): 2750-1469P.txt file - cDNA_ID_2707639; gDNA_ID_2214519; Annot_ID_134029

SEQ ID NO: 25684 - DNA, 3000 bp, Unknown; identical to SEQ ID NO: 11842
  misc_feature (1)..( 3000): 2750-1469P.txt file - cDNA_ID_2707639; gDNA_ID_2214519; Annot_ID_184554

SEQ ID NO: 25685 - DNA, 3003 bp, Unknown
  misc_feature (1)..( 3003): 2750-1469P.txt file - cDNA_ID_2707641; gDNA_ID_2214519; Annot_ID_134031
atgttgagagatttagggaagattgttaaatgtcaaatatttaattattcaaagatttttttttctaattatcaaaaacaaacattaaaatctagtggcagttattgtaaataattcccaactataggatttatttcacaaaatggctgctatatagattttttagataaaaccgatcaaactctttttcttttcaattattaaactctttgatgggttaagaaacataaaaacaaaaaggaaaacagaggagaagaatcgaggatccaaaagcccatctaaggtgagagaagaggggtccaaactgagattggaacaaaatcggttttagggtttcagaaaggcccaaattagattcgagtagagcagtcccacagtgactccgacatgacaacacttgagttacacaagaccaccacgtctctatactctaagtctatgccgtacgtcaaaggcaccaactctttcatcacatatattattaatcaatttatacaaaactccaaataattcacgggaccaatactgaatcgaaactaaacgaatttgttaaaatcggactttgtagatgcaaccgaaacagagtaagtacatgaaaatacgtacaactgcatgtgatttattgtgaaattctatgggaaaaaattgaattgacatattatgcaaaatgcccgtatgttacataaacttttatttttgtgtgtgtgacttaacatgagtgtataaatggaactttttttgttttattttgtttcatataagaatttacgatgtaggaaaaaaattagaaatgaaaagaggtggcaaaagaaaaagaagtgggagaaaatagatgtcaaggaatattgatattcttcttttctccgatacattacttttccttccattatcttctagtaataatttaggcttttgctgccaaataactcacaaccaaaaaagcccaccgaggaagatggttgttagggtttttctctgttttatactttccttgggctatcttacgtacgtaaaatatttctttatatatttgtctagtttcatcttcaatctgaaaatattattcaagtttcaggtacgattcatcaatctttgtattgtaaattgactcttctacaaaaaaaaaaatgaaaatagaaataagaaccaataactaaacttaaagaattaaatatgctaatttcaattccaatgtgccaacaatgaacgcaattatttgatcttagactaaaataatcactcgaggaactcgtttcaaaagaaagaaaccaatcaaatcattgccttccaactacggatactgagtttttttaactcattataacacgtgagatcgtcactatctcacgcatttttctttttgggtgggtaattcactatctcacggattacataaatgtttatggattatgacgattggctgcattggaagatgtatagcccaagaaaacatatttaatccagtatgatagccttgtgatgctctataatttaaagcatggttttatatataactgtgacgtaaatatcaaggtctaaaagcattgtcattttatttttatttcgtataaatgaaaactttagtctaaaacacccggtcatgtaaaagttaaaggaaaaagaaaagaatgatagctgattaattatggcaatgtcgtactatactacgtcgagaactattcatgattagatattcatcggtatgataaatcatatatatgtgatgtgcctagtgcagaaacccaaactattatttatttatctactcctttgggctttgacgtgcaagtaaattcttagatgttgttttcgaagtttatgggtaggcaaaccaaaatctggaatgagatatagaagaaacaaaaagaatttcgagaatgaaaattatgtctcattttaaattcaaatgaactataattcataataagaacatatgttaaatgatgtttttacaacttgatatggatttaaattacataaaagagaaaacacaacttttacctactccttctcacaactcattcatttttggtgtaaagttgatatatgtggtggacaagtgaaatttggcaaaacttggtttaacaattggctaaccctatgaaacaaattaggcctttgggtagagctttcttttatcaagtaccaacttcgaggttatatatatgctctgcttttatatattttggcatgattctaggactcttttggatccttcgattgatatttgtagacatagcaaaattggcagtgcaaagataaggttgctgtgtaagtcttgatagaatttagcaaatatagagactactcatctcgtctattctctctctataagttaaaattgatgggtttgatatcaacaagacattacaatatttctaaaacataagaatatctatacattagccatcaattagcaacaaattttttaataatcaatttaccatcataattttgtagcaagttggtgaaggaagactcttttcttggcagccaaacatcacattaatcccattttaacaataaagtgattaaaaactaaaagaactgaataaaataaaaacaaaagaaatgaatgaagcctttggctttgctttttctctttttgattctctccactttatttttcttgttgctactgctaaaaaaagcatcttcttcttccttttttcattcttaagagtcttttgcttttccttgttcgactctctcttttcacttatttagcttttgcttctgattggaactaaactcaattctctccttcttcctcctctttgcgtgtggtttatcttcctctaattaatctattgatctcaattctcaacctttttgttaatttcaatttccttacccctctctgcgttctgggtttccgagtctcgatttctgggatttcttgcttctcacatgaatctgtttcgcaacctaacttattcatcggagtgatatcgatattcttctcaaattttgaagcttttcgtttcgaattgacaattcatg

SEQ ID NO: 25686 - DNA, 3003 bp, Unknown; identical to SEQ ID NO: 25685
  misc_feature (1)..( 3003): 2750-1469P.txt file - cDNA_ID_2707641; gDNA_ID_2214519; Annot_ID_184557

SEQ ID NO: 25687 - DNA, 3003 bp, Unknown
  misc_feature (1)..( 3003): 2750-1469P.txt file - cDNA_ID_2707655; gDNA_ID_2214563; Annot_ID_134898
gatctgaagccttcagctttcgatccaaaagataagatatggaggaggtttccgcgcgaaggaaccaagtacacacctccacatcaatctactgaattcaaatggaaagattattgcccactagttttcaggttagacaaaaaaattcctttacctatttcacattgctacaaatcctgtcttacttattgacatgttttgcttatggtttaattttccaggagcttgaggaagctattcaaagtagacccagctgattacatgttatcgatctgtgggaatgatgcccttcgagaactatcatcccctggaaaaagtgggagttttttttatttaacaaacgatgatcgttacatgataaaaacaatgaagaagtcggaaacaaaagtgagttcttttcaagttaccggttagagagtgttggctggctattaccaaaacttttcagattgcaattactgagcgtcttttttgtcttcttaatgtaggtgcttctggggatgcttgcagcatattataaccatgttcgagcatttgagaactctttggtaatcagattctttggtctacactgtgtgaaattgaatggaccaacccaaaagaaggtagatacaaaaaattaacactttatgtggcatggttttgaaacgtttggtttagtttggtaactctcttggtttgcatataatgcaggtccgattcgtcattatgggtaatctgttttgttctaagtactctgttcacagacgctttgatctaaaaggatcttctcttggccgtacaactgacaaacctgaatcagaaatcgattcaaacacgatcttaaaagacctcgacctgaatttcattttcagattgcagaaagcatggtaccaagaattcatcaggtaaaaaccattatactttactctatccatagtttgtttgtgcttgtttcatttctcatggttcattgtttacatcacaggcaaatcgataaagactgcgagtttctagaacaggagagaatcatggattacagtcttctagttgggattcacttcagagaagcttctgtcgctggagagctgattccttctggagctcgaacgcccattggttcgcttttgtccaatctaaaaactacttttcccatcagcaaaaatgtatcattcacagaaacaaagtaattgtttgtttatctacaggtgaatcagaagaagaatcaggccctcgtctttctagagcagaggttgatgagcttctttcagatccctcaaggtaacacaacataagatatcaattaacaacactttcaaaactcaaaaccgaaacacagaaacatggattttgaatatggttgtgttcttgcaggtgggcaagtattagattggggacaaacatgccagcacgtgcagagagaacgatgagaaaaaacgacagcgagctgcagcttgtgggagagcctacaggagagttctacgaagtggtgatgatatttggtataattgacattcttcaggattatgatatcagcaagaagcttgaacacgcttacaagagcatacagtatgatccttcctctatatctgcggttgatccgagacaatactctaggcgtttccgtgactttatcttcaaggtcttcacagatgacaattgagatggtctcaagttgtctctggcgtttttagatttcttgattcccaagtaagagctctgcaaataggctaccttgcaaatatgaagttcgacgaatcccatttcgtttgttcgtttgtttcaatttatagattttgtatcaagctttgtaatcagctaaaagccatagcaatgaatattcttttttcttgtatactttttatgtaacctttcataatatgattaagattttcttgtctggaaattcttgtaaatgaaatgattttaattatcgtggtggttgattcattttatattttaactatacatttgcagtatagtgttgtcaatgtgacgtagttaacataaaagaaaacaagttgcataatttcttttacagatacttttccactaaaaatacttcatcgacaactacataaaaaattgaagtggtttaaagtttatagaatttacaaatgtgattgtatattctaaattgggaacaaagaatatttgatgcaccaacaaaaagattcgttcaaaaacaaaagagattcttgaaagaaactagagtttttatttctctaaaaggtggaaagtttcttggtcaggtaattagatactgaataaagacatgaagcaaaactttataaaagatagacaactttgggcaatgttagttacgtaggtgatgatgatatcttttgttttcttcaataaagaaataagagtaaaagattccaataattgttctaaggttaacactcgctgttgttgtcgctttatgtggtaaacgtatagagaatctctttgttctcttctgccatttgtccccttacaaaattaaatttgcgactcttcaaacgctatttaattattttaaattgattacgtattcttgaaattgagccaagcacttgccatttatttacatattaactacttattcaacattagatttgtagtctatattcattcaattgttctaaagtacaatctgtaaataaagacatgcgtcaccaaacgcaccgctaaatcttagaaaatcgcgatcgcgtttgaagacaaaagaaagctaataaaactagcactttcatcaactttacaacaacaaccaaataagcgacggcgattagagagtcctgcgtagtcgtgctcactgatcactcttagctcgtgccgtgatctgagactgagaaaacatcaccggttgggttttctctacgattccggtgcaccgtacacttcaccgcagtggataaatctctgcttccattttgactttttgaaaataaaactacaacagtcgcagagagattaaacttcgaaatccgatcgatcgctttctctctcggcgtttcttctcaggagcttcattccatg

SEQ ID NO: 25688 - DNA, 3003 bp, Unknown
  misc_feature (1)..( 3003): 2750-1469P.txt file - cDNA_ID_2707659; gDNA_ID_2214493; Annot_ID_133515
taacgaagcacttctctcttctctctcgtcctcaatacttcggtgtcaatctgatataggaaactaggcattgatatatggttagatacgtggcaatacatgagtggagacagtagctgtgagacgtggcaagagaagattggtcgatgggagtgttagaggaagaatcgagatgcagagatatatagctaatgaagatcatttgcagaagataagaagattttggatttgttgtttatagtttccttttggattctctctgagaatcgttcctcatcgttcgccggagtttcatgttgaactcttgtagatgagaagttgatatcgcgtttcatgaacgttgtatcaatctgtcattttcattaatcgaagcattctatttcgttactctgttttccgttatcactggtatcagagccaatcgtgtcctcggtggagatcaaagctacttgcacgatgaagagtcgtcggcgcatatcgtgggaagagataaacgagagctggttgaatggcttatgtgtgttttgcaaagagccagaagctcctgatcaccacatgaaacacaagaacttagggcttcttatgatctatggtaatgacgatcatctctctaatggtggaattggtgaatcaattgatcatcgttcaatgaatttggtacatgaggaacgagaggagcactccaagttggataatcacaaagatttagtacagagaactatcatggaggaacgagaggagcactccaattctgagattctgaaaagtgttgaacctagggaagtaaatttcgggttagaaaatcttgattctgtggtgatgaacgagtatcaggagcaagattgggttaaacagaacatgaataagaggtttgaggttgaagatgatgttgataggggtcagaaattgttgagtattacagaaaattgcagtgcacaccaagtgttcggtaaaacgtctcaacatgaagaaaagctggaaataaagaagaaagcgaaaggattcaaatcatggatgttcaaattcaaacttgctaagaaaacaataaggaaacgagacaataagggttggttccacacttggagcagaaaagtgggttggaggaagaacaagcctatgaaattgcagtttgtttcacatcaggtgaaagaatcatcacatagggataaagactcttttgcgggaaaaaagtcaattaagcaagagatgtgtgttgaagtggagagcttgttgcagcaacaggatttaagacgcattaaagagacacaagcggatcagggagattcttatgttgttgtccggaaactgttgccgcatcttgaatcggtttgtgctacaaaatcgtttttggacaatgattcaatgtccaaacttgaagcggagttaactgactcaaagatgaggacggctggtgttacacaacatcaggtctcaatttttgtcatggaaactagccatcatcatcaagtgttagaggattttgatatgcatatggtcattgaggatcaacaacctatcgtgacagaagctttgcgtctaatctctaatgatttccactcggacgtggctgagttgtgtgagcagttaacatgtgacgagtctcataaaccgaagcaaagactagctccaaagtcttggatgtttaagtatagaagggaccataagatactacacagccctactatgtctaggaatgtgagaatggttgttttcagaaaaatggaagcagcagaaaggagtcaacatttggttacacacaggtttcatgtgggtccactagaaatggatactcaagactctgaaattggtatcatagaggttttaagaagagtgatgatgctgttccaaaacagtattgtacaagccaagatgatggtgacaaagagaaagaaaacgttttacaagtctaggagattcaagttcaaacatagagttgtaccaagagctttacaatatggttttgaagtcaaaatgaagcaaaaggtttctacagagtatccatgtttgttcttgatcggcaaggaggcagaacttgttcatattttgcttgggtatagggacgtgatgtttaacttgaagaaaaaggggagatttagactctttcagtcattttctaaacaacttctcttatggctgcgacatgatgcattgctaataaaaccgtttctgcttagtgatgagaggttccaaataaagcatacatggagaactaagttcatacactccgtttcatcaattggtgttgggcattatgaatattctatttggacacagagtgacaaagggacgcagctcttttacagcaggagattggttgtttacaagcttggaagtgaggccaagaatgttgtagaggtgtctcaacgtgtgtatcagcttgttaaactgaaatttgccaaagacgaacgaaagcttgaagtcatacagagccaaacctttgaccctgggattggaattgaatcacaagagctacttgagaatacctattcgaactgaaccttgtggtcaaggttcttccaacaggggagttttgatataggaaactaggcattgatatatggttagatacgtggcaatacatgagtggagacagtagctgtgagacgtggcaagagaagattggtcgatgggagtgttagaggaagaatcgagatgcagagatatatagctaatgaagatcatttgcagaagataagaagattttggatttgttgtttatagtttccttttggattctctctgagaatcgttcctcatcgttcgccggagtttcatgttgaactcttgtagatgagaagttgatatcgcgtttcatgaacgttgtatcaatctgtcattttcattaatcgaagcattctatttcgttactctgttttccgttatcacaatcatcctcttcctctaaattctcttcttctctttgctgctacagaaaaagaatcaagctttagaggcaagcaaggactcactcacccacaagtatcctcaccccatctactcatg

SEQ ID NO: 25689 - DNA, 3000 bp, Unknown; identical to SEQ ID NO: 11855
  misc_feature (1)..( 3000): 2750-1469P.txt file - cDNA_ID_2707681; gDNA_ID_2214519; Annot_ID_134034

SEQ ID NO: 25690 - DNA, 3000 bp, Unknown; identical to SEQ ID NO: 11838
  misc_feature (1)..( 3000): 2750-1469P.txt file - cDNA_ID_2707685; gDNA_ID_2214519; Annot_ID_134036

SEQ ID NO: 25691 - DNA, 3003 bp, Unknown; identical to SEQ ID NO: 15537
  misc_feature (1)..( 3003): 2750-1469P.txt file - cDNA_ID_2707689; gDNA_ID_2214519; Annot_ID_134037

SEQ ID NO: 25692 - DNA, 3000 bp, Unknown; identical to SEQ ID NO: 11352
  misc_feature (1)..( 3000): 2750-1469P.txt file - cDNA_ID_2707699; gDNA_ID_2214491; Annot_ID_133457

SEQ ID NO: 25693 - DNA, 3000 bp, Unknown; identical to SEQ ID NO: 11345
  misc_feature (1)..( 3000): 2750-1469P.txt file - cDNA_ID_2707710; gDNA_ID_2214491; Annot_ID_133456

SEQ ID NO: 25694 - DNA, 1898 bp, Unknown; identical to SEQ ID NO: 11871
  misc_feature (1)..( 1898): 2750-1469P.txt file - cDNA_ID_2707714; gDNA_ID_2214520; Annot_ID_134051

SEQ ID NO: 25695 - DNA, 3000 bp, Unknown; identical to SEQ ID NO: 11864
  misc_feature (1)..( 3000): 2750-1469P.txt file - cDNA_ID_2707718; gDNA_ID_2214520; Annot_ID_134048

SEQ ID NO: 25696 - DNA, 3000 bp, Unknown; identical to SEQ ID NO: 11862
  misc_feature (1)..( 3000): 2750-1469P.txt file - cDNA_ID_2707720; gDNA_ID_2214520; Annot_ID_134047

SEQ ID NO: 25697 - DNA, 3000 bp, Unknown; identical to SEQ ID NO: 11862
  misc_feature (1)..( 3000): 2750-1469P.txt file - cDNA_ID_2707720; gDNA_ID_2214520; Annot_ID_184585

SEQ ID NO: 25698 - DNA, 3000 bp, Unknown; identical to SEQ ID NO: 11860
  misc_feature (1)..( 3000): 2750-1469P.txt file - cDNA_ID_2707728; gDNA_ID_2214520; Annot_ID_134044

SEQ ID NO: 25699 - DNA, 3000 bp, Unknown; identical to SEQ ID NO: 11860
  misc_feature (1)..( 3000): 2750-1469P.txt file - cDNA_ID_2707728; gDNA_ID_2214520; Annot_ID_184582

SEQ ID NO: 25700 - DNA, 3003 bp, Unknown
  misc_feature (1)..( 3003): 2750-1469P.txt file - cDNA_ID_2707736; gDNA_ID_2214520; Annot_ID_134040
cttccaaccatttttatgctggcggagattcttattccggtatgattgttccggccctcgttcaagaaatctcgaaaggtatcatcacatacttttatttgaatatcgtttaaccgtgctctttaaaataacacactatgatgcaggaaattatatatgttgcaaccctcctataaatctaaaggtaattgcaatttaaatgctctttgtaatttcgtaagtatattgatttttaaaaagtttcgatcaactaaaaatcactaggatatttttttgtacactagaaactgatagttatgtgtcgacaaaataaaagagattgataattgtgtatatatataatatgtttttgttaagttgataattaatattattcttaccaaaaacagggttatgtactcgggaacccgataacgcacgaagacgacccaaactatcgcattccattttctcatggaatggcactaatttcagatgaactatacgaggtatgaaatatgtggcatgcttaaattcgactagtcttgttatccttggcatttttcacaactctttttaatgttaaaaacattttcttattaaaaaaaagtcaattagggaagcctgcaaaggaaattatttcaatgtggatccacgaaacacaaaatgtttgaaacttgtcgaggaatttcataaggtacacattgcacactttgaaatttggtcgatgttcagtaatttatcagatagtgaacatctaactcagatttgtttttaataaacttacagtgtaccgacaaactaaatgaattccatatactatcaccagattgcgacacggcatctcctgattgctatgtaagtaatatgtcttttctccacctagtgactcttgtaaaagggttggaaaatgaattgatgaagaaacattttttctttttcaactacacattaagtaaaataccgctccatgattaagtcaacaaaaaaaattgcattttatataacttccaagaaacatacttttaaggttgcttttgcagttatatccattttatctcattagcttttgggccaatgacgagagcgtccgcgatgctcttcatgttaataaggtatatgccattaataatgtgtgatgataaaaaagaaaagaagccttaaaatctaaactatggccgattgatgattacagaggagtattggaaaatgggagcgatgtaactatctgagtaaaccatacaacaaagacatcaagagcagcgtaccataccatatgaataacagtgttagtggctaccgatctctcatctacaggtaagagttagatacctatatctaaattattaagaacctgatcaaaaatttcctaattagagactcaagcaaaaccaaattaaatcaaaccaaaatttgttattattttacttttaaacccgaaaaaaggaaacaaaaatgaatagacaagaatttattaaaaatatataggcatatccatattacgtagaaatttaatttacgtaaattattatgtatttatgttttgcaattattattattttatttttttgtgtaaacgcaattatttaacttaaaacaacctaaacaaaccgaattacatcatggtgaaacgaaacaaaccaaattacagatggattttattttgttttactttctcttaattcaatataaaaaatcgatacattaatccacagtgtccattcatacatacaaaatttaagagattccaatattttgcgcggttgatggtgaacagtggtgatcatgatttggtggttcctttccttgcaacacaagcctggataaaatctctaaattactctatcattgatgaatggagaccttggatgattagagatcaaatcactgggtatatatatttttttgtgtttttgggttttcttgttctttcattttctcatcgtatcacaagcttataaagctccggtaaaaatcattcatcctttttttttaattgacagatacacgagaacttattccaataagatgacatttgctactgtcaaagcaagtcttcttgtctcaatttaacatttctatttgtcgtttaattaaaaagtattttctaatttgttttaagcgttttgattgtagggaagtgggcacacagcggagaataaaccacaagagagttttatcatgtttcgaaggtggattaatggccaacctttgtaaaaattacaattatgaattatctactatgtgagctatttgttcctgaggaggtttagaactctaccactagttcgacatgctatagttaccaataaatgaggtcttatttgggtctagggagactacaggccaaagacttggaacttcttggtttattgttatatgttgttaggtaacatttttgtgttattcatagattttaccttttggtacttttatcttctcacagattatattgttctgtgttgtgctgttattttttacaattaaacttagatttttaataaattcttttttgtctcaaatttaataagttatatacctatctccattttactcaacaatattttttagatgaataaaatatttctgattgtgtttttttatctttgcgcgcatttagtactttttctgtattgaaatgtaaaattatattaacaaaaaaaactgactttgcatttagtatcacttttagaggattgaatttgatatccaaatcatatcaatatttaggtaaagatgtggcgaggataagaacaaaataataagagccataaaaccaacgcccctaccttatccattattcatgctgttggggattttgatcttatgtcaaaagtgtataatggtatacagtgagggagagcgacgcatgcaacattataaaatatctattttcataaccaacccgatatggctgctccacaaaagaaaccaggcctacgtaacgtggagctactttgtaattataaagatttattgtttcccataaactggttaaatgattttagaaactaaagtaaaatg

SEQ ID NO: 25701 - DNA, 3003 bp, Unknown; identical to SEQ ID NO: 25700
  misc_feature (1)..( 3003): 2750-1469P.txt file - cDNA_ID_2707736; gDNA_ID_2214520; Annot_ID_184579

SEQ ID NO: 25702 - DNA, 3003 bp, Unknown
  misc_feature (1)..( 3003): 2750-1469P.txt file - cDNA_ID_2707740; gDNA_ID_2214521; Annot_ID_134054
aattatcttttaataaccaaaataattcggaaaccaagtgatttctaacaaaaacaactgtgcacacacgcttgtcgatattcaattttttcacaattcccaaataaaaaaactttaacaaaaaattcataattccaagtcccacgaatgtagcttttgatacaaagtcttaaatattcttttaaacattatatacaaaaacatcttttactcattgattgttcttgctgaaaacctgaaatgcctcctctgtttcttccttcttcttcctctgctctgtttctacttcttctcctcctcttaactctccaaaccctaacctctatctctctctctcagccacaggctctccgttcaccagaaaagtgtggaaacttctctgtctccttccctttccaactctcttcctcctcctccgcagccgcttttcgactctcctgcgaaaactcctccactctgtttcttcacataaaccaccaaagctaccgaatcatcgagttcttcaccgacggtctcctcgtagacttcccttcgtctccttcttgtcgccaattcaacgacttacgctctttccctttctccgcaaaccaattcttctccatctctttcgaaaacgtaatcggtctttacgactgcgaagattcttctctctgtaaattcggttgcgaaaccaacgatctcttcggttgtgacggcagagaagaagacgaaacctccggtggagatatcggatgttgctatcctttgtctgatcatagcgcgtggcgtgtaggtgatgatttctctgtgtttagtagatatggatgcagaggattctcttcgtggcttgttccaagagggacgaacagaggaaaaagaggcgttaaattagagtgggctattccaagaaactcgccggaggctatttgtgatcgtgaggctcgaactgttaacgctacggctattgaaggaagtgttcgttgtgtgtgccgtgatggcttcgtcggcgacggcttcctccatggcaccggttgcttaaaatgtcagttttatttcttcttttcatttattttcgtgtatgaaacagagtacgtttcaagtaaccttattttactattctaaacaatgaatagaaatattttgtttcactatgaataattcataactgagtcatatggttcgttgggttactaaaaaacttagttttgattcagctcagtaattcattttgccttagtttaaaaagacaagtgtttcttgagttacaagcaacttacactacttggtttactgttgtaacagcttgcttcaaagacggaaaggaattatatggagacaaatgcaagatcaagaaacacaacgggaagaaactcactgttttagccggtaatttaagataatctcatctgaataatttgaaccaaacttcttgctaaaatcattaatcatatgcaggtgttttggctcctctgttcatactaggctcactgttagctctcttctgtctcctaaaacgtccggtaacaagtcacaaagatcaacagttcgatatatctacaacaactaccactactaatagtgtttcgtttcgcaaaggttacaacaagactcgtctcttcacgtaccgtgagttagaagaagccaccaaagggtttcaagattcacaaaaactcacacaaggcaaaaccggaacaatctactcaggcaatctaacaaacggaacacgcgtgatcgttcacaaggttctctgcgaaaaccagattgaattcatggagatttcgtctcagattgatcatctatccgcggttttgcatagaaacctcgcgagaatcataggtttttgtatggatattggatataatccactagttgtttacgagtatccggtaaatggatcgcttggagaccgattgcggctagggcttgattggtgcaagagagttaacattgtagctgaagtcgctggtttactcgcgttacttcagtatgagaactatccaccgattctacacaccaacatttcttctggtaacatcttcttagacgaagattttcaagctaaagtcacaggttttggtttgcagaggaaacagaggattgatactagtatgtacgatttcgcggttttgcttctagagattgtgactggtttaaagcagagagaagagacggtaactcaagcgttacagaagattagaagcggtaagcttgaagaaatcgtggatccttcaatgtattttcatgagcagcctgtggcttttagagaacagattggtttagtagctgatatagcgactcggtgcgttttgtttggtggtgatgggaaatttggaatggttgatgcagctagagagctgttgcagatcgctggaaacaacggtggaggcggctgcgataagaaaagagatggaattgaggaaacgttttcgaattcaagtttgcttcagatgatttctatgtctcctgattctatctatctccctaaaacctaaaacaaaaacagaggaagttaagggttttttttgtttgttttgaatgtatgtaaattaaaaacgctttgcttgagagtaaagaaacgtccttttcttgattactagattgtgttctgagaaaataaatcgtgatcgcgattggaagtcacgattataacaacgtgcaggcaaagagtaagaagaaacaccataaacaagtacaatgttttgtttttcttccatttttaaatactgaattttctttaaaagaaattgaaaggctgagaaagaatatctctcgaatcattaaattcgattttgaccaaatcgttatgctattattaaactctttttgtctggtatatatatatgatagctttgtttttgcagaacttacattttgtttttgtccctttgaaacgaaagaagatccaaaggtaattaatactaatctctgattgtttcttggtttattagatctttccaaatgctctgttttcttctgcacaatcaataaatctgttagttttaacgattgatgtgacaatagatg

SEQ ID NO: 25703 - DNA, 3003 bp, Unknown; identical to SEQ ID NO: 25702
  misc_feature (1)..( 3003): 2750-1469P.txt file - cDNA_ID_2707740; gDNA_ID_2214521; Annot_ID_184602

SEQ ID NO: 25704 - DNA, 3003 bp, Unknown
  misc_feature (1)..( 3003): 2750-1469P.txt file - cDNA_ID_2707747; gDNA_ID_2214521; Annot_ID_134058
aataactatgattttaaaaaaacacttattagatacgacgtggacgagcccaaatagacaaaaacccattttaatgctaatttacacagaccaaagaaacaaaatcagaggaagaaacaacaaacaatgctcataataatacacaattaaggatctctagtaaccctattgaaagtttgaaacaaactaatcacagcttcttcaagtgttcttgtctttagtagcagcagcatgagatttgaaccatggaatccacaccgaagttgtcttctgatatgctctataagcttcagctctgtattgttgtttcaccatccgacgctcgacaaggatcgttacatagaccagacacagagtattgaccaatgcaccaatcaaagtccacccttgaccaaggttccaagcaaatatgaccaatccccaccaccacaattgctctcccaagtaattaggatgtcttgagtaacgccacaaacccgagtccagattggggattttgggctttccttgctccttgagcttttggtttccggttacaaactcgtgaagctgtgtgtctgcgaagtacgccatgacgattccggtcaaacagatagccgaggaaatgaagtcccagatgtttagtggctcatcaatggaatggatgacatataaaggcagacatatcccaatgaggaagatctgagcaaattttggaaaaaagaagcaacatgagaaacagaaagcatataagctaagcatcaaatatatataaaggtaacaatggttcaagcccttataaccaaaagactatcctgttctccaaatcatcctcataaaggcaagcttagattaaaaacgagctctttgaggcaattcatcgaacagttggtggtcatgtacctgctgagaaacgtagacagagaagaaggagagccaccaccagtgtttcccgtactgtttccgtaagtcgttgaacctccagtcttctctagctccccattcccaattttcccgccggaagtagttatgagtcaacctaatgctccaaatccatgtcagagttatgacaatcatggatctcagcttattgtactgtgacaatggatgcgaagcgaagtaatgaaccagcattacaggtatcactgtccaatacacatcgatcatctgcaaaattaacgaattttttcaaaaactaaaaaattgcgaattttaacaaatgggtaacagatttggagactatggatgcgtacccagtggctagattggagtaaaccgatgacccagaagagcacattgacgtttaagaagaagagaaggtttgctaatagaagaggatgattcaaacaccatgattgaatagaagagagctctgaatcggaagatgaagagtaattactgagaaaggtgaggtagaatacgatagaaggaagtggagcaagaaatgcgacaatggcgtttctaagattccgattcattttctctcgaataagtcgttgatgttgggttggcctgtaggaaggagaaagagaatgcaatttataaactgagcttaaagaatatctttggacttttgggttgggttctttgtggcgtgtatgggcccatgttggcccactttgatcactgatatgattagagtcttctgtttaattatacttttggtgaaaattaaaatatgatcaactgtagataaagatattagctttttgtaaaagagccgaaaaagtcagtaatgaagaaaataattggactatgattttgtatcgtaatgattatggtatgagatttctgactattaagtaatgaaagtaatagtgtaaaatatatacattaaacaatataaactcaaaaattatgaaatgtaagtggttaagcagaaatagggacaaatgattaacaaatttcagagcatggggaaagggaatcgcaataataataactaggatttaatccgcggtaaaccgcggacaatcggtttatttggtttttatactaaatatttgaataaatttgatattttaaatttataaatataaattttttaatcaaacataattaaataataattgggatttttttttgttgttatttagtgataagataaatgtgttaaaatgtgtttaaaaatgtgtatgtaattttagtgaaagtaaaatatttacaaaaatgtaagattcacaaaattggtataatattttttatgattataagtgttttttttaactatttgacaggttatacacttttttggcaaaataaagaccatatgaattatgttatttataattatatgtctttaaagtgaagataaaaaaataaaattatttcacttatttttgttgaacggtttagattgaagggaattaattttattgaacggtttagattcaatcagatcatataaagtttagaagattattaagaccaaattatctttaatgattttgaatagcaaataacaaaatccaaaattgaaatcaaaattgaggccaaattagacaaaattttactttgtacttccccttttaataataaggggatagtgaattcgttattacaatactttttgaagtaaaagtgaagatatcactaaagagatacaatttagctgtgctcgtggtgactctaattattagcttagccgaaagcattggattctataaattaaccaactttatatgcggtccaaattcgaactttaatataaatttatgcgccaattgtgtcaagtaaaacgacgtcgttgaggtaaaaaagggattgtaaaacgccgtcgttctttctcccgcatctcggttgttttctctctctcccggaataacaatctacagttctaccggtttaaatgtaccggttaagtaaaaaccggaaagataccttgttctcctaaaaaggttgagagaagcgagggattagcgtgtatcgacgagataatcatctagtcgtcggtgtcgccgcctttctccgccgtctgaaatcgtccttgttcgattttccgaagacgaagcaggagaagatatg

SEQ ID NO: 25705 - DNA, 3003 bp, Unknown; identical to SEQ ID NO: 25704
  misc_feature (1)..( 3003): 2750-1469P.txt file - cDNA_ID_2707747; gDNA_ID_2214521; Annot_ID_184608

SEQ ID NO: 25706 - DNA, 3000 bp, Unknown; identical to SEQ ID NO: 11878
  misc_feature (1)..( 3000): 2750-1469P.txt file - cDNA_ID_2707751; gDNA_ID_2214521; Annot_ID_134063

SEQ ID NO: 25707 - DNA, 3000 bp, Unknown; identical to SEQ ID NO: 11893
  misc_feature (1)..( 3000): 2750-1469P.txt file - cDNA_ID_2707755; gDNA_ID_2214521; Annot_ID_134064

SEQ ID NO: 25708 - DNA, 3003 bp, Unknown
  misc_feature (1)..( 3003): 2750-1469P.txt file - cDNA_ID_2707761; gDNA_ID_2214521; Annot_ID_134069
taaggtcataagagggaagccaagaccatttccaatagatccaagcgtcccgaggatcatcaagaggaaatcaaaggaatctgcaaaagcaaagagcttataaaacggcaccgttttggttttctcatgttcctcgtctttcttctctgttttcttcacttcttcttcttcttccttgtctcttttggtctcagaaacctcttctagtatatttggatctccatttaagccgctctctgaagccattagagtttcacagatacctcacgatcctaagcatttaaaagaacagaggagatatgtaataagtttctaaatctatgagctgatgagatcttcaagagagagtatatatctaaatagggaacataaaggtcaggccaagaaggaaaagaaacaaagacttttcaccaaccatgaaaacaccctaaagatctgtatattgttttttcaagaacatgtgaaaaaataacgaaacctgaagcaagatctgtcgtttacaatgaggaataaccgaagctacggcccagataagaacataaagtacagagtttccagtataaaaatgattaaagcagagaatataaaaatatatatatatacctcgaaaagcaacaagaagaaagtgattagggtttagcggcttcttggtgtcttgccgtataaacagcagttgaaaaatgtgcagagagctctctctctctctctctgcttatatatttttatataattgtaagtgaagtttggaaggactcatgtgagtttatatatgctctgtttatttcttgacgaacaagctgtgacttgtttgagagaaagagaaaatggatgccatgaaattaataactactacttcgtaaaatttgtgaaaaatagtctttttgttgttgttgttagtaaagttaaattgtaaccatagcacaattggcgtagttataaaatagggaatcttgtgtatataaaatgaattatgcctttatgtttgtaatacaatataatacgtaagataacattttcaatattttatctgcccattattgtctaatgctgaccaagatgattaattatagcattaaaaaaatataaagaacgaattgatcacagcgatcgacgattagtctagctgttttgttcaactacaactctattattttaacataaagttttaatacgggaggaccgtatgtctgtataatcccgcgaatcactcatatgtacaatatagttattttttttattttttttggtatcagtgataagatatatttgatctcttattatagctagttaattagccatgttattagcagcttccatatgtccttactccttatcatcgtttaaaacgattcgttttatataaaaactcgaattttgtatgtacgtctttgtgtgtacatatacacatcaatatctcaaaaaaaaaggaagaagctgagttatgatgattttcttgcatcgctttagttgactttctcgttggcattagttgtgacttgtgactatggatggacaaattgacaagtgctgcaagaacccattcctcactagtaatctttgttatcataattgcgttttgccaacggatcgatgggaattattgatgtgttaaaacaaacgaaaaatcgaattcccataaatgtatatttcattagttattttgtaagttaagctaaaaatattataaaattatattttctggtcagattatatctttgcactaccattctaggttggaaccacgtgaagcttattttactttacgagcaagaaacacgtccgaattttaaattatcgattcaaaataaaacaaagaaaagtcaaaactacagagaaagggacctttctttcttccagggagccagggaaggaatggtctcgcattacttcttctgcgccttttcagaatcaatgaatcttatcgaaccaataacgattctgacgtcattcctgacatataatgatattcctatatttatcacctacccacgtatatcttttgtctatagcaagaatttactacttggggaacaagttatcaaatactacttttctaagaaaagaaaaactactagttgcaattttattccaaacattgatgtgagagtgactacaccattaataaatcgtgtgaggcgctattcagatttttcatttttcgatgaagtgtggatttgttttgtcatttttattgtaagtttttgttttggtgcacataaatatttaatttctattaatttaaaatatctgctgaatgacactaattattggactcattaattcactcgatagattattgacatttttttcagtaggcgtagtagacctttttccgggggaagaaaaaaagtttaagcggttcgattcccactaaccttttggagaatcgtgtcacgtgtcgaatagacccaaatcctttaccctacatgtttgaaactgtataaaattcccgacgtaaataagacgatcttgacccggcccgagaacccgaatctatggattttgaatttggaaacccaacctacaaattttttatatatcccactgacaaagccgttactagcccatgggcctaattacttcaaagaatgctcaacttttgatttttaatagagaagaaaaagtttgaaactttatcatatattgacttgtcttgttgctctctagagtgcaatcataccattgaatacattttaggattcgttttcagatggtttaagatataatcactctgaacgcaaatgcaaattagaatgtattttgatccaagcatttctacatgtactgctttgatctgaatcgaaaagagcaagtcatggttactccctcaataatcgccactaagaagagtaacagcttctttgacttttggaagcatttatcacatagagattaaatcattcaccaactaccactgcagtccacacaaaaaaaaagcttaaatagattaaccaaaaaagcacaagaaaactaaatgcagaaagagaggaaaagagacaaatg

SEQ ID NO: 25709 - DNA, 3003 bp, Unknown; identical to SEQ ID NO: 25708
  misc_feature (1)..( 3003): 2750-1469P.txt file - cDNA_ID_2707761; gDNA_ID_2214521; Annot_ID_184622

SEQ ID NO: 25710 - DNA, 3000 bp, Unknown; identical to SEQ ID NO: 11895
  misc_feature (1)..( 3000): 2750-1469P.txt file - cDNA_ID_2707769; gDNA_ID_2214521; Annot_ID_134080

SEQ ID NO: 25711 - DNA, 3000 bp, Unknown; identical to SEQ ID NO: 11895
  misc_feature (1)..( 3000): 2750-1469P.txt file - cDNA_ID_2707769; gDNA_ID_2214521; Annot_ID_184633

SEQ ID NO: 25712 - DNA, 3000 bp, Unknown; identical to SEQ ID NO: 11894
  misc_feature (1)..( 3000): 2750-1469P.txt file - cDNA_ID_2707773; gDNA_ID_2214521; Annot_ID_134081

SEQ ID NO: 25713 - DNA, 3000 bp, Unknown; identical to SEQ ID NO: 11876
  misc_feature (1)..( 3000): 2750-1469P.txt file - cDNA_ID_2707783; gDNA_ID_2214521; Annot_ID_134059

SEQ ID NO: 25714 - DNA, 3000 bp, Unknown; identical to SEQ ID NO: 11877
  misc_feature (1)..( 3000): 2750-1469P.txt file - cDNA_ID_2707787; gDNA_ID_2214521; Annot_ID_134060

SEQ ID NO: 25715 - DNA, 3000 bp, Unknown; identical to SEQ ID NO: 11890
  misc_feature (1)..( 3000): 2750-1469P.txt file - cDNA_ID_2707803; gDNA_ID_2214521; Annot_ID_134068

SEQ ID NO: 25716 - DNA, 3000 bp, Unknown; identical to SEQ ID NO: 11905
  misc_feature (1)..( 3000): 2750-1469P.txt file - cDNA_ID_2707807; gDNA_ID_2214521; Annot_ID_134070

SEQ ID NO: 25717 - DNA, 3003 bp, Unknown
  misc_feature (1)..( 3003): 2750-1469P.txt file - cDNA_ID_2707815; gDNA_ID_2214521; Annot_ID_134076
aaaggttgacccaattagaaaacttgttatatctttaggagtcaaagtcaaagcgcgtttacaaacaccgacactttctttgtcaactagcggttaccgcggttgttcactaggcacggaacactcgatttcttcccaagaagtcgcaaccaacacttactatgtatggtacatcacaacatagacaataaaaactcttggaatgttccgcgaaacaggtgattattgactaccatgagtggggaaatgtggggtaagttaacaagtacactgcttcacatgggaaaaagaaaaatgagatacacataattcacaaaatataatttttatcttagacaatttttttaaaataatattaaaatcagtgtagaagtggtccccaccactattttgtttttccttaaaattaattattatttttgctggactaaataaaattggtttttttttttctctctctgtcctaactctttttctttctctgttttgtatctctctctctctctcactctttgtctctcccctaacctttattgtactagcataaccattaccatacatactcttctctatcacgccacaaacgcagattcatcacatcttcttcttgttcatagcatctccatcactattgggctctcttcaaaggtgtatttctggggttacttattccttctttgtattgattagtgttgaaaaggtgtctctgttgcgttcaagagctagctttagggctatatattaagaggtttccagaggttttttttggattataggcatctgtgtttggcttacatggatcctttttttaaggttttctgggcaagactaattgattaggaccaaagtttgtgtttttatttgtttggatctacaaagatcaattaggctgttgttgaattggatcgagtgatggaagctagaattgatgaaggtggggaggctcaacaattctatgggtccgtaggtaaaagaagtgtggagtgggatttgaatgattggaaatgggatggtgatctctttctcgccacccaaactactaggggacgtcagtttttccctctaggaaactcgtccaatagctcctcctcctgctctgatgaaggcaatgacaagaagaggagagctgttgccattcaaggagacactaatggtgctcttactttgaatcttaatggtgaaagtgatggcctttttcctgccaagaagaccaaatccggagccgtttgtcaggtcgaaaactgtgaagctgatcttagtaaagttaaggattatcatagacgccataaggtctgtgagatgcattccaaggctactagtgccactgtcggaggtatcttgcagcgcttttgtcagcaatgtagtaggtatgtctctctctctctctctttcccaacaacaaaaaatgaatccaactttattcttcttcttctctcttgcaggttccatcttcttcaggagtttgatgaaggaaagagaagttgtcgtagacgtttggctggccataataaacgtcggaggaaaacaaatcccgaacctggcgctaacgggaatcctagtgatgatcactcaagcaactatctcttgattactctcttgaagatactctccaatatgcatagtatggtgttttactctgctcatctctatgttgtcttaaagtttgtatcagctgctaaatttctatccctttgcagaccataccggtgatcaagatttgatgtctcatcttctgaagagcctcgtaagccatgctggcgaacagttagggaaaaacttagttgaacttcttctacaaggaggaggatctcaaggttccttaaatattggaaactcggctttgcttgggattgagcaagctcctcaagaggagttaaagcaattttcggctcggcaagatgggacagctaccgagaacagatcagaaaaacaagtcaaaatgaatgattttgatttgaatgatatctatatagactcagatgacacagacgtcgaaagatctcctcctccaacgaatccagcgaccagttctcttgattatccttcatggatacatcagtctagtccgcctcagacaagtaggaattcagattcagcatctgaccagtcaccctcaagttctagtgaagatgctcaggtatgtatattcttacctcatccattccattattttctggatctcttagcctgctgatattttcctgtgaccttttcgtaatttgttatgattccatctcagatgcgcacaggccggattgtgttcaaactatttgggaaagagccaaatgaatttcctattgtcttacgaggacaggtattggtctgcttgattattctcaagttcttactttgtgatgttggaagttaaactgatgtgctagtttctcgatatacagattcttgactggttatcgcatagtccaactgacatggagagctacataagacctggctgtatcgtattgaccatctatcttcgtcaagctgaaactgcttgggaagaagtaagctaaacttcctctcccctctttgacaatactcgtctttataaagttccagactcctcaagggtttttattttgcttggcagctttcagacgatctgggttttagcttagggaagcttctagatctctccgatgatcccttgtggacaactggatggatttatgttagggtgcagaaccaacttgcatttgtatataacggttagttttgagaatactttcaccttgtgaatacctctctggatttctcagtatttatcgtcaatccggggttgcaggtcaggttgtcgttgacacttcattgtctctaaaaagtcgtgattatagtcacatcattagcgttaaaccgcttgctatagctgcaacggagaaggctcaatttacagttaaaggcatgaatctccgtcagcgtggcacaaggttttgttccgtttttctttttaatgaaattttggccttccttgtcttaattttcttcttctttgatgtctaaatg

SEQ ID NO: 25718 - DNA, 3003 bp, Unknown
  misc_feature (1)..( 3003): 2750-1469P.txt file - cDNA_ID_2707826; gDNA_ID_2214481; Annot_ID_133250
agattgtttttgcacattttcgtcgtaaccgcacttagctaaaatattcatactaatgagctgcgtccctactcaaagcgtaacgtcactttgtcgatacgaattaagaacgtagaatgtcatgatctcgtacatcaatacatcatgttcattggagtattcgctatgctcgagcaatagtcttttaatgctgagaagatcatgattttctactcgaatgctaacccagccaaaccggtttatctcgtctcattatccatatgctgaaatataaatttatatacaataagaataagtttcatatgtatattctcaaacattacagtataatgtgatctagatcctaatttcaatatgaagatatatctagtttagatagcatcaaaccattaacagttggattacagaatcaattttaacgatacaacaccttttgcacatgtatttatttccttgaaaacgtttaacttgtcttctcaatgacactctagttttctagaaaaaaattcattgctctttttcctctagaaaatttgtctctccagggcatgtatttaattttcttgctcttttttctcacaagtatgaatccctactatcataaacatatataatctctgttagttcctgaagaagtaagattaagaacattgagcttataaggtcatctcgtacatatggtgaaagcatccataaccataaatattatagcatgctctaaaaatacgaatatcctttgaaagaacaaattgaatgaatgagcaatcgacacaggagcaaagtgaatcaactttttagaaaatgtccaagctaactagaaaatgctaatccgtaattttgataatatcacaaccagttcttttggcccctagtcaaaatctgtaaacagagagaaaagtttgaagcttcgtacttgctttgcaagttacatgccaagagggtaaaacacatagagaagaatccacctacttgaattttaatgatctataatactgataaccaactagaactagagtggcaaacacaaaccgaaaagtgatgatctccttgaataaccctgcctccggatgcttcgaaaacaatccgcaactagatgtcctgattttgtaatcccgatgatcatgtcctgagtccaaacgaagtggtaccaaatcctcgagataaggagatataacagaaatatctgaggagagacagcaaatctcatttgtctcggtattatatttaaacaaccgcttgtgattgtcacaaaagacaagattccctagcttagaaaccgtcaacaccgtgaaccaactagactcccatgggtggttaataatgatactggctaaagttatggagtaagtcttgctccatatttctttgtctacatccatcaggctcagtatctctagctcccattctggcgcaccgtttgttttagttatggctagacggtcatcaaggttcaccatctgggcactcatggtgcaacacgtagatggaacggaaacattgtggaactctagtgtgtgaagatccaaggctaggattccgaaacgctaaacattttttaaccagtagattgacccattcacacacactgacttccttcccacgtcaatatcgttaggaggtggattcagttcactccattccccagtttcaacatcaagaacctcgcatttttccacaggactaaaacacatcctcaccactttatagctaccattaaatttgtctctaccaaatcccatctcccaattccccggaaaggaagtgaggtatagttcgtctgcaatttcacgaaaaaatcagacaaaaacaatccaaattttaactgactctttaataaaccattaaacagatattacctctgaactgaaaacgaatacgatcagagggcacgtgatgattagggctacaaggaaatctccggagttgtctggtcgatgggttcaaaacgttgatccaacctggtgctgggatacacaccaaaccctcacatgtcagagagggtcgtgtggcgtcaatatcgcagtgtaaatagaccatctggatctcttcctcaccttcgaatcccaactcagtccggtctccaacagccagaattttctccttcttctcaacgttcaaacgcctctccgcgaaactcttcgattccaggattgatctccattgttttgagacggttttgaatctgaggattgattttaaaggcaatccaaggaaaatttcttcaagtagatcgggaactacgtaaatcatcatcgggattagggtctttttcttcttttctctacagaactaaaaactcatcgggattagggtcttttttatacacaattttttttttttctagttttaacggaaacccccacaaatatttcattattactatttagcccagtcaatttccaaaagattaatttaggtcacctctctctctctctttccctatctcttggcctcgtgctcgtgcagctgaagatccctgctctgattcgtcaaatccagtaagctaaatttcctcttaattttctggtctttaattactttatactccatatgaataatttcttcaatcgaatttttcatctttgggtcttaatttttttctcaactgattcagctaacattagtgattagctatttgctggatttcttcgattgcttgtcgtctctatgtttcaattgtattatgattacgacacattcttgttctgatcattgtcgatgaaaagggtaaactttgaacaatcttctattacataaaattgaaactttttccaacatttctgagattttccaaatcaaattctcggagttgaattgaactctcaagtagcttacataatattcaaacttttgattatctaatcaaatctgtaattcttccttatctatgtggcagtggaagatgaggatgatccaaccacaaagaacagcaacaacacagatgattttgctatagagcctcgtgaagggattatatttgaatccgaggatgcagctaagatg

SEQ ID NO: 25719 - DNA, 3003 bp, Unknown
  misc_feature (1)..( 3003): 2750-1469P.txt file - cDNA_ID_2707826; gDNA_ID_2214481; Annot_ID_183332
catactaatgagctgcgtccctactcaaagcgtaacgtcactttgtcgatacgaattaagaacgtagaatgtcatgatctcgtacatcaatacatcatgttcattggagtattcgctatgctcgagcaatagtcttttaatgctgagaagatcatgattttctactcgaatgctaacccagccaaaccggtttatctcgtctcattatccatatgctgaaatataaatttatatacaataagaataagtttcatatgtatattctcaaacattacagtataatgtgatctagatcctaatttcaatatgaagatatatctagtttagatagcatcaaaccattaacagttggattacagaatcaattttaacgatacaacaccttttgcacatgtatttatttccttgaaaacgtttaacttgtcttctcaatgacactctagttttctagaaaaaaattcattgctctttttcctctagaaaatttgtctctccagggcatgtatttaattttcttgctcttttttctcacaagtatgaatccctactatcataaacatatataatctctgttagttcctgaagaagtaagattaagaacattgagcttataaggtcatctcgtacatatggtgaaagcatccataaccataaatattatagcatgctctaaaaatacgaatatcctttgaaagaacaaattgaatgaatgagcaatcgacacaggagcaaagtgaatcaactttttagaaaatgtccaagctaactagaaaatgctaatccgtaattttgataatatcacaaccagttcttttggcccctagtcaaaatctgtaaacagagagaaaagtttgaagcttcgtacttgctttgcaagttacatgccaagagggtaaaacacatagagaagaatccacctacttgaattttaatgatctataatactgataaccaactagaactagagtggcaaacacaaaccgaaaagtgatgatctccttgaataaccctgcctccggatgcttcgaaaacaatccgcaactagatgtcctgattttgtaatcccgatgatcatgtcctgagtccaaacgaagtggtaccaaatcctcgagataaggagatataacagaaatatctgaggagagacagcaaatctcatttgtctcggtattatatttaaacaaccgcttgtgattgtcacaaaagacaagattccctagcttagaaaccgtcaacaccgtgaaccaactagactcccatgggtggttaataatgatactggctaaagttatggagtaagtcttgctccatatttctttgtctacatccatcaggctcagtatctctagctcccattctggcgcaccgtttgttttagttatggctagacggtcatcaaggttcaccatctgggcactcatggtgcaacacgtagatggaacggaaacattgtggaactctagtgtgtgaagatccaaggctaggattccgaaacgctaaacattttttaaccagtagattgacccattcacacacactgacttccttcccacgtcaatatcgttaggaggtggattcagttcactccattccccagtttcaacatcaagaacctcgcatttttccacaggactaaaacacatcctcaccactttatagctaccattaaatttgtctctaccaaatcccatctcccaattccccggaaaggaagtgaggtatagttcgtctgcaatttcacgaaaaaatcagacaaaaacaatccaaattttaactgactctttaataaaccattaaacagatattacctctgaactgaaaacgaatacgatcagagggcacgtgatgattagggctacaaggaaatctccggagttgtctggtcgatgggttcaaaacgttgatccaacctggtgctgggatacacaccaaaccctcacatgtcagagagggtcgtgtggcgtcaatatcgcagtgtaaatagaccatctggatctcttcctcaccttcgaatcccaactcagtccggtctccaacagccagaattttctccttcttctcaacgttcaaacgcctctccgcgaaactcttcgattccaggattgatctccattgttttgagacggttttgaatctgaggattgattttaaaggcaatccaaggaaaatttcttcaagtagatcgggaactacgtaaatcatcatcgggattagggtctttttcttcttttctctacagaactaaaaactcatcgggattagggtcttttttatacacaattttttttttttctagttttaacggaaacccccacaaatatttcattattactatttagcccagtcaatttccaaaagattaatttaggtcacctctctctctctctttccctatctcttggcctcgtgctcgtgcagctgaagatccctgctctgattcgtcaaatccagtaagctaaatttcctcttaattttctggtctttaattactttatactccatatgaataatttcttcaatcgaatttttcatctttgggtcttaatttttttctcaactgattcagctaacattagtgattagctatttgctggatttcttcgattgcttgtcgtctctatgtttcaattgtattatgattacgacacattcttgttctgatcattgtcgatgaaaagggtaaactttgaacaatcttctattacataaaattgaaactttttccaacatttctgagattttccaaatcaaattctcggagttgaattgaactctcaagtagcttacataatattcaaacttttgattatctaatcaaatctgtaattcttccttatctatgtggcagtggaagatgaggatgatccaaccacaaagaacagcaacaacacagatgattttgctatagagcctcgtgaagggattatatttgaatccgaggatgcagctaagatgttctatgatgattactctagacgattagggtttgtaatgcgtgtaatg

SEQ ID NO: 25720 - DNA, 3000 bp, Unknown; identical to SEQ ID NO: 11922
  misc_feature (1)..( 3000): 2750-1469P.txt file - cDNA_ID_2707838; gDNA_ID_2214522; Annot_ID_134100

SEQ ID NO: 25721 - DNA, 3003 bp, Unknown; identical to SEQ ID NO: 16096
  misc_feature (1)..( 3003): 2750-1469P.txt file - cDNA_ID_2707846; gDNA_ID_2214522; Annot_ID_134097

SEQ ID NO: 25722 - DNA, 3003 bp, Unknown
  misc_feature (1)..( 3003): 2750-1469P.txt file - cDNA_ID_2707848; gDNA_ID_2214522; Annot_ID_134096
agaaccctatttgcataaacagattcgagtaagtaatcatagcaaaacatactccttatcagattcagtgaagctaaaaaactgtaaagtcttcaactttatggagaacacaatcaacaacagtagacgatcaaattcacaataaccagatacaaattgtgaagaattggtttagcaaaaattaatcagtgatggatttataaatcattaccagaggtgatacagtaaggaaacccagctcgttcgatgagtttggcactaagagcatcgaagcaacatggaccctgaagaacaccaggggattgcataatattccttagcttcttcgccggagaagatggaagtttcgcgtttcccgattcatcggaaactacggtggagttaacggcgccacgaaatcgtcttgagacagagaaggggttcgcaaataattctccgacggtttgtgtgaaagaagaagaggcagaagaagggaaaaaactcgatttggattgtttatgaagaattcgaggaggagaagagctgcaaaagctaagtgccgccattgaagccttgaaggattcacttctgttcggtaaaagaaagaaacagaaattgatcaaaagaaagaagttggacaaaccgaaacaacaagaaccagaccgaaccagatttaataattaaaaaaaaaaaaaaccatgtcacgtgagcttttttagggttcacgtgatcatctctatcgtcgaaatacaagcggcggacttcaaaatcataacttttttcttcgctcctctcttagcatcgccgtgaatcgttggtctcagtttctccgtccatctttgattcgtcgatccgtaagcatctattcagtttcatgtcttttgttctaaactttttggtttgattggggttttacctttggttaattaaagctttctagattcttagtgtttggattgaattctgtaaggtttggtaaaactataccaggttagttgctatctagctgcaatgggtacagagacggttgtgcatgatcaggcaagatgggcaatggctgcaatggaacgaaggcttgctgttgcaaaagctcagcttcttcaacaacaacaacagaagaatgagaaagataagaaggggacttctgatgtagatgtctctatgaaagaatctcatcaagctgattcactgcctactccctcaaagacatcaattaaaaaaggtttgatggttgagtataaacgaagaatgattctctctagcaactctttattgaactctgattgtcatgggaatttggttttgtagtagatcccaaggatgatgattctgttgcatatacaaagttgtcccatcccgttgatgagaatctgctggcaaccaatgttaaggtatattcagattcttgaggagaacgaagctcggccttcttctgtatgatagataagattgctcaatgtgtgtgtttttttgtgattcagttttctagtgcaaagggaactatagtagacaaggttttgcataaccttcttcgaagcggtgactctgctcaaaagtacttgcaaggtactaaaagtgtgaagctggataactatatccttcttgataattttgtacagtcacggtcttcggcctctggttctaaaaaggcatcacagaaggattcaaaacgttctaaaagccgtatgtctatgaagcgactcaagaaatctggtgctttgcatatccctaaagatctccaaaagtgagttctttatattttttttttttttttttgctgtcatatagattgaactggctcagcctatgcatctgagtctattattttggtattcttaataaagtttaagtgattacttgttcacttgtgtttgagtgcaggtttgatttgtttaagccaatgcatggtatgtgggaaagttacatgatgaaactcatcaaggtgaccgggtaagctacttatctgattaccgaaatactgattcaaactatgtgctttctataaggacgaaactgatgggagtaatctagtatacacaatcattttaagcttggtcatcattcttagacaatttactttttgcaggaagattcaattatctttaactcttctctcagcagatcttcatggtgctttcatgtttggtaatccttcattctttcacaaatctgtagtactaggatatgatcttttgtctctcactcactttccaaaacttaacttctctgtacgcttaaacaaaccttaaaactagtccttttttttcatattgtaatttgttccaatcatagcaacctattttacttgtgacagttgctgagtgcaagatagcatcattcactggtgtacaaggcataatggtgcgcgagacatccgaaacatttggaataatcacacgagatgacaaatttcgaggtatcttaaagcttttttcaccaatatatttgccataaatatcttgaatcgttctcttccccagcctcaaggcttaacttagttattgtaaacaatctgatacagttgtaccgaagaagctctctgtcttcatcatccaactcgactgctggaagattactttacatggggacaagtttatttcaagagacaatattgttcaacgttaatgctaaaaatgaagctctagtcgtttttcttagctagtggtagaaagcaaccattgatgaccacagaagcatcctaatctcacaagattttgctttagatctttccttatggacccaacattttaatatatttcttaatcttgaattttgtatgaatcctctgtaaatatactactgtgttattgttaatactaatttttattattagaaaatgagtgcttatatctcagaaatccatctggggccactaataaagacaagtacagttgaagattccaaggtgagtctgacttaactaaagtaataatatttcacatcactgtcctctctctctctctgcagctctaaactgttttgaaacctaattgcagaagaagtccagacaaaaaaaagaggatg

SEQ ID NO: 25723 - DNA, 3003 bp, Unknown; identical to SEQ ID NO: 25722
  misc_feature (1)..( 3003): 2750-1469P.txt file - cDNA_ID_2707848; gDNA_ID_2214522; Annot_ID_184659

SEQ ID NO: 25724 - DNA, 3003 bp, Unknown
  misc_feature (1)..( 3003): 2750-1469P.txt file - cDNA_ID_2707872; gDNA_ID_2214522; Annot_ID_134087
aacatccgtcgcttccaatttcaaacccctagtttctcgagaagcatcctcatcgttcgtcactcgctccgccgccgagccacaagaaagaaaaaccttccatggactgtgctatgtcgtcggcgacaacatcgacactgaccaaatcattcccgcggagtttctcactctcgtcccttcgaatccagaggaatacgagaaactcggttcttacgctttagttggtcttccagcttcttacaaggaacgattcgttcagccaggtgagatgaagacgaagtactcaatcatcattggcggtgaaaactttggatgtggatcgtcacgtgaacatgctccggtttgtttaggagcagcgggagctaaagcagtggtggctcagtcttatgctagaatctttttcaggaactctgttgctactggtgaggtttatcctttggattctgaagttagggtttgtgatgagtgtacaactggtgatgttgcgactgttgagttgagggaaggagatagtattttgatcaatcatacgactgggaaagagtacaagcttaagccgattggtgatgctggaccagtgattgatgctggtggtatatttgcttatgctaggaaagctggaatgattccatctgctgctgcttgattttgacttcaggtatgattctgtaacttgatgatgatgatgatgaggattggtaataggttaggattgagatcgaatttgtggaatagtctaggaagcttgacattgaattgaacgatgcaaaacatagttttcaatggttctagttagagaaagagaacacagtagttgggattctagttttgtgttgtttaaaatgtgttggtttagtttttgtgtgagattgataatgacttgttattctttctcttcgcttaagacttactttatctttccattggttcaatttctagattgtacatctcttgattgtagttgttgggagggtaaaagttatgatgttggctgatcttttccatgctcatatccattaagacttgagtgtccgatagtagaacaatacttcactcttattttgtctctaagactcctttttttttttcctttttttgttctatttgttttgcaggtgtcaatggaagtgcatgagagtcacttcaaggatcttgatccaataataagaatatgtaatgtttccaaaagcttatgaacctaatctatgttttatgaatatatatgactatcggctttagtcttcagtatcagtttcttgtttacatttggatgtatcagctgctaaaaaaatgcatagtttcccatcccatttgaaacgacgttttctctcatgtcttccactaatataatcttctggtcatgagaacagaacaggagctctgtttttctcacacaatgatcgaacacacttttgtcatatagtatagagaaatattaacacttctttttaggcatccgtatctagagtctttgtttcactgtgacctacctaagtatatcaaaacgcacgtttggaattctgaatggcactttcgtaaataggagggtacaaacatttctccttttaaattgttttcatcgtgaactctctcactcactcaacaaagtaaagaaacaatggcgtattctcttcctacatttccccaagccttaccttgctcgtcaaccaaaacttcttcctccttggctaccttccgatctcctttcttaagattcaatggttccacttccttaatcccctcctctatctccatcacttcacgtggcacatcctccccgaccatcatcccacgtgctgccgcctcagaatccgactctaacgaagccctagccaacacaaccttccacggcctctgctatgtcttgaaagacaacatagacaccgaccagatcatcccagcaggagccgcttgcaccttcccatcgaaccagcaagagcgtgatgagatcgccgctcacgctctctctggtctaccagacttccacaaaacacggttcattgagccaggagagaacagatcaaagtactcaatcataatcggcggcgaaaactttggttgcggatcgtcacgtgaacatgctccggtctgtcttggagcagctggagctaaagccatagttgctgagtcttacgcaagaatctttttccgtaactcggttgctacaggagaggtgtttccgctcgagtcagaggttagagtctgtgaggagtgtaagacaggagatacggtgacgatcgagctgagtgatagtggtggtttattgactaatcacacgaccggtaaaaactataagctgaagtcgatcggtgatgctggaccggttattgatgctggtggtatttttgcttatgcgaggatgatgggaatgattccatcattagcttaatcctcttccataaccatgatggtgttcttgtatgcataactatttgatgaatatttgtgttttagagttttctattttcttaacttttttatgtttgtttgatttggtattgttgttgttacctaaagaataagaaatcaaaagcaaaatagaccgacatgttccaagatatgtgaatatggtgagtgtttactaaattatgcgaatattgttgttgcaaccttattttcttccaagttgggcatcaatttccctttttgggcttagtcttcttttgtttgtaaatttagtttgttttagtttattgttggcccatttctgtagggtttggcccgttaagtaagtaccatgtaaacccagaaaatttacaacgaaaaccctttagcaaaaaagtaataattccgttggtaacttttctcattgtagtacatggcatattttacttactctactaaccaatttggtttggttattgaaaatttggcggtttaaacaaaccgatataaaataaccgttaagcggtaaaagaaaggacatcgctaaacctaaatttgcgactcctactttataacgccgctcttcttctccattgtttgtatactctgaaaaacatg

SEQ ID NO: 25725 - DNA, 3003 bp, Unknown; identical to SEQ ID NO: 25724
  misc_feature (1)..( 3003): 2750-1469P.txt file - cDNA_ID_2707872; gDNA_ID_2214522; Annot_ID_184651

SEQ ID NO: 25726 - DNA, 3000 bp, Unknown; identical to SEQ ID NO: 11913
  misc_feature (1)..( 3000): 2750-1469P.txt file - cDNA_ID_2707876; gDNA_ID_2214522; Annot_ID_134083

SEQ ID NO: 25727 - DNA, 3000 bp, Unknown; identical to SEQ ID NO: 11951
  misc_feature (1)..( 3000): 2750-1469P.txt file - cDNA_ID_2707908; gDNA_ID_2214523; Annot_ID_134116

SEQ ID NO: 25728 - DNA, 3003 bp, Unknown
  misc_feature (1)..( 3003): 2750-1469P.txt file - cDNA_ID_2707938; gDNA_ID_2214523; Annot_ID_134106
ttgcctagagactataaagaaagatatattgttttgcatgggatgaattgcggggcaaatctcctttggcagagaagcattttacttgcatatctagccaatgcgatctgccataggagtattcgcccagtaatccaaccatacattatctctctgtcttcataaacatgcatcttcactactatttaatatattcttcatatttcacattgcattttgagttattggaagttggactagcaaagtatgtatatatagttgatgaaagtgtttctatatagtgaatgaatgcgtatagaaagcatattctctggcacatcccatgtttcatagagcatatgtgtctagtataatcctaaagaccccttcatgcggtcctcatgcttctgctttcagaagttaccaggctagtaaatggtatattaagttttgtgattcatgttttgataggaaattgttccatagcatatgctctttatatcaaggtttacatatacattacatagtttgagtttatcctttgaagcaataaagtgagagaggaaaactgagattatttcttggtagaaagcattacagggcgaatcctctattggcagtggaagttgatgacccttatatgttattttctcatcattttcctctgccaaaggagatttgcctcgcaatgcttcactaacgttatggggttattcatttctccaatatccaaatctagtagctaatattttcatttaatagtgttatttgaggcagctcatatacttttgtaatttgataattgtaaaagattttactagagcctcttcaaattaactcctttcttttgatttggacgttatctcttcgttagaggctttcacacacatagtcaaagaatgctaaactaatgagaatccgaaaacccaagttccacaatcaagttaaaacgatataacggtttacaaatttttatcataaaatactaagaaatgtaacatgattcattttacaaaataattatcgtaacaaaatggttttaaggatctttaggtttgatctatatcttgtgaaaaccgagaattgattgctaataactatgcatttggacattgatcctcgttggctggtgacatctctcatgattagtatagatcttgctaagtaaaaaacttaaaacggttatctataatctaaagccagtatatattatcttatgtgatttgtcaaatagctaatgatcagttacaatagcatgcaagttttgttttagttggatatacttactgaatatgctgccagtacctgacgcatctaactttgatatttggccttttcaaacctaaatcataaaatctccaaaggtgctacaagaataggatatatacaagcatttttattatttttaaataagtatttgtctatttgaatttatattctacctatggactaattaaaaaataagactttataccacaatggtaaagttgacttaattgtataactgattttatataataacaatattcgtacttaagttttcataaaagtttgaactattttttatgaacaagagaaaaatgtgcacttgccaaaactatacaataaacaatttatgtcttaggttgattggttcataatcatttgtagttgctcgcaaaggctatgtttctgctatgattgggtgctacaatgtttttcttgttaaactcattattttactactatctagcaaaattcaaagtaaataaacttaacattgcaaaaagagaaagttaagaagcaaaagtttgcgagtttttccaaaataaaactctggagaggacaataccatggatcattccatttttagagtataaacctttacaagttgtctttgtcaaactttttggcaagtcaaaagtttaattctcgaatattaatcatcttaaattataaaattatacaaacgtacgtatagagagattttattctagattggaaggatagtgccattgaatatgcttattgcaatgttatatataaacacaacacatataattattgcagtagagagatgaaaaatacatagagaaggtgaatatgcattacagggcaagatcaccattggcagagatctattacttcattcttgcatcatatgcataaatgtttgtggtgagctctctgccaaaggagatttgcccggtaattctcttgcgccaatgttttatattaatttgttggtttttggttagtaagattttaatttttgagtccaagtggacactagttcccttggatcaaactcgtcgaaatcgacgattctaagttctaactttcaagaaaatcattgaacgatatctatcaatgtgtctttgttatgtttcaaagatgttgtattaaaaaagatcgatggtcacaaactctttcctcgtggcgatcagtagatgcatgaaggtaatgaattcttctatatatgcatcaagcgggtcagtgaaacattggttatgtaactaaactttaaaacttaaaaaaaaaaaaacttagctttgtcgactttagcttagtatgtttatgttggatcagaattatgatttgtatgcggcaaagtttatggttggtccattgtttgatcaaaagaccgattccatggccgtggcagaaaccacgcatatgagaattggcttgtcttgatcatggttgtttatttattggaggatttagaatttatggttagaaactggtaaaccgaaatcaatgcttagtgaaccatgactgggttaaattaaagaaagggcaaaatgggaatataaaatataccacatcctatataagtacactgagtaagcggcaattcacaatttgataaaatttcatgcgttagaatttgcaatttagcgagaagcgaaaaagtctgctcctttcgattcttcaggggttttagggtttttctcgactcgagtaagagcgaggatatttcgcgatgttctagattttgggtatttttaatcggaaccctagtttctctgtaatcgaaccatg

SEQ ID NO: 25729 - DNA, 3003 bp, Unknown
  misc_feature (1)..( 3003): 2750-1469P.txt file - cDNA_ID_2707942; gDNA_ID_2214523; Annot_ID_134104
gttgttgaattatttcttacaatgtgtgatgatagctgatatcagaaaaaaaagatggaagatgttgatccaataatggttttgacccggtcacctaacttaccatggataaattatcactaaattgcatatctaacaagaaaatattacagtttgattccttattgttgagttaataacgcaccatgttcatattaatcattcaccatgcatgcatgcatgcaccacatgttgtaaacaaaatgccaaaaagactaatcacaagtctaatgggcttgggctcacaaacatttttaatcaaatcgtcgaaaatttaaattagcactggacgaaagagatggaggcgaagacagagagacactttctggtttcgaattttgggaccgccggtggtgaagtttcgagtgcgacggagaataagcgagacctgttcggcgattcggcatctggggaatgtactgagagagagaagtttctgggaggagctcaaagttagtcctcttttgctttccgtgtttcaaaatcgctaatctagaatgattatagattgctgttttcgggttttgaggtcattatgatctagattggattctattgaaattgtcttaagttatccagctaggggttttactgttagttccttcattttccctcactgctttgtctttgcaattttctctattgttgtggttctttggattttctgttttttctaggatcatgtgattgaagaggggaaaattgataaggtcctttagtttgaaaaagattgacagatgtgaaatgtgaagttattatatagaagtctagatttcttgttgcatgaagtgaggttccaagataattcgatcagattcggtcttgattcagtaaacatgtatttagaccctcttgagtataatctaagtggcttctgcacatcgctctgcatgttgttgaggaattcatctttgttggtgtataaattgcagagaatgacaaggaaaggagggagcaagaatgcaggacaaaccatcaagctccactttttctatgctggttgctcaacttgggactgttatcaccattcaaagcccattccaggtgtgcactagttacttcctagataaaagaatgtacccttttttgaaaaatttgatagattttgggaatgtgacaatttttacaggatatctaggtttaatcaatggtgggattttcctctataccaatatatactgtggcttgctatgcaatagcaaacaagaaatcgaagtaggataaggttggttatcacagtttaagttttgagtgtgtacaatgagattatgagatggatttttgcataattaagttgtttctttttgtggtgtttgccttcaggtacatgaagaaatcatctcccagctagtactcaagattttctatcttcgttatggtctaatgcagctattcaatcagatgtcattgcttctgcgtaagtctcaatttagtcgttcagttgacaatctcaaagctgctgctagtccgtgccaattaataatagcatccactatttgttttaggagatatctgaacagatagccgagtatttctctaatccatatataatcctttaaaagtcagcttgtgaacttagaagccatttactattccttcccctttagaatgtgagagttatttagtaatagtttagtcactttgtgatatttagacattttacatccaatgtgggatcttataacaagcatgtgttattttgaatcacagatgaaagaggcaggacatgagcaaatcaaaacctttttactcaatcgaccacagccatgacacggcaccgtttttggttcttgtagcagtcaacaggtgaaagagaccagagaggtatgtctgttaacaaaagcattgtgaattttttttgtattgtttatgtcttaaatccaaatatgtgaccccattttggtccatcttgggtcgcacgtgggtgtcccagttagctactctttttacatctgcactgttttggacccatgtcttggctccatgttatttattacttttatttttttgcgccaatgtcattattattcaacccaagataatttttttaataaaataaaaagttcaaagtgaaaaatgaagaaagtaaagcaaaagagatgttaagctattgattcatttttcttttacaaaaacacgtcattttcacacaatcataacgttttcttttacctttttacttaggtttgctttcattatggtctagtcttcataatcgatcatcaagtatattatactaacttttttttcttgacttttgtataaccaatgtatgagaatgtactaggtagaaaacacctttgcaattataaaaatggataatggacgtgaaaactgaaaagaataagaattgggaacactaaatacaaatcaaagacttggctgctatacgattccttcctctatttttctgtgccctttaattaaagactaactaaattcaagaagcttgaaagaagagaagacatgcactgcagaaaacgtaactaatgcattaaagaatctgtgactctctgatgtgtaaagttgagaaaagcattatttaccaacaaaacagtgtaacggtagtattcggttttttggcagttctttaaggggcatttctggtacctaactaaaacttctaacggtcctttttcctaacctttcactatcccattcatatataaatcaataaaaattccttagccatcaccatctccaccactaccaaaaagctttcttctaactcagctgcaacttcgaaaaagagaagctttttcgctttgccttgtcctcatttctctttcacacaacttttctatcttatttaaaaccactctgttcttgttttctcagtcattcctctgattcaatcagattcttttagttttcctgattctttagcagattcatgagctcataagaagaagatttgttgttgagtgttaacccagaaagaaaaaggaagactttagaatcatg

SEQ ID NO: 25730 - DNA, 3003 bp, Unknown; identical to SEQ ID NO: 25729
  misc_feature (1)..( 3003): 2750-1469P.txt file - cDNA_ID_2707942; gDNA_ID_2214523; Annot_ID_184673

SEQ ID NO: 25731 - DNA, 3000 bp, Unknown; identical to SEQ ID NO: 11956
  misc_feature (1)..( 3000): 2750-1469P.txt file - cDNA_ID_2707954; gDNA_ID_2214524; Annot_ID_134129

SEQ ID NO: 25732 - DNA, 3000 bp, Unknown; identical to SEQ ID NO: 11957
  misc_feature (1)..( 3000): 2750-1469P.txt file - cDNA_ID_2707962; gDNA_ID_2214524; Annot_ID_134131

SEQ ID NO: 25733 - DNA, 3003 bp, Unknown
  misc_feature (1)..( 3003): 2750-1469P.txt file - cDNA_ID_2707968; gDNA_ID_2214524; Annot_ID_134133
taaaagttttaggatttttctaaaaagtattttgtaatatatttggaaaaacatttttttctgtattttacatggaaatagactgttttcttttagtgacatgttttatactatactgaatttgttggtaaaaatatatatatatttaagatatttttggtgaaatgatatattgccattcaacccaagttaaagtttaaccaaccaatatataatttcaatgaattttaagtattaaaaataattgttactgtgtgtaaccttgaatttgctttaagaagaaaccaaaacagtgttaaaaaaagcttctcctttactactatgttaggtaacttttttttcttcgtaacaaattttcgctgacatttaaattactttgtttttttctcacaattatttttcttaatataaaagtactttattttgaaaaaaacgaaagaataaaaatgccaaactgatccatttttaaaaattgtaactattttttattttatttttttaatcacatcgctaacataacctgcacataattttcctttcttatagtattatatttttttttatcttataagtcaatttataaaccacacataaaaataattatccctattccctagcatagaaacaattgttactgtgttaaaaccttgaatttgcttttaaaagaaaccaaaacagtattcaaaaatgcttctgatcctttactatgtcaagtaacttttttttttttcaagtaactttttttcttccgaataatttttttctcataattatttattattaatataaaagtattttattttgaaaaaaaagagagagaataatactgccaaactgacccaatttttaaaatccaaactaaatttatgtgtaactatttgtttgtttgctttttattttggaaagctaacataaccatatatacatacatagataaatatacctaatcatatttttccaatcctatagtattatttttatcttataattcaatttataaaccacacataaaaataattatccctattccctagcatagaaaatattttatcttccatattttcgacattttggccatggtacatgcccaaataccgatgccatcgaccaataaaatcttcattcataatccagaagaagataagaatcacacatatagtaattcttttctccttttataatacaaatctcaaaattcatagattcaaaaaccaaatcctctcttaatttgcatcgcaccaccacagatcaaatcacaaaggtgtgtgacccttccatgcccaaaatccaaatctttaggtttaaaaaaaaaacatttgcttcttattatatgtcacatacatgatgtgtttcgtgttcccactttataactctctttttttttttcgttggttcttcttccgtgacctagcctttgattccgccatgtctgtttccatatcctaagtcctaacaagttattgtgttacctgaccttctctcatagttattaaaaacccaaatgttaaagtttttgttttgtggcagcattttaacatttttggtcacctccacctgggtttgttgattggtcatgttattgatcttcaatttggtatctttggaccaacttttttttttcttatatatatctgtataattcaatattgggttctttctaatgtagggtttagatcaattcttcatttcttggtgttgattttgttttgtggaattcagggttttagctaattgttcttccccagttaggagttttacttcttaagatctgaattgtttagattagtaattctgattagtaccaacaatgtcatgtaatataattgacttcgtatgtctgaaaatgccttattagaaatttcttatggtgaatgttagaaatttgattaggataggaaagcaatttatattgactattgtttttgtattcccctgttcttattgcagaattgtgtgtttgtatcaaatcctgggtttaaagaagtgaaatatcttctaagtggtgatttatggaagttaaaatggatgagttggttcttgacgtggatgttgaggaagcaacaggtagtgagttgttggtgaaatctgagccggaggctgatttaaatgcggtgaagtctagtaccgatttagtcacggttaccggacctattggtaaaaatggcgaaggcgagtcgtcaccttctgagcctaaatggctgcaacaagatgaaccaatagctttgtgggtgaaggtaataataatacgcgttttttatctccaaattcggaatctttaaattcgatttttgtatggttaatgtttggtgtcttgttgtggtgttgtagtggagaggtaaatggcaagctggaataagatgtgcgaaagcggactggccattgacgactttaagaggcaaaccaactcatgataggaagaagtattgtgtgattttttttccgcatacgaaaaattactcgtgggcggatatgcagcttgttcgatccatcaatgagtttcctgatcctattgcttataagtctcacaagattggacttaagttagttaaagatttaactgctgctagacgctatattatgcggaagcttacagttgggatgttcaatatagttgaccagttcccttcagaggtataagctcagtatttgatataccgaaggatttggattgcatttggttttaacgctttttaatgttgcaggttgtttctgaagcagctagggatattataatctggaaagaatttgcaatggaagctactagaagcacaagttatcatgatcttgggataatgcttgtgaagcttcatagcgtaagctactctctttgctgttaaagttttagagtatttttggtttgattcggctttgtgtaatgttgttcagatgattttgcaacgatacatggatccaatctggcttgagaactcgtttcctttgtgggtacaaaaatgtaacaatgcagtgaatgcagagagtattgaattgctgaatgaggtaatg

SEQ ID NO: 25734 - DNA, 3003 bp, Unknown
  misc_feature (1)..( 3003): 2750-1469P.txt file - cDNA_ID_2707972; gDNA_ID_2214524; Annot_ID_134134
tgtaacaatgcagtgaatgcagagagtattgaattgctgaatgaggtaatggcttcaccagaggctgatagtgtcattgatgtgtattgtttccttaactgaagccactttatctggttgtgtttaggaatttgacaattgtatcaagtggaatgaagtcaaatcactttctgagtctccaatgcaaccaatgttgttgtcagaatggaaaacgtggaagcatgacattgcaaaatggttctctatatctcgccgtggtgttggcgaaatagcacagccggatagtaaaagtgtgtttaactcagatgtccaggctagtcgtaaaagaccaaaacttgagattcgacgtgcagagacaacaaatgcaacacatatggagtctgatacttcgccacaaggattatctgcaattgactcagagtttttcagttctcgaggcaacacaaattctcctgagacgatgaaagaagaaaatcctgtaatgaatacaccagagaatggtttggatctatgggatggcattgttgttgaagcaggtggttcacagttcatgaagacaaaagaaactaatggactgtctcacccgcaagaccaacatataaatgaatcagttctgaagaaaccatttggttcgggaaataagagtcagcaatgcatagctttcattgaatcgaaaggaaggcaatgtgtgaggtgggcgaatgaaggtgatgtttattgttgcgtgcatttagcttctcgtttcaccacaaaatctatgaagaacgagggctctcctgctgttgaagcacctatgtgcggaggggttactgttcttggtaccaaatgcaagcaccgatctctacccgggtttttgtactgcaagaaacaccgtcctcatacagggatggtgaaacctgatgattcttcatcttttctggtgaagagaaaggtatcggaaattatgtcaacattagaaacaaatcaatgtcaagatttggtgccgtttggagaaccagaaggtccatcttttgagaaacaggagccccatggagccacgagcttcacggagatgtttgaacattgtagccaagaggataacttgtgtataggttcttgctcagaaaacagctatatttcttgcagtgagttctcgacaaagcactcgttatactgtgaacagcaccttcctaactggcttaagcgtgcaaggaatggtaagagtcgaataatatcgaaggaagtgtttgtagatctcttaaggggttgtttatcgcgtgaggaaaagttggctctacatcaagcttgtgatattttctacaagctcttcaaaagtgtcttatcgttaagaaactctgtcccaatggaagtacagatcgactgggcgaaaacagaagcttcaagaaacgctgacgctggagttggagaattcttgatgaagttggtatccaatgaaagagagagattaactaggatatggggtttcgctactggtgctgatgaagaagatgtatcattatcagaatatcctaatcgactacttgccatcaccaatacctgtgatgatgatgatgataaagagaaatggtcgtttagtggatttgcttgtgctatttgcttagattcttttgtgagaagaaagcttttggaaattcatgtggaggagcgacatcacgtgcagtttgcggaaaagtgtatgcttcttcagtgtattccttgtggcagccattttggagataaagaacagttgctggtacatgtgcaagctgtgcatccttctgagtgcaaatcgctaaccgttgcttctgaatgcaatttgactaatggtgagttttctcagaaacctgaagcaggcagttcacaaattgttgtgagccaaaacaacgagaatacaagcggcgtacataaatttgtttgcaagttctgtgggctgaaattcaatttattacctgaccttggccgtcaccatcaagctgaacacatgggaccgagtctagttggctctcgtggtccgaagaaaggaataaggtttaatacatataggatgaaatctggtaggcttagtcgtccaaataaattcaaaaaaagtcttggagctgtctcatataggattagaaatagggctggtgtaaatatgaagaggaggatgcaaggttctaaatcgctcggcacagaaggaaacactgaagctggagtatcgccgcctctggatgatagtagaaactttgatggcgtaacagatgctcattgctctgtggtttcggatatattgttgtcaaaggttcagaaagcaaaacatcgccccaataacctcgatatcctgtctgctgctcgatcagcttgctgtagggtgagcgttgagacctctttggaggctaaattcggtgatttgcctgaccggatatatctcaaggcagcaaaactttgcggtgagcaaggtgtacaagtgcaatggcatcaggaaggatacatatgctctaacggatgtaagcctgttaaagacccaaatcttctacatcccttgatcccgcgacaagagaatgatcgattcgggatagctgtggacgctggacaacattctaatattgagttggaagttgatgagtgccattgtatcatggaggctcatcattttagtaagagaccgtttggaaacactgcggttttgtgcaaggacatcagctttggtaaggaatcagttccaatttgtgtcgtcgatgatgatctttggaattctgaaaaaccgtatgagatgccttgggaatgctttacttatgttacaaactcaattcttcatccgtcaatggatcttgtaaaggaggtatcttacttgttctagcttgtcatacccttgaaacagagatgtgactccatgttgtaaccttgttttttgtccgctgtttgcagaatctgcaactcaggtgtagctgtcgcagttcagtgtgctcgcctgtaacttgtgatcacgtataccttttcggtaacgattttgaggacgctagagacatatatggaaaatccatg

SEQ ID NO: 25735 - DNA, 3000 bp, Unknown; identical to SEQ ID NO: 11966
  misc_feature (1)..( 3000): 2750-1469P.txt file - cDNA_ID_2707974; gDNA_ID_2214524; Annot_ID_134135

SEQ ID NO: 25736 - DNA, 3000 bp, Unknown; identical to SEQ ID NO: 11967
  misc_feature (1)..( 3000): 2750-1469P.txt file - cDNA_ID_2707982; gDNA_ID_2214524; Annot_ID_134138

SEQ ID NO: 25737 - DNA, 3000 bp, Unknown; identical to SEQ ID NO: 11974
  misc_feature (1)..( 3000): 2750-1469P.txt file - cDNA_ID_2708018; gDNA_ID_2214526; Annot_ID_134152

SEQ ID NO: 25738 - DNA, 3000 bp, Unknown; identical to SEQ ID NO: 11974
  misc_feature (1)..( 3000): 2750-1469P.txt file - cDNA_ID_2708018; gDNA_ID_2214526; Annot_ID_184750

SEQ ID NO: 25739 - DNA, 3003 bp, Unknown
  misc_feature (1)..( 3003): 2750-1469P.txt file - cDNA_ID_2708022; gDNA_ID_2214526; Annot_ID_134153
cagcttgaaccacattactaataaaaaagatagaggaccatcaagtgactcaccagagctcctcaacaacaaccgcgcaatccgctaagttccttcttgttctgtaactcttgtacaccttctgtaacgtagttgcagctgcatcaagctcggtgaccggtcttggagagaagaacacaaaaggcgtaggtggagtaatagtaggcttcgttatttggattctctcacagttccttccattcaaactgttacgagcaggcttcgtcggttcaacaatctcctcatcttccttgttcatcggttcagtctcaacttctgtcacaatctcccagctgttgaagctcaaagaccgctccatacccgtcttcggagacttttcctgcgggttctcactcttgaaactgttggttcttgaagtcaagcctccttctttaagttttaagctgaaagatctggtttcaagaaaactctcgacagggttcttgaaactgaagaactgggtcgtcacaacttctttccaagcagacaagagcaaagaaagagaaagacccatctttctctgattaaacaacaatattaaacacgatctcttcctccaaactaccctgcacacgtatcaaattcagatcaatatcaaaaactttgacaaacgaatcttttttctctaagccaactatcattaatatattaatttgtttactgagtcattcctatcatcaccaccaaacacatttattatagccgacgatggataaaaatctaatctcattcagacatttcaacaaacacattcagaataactccataaaggtggagactttatgattttattcatcttttataatcgacccatgtaagaatcagagacatacctcaagaatttgcagagtattaacaccaaggaagacttgaaaaaggtcaagtctttatctctatcttcttgtgtagagaaaacttaaggaggaatgagaaattgaatacaacaaccaagttgaggaataacacaatatatatacacaacacaagctgaataaatgtatagtgtgtgtgtgtgtagttgacgagtattaaatgcggtaaaagttttgtttaaagaaagtcttcgttgaatatgacaaagctttgagtgaagaagattcaaagatggtgtgtctgaaaaaaaaagatattaattttaaaatgatatatagagacaagtaacaaagtgtgtgtgtgatagagaacagaacagtgtaataagggaacccataggagacgctgggtaataaaggtagcttcaccgaaacttattcatttagaaaagtagggacaatttattagtcttttatatatttttcgttttttttttggttatagaatttaaaatgtaatgtgtaatgatatcgaaattcctttagttcaattttggttattttggttatagagtaaaatttatttagatattggaaaaaaaattggacccgattcttttggtttatggagtttatgaaccattccaatacatacaagtaaacaacaaagtgtgtgatagaaaacagtgtatatgggaacccacaggagacgctcagtaagaagaaggtagcttcacagaaacttattaattcaggaaaaaaaaaatattgttgacaaataaacaaaaaaaattgttaattcagtagggtcgtttttcgagcaaatcttatctaccatgacattatgaaaaatatattaatgctgtggatatatatattaatgcagaaattattgaaacaatgatactatatatttactttgtccccaaaaaaaatgatataaatttacctttaactgttgaactagctagttacaatatcgtgaaatgacgttaataatagtaaccactattgcaccactcttttggtatgttaaccagattttttcaccatccaaagtaagaaagtttgtctatgtcgtgtaaagagaatttagacttcaaaaaactttgaaggatatgtataaatagtgcaagaggtgtaatcatctccgtaggatttttaagcagagagttagactccaactctttgcaaaatattgagaaaaactccaaaagaacatattgtcaaaacaaaaagtaattatttgctgcaagtagatactcacacaaaagttaagttttttacttaggtttgaattagtgacgttcattaaagcaatgaacctgttttgaaaacataacttaataggagtttgattgttagcggtagtttgcaactttgcattagtagttcattcatatcaaatatttagtttaaaactgtatgtggtatattcttaaatatcaaaatcacagctagtgaggtcttaaattacatgtggtaggtgtagatgacaaaaggaaatatttgaacaaattattcgcatgtgtagacacgtgcataattgcatatgagcgaacgaagattagtcgggacatgtttgaaatagtttttgtttctcttctttgttttgtgtcgacaccgtacaaatcttggttctttgtgataatcacaattttatataagattttggatataattaaatacggtttggtctgatatatctgtcatttgtcgtgtgcaatgtaattgatgtggtttgggtgtgttgactgttgtctaattgctattaaacgattatccacgcagtattgtcaccgttatcaactctgtacaatctgtttccatcaaatcaatctattcttctggccaaaatagtttatatcccctaaattagccattattattgttaattatgagtgaagagatgataggctccgttttgacatattgcactttggatttaggaataccaaaactaccatatccttgaaaggctaccatatcctccgaggtgagagtctttatgtcttaacgtctaatgaattgccaaacctggatttgtctaaaaaaggtttcaaggaagtgtacttcaatgatagtttattacaaaaatttcgtccgccaaattaactcctttaagtggtaccatatatgtaacagcaacatg

SEQ ID NO: 25740 - DNA, 3003 bp, Unknown; identical to SEQ ID NO: 25739
  misc_feature (1)..( 3003): 2750-1469P.txt file - cDNA_ID_2708022; gDNA_ID_2214526; Annot_ID_184751

SEQ ID NO: 25741 - DNA, 3003 bp, Unknown
  misc_feature (1)..( 3003): 2750-1469P.txt file - cDNA_ID_2708026; gDNA_ID_2214526; Annot_ID_134154
tttcagccaaatgggtgtatcctcttccgtgactatgctgtcggtgatcttgctcaggtttgatccaccttttattacttcagaaattcaaagttatcgctactcgtatgcccattttgatgcacttgaaacgaaaaaatatttctactacagtttcatgcttaaaaaaaaacattgtggtctggctttccttttaggaagaacaaccacttcttaagagatttagtatcctttagaatacgaaggcgtggttaccccttatgtgtttcagtatttcatcaacaggagaggttctctgggaaggatcagaggatcagcgagaacttttatgtgagaggtgatggcactgtaagttctttctttctcctgcgctatttatttgcagtacacatttctataattttgcagatctgtgatgattttgttttctatgcagcgtgcattctacttttctaatgaattcctagaaactttgttttctgaacaaggatttgaagttgaggagcttgatgtttgctgcaaacaagttgagaatcgttcacgcgaactggtcatgaatcggcgctgggtccaagctacatttcgtcgaacaaatggcaacaaaaacccttgtgatagtttgactcctgccaaattagataaatctgaacaacaggatagcattcagtctaaatctgaggagcaggaaagaaaagagattattgattacactgacattgacatatctgatggtctggctatggaaatgtttggagcctccccatcaagtcatgaggtaagagacttcggtaatctcattgtttttacatattttctcgaagagtatttttaatttaattctatgcttacaagtccatatctgtttttctattcgatttgttgtcatagatgagcgtggttaagcttagggattctgcttttaaaatcaaacttttgtcaaaagaatatcaacatacttgcaaatctacggggttgatgctctgggagtctgctcggcttatggcttctgttcttgacaggaacccaaacattgtttctggaaaacgggtgttggaattgggttgtggctgcacaggaatttgctcgatggtagctgccagatcagctaaccttgtggtagcaaccgatgcagacacaaaggcacttacgctattgacagagaacatcacaatgaacctccaatcttctttacttggaaaactgaaaacaagcgtacttgaatggggaaacaaagagcatatagaaagcattaagcgtttggcttgtgagggattcgaagttatcatggggacagatgttacctatgtagctgaagccattatacctttatttgaaaccgcaaaagagttgatcttacggaaaatgggagacgacttagaggtgcaagagaagccggcgttgattctatgccatgttttcagaagggttgatgaaccttctcttctgtcagctgcatctaagtttgggtttaagcttgcagacagatgggctgcaaattcaaaggaatctcctattgggaacatcattgacagttggttttccgaaaaggatttggtcgcagaaatcccgagttctgcgttgcatattctctattttcagatggagtaactatgtggtagaggagcaaatgttgattaactggagagttcttttatattaaaaaatcctcattgaatctcaaatcaatgaatgtcctacatgtattcttctatattagcaatggattttttgggtataaaactattacatgatgatgacttgttgttaccagccttccttatcatccatttccctcacgattttgacatttttaatggctttatgagagttgaatccacatgttaactcggtcctgcagaaacactttcccttttatgacttggattttgttggcatgttagtttagtcagtctccccctcatctaattccatcaccactttccctcattctttgccacacaaaagttgtccaaatgttcacatttccttctacatgagcaccgccatggataggtgaattatacatttacatctcctcttgtgggtttagcttgaatcataatgttttggagagttcttgtgatagattcacttccacaaaaaacctttgcttcttcaaaattactacataactccatgacataaaaaaattactaaaaacattattaattttatttttatattttttacacattgaccaaaaaataacatgttatgaaaactgaaatgataaaaatatgaagaatagtataggttttttatggtaagagaagtttagttagtgaattttttttttttttttttttgtattctcaaaatataaatagattcttattttatttcttttttcgtgtccttaaatatttatctgaatttttaattaataaacgacgatcaaaatagttctcaatcagttggatcatctttttattcctaaataaataaactccaaaagcatctctctgtttcttctcctctcttcaagctttttgtttcgtctcagtcgtcgtcatcatctctgacaggtgaattgaataatattccactttcattattccttcttcttctttatagcttttccacatgaatttttgtgtttgtgcttgtagatctaaggttttgtccagtttccggagtaattgaaatttgcagagaaagaaaaatccaatttttgttcattttggaaaaaatctgaattagactgattgatagtacacattttttagaaattttggagaaacccatgtatagtaagctacaaaatgatcaattatactcagatcatttcagatatataatgagaaatggtagattaatcattgttatttgttaggttgattcaaataaacattagaagctatttgatgaatctgtctatgtctacttgtggcagcaaggttattcacataggcaaagaagtcattcttttgcatgctgttttccaataaagttaattctctaacagaacaagtttcgagattggatattgacgacaacgatatg

SEQ ID NO: 25742 - DNA, 3003 bp, Unknown
  misc_feature (1)..( 3003): 2750-1469P.txt file - cDNA_ID_2708030; gDNA_ID_2214526; Annot_ID_134158
atccactaactaacattttgattcatatatatatatatatatatataaactctcttttttcatttaagaaaactaaaataaaacataattttaagtgacacataaacggcaaaaatgaagtttaatttgtaattatcatgatcacttatcgcaaaagtttgacaaagcaccatctcacttttgcgagggctcaatcttttcacgtcgatcaccacgtttgtgaccgatgcagaatcattaacttagtgactatcctgcctcaatacctatgagatagtagccttccgatcgaattgtcacattttgtaaaagttttccaataatttaatggaaatgtggtagccttccgagaagggttatttcacatataaaatttggacaaaaactactggtaagtaacctctttaaaacgctatacatacgagtggcacaaaattgtaaatcattacaaaagaaagtaataatactgagtaaaatattctttaaatataaatgtttgaattggtcctatatatgaagtcaaaaacaattcatattaaaaagaaaaagcagacttatgcatgtgatccacagcaaggacaacacatgcccaaatgggtttctttaagtacgtgtgctttatatagttgcgttatataccctaaaaagaaaaaagaaggaaaatggtgaatggtgatcataattacgacgtcgaaagaaatacgatgaaggtacacgctattacttatagagttatcgttttaaaattgacgaaacgttatgatcgtgtaaacatgggattttaaaaatcatgagaaaacaaaatccacaaacgaaacacgacatcatatatatattctaaatatgtagtattgatatgtgatcaaaacattgttaggttaaacttgaaaaggaaaaaaagttgctgttaaaagaagttgctaagacgtatgggaaattagtaatgttgacaagagaggtatggatgttgaaatgtttatgatgatatctaacttatggctgtcttctttaatgagtcaaatggctgatgcattttacgggaagtagttgaagcaaccccttataccattattgcacattattattatttccctctctcttttttgtattgtttttaaataaaaaaaaacaatttcagatcggttaggtccttttggaccatgaattttgtaggccataaaaaaataaaaaatagaagtccaaaacaaatgaagcagtgaataaactttaccaaaataagatccaaacacgtacgtgcatgcttgaatttgttcataaatgactgaagatttttcatttgattgactaaatattgtttttacttctttgcctttttttcttttataggttttgccaagaaaccaaaagcataggtaatgaacatggaaatccgaaccatcttcatcttatatgatacatactcatttagcaaagaaaaataattaaaggatttagtttttggttgtcacaaaaaagctttgtttcaagaactctgtcattgcgcttatatcaggaaagaaacttgaacaaaaaaaaagagctttgtttcaagaagaagggtctatactctatagtctatatatagtgcaacagaaaatgatcacgtgaggttgtagatataagagaagattatcgaaccaatcttctaagacaatttcagacttaatagttaatactagtagttttcttatatatacaaccaaaaagaaacggtttaagaagtgaaatataaaaaaactatccaatcttatccaacgagtcatggttctaaactcccgttgacttacataccataaccacagtcaaccctaagataaagatggctaaaatatgaaataattgtggcccttcttattattatatcaaatataaattcacaaaaattcaatggatgaggatgatagaactgggtttaacatgggcttccaacctaaaaccaattgacaataggtggagtggtccgaaccttctatatatcacttgataattcctccaatttttgatgtggaactttctttcattaacaaaggatacaaaagaaaacctctcataagcgacaatattaaataggatttagttatttagcaaaaaaagtagaactttagttatagtattttcataacaattttcttattatttaaccgcttgttaccaatcataacaaaaacaaaaacgtgatggatagttataagatgatgaaattgaagaactctgaaagagaggttcatgcttcgacacacaaatctcgtcaagttttgtgacttcgtctagaaacgaagattaccttataatctagctttttattctaattttttttgcattcatggttataaatggaagggatttgatgaaattagatgggattggagatggagaaggatggaggcacctgaagagagaagaacaattgttaaaactataagaaattaaagaataaaaagataaaagagtatcatgaagagtgaagaagaaacaatggtcataaaactatatttgcgattatttatgcaactttatatattttttattttttttaatcttttaatttattttatattactattgtaatgagattttacttataacaaaaaaaaatatttttactattcgacttcttgttacaacttaaccattttcattatgaccaaaaacacactttcacaaaaactttgaacaattttcatttctttttgttacaaacccctccaaaaccaatcttaaaacagttttcatttacataaaccttgagattaaatcacattaaaaatcccaaatcatatgggtttaaacttaaacagaatcttataaaaattcgaaagcccaatatgttttgttttcccaacaataaaaatagattggaacagaaaggttgtgggaggcacacattacacaccaaagcagtgttttctttctcctgaaaagatttttcaagctctctctttctctcaaaggtaaatgcttctctgatttcgccatttttgcttactcgattcaaaagacatg

SEQ ID NO: 25743 - DNA, 3003 bp, Unknown
  misc_feature (1)..( 3003): 2750-1469P.txt file - cDNA_ID_2708034; gDNA_ID_2214526; Annot_ID_134159
gattgtgttcagtggctagctaccatattaatgtgaagaggcataggatgttagtagaactagacatattttcaaatctaccctggtcttgattcacttgttctgacatgattttgcagttgctgatacacttctctggaaggatttaaagcagactcttattgccatattcattctaattagtatctattataactttgttgcaactgggtctaccgtcgtaactgctctttcgaaggctctattggtagcatctgtatttttgttcctccatggcattctaccagagaaaatgtaagattcctgagatgccaacttttgatagattttcatttatgtgcaatatgaactaccttaacctagttctctaataatggaaaccagaaggtatatgccaaacatttttgaaacactgtgtatcgtactcttcaatcaggaacaagtaatataagcaattgctgtctatttcagtttacgaacaactgaatatagatgcttattttgcagatttggttatacagttgaaaagattcctgcatcgcaatttcacctctcaaaagactcatcacatgacctctcattgtcagtgatctcttcatggaacaccactgtaaaagctttaagatctctttgccaggggaatgattggagcttctttttcaaggtatttttccttgaactagttattgctggcaagttccagtcgtacgatatcttatcccaacctgaaacagaaatagggacaaaattcgattgctgaagttctctttggtaataatattgtaacaccgctttggtgtttttaatgtcataggtggtcttcgttttgttagcattgagtttggctggagccatatctcttcacagcatatttgttataggtacacactcactctctatctagttttactacatgccaacgctacggttgtatgaattatagttcttcaacaataactggttttgttgttctgtttttgttcaacaggactgcccattgccttccttgcttttctcgtgtacgaaaagaaagagcaagagatcgactcaatagtggtgagttttaaatctttcgcatgcaagcacaaatccgatgtgtatgagaaattgttcggaagcaagaaacatgactaaaaaccctttttttgcccagcatttgtaattttcttttgtttccaacgacctctaactctggtttgagcttttttcaagttttattatttgtgaatctcttttttactcatttctattggtctttgtttacatgcttggagaaaaatggatgttgagagatgccctattaagccacaacttttgtcctctaacatgaaagtaagcattgaaaaatcgaatgaatttgtgaaaaaaagaaaggagagaagaaagattcgcaaggttgattcctaaagcacatgtccttagtcccgtgcctttgaatatagaatcaattgatagattatcaaaccacaaaacaactctaatattgaatttaatgacaaaatattagtaaagaccaactttatgaagtggcagcctttttatctacttgttgtaagtctatttctcgaattttcctttccaaatatccaaaatgtaattaatgtaaattgagttaactatattccaatatcattaaaatcatagagacgaatttcataacgaataaagaaaaaattttaagcttcaattttattgttaatattttgttgtacacatgttaaagcgaataatttagcatatgaaattcttacagaaccacgttatattacatatgtaaacaacatatctccgaagtagttcttttgagtttaatttaaagttgttaaaaaataaagattatctgaaaataaataataatacaaaaaattataaaaataaatagaaatgtttaactggatcccatccatctaaaaacagaagcttacaaattaaaatttgtattatcactccacttttattaaaaagccaaaattacaagacttgttataattacaagagttttggtgtaagtaattaataaaaagaagtcgggtcgggtcgggtcaagcccaactatttttgaatcacaagagttatctctcagtctcactagtcacttgcaaagaagcgttgtgtgagagttttgaatagaaagagtagttgtctctcattccccaaatttggaatcacgccgataaagccaaaattagccccacgaaaaagctccgacaaccaaagtaaccatctttttccgaggattcatcacttaaagcaccattttgtccacaatcactcaaccctaaaatctttttctcctttgaatccttttcatgcttcttcttacattccccgatttctttttcctctgagaaagtgatttccttttgattttgattcttttttagtctttctgcaatgattccgtattttgaattaaggatttataaaaaagcagagattggagcttggtttgttgtctatcatcaactatcacaatgggtgctctcagaagaagaaatgttggtttgattgattcaaagggttgttctaagttgtttcctgttttacaatctcctcctcttactactacttcaatgtctcagtccaatggtccattctcttctcttgtcatttgtgtcactggtttatccaaaggtaaagactttgttcctttttcaatctctattaggcagaaagtttgaatttttatgttccatcaatattaaagttttattcttctagactttcagattctgttgttataactttggttttatgtttgtaaatttaaagaatttgttcctcttcaatctccattagtcagaactcagaagtaggatatttatgttaatcaatctttagatttcagatgctgttgtgaatgtgatcttgttgtattcataacattggttttgtgttgtgatatgttaaattgctttgtttctttgcagatgcaagaaaacaagtcaaggaagcgacagagagactcggaggcgagtacactcctcatcttcaccagcgatg

SEQ ID NO: 25744 - DNA, 3000 bp, Unknown; identical to SEQ ID NO: 11981
  misc_feature (1)..( 3000): 2750-1469P.txt file - cDNA_ID_2708038; gDNA_ID_2214526; Annot_ID_134160

SEQ ID NO: 25745 - DNA, 3000 bp, Unknown; identical to SEQ ID NO: 11981
  misc_feature (1)..( 3000): 2750-1469P.txt file - cDNA_ID_2708038; gDNA_ID_2214526; Annot_ID_184762

SEQ ID NO: 25746 - DNA, 641 bp, Unknown; identical to SEQ ID NO: 11982
  misc_feature (1)..( 641): 2750-1469P.txt file - cDNA_ID_2708052; gDNA_ID_2214526; Annot_ID_134165

SEQ ID NO: 25747 - DNA, 641 bp, Unknown; identical to SEQ ID NO: 11982
  misc_feature (1)..( 641): 2750-1469P.txt file - cDNA_ID_2708052; gDNA_ID_2214526; Annot_ID_184768

SEQ ID NO: 25748 - DNA, 3000 bp, Unknown; identical to SEQ ID NO: 11615
  misc_feature (1)..( 3000): 2750-1469P.txt file - cDNA_ID_2708064; gDNA_ID_2214506; Annot_ID_133750

SEQ ID NO: 25749 - DNA, 3000 bp, Unknown; identical to SEQ ID NO: 11615
  misc_feature (1)..( 3000): 2750-1469P.txt file - cDNA_ID_2708064; gDNA_ID_2214506; Annot_ID_184112

SEQ ID NO: 25750 - DNA, 3000 bp, Unknown; identical to SEQ ID NO: 11614
  misc_feature (1)..( 3000): 2750-1469P.txt file - cDNA_ID_2708068; gDNA_ID_2214506; Annot_ID_133749

SEQ ID NO: 25751 - DNA, 3000 bp, Unknown; identical to SEQ ID NO: 11614
  misc_feature (1)..( 3000): 2750-1469P.txt file - cDNA_ID_2708068; gDNA_ID_2214506; Annot_ID_184111

SEQ ID NO: 25752 - DNA, 3003 bp, Unknown
  misc_feature (1)..( 3003): 2750-1469P.txt file - cDNA_ID_2708072; gDNA_ID_2214527; Annot_ID_134195
cacatgaaatggagattaaacaaataatcttacggtaagattcgcattttgttctaactcgaggaagtggtgcaacgtgatgacattctaaaactccactaatccaatggttccctaaaattccgacgaatattaaataacgtaatattctatgaataagtctaattttgtttttgcatcaacttcgaataatgtcatttggataaggacgaagcatgtactcgtcattcgtctgcgtccatcacaagctaaatactaaaccaaaattattgatcatattattggttgctccattttcattcccttatatatgctgttgttcctatatataccggaatccgtatatctcaatactacatcgctagatcaacacaacaattatttccatattatcatcctcaaagtttgagcatctgaatttcacaatcagacccaagaaacagctacttattacttgagtcgatacagaatcaaaacatatattcattttgatctatagtatgagatacttataagaatataagtaattacttagataattttttttacttattcctccaggactccatccactaactggtctaattgggtaggtacatgattttcattactattgtaatcattaatggtcattattaactaggtcagcgtctctgtatgatacaaatgtatattcttattgttaaaaatgcagtattaacttaacattgataccaaaaataaattaaaaaatgtagtattaactttgcagtatttatagatatatttaaatggatagtcagacactaaataaggacagacagatctagcaaggccaaacgatattaaaccccattttatctgatttaattaattaaatatcattttcggtaaccaaccagaatattcaagtccacacgaaatacataatactattgtatacttgaactcttcaaacttctacgtcatatgatgttcacaagtttctaatttagaatattcaaaacagctttggactcatttttttcttgtagagtcggtacatacgcaataaccacatttagtcattagattcaattatctatgttttatttcgctttcaaaagtttagtagtgtagaaatttgtccattgtaccataatgtaattgaggtagaacaatagaacatgaaatcatttaacaaaaacaaaatcgaatattatagtcacgaataaaaaataactcgcatcaatctctatgtttggttaataagaatattggacagtgaaaagtcgtactttaatttttcccataattcgacgtgagacatgtgagtggccgcagggagacacgtggcggttaataagacgttagactgacctgacgtggacgagaataccgatgtgtcaagtggattccagctggcagccacttggataaagagagttggatataacttgtaatgtaattcaacacaaaaaaaaaaaaaaacaaattctaagaaattaccttaataacatatgaccaagcttactttttttgtaagatgtcataataagtcttcttttaatgccccatttaatttccctcttaagatgaagaaaaaattatatcttactctatagttaaaatatagaactcactctctggtctctaccaaaaaaaaataatatatatatatatatgtatatatatatatatatatatatatatataaaactcacttgtagataataacttgttgaccaaacttacataattctataatattatagcaatcatttctttagggtatattcgaggagccaaaggaaatgtttgatattttataatataattgaaattaattactaattgtttttaggtatagggcttattaggagaagtgtattcacaggctgtcgtgtgagctttatttagcttttgttcttcgaatgatgcaaataaacagctggccgtatcacaacaagacactgtcatcgttgttggtgtacgcaaaggatggatatacacatttttgtgtttctattcgtaattatggtttgtgtaatttttgaactttcacaaattgacatcaataaattggtctctttcggacatattttatattatttgaaatgaaaagtgattggggttctccttttttcttattctactatatcataacatagcattaatttttgttgttgttaaaactcatattaaaattatgcgacaagtaatctaattaattttaaaactttgattctatttagaaatttatcataaaacccaaaatttaatcatctaaaaaactaaaacatagaacaaacaaatacatagccagtctttggctataagccatggcaaccaattcgtttggtaatttgtcatcttctaagtttgaagaaactgcaaattattcaaaaaatattgtttgacaaaaagacgagtgtatcatcattcccattcattacctcataaatatttgaagcacatttttctacatattattttgtttctacttaaagcatgtttaattgaatagactttgatatccagtatggctcattattcatatgccgaaatgaattcaaaacttattgatggacctaccaaaaactcccaatgactttatcataaggttcataacacacacaaaaaaacgcatttttgtggtctcttctcttaatcacagatttttttttcttaaaaaaactttctctaatcaaagttaaagaaaagaaattacagtcaaaacaattaaattagtattttaattaacaaaacagttaaacaaattcaaaataaaaactgccatgtggtctctttcttctctgtttctctctcccttcctttaagaacgcgtttgcagactttgatcagacttcgcgttcccgccgcccatctccctctctctctctttttctctctcacacgtttcttttttgtctctctccctgattcatcgccgtagctgtgtgaccgaacattgctgcgagttcctcaaaacccaaatctttcttcctcaaagactctgttttttctttcttcctttcttcaatg

SEQ ID NO: 25753 - DNA, 3003 bp, Unknown; identical to SEQ ID NO: 25752
  misc_feature (1)..( 3003): 2750-1469P.txt file - cDNA_ID_2708072; gDNA_ID_2214527; Annot_ID_184806

SEQ ID NO: 25754 - DNA, 3003 bp, Unknown
  misc_feature (1)..( 3003): 2750-1469P.txt file - cDNA_ID_2708080; gDNA_ID_2214527; Annot_ID_134192
tgtccatgcctccatggtgaaaatggttatcacaaagacgatgaggatgagctttttgctcaagtcatagtgaatggacatacagacagtgaaggaggactgtggtgttgacgttgtttttgataacgaggtgagcaagaatgtctattactcctaaacactcctttatgtgcgaaatagagaggctcttgaaaataccttctagaatcagaccattaactagtcctcatgaatctctctgactctggtggtgggaaggcaattttgtaagctagggttcttaatgcaatctctttgcaagactctaaattctcaagttattgaaaacttttggcatgaattaaagttagaaatcgatcgtagactgaagactgaaattagaatgtttaggtctgatttcttttggttgagtagaactcaaacagaataaattttagagaatgctatacatttacgtctataatgattccatctctttagtcttgagcatagctaaaagtctatcaaacttcatctctcatcaacaagacaaaaacattcatcgctatcttcagaacaactttgagtggtgcgaattttggtggcaatttcttgaccactttcttctctttgtatttcttaccaagcactgaagcttcattagcgatagaattatgcttagatattgagggccataagcataaacttgacctgtttcctttctagaaccgagtctaacaccactaaagctaagaagcttcgtaagtcagattctaacacactattgcttaaacttattgaatcaattgatttttttcataacataactacgaagttaatgggtcctaaataattttcgagaagatcgatcatgcaccaaataataatatctaaccatccaattacgataggaaaaaacacataagataaattctcatatattcttagggattatttagccaacttaagttagtagtttaccaaagcgtagtaagtcaaaaagttttatggaaaacttggaatgcgcaaacttgagggtgagtaccaaacaaagaaatatggccatgaaaggaagtaagatatatagtaccaaaaacaattatttgacgcaaatcacctttcctttctctaattttcaactatattaaagaaaattatattgtcatcaatctttgaataaacagttaaactaaaactttaatgtaaaataaaatatcataaatacactttgtttcctataaaagttatgtgtaatttttatacagatgttctgtattatgttaggaaactaatattacctgaattgattagtctaattattatatttaatagtcatccaaaaataatagaaagcactagagagtagagagagtgtcgaccaacacaaaagaaaaaaaaaaaagagaaaaagtggttaaaattgtgatgttggcaaatagacgttatactgatgtgttcggatctcttatattaatggctaaataaatcaacggccgtccttataaaaggccgtaaaaacaaaaacaaatttgaggatagcgacatttcaagtttcgaggtatgtaacgtaagagttctttaaaggaaatggaaagtaacgtaacaattgcatagattgcgatatagtataagattcgactacatctgtcaacatatttattaggtctatctctggcgttacacatcacacatggagtctaaaattacttttatttattttgtaataagaacaaaattataaatggatattaaaacaagaacttgaaatccaaacaaaaagtaatattgtatacgatgagataattaatatgttatgattctaatgttttaaggaatatggtaaacaaaaaattcttaaaaattcattaaaacctatgtatatcagtatatttaattagttttttctaaatataatgataattataaatatagatcgtgtcaaactagttaaaacccgatagtcagacactcaaatactcatttggttcaacaaatagggtacgtatatatttataaaaaaatcatttagtttatatattgtctattatttgtgtcttattctttttttttcaattttaatattacttcaatgcgtgccagttcaaaatcttacctataaaaggattacgactacatactaaatcacaagtaaaataatcgcatcgaaaatcttttttattgtgctcttcgtctcttccacggtcgtatcgaattgccgttttttcactctcatcaaactgatacaaaaaaattccaaacttcatttttctttgcaactgcgaaacaaaagctttttgctctttcttaaattagagttacaaatccaatcgtgaaacaaaactttttgctcttgcttaaattagggttacaaagtccgatcttaaataatatagatattctgtatctattgaattataccactttaattttcaatattcaagtaagtttttttctttcacaaacactatttatattatttatattaaattatagactcttcgctagagaaaactattcaggaactgatgtaattacatagaaaaaagactatttcgaatccaaacttttttaggtaagcaatctagtcgagcattagaactacgaaaaataaatttaatacggtaaaaaaaaaaactaaatatcgattccaaaagctaaaaatcaccatttcagtaactaaaacctccaatcccacttccaccaaacctccaattccacttccaccaaaaaataactattcaagtaaagggcttgggtagtaatgaacggccacgatttcatcaaagtccgtaaaatcagccttttgaacgtgagagttgtaagcatttcagagagttttacatgcaaaaagagtttttgaccataaggatctacatttccacgtagatcaacgtcaagtcacgagactaagctctatatataccagtagaggagcacattgtttgtaacgtctacaaaatttagcttttatcacttaattacaaaatctttagaatcgaaaaccaaaaagaaaagaaaaaaatg

SEQ ID NO: 25755 - DNA, 3003 bp, Unknown
  misc_feature (1)..( 3003): 2750-1469P.txt file - cDNA_ID_2708084; gDNA_ID_2214527; Annot_ID_134191
tgttaagactcccaattcgaaataaactatcattcatatttatgtaattatgttgcaaatgtagtgttggagccaatgtgaagggatttttcgcatggtcgttgctagacaatttcgaatgggcaatgggatacacggtccggtttggactggtttatgtggatttcaaagacggatgtaagagatatcccaagaaatcagctgaatggttcagaaagttattgaatgaaaagaaaaacgattgatgatgatgagatatgtatatttcattatattagtttctctgttactcttgagagatttatatattttttcccccctttggaaataatgagaaatggttttagctattttcacaacgaaacccgattgatgtatagctgatggaaatcatctttcgatgtaattacgtacgttttataaggaaacttaatattaaacttgttgaaaaagttaaaaaaaaaatagaatgtgaaaacgatataggcaaagagtatgtaacatctacaactttcagcatatatcaatttgaaaaaaaatgttcaatctttaaatttttgaagaatctcatggttttcaaagatcatcatttatggtattatgagttggattattgatatttttttaaagattgtgatggtcccattattgattatagcatgtgagatgttgacagaactgctataatgtgtaacaattattcgcttcgatgtgagaatattctattaatacgcattcaaatagaaaagcccagtgaatatgaaaccaccaaatataaaagcctcacaatttatttatttattttaggctctgaatttttttattttcttattatggtaaatcgtctttttttgttaactttgtctcacattcccttagatggcaaattagcatcttactttacctgaatcatttaacttgaactgaaatgttaacgttaatgtgttccaaactttcaatctcaaaaaccaatttagtaatcgttcaagcagaatttgtatcaaacttttcttgtgtatcaaacaaagaaaaaaaagaaaaaaaaagaaaactgacgttatttcttttttcgttttgaaaaagtaaacttacgatgacgtcatttcaggaggtttaagcttcaacttttccactaatttcgaatcattcgaaggtttaaccgtttaaatacatctttttctcacactaatttctaagttactactacaatattattctctacgaccccaccactaaccactattatccgaacttccgaaggaaaagttcgtcacgccgtctgactttagaaaagcacaaagagtaagatctcaactagtctctcatgcgtgcatagcaacaacgtaacaagaagtcagtaaaggcggactctatatgcgaacttagtacctgaatctgatccaaagacttatgcacggtttgatgtaaaatcagtagtctagtcgattatttttagtgagttttaattagtaatagctacataaatcctaagttcaagttacgactattggtttacgctttcgcatatattatattaaaactgatagaggaatatcaagatcgagaaaagtttgttagagaacaaaagcaacaaactcattctcattcattctcttaatcaaaatgattacatttccctctcttatatagtatgatagttaacgagacattaagccaatgttgaatacacggtttacataaaccgatcttaatcgattctatactctaatacattgcgttggtagctcacatgacataagattactttatattatttaaatcattctgaacattatcttaatgggctaagctttcccaatttgaccatgcccaactttttaagagaagatatgttttaaaattaaattgcgtatacagattcacttgacgtcactagccacgtatagtacgaacttatgaatgaagacataattgcaaccatatccaaactgattaactatactgtatccgtatgtataacacctacaacgcctgcttgtaaatcatacaggaatgaatttaagtattttttatatcttcgttaccaataccatatcaaatacattatgtggaaaaaattcaaggcacatgttcatccaccagcgaataaaaggaacaatatctttctttgtggatattcaaatgcaggataattcacattctttcatatttgcatttttaaatacatggaattaatctttgatgtcatttccttgtggaatcggaattggatgtttttgataagcatttcataatttcaaagattaattccagaagaaaacgaatttttaaaaaaaacatttatctaaattttcaataactaaaactccaattcctttgggataaaataaaattccaattccacaggaaatcaaaaacaaaatcgacaaaaagggtttggattgtaatgaatgttacaccgcaacagccacgatatgaacaaagtccgtaaaagggaacgtcagctttttcgaacgtgaaagttgtaagcgctccagagtgttttacatgcaaaaagggttttcgacagtactgaacatagccaattttaagaccacattcaatctccacttgtccaagtacaaacacacatgcatagacactaagacacacacttatttctatagattagaatgtaagcagtgatcccgaccacattcaaacacgaagatgaacagaagctaagatacggtctcatttgggggtaaaaagaaaaggaaaccaaacttgaattctcttccttatttaattatattactatacttctcttcattagggcaaatcattgtttaatgttaattaagttactttatgatagtaattacatactaatatgagtataagaacatacctttccacgtagaccaacaacgtcacgagactaagctctatatataggagaagagaaatgcttagtttgttacaactacaaatctcatctttgaaacagtttgaagaaaatacataacacttttaaattccaaaacacaaaaaaggaatatg

SEQ ID NO: 25756 - DNA, 3000 bp, Unknown; identical to SEQ ID NO: 11995
  misc_feature (1)..( 3000): 2750-1469P.txt file - cDNA_ID_2708128; gDNA_ID_2214527; Annot_ID_134173

SEQ ID NO: 25757 - DNA, 3003 bp, Unknown
  misc_feature (1)..( 3003): 2750-1469P.txt file - cDNA_ID_2708139; gDNA_ID_2214527; Annot_ID_134169
aaacaaatgataatttaatttaatagaatgataattgatttatatttgcttcaaagagaaaaaagtttaaaactgaattatatccttcttgtcaatgtcacagatagtttaatactttatatagataacgtcgaagacgaggttacaaaaaaaaaagaaaaaagaattctggttagagttgagaaaaaatagtaagttatgtagcattccacttctataaattccaatgaatactgtctaaaagttttgctaagaactgtatagccatgatgagaatgaccggtttcatagtagctatgatgatagcagcggcgatattcactacttgcgttgatggaaacaagttcttttatcaccgggaaattaaagtacttcgacatttgaaacggttcaacaagcctgctcttaaatccattaaggtacatatcttatataaatttcatgacaaaaattaaagaaacctttttagagatgaattctaatacgctttcattaatctttcttgcagagtgaagatggagatgtaatagattgtgttcctatcactaatcaaccagcttttgatcatcatttacttaaaaaccataccatccaggtttggtttcacttccaagtctatctattgttttaaaacattatgatttttgaatcaattgtgacgtaaagtttacacatgcagatgagaccgagtttctacccggtaagtgattctacgtacaccaagagggaggcaaaggctgtaactcaggtttggcacaaggctggagagtgtcccaaaaacactgttccaatcagaagaacaaagaaagaagatctcttgagaccaaaatccatcaggagttttgggagaaagtctcatcaaagcattccaagaactacaacctttgatccaacattaggtcatcaggtacaagtcaactacatgcacacacacacacaaacacatgtgtatcattgttaatgtcttgtggcttacgcttttcatttcttttggagtgcctttagtacgcgctaatgggtgtgagaaatggaaaattttatgggacagaagttgcaataaatctgtggaaaccatatgtccaaattcctaaagagtttagcttggctcagacttgggttgtgtccggaaatggctctagtctaaacaccattgaagctggttggcaggtttggttccttcttgactacatcctctttgcttttatgcaaaacacttaacttgctctaatattttttgtcttaatttataggtttatccagaactatatgatgataataatcctagattctttgtttattggacggtatgttctccttttcagcagatttaggcgtacttatctcttctactatacactaatcatttgaaaaacataaagattgactagttttctgatccggaatagaactatagaagtctataattcaagttaagtctctagatttatgtatttaaggatttaattaaccattatgaaatcgttttttttttttgggaaatagcgtgatgggtaccgaaaaacgggatgctacaaccttctctgctcaggttttgttcaaacgagtaatcgatacaccgtaggtggatcaatcaccaccatgtcacgctaccgtggaactcaatatgatctctccgtacttatatggaaggtaataacgtaattatatttcacctcaacaacatcagattcaaatattcaacgtaacttcagtggcaagttacataccttttcgctcaagttacctctccatctatcttgaaatggatatcaggaccaaaaaacaggaaactggtggcttagagtcaatgaaaaagacgttattgggtactggccaggctcgttgttcaattctctaggaagagaagctacgagagttgaatggggaggtgaaatcattaactcaaagaccggtgggagacacactaccacagatatgggaagtgggcattttgcagatgaaggttttaagaaagcaagctatttcaggaatcttaagatagttgatggaaccaatactcttagagaaccacaaggactttacttctttgctgataaacataactgttacaatgttaagacaggaaatggtggaacttcttggggggctcatttcttctatggtggtcctggtcgaaacgttaaatgtccttgattaggatctgtgtgttcaaaagcttttataatctcacatacacatgtctatatttgaataagaacatttgcgaaaaccacgtcatcagagatgtttatatctgtcatttttcttaatttattaatgaacagtctgttgacagtgaaattgaaatatcgagaataataaatacgtacatattgataggtaactaaaatacagctggtttaaatcaaattgcaaaaatataaaacattgcacgtttaacaaatgtaaattaaaccgtgttcgttattcgttattctttgaccagttgaggaatcgtttggacggtagaatccgtcactatgcctctggaatatatataacgcatgaatccgttaaaacaaaactagaatgataaagaattatgtattgttttcaggtaaggcaaattatatagatgtgaatatgtgatatatataattgcagagctttaatgtgtattatatatacacaatgttttgccatgatgttatattattcataccaaacaatccacaagggaagtaacatgcgaaatggttagacgtgcaaaacattgcaaaaaatctataacaaattaactatgttgatcgaatcaaaggccacacaacataacagtgatttgcgatgacttttcgtttcacaataaataccaaacatgtgctgagtttctctttagataagaccaaatccttgaaattttgtgtatgtggttggttgatctaactcgaccaactatattgattctgtccccatttccctttaattctgtctttaccacaccacaacactaatcataaaacgtcactgtttgtctttgattttgaattcgtcaatatcaaaatg

SEQ ID NO: 25758 - DNA, 3003 bp, Unknown; identical to SEQ ID NO: 25757
  misc_feature (1)..( 3003): 2750-1469P.txt file - cDNA_ID_2708139; gDNA_ID_2214527; Annot_ID_184779

SEQ ID NO: 25759 - DNA, 3000 bp, Unknown
  misc_feature (1)..( 3000): 2750-1469P.txt file - cDNA_ID_2708146; gDNA_ID_2214528; Annot_ID_134236
cttttaagtcttgtatcactgtaatgtctgttttcaataataagattatggttaggtaaatttggttaggtcctttgttctttctggttgtgaatctaaaaccttggtacatagcttataaagatcaaaccattcagtaactgtgatagttatgttgatgaggatggtatgatatgtctcatctatacaacattgaaagctgtttaaagaggaatttgaagaagcttcaagagaattttgttgtctatggtttcagcttggatttaatgtgtatgttggattatcaaaaattcaaaattataatgtcaacaagagtctacaactactgtaacaattctcttctcttacattggaaactaattttaaatagcagaagcaaaaagtcaaaatgtagatatggccggaaattcgcactacattttaactgacaacggttcctattgagacgaaccagtagtaacagcagcatcagcagattgctgagaggatcctgaaggtgctgcagacacagagtcaggtggtggagcagagactgaacttggatgtggaggattaggccttgaaccgggacctggttgttgtgggtaatcatgatcagcttgttgtgaatggccatggtggtaaggaggatactgctggtaaggtggttgcatatatcctccatatgatggtggcgggtatggctggtgctgaggatagtggccatgtggtggcatagtgtaagaagaagaagaagctcctctgttgtcactggtgcttgaaccgctttctttggacgaactaactgcacccattctctgagggtccattgatgggtaaaatggtctgtcttgatgaggaggttgtggtggtggtgggtgcatatagtattgtagcattggtggaggttgattctgttgctgagatataactgctcgaggtagtaaaccactatgagccacactgccctgttggttagaaccatcttgatcaggtttgggaacctgaggtcttccccatgtgagttttagcctctgaccgttgacaactagcctgttactgagctcttctgcagctttctctgctccttctcgggttgtgtaagtgacaaacgcacatgctttctcagccaagattctgatggattcgatttctccatgggcgtagaattgatcacgaatgtcttgctcaaggactctcgagtttagcccaccaacataaagcgttctgatgctttgatcctctggagattccaaagtacccatctccccagccttgccaagtaacttcaacgcaactggatcgtttacactgcaggaagtgaagaataagatgagaaaacagttccaatatcaccaaaataacagccagtttacgcacacaaactgatgtatttttcataactctctttcatgatataccaaagcaagaaattgaggagtaactcaatattatcatactcaaacaaaatgaaagttagaagtatgcttacccataataacggtctttaatgttctgctgggataactctcctgtttcaggcatctcatgacggtatggacactcatcacctcttgtacactctcccctaatgaagaaactacaaatatgagctcggttccttttgtagtaaggcgttgtcctttgaagcatacgaatggtatcgttgggccgaatcttcccaaaagaagactcataatctagtccagctctcgtctacacaagaaaacaaaaccatttcaataggccattacaaagtagagaaactgtatagccaaatctcaaaccaatcaatactcaaataatataactagttagaacgcagagtcaccatacctttcgatcatgctcttcagcgaaaaactctcggttcacatcactttttgggatagaatcatgagtactaatgttgagcgccgtgtctctgacctgaactggaagaccatactcaagatccaagagacaaacttggcacacattcttcaacttgcaacatgtctgacaaacttcagtcttcttgtatctcgcatccctaccaggtcgccatctgaaaaccgtgaaaggccgggtacagatcttacactctttatcgtaattcgcctttgtctacataccaaacaacaacaataaatcaatcaatcaatcaaacatgaagctgcacatcactaccagacataacatgagacagtattcaatgaattacattccctctaagcaaatttgatcagaacaaaccaaagatatcattttgaactacaactccatgaattctgatttttaccaaaggttatgaattgtatattaaatcgcttaaaccctaaaatctcaaatcactaaaattgcagcttcaacactaagaaacataaaagcattaaacaagctcgaaaatggacaaatgaaaggagatcttaataaagacacatgaatgttaaaaaaaaatctagctaaaggcaaggaaatcgaatttgtttgaggagaaacataggaagcgaagaatataccattctcacgtaaggattgtcaccgagacaagactcacagatgattgggaaatcagaacgttcccatccatcagcctcgtgatctctcagtattctatgcgccatttcctaattctcttccttcctcaatgatttctggatttcttcttcagtctcgaacacgaagattaccttgaagagcagatttgctctcgtttcgattttttcgggaatctttaatattacagctgctgttgggccgaatgtttgtttggcccaatttaaacccatgaaataagaaagcttaaagtgatggtggtgtactgaaataaacaatacggactcacacagatgataattcatcgtcacacacaggcgggaacaaaaataccctaaaatcgctaaatggcgccacaaaatctcagcttataatatcacttcccgctaacaattgcaatctcctcccagaaatttcaacagctctaaaaaccctaaccgtttcgattcacactctaacctttcgataatttcccagaagatg

SEQ ID NO: 25760 - DNA, 3000 bp, Unknown; identical to SEQ ID NO: 25759
  misc_feature (1)..( 3000): 2750-1469P.txt file - cDNA_ID_2708146; gDNA_ID_2214528; Annot_ID_184853

SEQ ID NO: 25761 - DNA, 3003 bp, Unknown
  misc_feature (1)..( 3003): 2750-1469P.txt file - cDNA_ID_2708150; gDNA_ID_2214528; Annot_ID_134212
gtttcttcaagacgtcagtaaaaaggagggattgtttagtagaactccacttggtcggtctggagagccgaatgaagtagcatcactagtggtcttcttgtgtcttcctgcagcttcttatatcacaggtcaaaccatttgtattgatggaggcctcacggtttacggtttctcctctcaaccacaggcttgaaaatggtcttgtcgtttcttgtctgtttaaatattctctccctaataaaatctctcatcacgctatgagtttatgtcccttgtacaaaaacacacaatgtcaaattgttgctctttagtcttgtaagagaaatgagggacttatctatatgaaggatcaattaaactagtactattttatttgtttggttaaactatccttctctaattattgcaacttatgtgtctatatatggattaatgtcataagtactagatggaatcaaagataacactaaatagcgttagtcatagaatcatactcacaagaatgagtcctctaagttcaatggaccactccgaagtccatcatgagaacaagaccaatcaataaaaatgtccttttgttatctaaattagcaagtgtaccaaattttgttcaccattctaacttataatttcagttttcttttgtgagtgaagttattgaaaaagaaaaataagaaagtattggtcaaagattttgacaacaacaagttattttcttgaggaaccaccaacttagatattttagtcatgttctctgttataagtcctactgctactacataatgtttccaccacacataaaaaacaaactcaataattcacacttatctgatccacattcattgtatataatcttatggcatttctggtcatttagtctcaagcaaaatggataagagatggagtctacaaggtatgactgctcttgtaaccggtgcagccagtggaatcgggttcgtcttaattctctgttctctatatcatgtttttggctcattgttcttcttgtatttctaaattgtcaagacttaaaggaatttttgtgtagtgtaggtatgccatagtagaggagttagcaagttttggagctataatccatatatgtgacatctctgaaactcttctcagtcaaagtttaagtgaatgggaaaagaaagggtttcaagtgagtggttcaatctgtgatgtagcttctcggcccgatagagaaaaactgatgcaaaccgtctcctcgctgtttgatggcaaactcaacattcttgtaagtaaatgatcttataggaaaaggcgaaaagccaagcatagttgtttaaagagagcttcttaacataaatcttatggaaatgcctaatcatatgtaggtaaacaatgttggtgtaatacgtggaaagccaacaacagaatatgtggcagaggatttctcttaccacatctcaacaaatttggaaccagctttccattttagccagctttcacatcttcttttaaaggcttcaggatttggaagcatcgtctttatgtcctctgctacaggggttgtatcagttcaatgtggatccatttatagtctaactaaaggtaaccaaagttgctactagaggtagttcattgcaagactgactaatcaaatatgttttttttttaaattgcttttttctgttgatttattttacaggagctttgaaccagttaactagaaatttagcatgtgaatgggcaaaagacggcataagagccaatgctgttgcacctaatgttgtcaagactcctttgtctcaatctgtaatataaaaaaagtcaacatttacattttagtttttattttttatgtgaatgtaacaatctcaattatattcctctaattaattctcaattgtgtgttcttgaagtatctcgaggacgtcggtttcaaggaggcattgttcagtagaactccacttggtcgcgctggagagccgaatgaagttgcatcactagtggtcttcttgtgtctaccagcagcttcttatattactggtcaaaccatttgtattgatggtggtttcactgttaatgccttctcttataagccacaggcttgataatggccttgttgtgttttgtctaaatgtcttatgcaaaactatgctcaatcaacttttgtgggattggattttaattgtggttcggtatgtggttcatatctttgtcacgagagagaaacacatgcaaatcgcctaaattatatgtgtggcaagctcaacattcttttatgtaaatcataatttaaagaaactaagcatacaatgggttaagctggctttaagtatttgaacaagaagatgtttctgataacaaagagtaagccaaaagcagatcacaacatgctttaaaatccctatgaaataattggagaaatgtcacaaaccatctttatatatataattcaaaggtgaacgcaaaagcttgatagttctttcctttattgtctgtttcactaaagatatcattacaaattaagtcaagatccatcatctcttacatcactatttgtcacacgaaaagtatgagagaaacattttcctatttgcttgccattataataagcttcatatagggaaggaagcaaggaaaaaatgagataaagagaaaagaatgagtattgggggaagtagtatagtagtagagagtcgtagaagagttatcttctaaggtcattagtgatgaagagttcatagttagtttactttgttcaaggtggataagcaatagggtttaggcctttgttattatcagacttctacttttggaagacactaaaaagttgttatctagccataagaaagttttggccaaaggttttgactacaaaatgtcatttttgccggggccactaacttagatatttttgtaatgttctctcttacggctacataatatttccaccacacatacaaaaacatactccacacttatctgatccatattcattgtatatatagtttgtggcatttctggtatatg

SEQ ID NO: 25762 - DNA, 3000 bp, Unknown; identical to SEQ ID NO: 12013
  misc_feature (1)..( 3000): 2750-1469P.txt file - cDNA_ID_2708154; gDNA_ID_2214528; Annot_ID_134198

SEQ ID NO: 25763 - DNA, 3000 bp, Unknown; identical to SEQ ID NO: 12013
  misc_feature (1)..( 3000): 2750-1469P.txt file - cDNA_ID_2708154; gDNA_ID_2214528; Annot_ID_184817

SEQ ID NO: 25764 - DNA, 3003 bp, Unknown
  misc_feature (1)..( 3003): 2750-1469P.txt file - cDNA_ID_2708166; gDNA_ID_2214528; Annot_ID_134213
ttcaaaggtgaacgcaaaagcttgatagttctttcctttattgtctgtttcactaaagatatcattacaaattaagtcaagatccatcatctcttacatcactatttgtcacacgaaaagtatgagagaaacattttcctatttgcttgccattataataagcttcatatagggaaggaagcaaggaaaaaatgagataaagagaaaagaatgagtattgggggaagtagtatagtagtagagagtcgtagaagagttatcttctaaggtcattagtgatgaagagttcatagttagtttactttgttcaaggtggataagcaatagggtttaggcctttgttattatcagacttctacttttggaagacactaaaaagttgttatctagccataagaaagttttggccaaaggttttgactacaaaatgtcatttttgccggggccactaacttagatatttttgtaatgttctctcttacggctacataatatttccaccacacatacaaaaacatactccacacttatctgatccatattcattgtatatatagtttgtggcatttctggtatatggtcactagaaaaatggacaaaagattatggagtcttcaaggtatgactgctcttgtgaccggtgcagccagcggaatcgggttcgtagttcttctctattctcttaagtttatgttctgcttcgatataacaacctgaatggtcaagattacatggaattcatatttgtggaatgttttagttatgccatagtagaagagttagctggttttggagctaaaatccacatatgtgacatatccaaaactttgctcaatcaaagtttaagcgaatgggaaaataaagggtttcaagtgagtggttcagtatgtgatgtaacctctcatcctgagagagaaaaactgatgcaaaccgtctcctcgattttcgatggcaaactcaacattcttgtaagtgaatgatctttatatagaaacaactaagcaaactctacaaaacaaaaagataacttaagagagaatttttgttcaacataggtaaataacgtgggggtacttcgcggaaagccaacaacagaatatgtggcagacgatttcacttttcatatatcaactaacttggaagctgcttaccatttttgtcaactttcacatcctctcttaaaggcttcaggctatggaagcattgtattcctttcctctgttgctggggttgtatcactaattgactgtggatccatttatggtctaacaaaaggtaaattactccaaatctgactaatcaacaaagagttttttaccaaaaaaaacaaaacaaagagttttctgcttccttattttgtagtgttttgttgacttcttttataggagctctaaatcaattagctagaaacttggcatgtgaatgggcaaaagacggcataagagccaatgctgttgcacctaatgttgtcaagactgctcagtctcaatcggtaaaataaaaataacttttacatctttttatttttgtggatttaacgacatcaatttctctaattatctctcaatttttgtgttaaaagtttcttgaagacgtcagtaaaaaggagggattgttgagtagaactccacttggccgtgttggagagccgaatgaagtttcatcactagtggtcttcttgtgtctacctgcagcttcttatatcacaggtcaaaccatttgtgttgatggaggtctcacggttaacggtttctcctatcaaccacatgcttgagaaatagtcttgtcgctctcaaagttctatatctaataaaagttctcattctatgagtttataaacgtaaacatcaatgagtttgcaattccatattggagatactaatctcgcacatatacaagattcggttacacccgctacgccaacaactcacaccaatgtgatctctcattctctctcataaatgaaatgttatactattttttgagaattgtagcattgataggatagattacagtctatatgtctctgattttaaatgttaattgtaacacaagatgattatattgtacatatttttgttgttgttgttccgtctattttgctgattatacttgtttattgttgttcttccgtgtctgtcgtgttttatctgtttgtcttaaactttgtattttatatcttgtgatttttgatactacacgacaaaaatgaccttgtcgtgttttatcttgtgaattattttattctttcgctattagattaatccattttgtgaataatttgcgagcaaggccctcacacacataattataccttttgagtcttgaatcaaaaggctgtcaaaaaaaaaaaaaaaaaaaaaaaatcttgaatcaagttgatagatacatatgggcttgcgtgatcttgagtcttgaattcataataggcgaatttgaatcttgaacgactaatcgataacaaacaaacaaaaaaatattatataattggttagagtagttaactctatcacgcttaatgagcattttatatttgtctttgaatgacaattcaagtaaatactttaatttcaaaattgatggatcgttttttcattgtacttttcttcgaataatattagagataatcttccacacttaaaatagattaatctcattgtctctcatcctacataagcttcttactttaatttgtctacatccctcttgtctcaattaagtattattattaacgcttcaaattcttactacctaaacacgtgaacagtagtctttcagtagtcttttaatttgcgagtgaagttaatgaaaaaaatacaaaatggtaagttttggtcaagattttgactattaaaattaatatttgctcttgaccactaagtatatttttgtcatctctttattatggctaaaaattgacacttatctaatactcattcattggatatatatatataatgtgtagcatttctggtcagtgaaaattgacatacaaggactatg

SEQ ID NO: 25765 - DNA, 3003 bp, Unknown
  misc_feature (1)..( 3003): 2750-1469P.txt file - cDNA_ID_2708169; gDNA_ID_2214528; Annot_ID_134214
ttatatttgtctttgaatgacaattcaagtaaatactttaatttcaaaattgatggatcgttttttcattgtacttttcttcgaataatattagagataatcttccacacttaaaatagattaatctcattgtctctcatcctacataagcttcttactttaatttgtctacatccctcttgtctcaattaagtattattattaacgcttcaaattcttactacctaaacacgtgaacagtagtctttcagtagtcttttaatttgcgagtgaagttaatgaaaaaaatacaaaatggtaagttttggtcaagattttgactattaaaattaatatttgctcttgaccactaagtatatttttgtcatctctttattatggctaaaaattgacacttatctaatactcattcattggatatatatatataatgtgtagcatttctggtcagtgaaaattgacatacaaggactatggataaaaggtggagtctccaaggtttgactgctcttgtgaccggtggagccagcggaatcgggttcgtctagattctcactatatcaactcttttacccattgttctgtttctaaaattcattctaaattgttaaagttttaaggagttttattatgtttatcgaatgtttagtcatgctatagtagaagaactcgccggttttggggccaaaatccatgtgtgtgacatatcgaaaactctgctcaatcaaagtttatccgaatgggagaagaaagggtttcaagtgagtggttcagtctgcgatgcatccaatcgtctcgaaagagaaacacttatgcaaactgtcaccacaatatttgatggcaagcttaacattcttgtaagttaatcttaatttaaagaaactaagcatatctttaagctatttagaaatgacatgaatatatactcttttctgttcaatataggtgaacaatgttggcacaattcgcacaaagccaacaatagaatatgaggcagaagatttttcgttccttatttcaacaaacttggaatctgcttatcatctaagccaactttcacatccactcctaaaggcttcaggcaacggaattattacttttatttcctctgctgcagggatcgtatcatttgatgctgcatccatttatggtctaacgaaaggtaaccatagtgaaaagtttaatactagaggaagttcattgcaagaatgaccaaatagtattgtggatttatatatgtttcattatgtatattatatatttgattaggataattttcaatcccatttaataatttcaaatgatatttgagaagaattgttttttttttttttttgtgcgtgaaatcttattttagtgtgctatgctaacatttttggtttcagaaatatataattcagaaggtcaaatatagggcattcatattcaataacatacaaaaacaaaactaatttataactatgcatgttatttatggataataaatctttttatttttatttagatggttcataaatatcgcattatgtctccgaaagctgattctaacggctaattgattgccctagtatcattcgtttctatttctaaattggtctatctttctttgggaatcctaatagatgtctctcatagtcatagtattattttttcttgtttgtgtatatgttcaggagctttgaatcagctagcacgaaatttggcgtgtgaatgggcaaaagacggcattcgagccaacgcggttgcgcctaattttatcaccactgctctggctaaacctgtaaccaatacaccctctcttttttttcttttttttccttttaaaattaacatcatcacccactcttattcttgttttttacaatcttgtaaacattcagtttctcgaagacgctggttttaacgagattttgtcgagtagaactccacttggtcgcgctggagaaccaagagaggttgcctcacttgtggcttttctgtgtctacctgctgcttcatatattactggtcagaccatttgtgttgatggaggtctcactgttaatggcttctcatatcagccataggcttgagccatgtcttgtcttgtcttgtgtgttgtggagtatggtcatatggtcagtatctccataatctaaatccatagatatgtgagttgtggagtagacacaatttttcaataatggaatatctatttaccagttccgtattatgcatgcattctccatgacaacgcttctcataacgaatataattacgtggatcataatactatgaggattgatatcattgagatggagtagacacagttattttcttcttcccttgccattagcaatttcaattgtatctatgcttgaaatacttaaatggcatttacttcttaactaaaaagcgaaaggagggaaagaacaagtcattacaagatactataataattagaaattaaaagagtataattacatcttcccaaatgtgtcaaatattcagcaaaaactctgtcaatagaaatgaacaaacggtattttaaagtaatacaatgggtaaactttagatattttgtaaaaacctaattagaaaaaaaatttggaaatcttagttgaagataactacccaaattatgaaaaaaaaaacatttgccttcttgttacctaactaacacgttgaatgttttacaaaaattttgttcaccagtctaactgacttgtcgtttcagttgtcatcttttgaatgaaattaatggaaaagaaagaaacaaaaatgagtaagtttagatcaagattttgactattaaaagtcatatttgctcttgaccactgacttgtatattttgtcatgttatttattatggctaatatatccaccacacatacaaacatactcattaattgacccttatcttttatttttatggtaagaaaattgacacttatctaatactcactaggtgtgtatatataatgtagcatttctggtcattgaaagtaacttacaagcaaaatg

SEQ ID NO: 25766 - DNA, 3000 bp, Unknown; identical to SEQ ID NO: 12036
  misc_feature (1)..( 3000): 2750-1469P.txt file - cDNA_ID_2708189; gDNA_ID_2214528; Annot_ID_134229

SEQ ID NO: 25767 - DNA, 3000 bp, Unknown; identical to SEQ ID NO: 12036
  misc_feature (1)..( 3000): 2750-1469P.txt file - cDNA_ID_2708189; gDNA_ID_2214528; Annot_ID_184845

SEQ ID NO: 25768 - DNA, 3000 bp, Unknown; identical to SEQ ID NO: 12015
  misc_feature (1)..( 3000): 2750-1469P.txt file - cDNA_ID_2708197; gDNA_ID_2214528; Annot_ID_134201

SEQ ID NO: 25769 - DNA, 3000 bp, Unknown; identical to SEQ ID NO: 12016
  misc_feature (1)..( 3000): 2750-1469P.txt file - cDNA_ID_2708201; gDNA_ID_2214528; Annot_ID_134202

SEQ ID NO: 25770 - DNA, 3003 bp, Unknown
  misc_feature (1)..( 3003): 2750-1469P.txt file - cDNA_ID_2708205; gDNA_ID_2214528; Annot_ID_134203
tgacccaaacccaactggatccgacccgaaccagaaccaaatatttagaattattctattggatagtaaatcatatacccattaatcccaaacccgaacgggttctaccagaactcgaatgggttactcgtatgcccaaccctattctctgatttaattatctaaaaactcccaaaaaaaacatatgttttgctgactactttttattcaaaaaaatgtacatcctcttctaccaaaatcatttcataagacatcccaaaacccttggaataatgattttatgaatgaagaatcctaatttgtatataccaagaggttttaaaaagttttaagtttttatttctaatggcatacctatgtaattacttacaaaaaataaggttacatttaaaatgcttatttataatttttgataagtgtgtatgtgagaaggtacggacatcgtgatggtaatctgcttatttataattttaacttgcagtataccacatgtaggcttatattttatttaaactaaaaatttttattgtaaagatgattataaatatatgatattattttatttgattttaaatgtatagtaaactgcgagttgtatatgttttgttgatattatttatattgtttagtgtttaaaattatacacttgtattttgattgttaattttagagtttcacatgtagtataccatcttgtattaatatcgatttaaacccgtcaattctaggattttctatcttgtattaaaaattgaatcacatcatacacataaaaaaatctaatatgttattaattattgtagtatataagattataaatttttaaaataatatgtatgaaattgaatataaatattcaaattatgacccagtattcagtagaaaattttcttaaatctatttttgacccgttataatattttttcatgtattgaacagtttatattagtttttaaaaattcaaattatggcatatgcgaaaaaactctaattatttttttataacgatgatattattttttcgccaaaatagaatcatataaagatgagaggtgaactataataattaataaaaaattaatatgataatttagatatcaaatctaatttgttgattttaattggttacttttttggaaattaataatgtattttgttttttaattaaatttaattaattaaattagtatttgacttaattattaaagagatgaattaatgtactctttaaattttatttctaatggcatacttatgtaattacttacaaaaaataaggttatatttaaaatgtacttcctaaataatatagtaggatttcttaattaggaaaatgacaaaaaaatattatatttacctcttaacttttgagattttatttaaatttatgaaagttttgcttttttttcagcggagatgttaggcgaaacttacattattttcttgtcagcaaagatttggtgaattcgttaattcgatgatgataacgttagtgacggttgcaaaaatgtttctgtttttacggttttttgattcatgtagaggcaaagtttgtttgtaattggaaagaaaaaataaattaaataacgaatcttaaaaagtcttccaagttgatttttttctttactgacataaattttgctttatatatcatacaaatacgtcaaagtccataatttcgatgatggtgatgacaaaagaaaatatgttattatcttttgcatgacatgccctcatatatgaaactgaaacacagagttatgagctcatctatatatacatttttgctgctactttgtgaaataaatactggagttgggatttatttacaacggctgccactggcatttaataattgtttttgataattagaaagaaaatcttctaattaaatatttgacatttaacaatcttcccaaaatctctcaaccttaactacacgattaattactaaaataaaacttctaaaatatttaatatcatttaattactacaaaattatcatttttgatattgcttttctgcatgattataatcatcaaaccgtagagatatttgatagcatttaattactacaaaattacaaaatatttagacaataattcataaacatatcataaataaaatcaacattaataaaataaatgagttttttttagaggacgggttggcgggacgagtttggcaggacgttatttaataacaattgtaaactatacaataaaaatattttatagatagataaaatttacaaacttttatatatattaattaaaaaaataaattgtttccgcggtgtactgcgggttaaaatctagtctaatacaatattagagataactatagtcattgctctcatttttccatttgcatacttatatgttctcaattctcatacctaccttatattgtgtgcccatacaccttccatgcgcacttgttgtccacacaaattacgatcaaacaactgttatatagtttccacccacactttcacctatggtttaagaaacataagttactctaatgtagtaggacgagttgaccaaacctaactccttcattttgttgcaccaacccatatttttaccgagtaatgcacaccccaaaacttataatcatagtcatcttcctttcacgtcccataaggttcacattgattactctaatctatttcactttcaagattaccaccacatgtaacttttccattccttttccacatttatctcttaaacctcaaacactttcaagtttcatcttctctctctcttattaacttcatctaccaaccctacttaacctaaaaccattttcaattgcttaatcagtccacacaatgcacataaatttccgtgaccacactgttcgttttagaagaaaaaaaccacttccaaaattgcatatgtaccaataagataaaatgttttactcattcaaatagacctacgagattaattaagactaggtttgctttgggctaaaactggcccataagctatg

SEQ ID NO: 25771 - DNA, 3003 bp, Unknown
  misc_feature (1)..( 3003): 2750-1469P.txt file - cDNA_ID_2708217; gDNA_ID_2214528; Annot_ID_134209
tggcctttgtgttttaggagcaattaatcaacttacgagaagtctggcttgcgagtgggccaaagacaatataaggatcaatgctgttgccccgtggtatatcaaaacatctatggtggagcaagtatgggtttaaaagccttattatctattatgcggttaaatataagctcttgaggctgaaaatcaaaatgagaaagactaagctaatttgtgtgttccttgtttaagatggggttgtttaatggttctcgtcttttggtctcaggtccttagcaacaaagagtacctagaagaagtctactcagtaactcctcttggtcgacttggcgaaccgagagaggtgtcttctgcagtggcttttttatgcctacctgcatcatcatatattacagggcagattctttgtgttgatggtggaatgtcaataaacggtttcttcccacgacatgattaggccactctattgttttactagtttccttgggatcctttttgttttatctttagcatgtctcctttctcccgtgaaagacagttcatcgatatgagatgagaattgaagttgtgctactaagtctactgttaatgaaaaggataatttagcatcagacagcgtgattcagtttcccttgtcttttactgattatcttgattgtgcatgtgggggaaaattgctgaggaaccttttcatgttatgacttttatgaaaacaaaaactttatgtttcttgagttagtattcattagcttgtattctgtgtcatcctttctcggttttggctttcattgtgtcttgaacctgcactcatatccaacaaacaatggttgaggaagagagaagctgcatagaataaacgaggaacctttaatgaattaccgccacctgtgtctcgggtcactcttcttctgcccttgtatttacagcacattaagctctgcttttggttaatatcgctttgtctctgtgtttaataatgtttttggttcgatgtatatatacaggtaagcaatgcaggaaagtgtatagccaaaccgaccacaaaatatgcagtagaagatttctcgttgctgatggctacaaatctggagtcagctttccatctctcacagctcgccaatcctttgttgaaagcttcaggttcagggagcattgtccttacgtcctctgttgatggggttgtccatctgagagtcggatccatctatggagcaaccgaagctaccgtatatatgtctacatccttaaaacaatgttcccttgcgttatgatgctttcgtaacatatagatgcgtttcaggagccatgaatcaactggctagaaacttagcttgcaaatgggcgagtgacaacataagggcgctctgtttgtccttggttcattaaaactcctttaactaataatgtacggcgaaaagtaaaaagtctccttattattatgaaaatatatctatatcataacttcccaattttgatttgtatgaaatgtttcagtttctcaatgataaagatgcaaaagaaaaggtggagagtaggccaccgatgggtcgtgttggaggtgccattgtcaacgttttttccttcaagactctgccttaaaatacatatatgcatgtgtttggattatattttcctgcgtaataattaagaaatgtactttagataagttcctatctaaagtcgcttgtgatgccaaagggattgggtcccccttcttcttcttgttattctctatgttttgtttcctgaaatatttatgcttgtggtgaacgagagttcaatatctgaattcattatctactttggccaacgcctaatggtatcatttggtgtctcaacatgtgatggagtgtctaatttggtttgaaatcccaaaattcaatatccatgggtattctctagtaatttataaaagaactttggtccaaatcctacaagtggtcatatactgacataccacatagtggaagaactagctagctgggtttgaaataaactcaagataagacaagtggtcagaattgatgttgagagatttttttcctcagcatgggtgtcaaatgagggtccatcaaagtatgcagatgtcactaagggtttccatttagagtaatgagacatgaaatagtgggttttgggttttgagtatttgggttttgagtaagtattccaatataatatatgttcggataattttgatagctaaaatcattgtccacggtcccaaacgcccactagtttaggtaagatggacagccctagatgtaactatcaggagttgcccaatgtctatcatgtaattgtatcttttcttatttacaaagttgttagtaatctatctttatatacaatttaaagaagctcttgttagttatgtgatagataaagatggataacagccgatggagtcttcaaggtatgactgctcttctgaccggtggagcgggaggaattgggtttgtcttcttaccccatttttctacttctatttgatatccaaaatggtcaagaattcaaggagtttatgtttgtggaatgttttaggcatgccatagtagaggagctagctggttttgggccaaagtccatgtatccgacatatctgaaacactgctcaatcaaagtttaagcgaatgggaaaagaaaggatttcaagtgagtggtacaatctgtgatgtatcctctcgtccggagagagaaacactctgcaaactgtctcctcgttgtttgagggcaagctcaacattcttgtaagacgtttgtgagtgaagttaatggaaatgacaatgagcaagttttgctcaaatattttgactataaaatgtcaattttggttaggaccactatcttagatttttttcatcttcactcgtaaggctacgtattatttccaccacacatacaaagataatcactagattcatacttatccgttccacattcattgtatatacaaaatctgtggcatttctggtcacttcaagtaagatacaagaaaaaatg

SEQ ID NO: 25772 - DNA, 3000 bp, Unknown; identical to SEQ ID NO: 12035
  misc_feature (1)..( 3000): 2750-1469P.txt file - cDNA_ID_2708221; gDNA_ID_2214528; Annot_ID_134228

SEQ ID NO: 25773 - DNA, 3000 bp, Unknown; identical to SEQ ID NO: 12035
  misc_feature (1)..( 3000): 2750-1469P.txt file - cDNA_ID_2708221; gDNA_ID_2214528; Annot_ID_184844

SEQ ID NO: 25774 - DNA, 3003 bp, Unknown
  misc_feature (1)..( 3003): 2750-1469P.txt file - cDNA_ID_2708225; gDNA_ID_2214528; Annot_ID_134231
tcttgttgggcaaatcttcttccaagtattcgtatggcacgcctttgagtttgagagccatctcgactcgacgactaaaagggcttgcccaaaaccctagaagcttcacactctcttctttctccgccattcgatatctctcactttttggtatctaactcctctgtttcttgcactacttttcttttttatgtttcgtttacttgcttgattacttgagtttactatattctatacacaaatgaagttatgggtggtgaaataaacaaataaataaaaggaccattttgctttctctttgtctttgtatccaaggatatcttgaagatcacaccagaaaaggactgatttatattttaaggtatgcacgtcattgccaacgtcattcgtcttagtgttttaagatatttgaccaacacttagtgtttctaatctccagtcaattagccgaccaagaaataacaaatctccaaatgattacgttctacaatttatattttaagattcatatgttgaaaagtttaaaactgagagattaatgtatcgactgtatttgtaaaacacacaactttttttgttttgaagagtctattttttggccaattcattgtctgccaaacatttgaaatgaatgacattgtaaaacagaagaaatattcagttatcaaacaaaatgttaatcattttgaaagaaatgatgtaataatctaaatcaaaatataacatttatataatgtgaaccttttcagtttttgggtttgattccgtcttgattcacggtatcggttgatttggtttagttaaaccgaaatcgaactctaagcgaaatcatctcgtcggttaaacttcttttgaatttagacaaaggttaataattattatttattccatacttcattaggatcaaatgtatccgatacatcataattcatagctcaatcggagattattataatttagatagagtactcacacactcaagtaaaacatgaaccataaccatgacaaaaacacaagcaactccgatgataaaactcgaacccattactcaaccagagatctgaatagacttaacatcagccttcttagtctcagccttaggcaccgtaacagtcaacacaccattctccatcgcagccttaacctgatccatcttcacattctccggcaacctaaacctcctcgtaaactgtccactcgatctctccacacggtgccacgtgtcattcttatcttctttctccacgtgtctctctccactgatcttcaaaacactatcctcctcaatctcaactttaacttcctccttcttcaatccaggcaagtcagctttaaacacgtgggcctcaggcgtctctctccagtccacacgtgcgttcacgatcgctgagttctcacgagaaagtgatgatgatgttagttccttgaatggatcccatacgtcaagagagaatggatcaaagatgttgcttcgtctgttgttgttgaagaaacttggaatcatcgacattttaaagaatttacttttttttttgttgatatcttcttgagaactttgatttttcgatttctgatagaacacacgaaggatttttgaagctatttaaaggtactaaccgaaatttctcgagcttctcgagttgttatggggaatacagaaacatctagaggacgtctatgagaaaaatcaggtgaatccagaaaattctaggagcattttgaagattgtttgtgttcgttgggtttaatgggccttcatgggctttagacaaatatgtagtcttccaaaaaaaaaactggatttctacagattatccggttcgactggttaaccgaattaaattccaaaataattggactctaatcacactatccataaaatctaaaacattttctttgttaatctgaagcatttaaggctgtctgagtattatgggccatgggctttaaaagcaattgtataacgtgctgaattgaatagaatattactaaaaactgggcccatctaaaggaggattaaacaaatccaacggtgtatattggacattgagctccactaagtaagtagggtcacaatgacgtaacttcccgcgttcattacggaatcttgagcgtacgattctactattgggcccatctttataaaaattatactgttttttttactaaatccgtcggccacaaaaagatatgttttttttttttgggaaaaaaaaaaaacaacttcgacgaaagactcggcgaacaaaacacactcgcttcaacaactctctatctctctctacttgtcactctctaatctacacacaattaacaaagctcaatctctctcttctcttactctctacctctgtagctgatagggtcagcttcgtcggcgctatttctgccggatttcacggacgatttgagatctgttcttccttcttcttttttcctctcctgatctgattcaactctaatctgcttcagtctctgtgttacgaactgattccgttcaggtacggttcgatttttttccaagctttttcactctctgacactgccaataacactctcgtgttagtcctggtgttagtgttatgtgaattcatcgattcctgctttgtgtgtgtacgctttaggcctttcctgttactaatcttgttttttagtacttctttggtaaattaagaaagtttgagaagaatgtgattttgttttggttcttttgatactttagttttactttttttcctcagctttaatcttgtagagattcttctaatcagatcttacggattcttaaggatctataaggtctatgaagattcgttttgtaattctattacattgtgtgtggataagaaagatgtacttttttttttttttggtatttgttatgacttaccattttttttgtttctacagtgaaaaaaaatgttgagcgtttcaagcttctgcagtttaatgggagactgaggagtcatttgagtgaaacgtttggaactttggaaacagatg

SEQ ID NO: 25775 - DNA, 3003 bp, Unknown; identical to SEQ ID NO: 25774
  misc_feature (1)..( 3003): 2750-1469P.txt file - cDNA_ID_2708225; gDNA_ID_2214528; Annot_ID_184847

SEQ ID NO: 25776 - DNA, 3003 bp, Unknown
  misc_feature (1)..( 3003): 2750-1469P.txt file - cDNA_ID_2708229; gDNA_ID_2214528; Annot_ID_134237
catattgtatgtttactgcctaagaacgacaaagacataatgtgcatacggtgatacaggtgaatcagattggtacagtaacagaagccattgaagtagtgaaaatggcaagggatgcccagtggggtgtggtgacatctcatagatgtggagaaacagaggactctttcatctctgacttatctgtgggtctcgcaacaggtgtgattaaagctggtgctccttgcagaggagaacgtactatgaagtataaccaggtctggatctttttccaaactaatatcctcagtaccccttatgcaattacactagaacaatctacattacgtggagtaacctgcattggaattttggatcatagctctttcatcagattatcatcagcttctttttagcttttaagtagctgagttatgttgtggtatgtgaatctttagcaacctaggctaagtttcagtttcttcaacttttggctaatgcagcctcagcttatagatccataatgattgagtttggagcagccatgtacatttagttgctagatagtgttctcatttcattgtagaaactactttattaaaaagctgaatcactgttgaaatgttcctgcagttgctacggatagaggaagagcttggggatcaagcagtgtatgctggagaagattggaagctatctctctaaacaaaatgcacatgtgatattaattgttacacttctcgtcttacttcattgttctcgagtctatttctcacgcagacaaattcttgtgtcttgaaagttcaaattttttgttgtttttgccaaatttaagaacaaacagaagtaaagagtgttaaacatgttttttacaaattgtaaaagcatccaaaaacatcaatcaacactagttcgtgaggttgcagaagccacaaacaaacgtgttttagggcttcgtgtcttctttttcttcaatgtttaacaaacagatgaaaagtgttataaacaagcttttccaaatttcagaaagacaaacatcatacgattatctagtttagcattgccttaagatagtaaatccagaaaacaactgaatcaagacagacatttcaacaaaggactcgaacgaagactatcaaacattcatcattattctggtttggtgtcttcttcttcttcaatcttaggcgccagatagtatcgaatgtaacccatctcagccaccttgtactccaccacgaccggtaactcagaggacaaactgatggtcacagtttccgacaatggagtagcctttgtgaaggagttcatgtacctcaatgcaaatgaaagcgaaacaggctcgttcatctctatcacaatagcatcttcaggctgcaaaacacacatacaaacataaggtcacttcaacattgtattggacagattattaaacaaatctctctagatgactagtgattgttcatactttgtcgacggtagtattctgcctgagcacaatgtttgctgtcccgatatcacctgctgttgaaaacttcaccccttcttttgttaccgagatcacaactgcaaaatcataacatcaaaaccagaatcatgattagagaatcctcgcagtgatacaccaaataaacaaacagttcatttacctgtgtcaccaatgctactgagatctttgcatatcctggaaaattcaccagaaggcattctcacaatcgagtggtactcagcatcaggaattcctaaatgctcactgtcgatatccatcagcttcatctcaaaatctgcaatcttgtcttgtgctgcatcatcaacaccatttaaataatgagattaacaccacatagtcaatatcaaacaaagttcctctgttaactttcactaaatcaagaaactctattcactttcaaactatagtctttaagctagagactatacctattctgaaaacaaaaatggaaggactcattctcatcaagcaagttctagtttctgtcaaatgaaacctataaataacagttcagatcactaataacatcattaactacacaaaaacaaagccatatcaaaccttattccaaaccaaaaaccctctattaacatagattttatcttctctttcatctcttacaaactaaagctttcaagaaatggactgaatcattctctacaatcatattctagcttctggcaaatcaaacctataaacacagaatcaggtcaccaatagcatcaacattgacaacaaaaccaaagccctaacaaacaaaaatcgatttgaagaacttactgggactctcaaacatgaaagtaacagtgtcgctaccatcatcagctttgatggtgatgatatcatcatttccagcacatttcagcatcttagacatattaccaagattcattcccatagagaggttcctatcgcatctatagtgctcgaaaccttcagatctaagcaaaagagacaccaacgcgacatggctcgaatccatagcttgaagcgagaaccctgtggtcgaacagtcgaagttcgcatcgttcaccagatctttgaccgcttctagaaccttcttcagtagagaaccttgaactaaacgaagctccaacatcttctgggaaattatcgaaaggttagagtgtgaatcgaaacggttagggtttttagagctgttgaaatttctgggaggagattgcaattgttagcgggaagtgatattataagctgagattttgtggcgccatttagcgattttagggtatttttgttcccgcctgtgtgtgacgatgaattatcatctgtgtgagtccgtattgtttatttcagtacaccaccatcactttaagctttcttatttcatgggtttaaattgggccaaacaaacattcggcccaacagcagctgtaatattaaagattcccgaaaaaatcgaaacgagagcaaatctgctcttcaaggtaatcttcgtgttcgagactgaagaagaaatccagaaatcattgaggaaggaagagaattaggaaatg

SEQ ID NO: 25777 - DNA, 3003 bp, Unknown; identical to SEQ ID NO: 25776
  misc_feature (1)..( 3003): 2750-1469P.txt file - cDNA_ID_2708229; gDNA_ID_2214528; Annot_ID_184854

SEQ ID NO: 25778 - DNA, 533 bp, Unknown; identical to SEQ ID NO: 12065
  misc_feature (1)..( 533): 2750-1469P.txt file - cDNA_ID_2708241; gDNA_ID_2214529; Annot_ID_134246

SEQ ID NO: 25779 - DNA, 533 bp, Unknown; identical to SEQ ID NO: 12065
  misc_feature (1)..( 533): 2750-1469P.txt file - cDNA_ID_2708241; gDNA_ID_2214529; Annot_ID_184883

SEQ ID NO: 25780 - DNA, 3003 bp, Unknown
  misc_feature (1)..( 3003): 2750-1469P.txt file - cDNA_ID_2708245; gDNA_ID_2214529; Annot_ID_134244
aagtcaaaggtctgaaattagattaccaaatatccccattcccaattaagtaacaatcctccattattcttcaataaataagcgggaagcttgagtagattacaagaatgacccaactgataaaaaaaacggctcctttaaatgcaaaaaaactcctttcagtttcaaaggtatcgtctccctcaaaatcacaagctctacatacaattcctgctcacatcatcacatggcttcatcagattcgtcttactctcggaaattcttactcatcacctttcttcctctttccttggcctgcttggccttcctcctccaatggcgaagcggagtcaacgattccgttacgcagtggtttgatgataactatccgttcccaggaatggccactgtctccgagaaacgttctcttcgttctgattcgagctgcgtttctcttctgggtcagagccgtacgcaagcgtttccttatctccgagatttgaagcttgatcacaagcccgatcttaaacctagggttagaaatcttggttttcaatttgatgggttttgagaaatgttaagacttgattcatttgatgatgtaaaaatcgatttttttttgtagatatgtataacgacgagcacttctgctgggttagagcagacattgccatggatattctatcacaaggtcattggagttgaaactttttatctatttgttgaaggcactgctgcttccccaaacgtttctcgagttttggagacaatccctgtgagcttttacgagtcttgttttgttatagttgctctgttcatgaatcctgatgtttggctttatgttaccttctaattctcagtgatgatatttgtttgcagggtgtaaatgttatatacaggacaagagagttagaagaagaacaagctaaaaggtattcttgtgttttgtctgtcattaagttatggatttagagccatgtagattagaaaaatggaggatttgaaggaaccacctctggttatttagacatacctagatatattggtgtctcattggtgtgctcttgtgttatgcttctttgcatcttgttcttcaaaactgaaatggttctttgcatcttgttctttcaaaaaagatcatttcatttgaagttttattacattttctttggtttatagccggatatggaatgagacttggttggagaagtttttctacaaaccgtgtaattacgaattattcgtcaaacaaaacttgaatatggaaatggctatcaccatggcaagggtacctgttacattcagttagtcactagaaagataaattatagaattgccaacttttttcacattctctccttttgcttggtatattataggatgctggtatggactggatactgcatcttgatactgatgagcttgtacatccttctggaacccgtgaatattccttgagaaatttgctcagagatgttcctgcagatgtggatgaagttatctttacaaattacgtgagttaaaagtctttgaagacattggaattggggtttctttctttggtttgacgatggtgatgactcgcaaatgttcctttttcaggagagcagcgttgagcgagatgatatcaaggaacctttcactgaagtacagaacattatcatctagagcttgctatcttgggacatatcttcatatgagttttatcatcaaaagtgtttgtttttgaacttttaggtatcaatgttcaagaagaattttaaacatcttcctagagaagtttactatggaaactataaagaggcaactcgtggcaatccaaactattttcttacctatgcaaatgggaaatccgctgctcggattcaagaccatcttcggcccaatggtgctcatcgctggcacaactacaagacgtatccaaagtatgttcttttcctcacttagcttaaacatagacattcattcttttgcttttgtaatctgacattgattccatctttgttgtgacagcatcaaggaactagacgaagctgcgattcttcactacacttactcgaaattttcagatcttacttcaagacgtgatcgatgtggctgcaaaccaacaaaaaaagatgtcaagagatgtttcatgctagactttgacagagccgtaagctagttttgatttgtttatgtcgattagtatagttcttgttcatcacattttgtatttgtttttgtttctgcaggcattcatcattgcttcaacttcaacttcagaggaaatgctccaatggtacagagaaagagttgtatggactgacgataatttgatcctaaaacttcttaggaaaggaattctgactcgcatttatgcaccaatggtcagttagttttactactaaatctacatcctcttttaaatgcttttcattgaacaaagctatcatctatctcaggttataatccaagagctaagagaagccggtgttttcagctcagtggtaacttcagctcatatgtctctctcaaagaatagaagcaactcttcaacctcaagcaactactaggaaggtgttggagtttgatcttgttggtgaatcttaagcagtatcagcgataccaccgaaagcatctccaggcttggaaaaaatccaaaatgtttaattataactttcttgaaaatagacttcaaaaacttgcagagagatgaaacagagattttctgtacattttcgacaagattttttttttgcttaggtaactatacaagaagaacattagagcaggctttgtggatctacttggaccattaatatacattctatgtaaaatgcttggatttttctgttggtcttgaatcttgatatgaagaaggaatcatagtatgatagtgtctgtgtttaaagactagtgttatagagtgaccaaaagacagtggagtgggcgcgtgtcatatacgcgcgtacgagctttttttttggcggttctttgcctctccttcctctcgagtctcgagtttgtgccctttattcgatg

SEQ ID NO: 25781 - DNA, 3003 bp, Unknown; identical to SEQ ID NO: 25780
  misc_feature (1)..( 3003): 2750-1469P.txt file - cDNA_ID_2708245; gDNA_ID_2214529; Annot_ID_184881

SEQ ID NO: 25782 - DNA, 3003 bp, Unknown
  misc_feature (1)..( 3003): 2750-1469P.txt file - cDNA_ID_2708249; gDNA_ID_2214529; Annot_ID_134241
accaaaaccctcttacaaataaatcccgaagctttatgcagagagagagagactccaatcagaagcaagcatccaagagacagcaacaacacagagcagcaagactgcaaaagcaaaaacagtgtttacatttcacaatcagtattaaaaacaaatccagttgctttaagacatgcaatgtagtaagcagtagctagatcatgcaaacaatcaaatcctaaaagatgcacattcatcaaaaacaacatccgattcacactgttaagtaaagccatcaaagaacaacaattatcctgtattcagtgaaggaacagagaacacaaaaaggatccatcttgctaagccaatttacttatcaaaacttgtacaagtatagtttcaagtactcataaacagttaaacactaccaaaccaataacgacaagaacacaatcacaattctagtttctttaaagcatgcaatgttgtagtaaccagtagctagatcatgcaaacatgttaaatcctaaaagatgcaaattcattaaacacaacaacaattgtcctgtgatcagtgaatgaacagagatcacaaaaagtcaacctctacagaggaatattctagctaaaaccacatgaccttttgttcaaagaatctctagaagaaatatttaaaataaggaatatagtcaaattcaaactatacacaaaatctaattagtaaaaacagattaaatataatggagtgtgtttattgactaaccatccttctagaaagccaggactgctctgttgttgctgatgctgcggtggtggaggatattgaggcgcgtacggtggaggatatccttgctgaggataaccttgttgaggatatccctgaggtggatagccttgctgaggatatccctgaggaggatatccttgtggtggataagcatcttttggatatccctccggtggataacctattgatacaatttcagcacaaacaaaattcagatccgtcgtacaaaaacaataatcagtaccaaattaagcagatctaagaaaaaattacaaatctaaaaaccgaaacttctaaaagtaatcgaaaatagaaggaaagaggaccttgaggaggaggaacaccaacgggaggttgattgtactggctcattgtttcctttgaagaaaaagtgtaaacttcgtagagaagaaggagatcacgaaccttagatcgaaaaagtttatagaagcgatagagaaggacaaggaaaagaggagagtgttttaagtataacgcgttttgcagttatttgatttttcttgtttttatccataactttaggctagcgttcaatacgatgaattaaaatgaaactaccaataaaaaaggttaaattaaaacaagattcacgcggtttctgccttttgcagcgatattatttctgttttttttttgtttaatagaacttaattaattggagaacaaagattattgattggttgtttattctgttgttttttctaatgttctgtatgaaatctagtgatgcttaatttctttttgtatcttacttcaaatttccttagaatatagaaattcattttgttttatcgagtcgattgacttaagacacattacaacatatgataaatagatgtacacaatagataaagtaaaagtgtctacattctaaaccccacttacctacttccaatgtatactaaaaaagaggagatattcatgtacatatatacattttaaggtttccaatctcttgaaaaggcttgctgaatcacattgtgaaagtagcaatggcctggacttcactacaacattttccttcccgccaattacacatcgttctctttgagctacttcatctactagttttgccactgctattctaaaactgaccgtaagtggttgatgcaaagaagaaaatatgatcagtcattccgttttgcaacataacaatgaagcagaaaattatgtatgttcatttcgataatcctagttgttcgacaccttaatgatcttggtgtccttgtatagattaccttagaatttggttcttcattgtcattggttagcttttcaaacttgatgtcctataaaaatgcacatctcagacattacgtaaatcctagaatctacttttggtacttacacgatacaataccgaaaacgtaagtaccaaaagtagattctaggattaggcccaaaatgatgatgtaaaacaaaatcatgagtgggttaggcccatacggtcataaatgggcttatattggattagtttcctcctaccttatcctctttccgaccaaatttaagatattttatagaaagaataataatttaactttttagtgtgagtagccaacaggattggaacgaaaaagaaagtcaataaaagccaacagtaacgcgtctacacgtggacggttgattactcagaaccatgttagctatgggtccagacctacccacttgtgtctcacctttaatcctgcctcgacgttacgaaccccagcttcgtcaccgaaccttactttatatattagtccttcttcttctcatcttctcgcaacgtaggttctggtgaatgatcctaatccgtttagcttttaaaaaaataagaagacatatttatcaacttgatcaacttgagcaagttgcagcagatattttcctcggccaaggtaaagatctgatgttgtcttcttctctactcgatcaatttctatatttgaagttcgtggattttgaaggatttgattggtttccatggtattagatctctgtgatggttgttgatctatcttaaaacttgatttatcttcagttctctcgatttcaaacttgtacttgtcctacttcaagtgatctaatcggaaacttattgttgctatgtttactgatcgtacagatctattgatctaaggattaagctatgttgtgattgagttgttagatttgaatttgaatttgaactgagcttgtttgtttgtgtgtgcagatctagagttttgagaatg

SEQ ID NO: 25783 - DNA, 3003 bp, Unknown; identical to SEQ ID NO: 25782
  misc_feature (1)..( 3003): 2750-1469P.txt file - cDNA_ID_2708249; gDNA_ID_2214529; Annot_ID_184877

SEQ ID NO: 25784 - DNA, 3003 bp, Unknown
  misc_feature (1)..( 3003): 2750-1469P.txt file - cDNA_ID_2708261; gDNA_ID_2214555; Annot_ID_134746
gtgcagtaatgattccaattctattcaaaactgtcctggatacacatactgtctgtcactataatgagctaaactttgttagtatgggtgggttaaattgcagggccgctttgcagaagcgttactgcgtgaaatagcaggtgtaatcataccatcagaaaggatttatggtttgggttcagggtcagtatcattatgaggtccaccaatgattttgtttctcatccagattctacccttaatctagttttattttctgtgtgatatcccatcaggccaaaggtggaagttctaaagctacttcaagataaaccagaacatcagggcttgacgctgcagtaactcacgttctatatatctatcaataattcttctatctgcatgacttggtaatggtcaccattagtttacaatccctatgcatttttaatttggccagtttcgtggaagacagactcgcaacgctgaaaaatgtcataaaagagcctgaattagacaaatggagtttatacctaggtggtctcttccctctcccatatcatcacttctggttccccttattggttattctgacaaaaacttatctcaaaacaggaacctggggatacaacactgagaaagagagagctgaagcagcaggcattcccaggattcaggttattgagctctccacgtttagcaataagcttaaatgagtgcatatactcattggaaaagaaacaaagctttcctctttattgtattctacggcattcaacggaaactaaaaaccaaacatgtttaggtaagattcagtaaaagagttgaactttcagtactacccattatagaagcttttctgtgacctataattcatccttagtaagatcattcttgttaccatcaccatcttcgtgatctttcctttgctcagcttgaaatttgtcaaagacatcttcaaatggaggatctccaggtcttctaaactcttgcttccctatcttgacctcgtaagcttcttcttggctcagcacgaattcccttagctaattgaaagatatgattgtgatgttagattttgactaatccactaaacaaagttttcagcattgtgtgttttctgtggcttttacctcagtcacaagcttcccattttgcatattgaacatcactgtgcttcgatctacagccatgaatcttactcctatccctcctgttcttaaaacttttgtccatttcatagcaatatcaatcaccacatcctgattgaaacatataaacagatcactattcaatcccctgaagcaactggacccatatcgaattcagagaattttgaacagtaactgaaactataacttaaggaccccaaattcacgattcgatttggattttagtttaccttggtacgggggacgcctaaccggagcttgacgaaaccgacgacggttccaaaagtccgtttagccatttcctcttggatctgatcgaatcccatattggtgaaatccggaggcggatcaaattccggggtcgttgctttcttcccccactctttccatgactcgtcttcttcattgtcttcaacgtcgtctaggtcatcggagatctcgatccgtcgcttcgttgcttcggcgatccggacaaatccgtgaaaattcataaaaagaaggaggccaacaagtagaatcagcgaagaagaacgaacgatcttctccatcgtttaacaaatttattcaggaatcagaaacagaggaagagagactgcatcggcaacggcatttctatatcagtaaagcttctacaaactcgcacacaagtcacaaaaccataataatgtgactttttacttgtttcgggaaaaaaaactattaacgacataaactgaacctgctggttcaaaactgttcgccgtttttctatcttaaaatagaactgcgtgccaactattgacgtaaagatggcaagcatatcaaggctgaaagatgaaaacgacacgaggttgcaccgtaaataaaacaagggtaattgtatgattctctctaatctactactgcactacagaaggtaaaactaaaagtcaaaatttgtctaattttaaattcaaattaattaatcaagtaaaacaaacataagtctaatttgatttccaaatttgtttttttttttctttttttgatttccaaatttgtttatagtagtatcattttagtattcttattacccaatacggaaacaaatatttgaaataaacatggaaaaattaaaagtcattccatttggttaacaaaaggaacgtttggtaaattcacacgtgtctcatcgtcatttgtgcaactgacttgtataaggaagggtacttgtggtaataaaagcgaaaaccgaggggtggcctcgtgaaacgcattttccgtgttccaactgtatcgaggcgtgggacctacaatcaaaaataaaataaaattaatgccccttccaaaaaaaaaaagaaagagaaaaaaaagaaaaagggaagtaagaagccagctagggtttgactgcgagaaatttctgatctgcgtgaatttctcaaagagaggaatcgatcatcgattccgtggatttcgtttccctccctttttatttttatttttcgagaagccatctcaaaggatctgagtttataccgttgcatcccccgcgactttcgttttccgatttcccccaaattcgatgcaaatctaagaagagagagaaatagaaaggtgtgtgcgcttcaaccgactcagtgtctctctctctctctctctctctctctctctgttgctatttgaggttttttcctttgcctcgggggctctcgctgtccgaattcttttgtagggatttattgggtagggtttttccactttttttttgtcttcttctactagcttcgttgtgcattgggtttaattgtttccagtgtagtgactgtcagattcttcgaccaattgcatgcaatctggaggcagtggcggagggcccgctcggaatccggccatg

SEQ ID NO: 25785 - DNA, 3000 bp, Unknown; identical to SEQ ID NO: 12075
  misc_feature (1)..( 3000): 2750-1469P.txt file - cDNA_ID_2708265; gDNA_ID_2214530; Annot_ID_134248

SEQ ID NO: 25786 - DNA, 3003 bp, Unknown
  misc_feature (1)..( 3003): 2750-1469P.txt file - cDNA_ID_2708272; gDNA_ID_2214530; Annot_ID_134253
gatcactctctctctctatctctgttcacacatctctcccaaaggtatttcgaatcgaaattcttttgatttctttctatgatttgtttacattttttcgtggtgttcttgatttttttctttgatcaaaactagtagaaattttccaatttcgtcctgccttgtgattagtagtagatattttggaatttgattagtaggtagaagaagatggggacgacgttagatgtatcaagagcagagctagcacttgtggtaatgtatttgaacaaagcagaggcaagagataagttatgcagagctatacagtatggttccaagttcttgagtggtggacaacctggtactgctcaaaatgttgacaaatctactagcttagcaagaaaagtcttccgtcttttcaaggttaatccttttgattttgattagagtgtgtttttacctctttgtttaattaactaaatattatcattgttgcagtttgtgaatgacttgcatggtcttatcagtcctgtgcctaaaggaactcctcttcctcttgttttacttggaaaggtaggtgctttagagatcaaagctcagagttcgtttcggttttatatctttgttctgtatcaatctttgttgttattttcagtcgaagaacgcacttttatctacattcttgttcctggatcaaattgtctggcttgggagatcaggaatatataaggtgagagagagagagatcatcaagtttatgttccactggtgtattctagttttgtgtgtttggctaatgtcttatatgtgttatctcaacacagaacaaagaacgagctgagttacttggacgtatatctctcttctgctggatgggatcttctgtctgcacaactttagtcgaggtccgcctcttctttcacttttccgatcgattcctcatgtcatcttggcctttttcgccagcttatgtatcggttttcactgttatcaggttggtgagatgggaaggctttcttcatcaatgaagaagatcgaaaagggactcaagaatggaaacaagtatcaggtaaagttttcttctttgttaagaaacttctaattctacaaaatcttattataagagactcaattcaaattgtataaaaatgtaggatgaggattatcgtgctaagctaaaaaaatcaaacgagaggtcacttgctttgatcaaatcagctatggacattgttgtagcagctggtcttcttcagttagctccaacgaagatcactcctcgtgtcaccggagcttttggattcatcacctccatcatttcttgttaccaggtaacacttgtttcatccacaagacctcactttccaatttcgtaactttcttcttctgaattctgatatttacatgattctcattgttctccacaaacacagttgcttccgacacgccccaagatcaaaacaccctgaagtcaatcgaggaagctggtgttaaggagaaagtcatttcagaaagtttctgttcttcttattattaaggaaattcactgctgttataaaacatcgtataaaatacttatttgcaggaattacggttattataaatttatgcctcagattcttgatacacaagtttcaatactcaatagtattgcattattatgagatgttgtttctgctacgcaataactagaggcaaaatccaactacatatatgttttgatctgattattataatagactttgggcttcattccgcctaaagctacaacttggagtctgaagagcatccatgcatcgtggaacgctcattttacactgaatgctattttttattaaatatgaaaatcctcgatatttttctataaaaaaatatcttgaaagttgttgataggcccatgcatggatacgaagattttgggaatttaattccgaaatgtaagatttggtttgatttttttgttacatttgttcaaattagttttagattaaactctaaatttaaatcataagaaatcatcaattttacctggataatcttaacaacttatcattaagatctgttataattattaatttgtaaacttgagttaagttcgataaaatcacttcggttccattcgtttcaaatgtttccagtccaatgtcatgggtattgtttaggttaggtgtaactgtgtaaggtacaaaatgttgtttggatcaattaacgcaaaccaaactctcactgccttttacgattccaatggcaatatacattgcttctttgggatttcttcacaatcccgcaaggtttaaacttcctctgtccagtgtccccccaaaaaagtgcatattacattcccataactggcgtatatacagagcaacagagaatatcagttaaaaacggtgtgagcaaaaagtgcttcggttaagtattaaaattggttcgaaccggtgaaaagtgcaattgggattgcgtctctttgcatccaaaggacccaaacggacccctcatcacctatgtatcaaccttcactcgcttcaccggagcgtgcactttcacaaacgcggattctcaaatcaattttacttctttttaaaataatgttaaaagaataaaagatatatttctcataatacaatgcatgaatatactacaaaatccttaattttcctaattttctaaaagataaaatctaataattcgctgaaaatggaaaagaataatattttgaacaaaataatttccccattgttgcctatgactagctcgcacgttttaagcctaatctctcacgaatacataaaaataaaattaaaactcattgaccctttgaccttaaagcgcgtacctaacactcgcttctattttctctcttccctttatattacaccatcgaaccacttcatatcaacccttgaaaacttcactcgtcacacattcgattctttcatcgttgtgtctattataaatatatgtcaatttggtttctaaaaaattctaccattgattgattgatttttttttctttaagagatg

SEQ ID NO: 25787 - DNA, 3003 bp, Unknown; identical to SEQ ID NO: 25786
  misc_feature (1)..( 3003): 2750-1469P.txt file - cDNA_ID_2708272; gDNA_ID_2214530; Annot_ID_184895

SEQ ID NO: 25788 - DNA, 3003 bp, Unknown
  misc_feature (1)..( 3003): 2750-1469P.txt file - cDNA_ID_2708280; gDNA_ID_2214530; Annot_ID_134255
gtgcggcgtgactacatagatgcgtgttattaatttgatttgatgacgacatcactacataattaacttatttgcttaatttccttaaagtcagaattattaatggtttgttttaaaagattattcagtagcattttccaaagaatagacgcctctccactacaaaagacatcttcatattcgctttgttcaaatactttttgttttccgaaaaagaaagaaagaagagaaaggctctcaggccttagaaatttcacggatgtctttttttgttatacaaagttttgtcaacaagtgcaatttgttataatacgcatgcattcacgaaattagaaccttagtttgaacagaattatgaaagtagtaacttgaagaatacaattgtgtacgtaatgttttgggaaaagtcaatggagtcgttgatacggcacgtgtcgaacacaagcgattaagttgacttgtttctgaaggaaactgtggcgacaattcgaacgaagtttcaggtattttttgcatcattcttgccaaacgtcgacgggacgcgttttttttttgtctgcaccaaaataatcgacttttaaaacctgtgatccatagccagttaataatttcaataacaattttatcacaaaatgtaacagactatatataaattaatcgtatatcttcacttttgagactaatgtaacaaacgtgctcttatcatatagtgattgaaacatttaaggagcaattaaaccccctcgttaacacgaaaagctgtgatggccattggcattgcacgaagaacaacttaccgtcccagaacacactagagccgctgccgcgctttctcacatttgcgtatatatataattttgatcaattattttgacgtaacagttaattacattaatacaaattggtattgtagtcgtagttacgtgatttatcccaattcaaagtggatgtaggtaatagctgggaaaggtaaaaactgaaaaatcttggccaacaaacacatgcatgcatggctatacattgtaaattacatatgtcagcagcatcgtgtcgtgagctaagctaaatagctgtggaaatgttcatatatttaacaatagtttaaaactgcaacgatgtggtcgctcactctataatgtatttttgcgagatattattatatgtatattatcatatgacccaagatgaccgatgggcttagcttgcagtactgatgaataaatcattacagactgtttctggaaatttgttgtttgttgcccagttatttcatggcacatggattaggcactcatatcaactatgtagtactttttctacaatgttgtcgtgttgacttgataaaagtatacagtcaatctaggtcaatatctactagttctttcttataccgtttttggtggatagcgggaatggaattgctaattctaacttacaaggtatggtttacgaatattgtaagtgtttttttttagaatgccaattcagatattcaaaaaacggagaacatgtactagtcattaaatatagagtaatagagttaaaaatctataaattttgaccgaatacatataaaaatataaaaaattagaataatcaccaagtatttctcggtgcttattaatataagaagatagaatttaaaaatggctaccaaaaacaaaaataataaaaatatttattaaaataagcaaattgttaattagataattcaacagatttgaaatttataatcggccacttgttttttcttttataattagagactctcaaaccaaaatctaaagtaatttacacgatatgtatatataaagtcaggtctaaaccactgaatttagagatccgatccgttgatgggaaaactcaacccacattatcaattctgtggaaaaaagattgtgatttatttatattttttgtgtggaacacatgtatgtactataactgtgtagtacatgcatatgtaatttcaagtactcgttaaagaaaacagaccagcaaattgtcttagtaacatttttccacataccatctaatcgttcatgacatcgttttgcttatgtcacgtttatgacgcttgtatgaatgtgttcggctgttggtgtaccaaatatacgacaaatgcgaaacataagagaaaaagataagttaaacgttatacctaaggaaacaaatttggagtcttcacttttggtcgtcctcagcaaacaaatttggtgtatataataatcaaaataggcgaagtcctataaattgtttgccaacaaaatataaattgtcaaactagtattcgccacaaatgcacttttgagttaaaattgaatcacgtgtgaagaagttgttggactttgtttacatcctttggatcaagtcttaaagtcgttctatggacatttgagaaatctacgggaaatagaggcaaaagaaaaagaaatcaaatatagtagtaggttttaaaacatacatactttgtaccaaagcttaatggcgccatcaatgaatgaaatagttgatgtgattgtagctgaatgattgctagttacttgttgtgctcgtttgaggataaatcttatgatttcaaatttccaatatctttgaaaatcgttcaaagtaagatataaacatacctttgaaagagaaattagtatataaacaaataaaactaattatagttttcaaaatgataactgtagatgattaactattttctctcactaatttactaacatatccttgataaaacttgtaatctagatagatagaatataaaaagacgtaatctattatatacaaaacaaatttgtatttgaggattttttttatttataattataattaatagttttcaaaaaattaagcattaacgctgcgtttttcattattcatttttttgcagattggttcattattgggaaacaatagaaacgtaaaacgcagcgtataaaaaagattattatccagtaagtcagtaacttacacagattctctagcacaactgccatg

SEQ ID NO: 25789 - DNA, 3003 bp, Unknown
  misc_feature (1)..( 3003): 2750-1469P.txt file - cDNA_ID_2708284; gDNA_ID_2214530; Annot_ID_134259
gatagtttctgatagcgtaaattgatgatgcaggagttgataaatttcacgctgcactacattgcagacctggatattccaattaagaggtataacgtggatccaactgctagtctctaatcatgtttgcaaagtgataagatgatttattttcttgaaatttgtatacataggggaacatttattgaattccgaaatggaatgctcaatgtatcacccattggtcgcaactgcagccaagaagaaagagatgaatttgagagatatgataaggtagaagaaactatatttagtttgttcaatttcttatagaatatattttgagcattgtcattcaacactttttttaaaaggttcaaaacatccgaccaaagatggtagctgaacttcgtgagcggtttgcacatcttaaccttactttctcaattgggggacagataagcttcgatgtgagtagaatcaaaatgtggattataacaatttcttaaatccattttttgagtcactgagtctaatcaaattgttatgacttaggtcttccctaaaggttgggataagacttactgcttgcaatacctcgaggacttcagtgaaatccatttcttcggtgacaagacctatgaggtataagactcatctcaactctgcaaatctattcattagagttgttgtatggtttccgttgagcttgatgggtaaaaatatggcttttacttctgcagggtggaaatgactatgaaatctatgaatcaccaaaaacaattggccattcaggtcagctacttggatatattatcgtttaatctctgtatgtttgtgttgcgagatattttcatgacaaataggattgtttctgttgttgcagttacgagtccagatgacacagtggcaaaatgcaaggctctgttcatgtcttgaaacactactcatctcaagaacacagtgtcaagagtttgattcttctttggcgaaatctcacaactcttgattacaagaaatggagagaagtgtgtttgaatgctatctataccgtatgttttgaattttgattcatcaaataaaatatcttgttataaccttttgtttcagaacatggtcctcaaagttttaaaactaaaggttaaaaatatcctcttcaaaaaaaattggatgttaaagattttgtttacaacagattctctccaaaaagagctttaaaactttacaagaatttacaagaagaaacaacaacaatttgtatttatatattcattaaacagaaacgcatataaaaacttcaaacttgagaactgataagatcattcctccacgacattttcaagactcaacgaccggctcaggctcctcttctcctgcagcttcaggggcagcgtcatcttcttttgcttcgggaattgaggcggtgtcgtcaggtttgtgatcatcagaaggaggagaagcgccaccagaagaggcggatcgacggtggttagcagcggcttgatggacgtgattgtaactgcctttctcgagaaagagctgattgaagtggactttacagtagaggacgccattaagagaagcgtaagaagagtgagtcaaaggacaaccactgtgtgtgcacctgaagcaagtcttgtggtaactttctccttccattgttactttctcaagtgggtaaaccgtcttcttacaagtcgcacatttgtcttgtgttccactgaagaatgatgataacttgcttggagttcgagtcttgcagtatccatcaattgagacaaatcagatgaaaaaaaagaggaaataaaaacaagatgatgaatctttgaagacattaccagatgatcattgggcttctcggtctttcctgcctgaaaattcttgctgtaattgccagattctttgaaaagctgttcgaagtgtggcttacagtaaagaactccatccattgatgagtaattgcttatctgtgttaagaaaagatgtggtcttttaaaacaatgaagcattgtcgaaaaacagagtaacaatggaggaagaagaagaaaagagaaataccacgagagtgcctttgcaatgggtgcatctgaaacatgatttgtgataagtattaccctctaatgttaacaaatccatcacgtacacggttttgtcacaggccttgcatttatccaatgttcctgtaaacgacattttctctctttctttcggatgttagattcaaaaagtttgttcttcgttcgccggttcttgtcttaggacacgaccaaacgacgacgagagaaaaaacaccaggttttgtgtttttttcttttcatctctcaagttctctgtcttatttatcaaaaattcttgaagaaatgagaatttgtggtaattttggttctagtggtagagattcgaaagaggagaagccattcaatcattgtcgatcatcaaaattctaatttcaattttacaattttagactccgagcacaatgaagggtatcgacgttttcagccgtacgctctgtttgcggaagatccgaagatctatttttaaaaattacgagagaataatgataaatacaaagaaatgtgggggttatttcataattatacgaacgtacaaggctaatttagtgaaataaatgtggataagagtgagtgaaactgaagaagagcctgtccgtgtaatgaaaatccacttgacgacctaaacaacaacaacgactccggcgagtgtatgtatctttcactttctcactaaccaaccagacgacaaaagaaaattattcatcttagctaagctcgattagtttctggcggaaacggttttgtggataattgttagcatattccgatcttgccctcccccgagagagagagtccaatcaatcaatcaatcaatcatctcttacgaagctacgtgtgacctaacattctccagattgttgtttatagcctcttcttagatttacgatttgtgagcttgtgaagatttcttggtagaattagagttctctgtttcgagatcgagatg

SEQ ID NO: 25790 - DNA, 3000 bp, Unknown
  misc_feature (1)..( 3000): 2750-1469P.txt file - cDNA_ID_2708287; gDNA_ID_2214530; Annot_ID_134263
cttgaataagaagcctcagtgcgaaacactagaagcagagctaaagccggagccgtaagctgatacggtagaggagaagctcgaagtacagggaagaaatcaggcaaccagtccaaatccacggcggagttatagccggcgatcaggatcgcgacggtggtgaagaagaaaacaggcggaatcaaagacagtataacgcgtgaagatgggctcgaggatacgtgacggagatggcgaagagagcttctgtgtctgacccaattctcgtgagtgtagagagatcgtttctgctgcatccgtctctctttgataccgtcagaccagtttgggacagctttaagcagcgaaatgagcttctcggatagaggtgaatcgtcggatttggggccggaggagacgcaggaaggattgaatttgaaatgtagggatttgggagctctggcggagattccggagtataatcgtggtttgagaaaggataggttggtaaagttagaagaaaaagataggttcattgactgatacattttgggcgggaaaatcgaggtttagggttagggattttggtggagacgacgatgaagaagaagaagcagagacaacaataaagacacatgcaaaaattgcagagtgcataagtaaagagagacaagtgtgacttggagaaaggtagttggaacgaacagttgtgcgctcgacaacgtttcggtttctaagcttttatctgggcttaaatgggcttatactgaaacttctattctatcttctaaatgggcttatgtcttatctcagcccattaaagttccgtaccctttgaggtcagttgaaatttagggtttatagagaacgcctatctggttggagaggtgaaattggaacggaaaaaatgtcgaagaagaacaatttagccaagagaaagaagcagcacgagtacaatctccaaagtaggtttctttaaatctctttaaacgctttcaattcaatacgcatgtgtttctcaacaaaacttggaattttttcgatttgcagaagagaaagagttacaggacaagaagatcaagaagcttcatgccaacaagaataagatgaaagtaaggaccttttctgtctctcttatctcttaattctgatatttagttcatatacattggtgttcgttaagtagcaaaccgattctgttgcagagaatggtcttttctagctatatattactctagttggttaccaatggtgaaatgattgaattcgcttggattcaatttgatttcgatagtgttagtcagaagcttatgtggggtaaaaataataatattgaatcttcttagtagaacatctgacgaataagtttgagttttccaaatcatttaaatgaagtctagagtagtttatgatatctgtgagttggttgattttgttgtctaggttgatggaagtgggaagaagaagaaaggtggattttctgttggcaagaagaaattaaagacaaaactgactccaactgctaaagctaaagctgctcaggcaatggagctagacaattgacaaggaacttcgttttttttcacttgtatgtaaaattgttcttcattgatcttcgtctttactttggagaaatcatgttgaagctagcttcttcttataggttaaactcttatgtatcactctctcttttgaatgcaagattttgctatctaaccggatcgggatcattgtggaatgtagctattgatgaagtgaaatgtgtatggttcctaattgcttctaaagttcaaattcagcatagattctgatttctctgagaaaaagtcaacttttaggtaaacaaaacaaagacacaagtatgtttataattggcataagactttcatggtgcattagtcagacccaagatcttttctagtttattagtacattccagtattccactaaacatattttgaagaaaaaaactgtcttttagaaagtcaaattatgtttgtcataatcaaaagtcttatacaaacagtgtcacacattacatggtacatttaaagttgaatcctaataggaaaaaatctcaaaggctttgagaggttatatcatcccatcaatgggtccttgcgagatattttatagatttcttctgatcagcctctctctctcgtcaaaatagttctcaaagtggaagccagtgggcaagtctctgaccagacaggcccaaatcttttctcactctccggcgcgtggcctccactgtctctacagattcttccgtctcagatcaaattccgaagagatcaatcagtctatagaaacagtagagagactagtaagaagtagcatcagcttgaaaaggaggaatctgttcaccaagatttctggttgagaagaaagaagagtgacatgttggtgcacgcgcctgaataaagagtgtggccataagagtcatgtgccatacagatgcctagttgctatatagagctacagtcaaagtcagtttattcattaggattttgaatttccaaatacattttcagaaaaaaaagaattaaaagatcccattgttgttatcctcacagtaaatgcttttgcttgagagagagtctgttagaggttttttgtttgtttctgtttccttctgtcacccagaaaactaaaaagcaaacaaattcaagaagagagagagagagagatagcctcaaaaccaagtcctaaccattgttgatagaagagaaagcttttcttttcttgttgcttatggtgaaagaatgaaagagagagaggaggagaagtaagaagcagagaaagtgtttagagctttgcatgttcctttctctccaagtttatatcttcatcgtaaagtctctcaacctttgattctgttttttcctcttatccatttatcctctttctttttctctctctcctcataattctagccacaatctttttagggtttcacaagttcacttaaaaagttgaaaagagtctttcttcttcaactattgtaaatgcgaaatg

SEQ ID NO: 25791 - DNA, 3000 bp, Unknown; identical to SEQ ID NO: 25790
  misc_feature (1)..( 3000): 2750-1469P.txt file - cDNA_ID_2708287; gDNA_ID_2214530; Annot_ID_184905

SEQ ID NO: 25792 - DNA, 3000 bp, Unknown; identical to SEQ ID NO: 12088
  misc_feature (1)..( 3000): 2750-1469P.txt file - cDNA_ID_2708291; gDNA_ID_2214530; Annot_ID_134273

SEQ ID NO: 25793 - DNA, 3003 bp, Unknown
  misc_feature (1)..( 3003): 2750-1469P.txt file - cDNA_ID_2708295; gDNA_ID_2214530; Annot_ID_134274
aaactgatccaatgaagcagcaaaaaaaaaaaaaaaaaaaagcagaaacagccgtatacgtttggagataatacagatattcgaattgtccaaaacacaatatatcaaacaagcaaaagcaaacacattgagatacatacacgtaaccaccgagaagctcttttgaaccaaggagagtctattatgcgaattggcgcgttgtaccttataacagatattgggtattgaaggtgaacttccggcggggatttaaaatctggtggtggatagcgacggcggacggcggcggctgcggccaagcgatgtggaagcggccgagcggataagtgagagaaagcggactaaatttaggaattaattttattaaaaataaaaataaaaatcaaatgaggaggaggaaaaacaagaaaatgagaggaccgatcatgtccaggtgtcatgatcatgttggctaatggctagtggtggtatcaaccataacggcatcgttaggtaaaaaaggaaactaggctcgagtcggtgggctctagtagcgagagtggttcgagttggcgatgcttggagaatttgttaaaaagccgaggcgcttgtagattaaaaattgttggcccaataataagtatgggcttttatataggtgataaatggcccaactgtttttttaaaaaggctcgaatcttcctcatttgaaatttctaaggaatttgattttccaaaacttttgttgaatacatttgaatttaaatttgtaggaactttgaggagcaatttgtcttggcaaattttgttttgaaatgtaaattttaattgatatatccaaaatttggtgtctaatctttttatccatgatgttatttcaaaactttaaaaactattgattcatactagtattgatggtattgtacttgtgaattgttcagaactcttttgtcaaaaaaagaaaaaagagaacaaaatgtttcaaaattaaataatccaagagaggtggaagtggggactgtaacgcaacgggaatattgggagtgggcatgcaattattgcactcatgaaaaataaaactaaaaatgattttactatttggctgaaggtgacaagtgtttgggtggcttggtcggtttttgtatacgtaagtttatgccacgtgtcctcttatccatggattggacggcttggaatcgtggaatattttattctcataccaaagtccaaatatattacaacctccccctttttttcccttcacaaaaagctaaaagccattgcttaaaaaaccaagaaatactaaaaggatttggaaaagtagcaatcctgattttgattgatagtactataatggaacaccagtagttgaaattagatacataggttgaatggaattgtaacataggtttattttattcccttttttttttgtgaatacatgacaaaatggtattgaattgtaaatgaacttttcagaattgtgtgaatggccaaaaaaattgcaaaatataaaagactattctaatatcgacagaatttactaatcaagatcaaactcataccaaaataaatataggccgttcaataaataatttcattatggatgtgagtttaacttcattatggagcatgtacatggtttgggacacgggaaaggcgataacataacttctgcactatacaccgtttaaagagggaatttaccagggaaatttggtgcatggtcagatcaaatttggtccatatgagagcttggacggtaataaaagaaggcaagcgatagaacataacgaaatttggtaatgggactagaagaaaacagcacgtgggtaggacatagtgttacacccaaaaagacaacaaagcaacgaagcaaccataattgtttagtcctttttttctttcttttggcttaaacgttgtctttcctttttggcaaatagtggattgctgccgaatattacactatccaatcttcttctttaacctcattaaaacccactattcatcatgcatttattttacacattcatggtgaaactacttggtatatatatgcaaatgaatatgcatgtggatggtacatggcgtttgattttgcatataggcaatttattgatcaatacttggtgtagttggtacattaaagttgcattatagacaaacaaaattcggctgtcatgcttgattgatctatagatgatttcataataaaaaaatattgtcatggataaaaatagtgaagatgataacaaaaagaacagaacacaaagaagaatctcatttcttttttgattaataaaaggatataaagtcattagtttttttattcgtctcactcgacactaataataactaaaattgttggagaattaaaagtaagaaagcaatgctataaaataaagtaattgttgggaatggagcatgtaaaattatcactcataactaaaattagcaatgttataaagtatttaagtaagaaaatgttgtagataatttgttaaatgaggtgtccctatgtcttttaggtgcggtgagtccatgtgcttatcctgacagcggtccaacttaaccggcggttcatctcgaccacatattcaactgcttttttaatatgattttctgtattttcttacctgtcataatctacatttaaacgttaaaaaatgtccacaattttatttattttattagggtacaataacgacatttgattagagtaaagaaaatagttgcaaagcgggatttgaaactctgtccacatactttaattatcattaatcaataacaagcattatcagtattcagcagcagcaaagatgataacgttaattatactatcatgcaattaagttaactaattaactatcatcttgtttatgttttaattttgtttccatcatcttccaaccttgagtttcggtcactataaaaagccaccactctctctgcttctctgcaacacataacccactcacagaaaaacctagaaagctctagagagaaagagagagagagatg

SEQ ID NO: 25794 - DNA, 3003 bp, Unknown; identical to SEQ ID NO: 25793
  misc_feature (1)..( 3003): 2750-1469P.txt file - cDNA_ID_2708295; gDNA_ID_2214530; Annot_ID_184916

SEQ ID NO: 25795 - DNA, 3003 bp, Unknown
  misc_feature (1)..( 3003): 2750-1469P.txt file - cDNA_ID_2708329; gDNA_ID_2214531; Annot_ID_134292
atatatatattatcaaatcatcaaaaaccacaatttccacctggtcctccaaatgaaaaggcttctcctgtagatttggtataaccccaatatgtcgccctaaaacaattataggaatcgacataaagtcgtattttcctaccttcaatgtaaactcttttatagtccgagtttataacaacgacgttattaaaatgtgccgtctttttaaagtccgcaactggaaaaaacccattgcccattggaggactgattccatcgggagattcaaaagtatttcctccatatcttactagagaagctccattattcaaatgtgaaaataactctttaggccaataaccaatgacttcatcaaacattttaagtgcccaatttccgctgaagccatcctaatacatataaaacaaaagaaaaaatgaaaactaaatactccaacaagtatggtgtaatatgataagttcatctaaagtctaaactaattatataaatctttttcttaaaaaggataaacagaaatttacctgaaaaacttgcaatttaaacgtaagacttgttttaccatagacagatgttccccaaaatccgcttccaattcttgaatttcgacttacaaccacaaagccagggcattgtgtattatagcacccagttttctgataaccatctccctacatataataatatttgttacacatgtaaaataatgaaagacgttttgatctcttattttatttttttactctaagctgattaataatgttcttaaaagaataagagtagctaaaaattactcacagtccaatatattgtaaatcgtgtgacactatcaccgtacaatcttggatgtacctaaacagaaataaatataaaaaagattatgtatgttaaaaaaaaaacagattatggaacgcaaaatctttagcaagtttgatagaactgacttactgccaaaccagcttgtatactattgagttgacctggaggtccattctctaaccatatttgacttttactgtattggttattttgcagtttcaaatcatgaatacttatatcagcttctgctccccgatatatacttccatctaaaatggtctcaattgttgcaaactgcaaatttcatcaatatgttagtttaattttcatctataatatatattttgcatgaataacaatcggatgttttgatgttctcctttaattttacgtaaaacgaatagattattagaatgtcttaacaactagatgaaattttgtaactcctttcaaaaaccaagattaggagaagacatacatgttgaccagaatactcggcggtattcaaatgaacgcccttggatacatttctttgtctcaaaattgcaacggttccttttggacaatgctcttttgtattatatttgttgcttctttcaatttttccatctaggctgaatgtttcctacattataccacaagtaacaaaggaagaataagattcgtcagttttgatgtctcccgaagtcctattttcatatttgattaaccacaactattttattcacattttataaatttataaactaacattaacatattcatccaaaagtttcttaggaatacccatccttgactataacaaaagttacttatcatacataaactttgaactctacttttataaaataaatagaatatgcgagatctaattctaatatgaaaaaatctagataatttctaggtcggattagatttcgaaactcaaatattttgcccaacgatatatgctacgttacctggatcttgtgatctttcaacaatggatgttggaaagctggttgtttgtatatttccacacaatcaaaatcctataaaattggttgaacacacaaattagagaaaaattctaaatataagaatggaaatctttagaggatagaacaaacaagcataagcaagggtctcacatcagtgtttccctgtgcaccttgtgtaaacagcagataaacacatagacttaaagctagacgtaatgccattgctaagttatttttagtttacctagtttatatcaatgatacttttcagtataaataaacgaattcgagtcaaagactatctaaactattcatattaattgtgtttttaatgttttaccaaaattaacatatgtatatattttttggtcaacgttcaagtgtatatatagggaaatatggatacatggcttttagtttcccatatgtaaacataacataccaaaaaagtttcaaagttattcaaaatactttcatacgtatctttcaataaagagattcctaaaataactttaaaatagtcaaaataaccaccaaagtttatgaaaatctaaaaatattattttttaatttaaatatctttgtcacattttctatttacttcttatgccaattattgtttaagataatgatttagattaaaatattaacgaaatatcattgcttaaagtgttaattttactgtttttcgagtatacatatattcaaaaataaaatcaaaacattaaaaagaaattgaatcaaaaaagggtaatctattcaaaagaaattgaatacaacataaatgaaaaccattgtcattctttttccctggatttcacaattattaaaattaaactttatattaataatatcttaagataatataataaataaaaagtttatgagatggcagttaccccgttgggaacagattttctgatcccgccaatgttatctccacgtgtcaaataaatattggtcgcagagatatgcttcatctaaaccagatatcctcctaaccgtacgataaaaatccaacggaccagaataaaccttatctctccagttttagatctcgtataaattcaaagaacccaaaaccaaacaaaaagcacaagcacttagcagagcaaatgaagaagacgaagcacactgagaattcaccggccagagatcaccaataagtgttgtagtttccggttacttcgaataaccttcaatg

SEQ ID NO: 25796 - DNA, 3003 bp, Unknown; identical to SEQ ID NO: 25795
  misc_feature (1)..( 3003): 2750-1469P.txt file - cDNA_ID_2708329; gDNA_ID_2214531; Annot_ID_184945

SEQ ID NO: 25797 - DNA, 3000 bp, Unknown
  misc_feature (1)..( 3000): 2750-1469P.txt file - cDNA_ID_2708346; gDNA_ID_2214532; Annot_ID_134316
agagctgtttctgttcgtcgtatgcggtctaagtaccaagattctgcaccttctaatgaaactcataacaaggtaattgattccctctccttctcgccacctcgttcatcattacactgagaccttttctctcatcaaatttcttttatatttttctctctatagcaaaatgaagataagaggaagttgaagctaattgaatcagttgcaaaagggtcttctcaaggtgagtcattatcagtatcttctataccacaaggaaaagagaaactcgagaacgttggcaccgcttcacgcagtaaaatcagtaaaaactttggtgagctcttggctagtgatgagaatacatgggaaccttcatccgagactcctgtggcagagaaaactctgtatgtagacattgtgcatctagtagataagaaggtacaagaagagtccaagaagcagcctatattgaaagagtctccttcactagacattgttcctgtaaaagatgaagaagctgatatctcgcagcctaaaagcattgagcaagagaatggtaacagagatgaggatttcactaaattctcaagtcagaaagttgaagaatgtcctgatcatcaagctattgttgcactgccagaatccgatgtggtagagattacaaaggagaagaagattgatcttgaagttcagttgcaagtaatcacaacaaatattgaaagttcaaggcttcatcatcgttcaagttatctcattgttcctccaccaccattaccaaaagctccttcagattcttggttaaagcgtacattaccaacaataccaccaaaaaacaactcattcgcatggttacagtctcttggcactgatgatgataatcactttaccaagactcaagctaatccaaagtgggaaactatggtcaaaacgtccaatacacagcaagggtttgtgtgcttctccaaggtaaaaaaaaaaaaaagaaacgtccaatactttcacaaatgtgtcttaattttcaaagtcaatgcttggcaaaatgtgttaatacttgttgatcctgttttgttctttcaggaaacactaaaccctataccagagtcatagcaagaccaaaacaaaattctcactggtggtaatgaagaaactgtaaaatttttcacaccaaattacatgtaaattttcaacaataaagaagggatgagccaataaagtttgggtattttgtctttaactatttgtgtaaatctgaatcaaaaagattccatgataaagagaaagcaatggagataaatgtcttaaatattgtctggcacttaaggagaggtttcttgttgaagtgatgtacagctcatgttaacggagatttcatggcaataattccatgtgacactgcttctttattctctactaatagacttttttttttcgttcttttgtaattatggtttcaaaatatagagctcactagaaaggaaacttgaaagctgcagaattgaattgaattgaataccttgactaaattagtcactagaggaattattgaaacaatattggtgtgaaaatgttcacatttcatctcttattctctttatatatatagtggcatggaagatcacatgcaaatatatgagtgaagagaaatttaaaaaacaatatagagagagagtgagaggtttctttatcagttagtttgacatgaaagaagctgctgcttttgggggtgttttgttcttgattttcatgtttcttctgtcgttgttacttgtaaccatggccgtatttgcttgctccaaaaagaaggaaaagaagaaggattcaagttgctgttgctgctgtaaaggtggcgtttttggcggttgcagtggtgatggtggtggaggaggagggggttgctagataagtagatatatcacttgggtactgtttccgtacgtatttgaatttatgaccaatttgcttagaacatctaggcattacctaaagaacaacatgtgcctaatcttattatcgttatgctaaagtaaaatcaaatatctatttgatattagtatgatcggatccgattcttgcatcatcctactatcagtttcattctactttaatagttccatcgtttgtattttttctgcacaaactaatcatcttaatgaataattttatcaccatatcatgttaaaagaaaatttcgacgtaaatatatcatgtcatgatgtatacaagagaaaaatatatctcaatcatagtttttgtatgtatatattttaacattgttttgatgttatttgtccatagtgttggtcgttggaatccaaatagcgagttattattaaacaaaatgttccaagaaattgattatgatcgtcattcgtccatgtgctaagtccactccccttattctaagacttttatccatcctttaaattggaccaaatattaaaagtcaaatatgtagccatctggctccagagaacaccaattttttttctaaaatgacaaaaacttagaagattcaagattcagaaaacacatacgtaacgtaagccaatatttttccattcaaagagtttaccgatagcgaataaaaactgttaaaaaaactagaatgaatactgtaaacaatttatattagtagatagattaaagagtttttaaaattgtggtaaaactccaaaacaactattaatctgaaagagagtagttgttgttagtttacccaaattatctgattgtgtgaatgtagtaatctccacaataaattgcattatggtattattacggagttatcagacttttcacttcaccaatcactgtgcttattaaataatgactacttaataaacagattagtgtttcattggagcgtaagaatcacgcgctaaacttacgcgtgggtttcctctttatctttaaaaattttctcaagtttagacagaacaccaggtaatagagagagaacaaaatagtctttactctttcagtgagagagagaagttagagctgtaaaagcacatg

SEQ ID NO: 25798 - DNA, 3000 bp, Unknown; identical to SEQ ID NO: 25797
  misc_feature (1)..( 3000): 2750-1469P.txt file - cDNA_ID_2708346; gDNA_ID_2214532; Annot_ID_184977

SEQ ID NO: 25799 - DNA, 3003 bp, Unknown
  misc_feature (1)..( 3003): 2750-1469P.txt file - cDNA_ID_2708350; gDNA_ID_2214532; Annot_ID_134315
taagaagttcgacaatgatgtttcacttgaaataatagcaatgagaacacctggatttagcggagcagatctcgctaacctcttgaatgaggctgctatattggccggaaggcgagcacggacatcgatatcatctaaagagattgatgactccattgatagaatcgttgctggcatggaaggaacagtgatgaccgatggcaagagcaaaagcttggtagcttaccatgaagttggtcatgcagtgtgtgggtaagtgagaaacatattaaaagcctgtctgtatattattactatcaaaaacttactttaaagttataaactttggttttttacagaacattgactccaggacatgatgctgtgcaaaaggtaacgttgataccaagaggccaagcaagaggtctgacttggttcattccatcagatgacccgacactcatctccaagcagcaactctttgcaagaattgttggtggactcggtggtagggccgctgaagaaatcatctttggtgattccgaggtgactactggcgcagttggtgacttacaacagatcaccggtttggctagacaggtacgcgacacgttcagcttcacattagttatgctggagcctgatgataagtttgatcttttactagttgatgaaactgagtgtttgagactgttgaatatttttactttgcagatggtaacaacatttggaatgtctgatattggaccatggtctttgatggattcttcggcacaaagcgatgtcatcatgagaatgatggcaagaaactccatgtctgagaagcttgcagaagacattgattctgcggtgaagaaactatcagacagtgcatatgagatagctctaagccacataaagaacaatcgtgaagccatggataagctcgttgaagtgcttctcgagaaagaaactattggcggtgacgaattcagggcaattctttccgagtttactgagatccccccggaaaaccgagttccttcttcaacaacgacaactccagcatcagcaccaacaccagctgctgtctaagtaatcaatctgtatacttgtgatacttataatttttctgtaaatttatcttcaaacttacactctagaaatgtgatactatctcaaaatttagtaacaagtaaatgtttaaaaaattgaatttgtaggcttgtttatgatattgtccagatttgcaacactcaaaccgaaattcaaaagtattttcaagtagcacaagcagaacaccaaaaactgttatggaatcatgttctttatacttacaaacttatgtacatttgcttacaattaacctcaaaccattagtccctaatgcttcagagtctttaatccaacaccatcatcatctctctgttcaatgaacatccaagaatagtagcattccagagctaagcagaaaacctgaaaccaaaatattctaaaagatcaatgtttgattccaaatcagtaaatagaaaccgtaaagaagcaacatttatcaaaccttaaaggaaacgttacgcattaaatggcttcacgccacttgcaattccatcaccagctctctcgttctgctctttcttcacccacaccattgtagaagaagaagctcctctcggcattggccgattacgatatctccatttggtttgtgtcttgagagttttggcttctcctctattgatagagaagttctcaaactgtgtttctatggccattgatttggtaatctctttagatttggtcgctttcatccaataaactggaaccacatctttcaccggagtattattctccgtcacgacggactcaggcggcacgattgatgatacacaaccgcaatcgatgacatcctcaaccacagctccatcttgatttttattcgtcttgctattatatcgtttcctccaagctcccttattcttcttcttcttcttcttcggtaatccatccgccgcatcttcacctccaccgctctcgatcgccaccgtgacttccggtttctccttctcaacgaatcgtgcttctccgccgtctatagattccttttttctcccaaaatgcttccgattacttcgattcatacgcttctcctcctccgctttcttcagatcttcttcctctatctttttctcttcctcagcctgtagtttccgtcgtctctcttcttcttcctttcgcttcttctctttctcattgagccaacgctcctggagctgaaggatgctgatgtagttagccggaatcagaggaacagtctttcttttgccgtatgtgttcttctcctccattgaaatcatttccttcacacgcttcacaaacaaacctcgtcgaagctgaaatagtgaaaagcgtactgtagtaataaaatgctgaaaggaaaagtaaaaaaagagaggtcctacgcaatagcattaactttttataccgcacttccttagaggcccattggctggcccgtaacttcctttacttttttgagattttctgataattttgttgtaaagttcacaaaacataattaagttggaagcacttaagttcacaaaacattctaatgaaatcatcttgttataattgactcaagttacaaataatatgataaaacagtcaaaattaaaaaattaactaccataaacatgtaagattctaaaataaatataaatgttttattactagattcaggtgttggaagactaactaaaagggaaataaatcagacacatagagccaagcaacatttattactttttatagtatttatcattagagtaaagcttattttattaaaatcaaaccttatctctcacacacacacagaccaaggccattttctaagcaacttgtgcgactctccttcgtcctcatctgccaaaaacttcgtacgagtcgctacttctctctctatatataaactccttaccactctctttttctgattttttgacgttaagagatagaaacagagagagatagagagatagagttatg

SEQ ID NO: 25800 - DNA, 3003 bp, Unknown; identical to SEQ ID NO: 25799
  misc_feature (1)..( 3003): 2750-1469P.txt file - cDNA_ID_2708350; gDNA_ID_2214532; Annot_ID_184976

SEQ ID NO: 25801 - DNA, 3003 bp, Unknown
  misc_feature (1)..( 3003): 2750-1469P.txt file - cDNA_ID_2708354; gDNA_ID_2214532; Annot_ID_134311
acatgaaactccctctccttcaaattaaaagcctggtctaccatgcattatagctaagtaactatcaccagaattttaaagcgaaggagacgaaccaggtatcagcaatggcagagaatttggcaagttcatcttcattcaaagatgttgttgacgatgtgcttcggcttttattagaagctttgccttcaagcgtttgtattttcggatgcgaagaagaaaaagatgcagccgaagcatcagtgtctgaagtcgagaatagccgctggtgaagtaaacgcgacggaggtattattggtgaagaagataatcgacgagcagagagaagaagtctttgcagctgattcacccgtaccgacgccaacattttcgaaagagaaagcgatcacgagtttcggaaactgcggtcggaagttactgacgtcggattcgtcgtcggcgaaattgaagaagacaagtgagtgagggcaaaagtggaatgacgaattctcgaaggatgtaattttaacgggctacatattaaactatatgggcctataaactatagtaaggcatattaaaaatttagattgatgataatcagtaaaacaattagagaaaaagaaatttagattttagggttaaagttatacgctaattttcacgattgagaatttagagttgagggtttctattttaggttttagtgtatttctttttattaatttctaaaatctattttcctactttcggtataaaattttggggctattacgagaatgagtattttctaacccaaaaactaaaaattggacatttttacaatggacttatggggaaaggtactttggtgagttgggttgacgaaattacccctgccctacaatttcactcaatcaaaagccatcttcttgagtcatcttctccgacaactcacggcatctaaatgttggttctgataaactcaaaaaatcaattaaaagttttttaatggaataatattaaaccctaaggagataatttatagggaacccaaagatttcaattaaaaaaataatcaaatcaattgaggaaattagctcttaaaattttcgtttgaatcaattgagcagattagctctcaatcagaattcgtttgaatcccaaaattcgttcgattcgagaaacccagaattcgtttgataatctcgtcattatcaatctctcaaatttaagaaataagcttagatttacctaattcatttgaatcaagctcgaaacccagaattcgtttcaaattcgcgatcttatctcaccacattctcttgcttctcagcctcaccaacccttctctttacagtttgatcggacttttatagagaaaatgatgaaaattattaatgagattaggttgtcaacgtctctgcaacaatgaaatcggaaaagaaaaaagattttgcaataaaattttagaaaactgtgaaaggtgtgaagggtgaaaacgtcaaacgacgaaaatataaatacctaaatctataagccatatgagatgtacctattttcacaaaaacatagacttaattgtaccaatcccataattgatccataaaattttagtatattttataatttttccataaaatgagttcattaataggatcgcacaaagttcaaaagagtagttggatttggatatgttggtatcagtttgtttcactttcagcttgtagtatttttctaacaaaggtcccacgatcaaatgagaaatctcattcttgtatataatcattataatttaaaagatccaggtaggctttcattatagtgtgtatataaatatatcacatcggcacatacaaaaactaatatattctggatacacaaaatattagagagcaaagacattggtaataaatcttatttgaaaatttgatatggcgtgtccacaaaatctttcttcttactagagattagcgatccacaacaattagttcaaagattagcgatcccctaattcattttgattgtgtttggaagcgtggagagaaaaattgtattcgaagcattaaattattttcttgccaatagattatgagttaccacttattaccaattgattttgagttgaaattccttataaaatttgatttaagctttagatgagatgtgtgtttgtgtctacggtgcactcgaaatcagaatatattcatttctaccatcgttcatgatagctcgggcattcgaactcttaatgccctaaaaatttattttcttcatctatttattatgttggatttagtgtgttcgatgtgttttgaatgagcgatacacatgtgtaccatcatttacggaaacttgaacgtttggagtgattgattaggtaagaatcctagaacaaaatgactactacaagtaacttttttgcaaaaaccttattttatgtatttcatcttaatactaataacaacttgacttttgttctaccttttcaatttcttattcactacaattttattacaccacactaatcacaagattcacaactaatggtgtatgaaccgttgtttgtgcttcaaactttgcagcgaatattcaaactttttatctatagaaaaagaagagtgtgggggcattaaaaggagctgtctcatagttggtaatgtcaattaagaagctggcaatacaatacatgtaggacaattcaatcatcgacccatttgaatagataatgcaacccaattatttcaccttattacaaagaaaaaaatacaccccaaaatatctcatcaataagcatattatactcatgatgacttttgttaattataaaaactaatgatgctaataaccaaaatcaagagttgataaaggaagtcacgtttggagattctgtctatagtgtttcgctggaggcgttgaaacagccctctttaacagctcacttcgtttcacattcctaaattcctctcaatcttcttcttacttaacttattatataagtctctgtttctctctgacaaaaatattccaccacaaaaaaaaatg

SEQ ID NO: 25802 - DNA, 3003 bp, Unknown; identical to SEQ ID NO: 25801
  misc_feature (1)..( 3003): 2750-1469P.txt file - cDNA_ID_2708354; gDNA_ID_2214532; Annot_ID_184971

SEQ ID NO: 25803 - DNA, 3000 bp, Unknown
  misc_feature (1)..( 3000): 2750-1469P.txt file - cDNA_ID_2708356; gDNA_ID_2214532; Annot_ID_134310
gcaaagatttggctccttctatacctctagaaaaagctttgtccactgcatccttagcctattcaaattaaaaacgtgtcttgttagttttgctgggacgataaaaaacatgtaaaagtttgtgaccaataccgacctgtgtagacacaccagacgctttgtctggtgcggctgcagcctcggtcttgaccgtttcaacagatgctgcaacggttgtctcggcgtcagttagagtgctcctggcggtttggttaacggttttctcagcatcagtgagagaagccgtgacggattcagcggtgcttgtaacggattctttggcttcgctgagagccgaagttgccttctctaagaattgagccatttttttttgtggtggaatatttttgtcagagagaaacagagacttatataataagttaagtaagaagaagattgagaggaatttaggaatgtgaaacgaagtgagctgttaaagagggctgtttcaacgcctccagcgaaacactatagacagaatctccaaacgtgacttcctttatcaactcttgattttggttattagcatcattagtttttataattaacaaaagtcatcatgagtataatatgcttattgatgagatattttggggtgtatttttttctttgtaataaggtgaaataattgggttgcattatctattcaaatgggtcgatgattgaattgtcctacatgtattgtattgccagcttcttaattgacattaccaactatgagacagctccttttaatgcccccacactcttctttttctatagataaaaagtttgaatattcgctgcaaagtttgaagcacaaacaacggttcatacaccattagttgtgaatcttgtgattagtgtggtgtaataaaattgtagtgaataagaaattgaaaaggtagaacaaaagtcaagttgttattagtattaagatgaaatacataaaataaggtttttgcaaaaaagttacttgtagtagtcattttgttctaggattcttacctaatcaatcactccaaacgttcaagtttccgtaaatgatggtacacatgtgtatcgctcattcaaaacacatcgaacacactaaatccaacataataaatagatgaagaaaataaatttttagggcattaagagttcgaatgcccgagctatcatgaacgatggtagaaatgaatatattctgatttcgagtgcaccgtagacacaaacacacatctcatctaaagcttaaatcaaattttataaggaatttcaactcaaaatcaattggtaataagtggtaactcataatctattggcaagaaaataatttaatgcttcgaatacaatttttctctccacgcttccaaacacaatcaaaatgaattaggggatcgctaatctttgaactaattgttgtggatcgctaatctctagtaagaagaaagattttgtggacacgccatatcaaattttcaaataagatttattaccaatgtctttgctctctaatattttgtgtatccagaatatattagtttttgtatgtgccgatgtgatatatttatatacacactataatgaaagcctacctggatcttttaaattataatgattatatacaagaatgagatttctcatttgatcgtgggacctttgttagaaaaatactacaagctgaaagtgaaacaaactgataccaacatatccaaatccaactactcttttgaactttgtgcgatcctattaatgaactcattttatggaaaaattataaaatatactaaaattttatggatcaattatgggattggtacaattaagtctatgtttttgtgaaaataggtacatctcatatggcttatagatttaggtatttatattttcgtcgtttgacgttttcacccttcacacctttcacagttttctaaaattttattgcaaaatcttttttcttttccgatttcattgttgcagagacgttgacaacctaatctcattaataattttcatcattttctctataaaagtccgatcaaactgtaaagagaagggttggtgaggctgagaagcaagagaatgtggtgagataagatcgcgaatttgaaacgaattctgggtttcgagcttgattcaaatgaattaggtaaatctaagcttatttcttaaatttgagagattgataatgacgagattatcaaacgaattctgggtttctcgaatcgaacgaattttgggattcaaacgaattctgattgagagctaatctgctcaattgattcaaacgaaaattttaagagctaatttcctcaattgatttgattatttttttaattgaaatctttgggttccctataaattatctccttagggtttaatattattccattaaaaaacttttaattgattttttgagtttatcagaaccaacatttagatgccgtgagttgtcggagaagatgactcaagaagatggcttttgattgagtgaaattgtagggcaggggtaatttcgtcaacccaactcaccaaagtacctttccccataagtccattgtaaaaatgtccaatttttagtttttgggttagaaaatactcattctcgtaatagccccaaaattttataccgaaagtaggaaaatagattttagaaattaataaaaagaaatacactaaaacctaaaatagaaaccctcaactctaaattctcaatcgtgaaaattagcgtataactttaaccctaaaatctaaatttctttttctctaattgttttactgattatcatcaatctaaatttttaatatgccttactatagtttataggcccatatagtttaatatgtagcccgttaaaattacatccttcgagaattcgtcattccacttttgccctcactcacttgtcttcttcaatttcgccgacgacgaatccgacgtcagtaacttccgaccgcagtttccgaaactcgtgatcgctttctctttcgaaaatg

SEQ ID NO: 25804 - DNA, 3000 bp, Unknown; identical to SEQ ID NO: 25803
  misc_feature (1)..( 3000): 2750-1469P.txt file - cDNA_ID_2708356; gDNA_ID_2214532; Annot_ID_184970

SEQ ID NO: 25805 - DNA, 764 bp, Unknown
  misc_feature (1)..( 764): 2750-1469P.txt file - cDNA_ID_2708367; gDNA_ID_2214548; Annot_ID_134615
ttaaatccaagaaaattgcttcatattgcatgactcatgagtatatacacatttatagctggaattagtattatctagttcatgagtgtatacatattttatagcttaatgttttatattatctacctaataaactttcattcatatggtaaactagatatagaactaattactaatgatggcagttaatgaaacagttaactatataagtttgtagaaaaattaaattaagttttaacgtatagatattcatgtgaacaaataatgattattaatacaaaaagttaactaccacatatttcttaatgaaacaggtaactagaccagttagtagaaaaatttaaattaaatactcatgagaacaaataaatgattagtaatacaaaaagatttaattttacattttcttttcccagtgtctaccacaaaattctaacactttttttctgattgcctaagcatatatcgactacaagtataggaaattaagccttaacgttgtagtattaactttctacgatagagaagtggaaacttgagccatgtaaaatgaagcaatttcttggattcaactttattgttcaaacaaaaccaaatcgatctggtggtccatttaaagtttttgcatgcatatatgttcgtgatttgaccattaattaacattcacatgattaatctctttataaataatccttcagccttgtactctttcttgttcctaagcaaaagcagagttataagcccaaagacaataataaaaaatg

SEQ ID NO: 25806 - DNA, 764 bp, Unknown; identical to SEQ ID NO: 25805
  misc_feature (1)..( 764): 2750-1469P.txt file - cDNA_ID_2708367; gDNA_ID_2214548; Annot_ID_185481

SEQ ID NO: 25807 - DNA, 3003 bp, Unknown
  misc_feature (1)..( 3003): 2750-1469P.txt file - cDNA_ID_2708406; gDNA_ID_2214533; Annot_ID_134331
aatgaaaatcacatttcaatacttttttaaaaatgtattcttaaagagaagacgcaaaaagtatttaagtgtacagtgaacaaataagattttgttttagtggtgaaagagaaaaattacactatatttctaaattagttttttttctttcttttcggtttttgaggtcatttaatcagataattcgaaaatatttaaataacttatgtactaggataaaaagcaaacatttttttttggtatgaattagtagtagagaatattacgtgattagacacttttttaaaagtttgttcctaattaggcactttaaatggagaagtcactttagataaattattttacttatttaccctttaactacattttttccatcggtcatttcttctctctccttttcccatctcttctctattttttttttttctcactttatcgaagaaaaaaacatttcccagaatatcttcaattccaaatctgcaattaatctccaaatccactctacgcgatggctttcttttttctctggactaattagagaatatgaggtcttggtttctttaagattgtaatttattttgcaatttaaatatttgttttgatataaatttgagattcaattatctaagaaacatcttcttcttcaacaatggcggcttgatttgatttttgctctctctcatgtgtcaaactcgtttcatctatgtagcatcgagattccggttaatcgaatttcctgttattatggacatgatatacaaaatggatatagaacagtaaaaaggtttccgaatggatatatttaaatggactcgttattatggacaccaaaccattgtttgttgatttttctttcggtttgcagagacctctaccttcaaaaccttatggacatggaactttggtttctttacaaaacacggttaatcgaatctcctgttattattgacatggtatatagaatgaatatagataagtagaaaggtttttgaatggatatatttaaatggattcgttattatggacaccaaaacattgtttgttgatttttctttcagtttgaagagacctccacttccaagaccttatggacatggaactttggtttctttacaaaccacggttaatcgaatctcctgttatatggacatggtatatagaatgaatatgaatcagtaaaaggttttctgaatggatatatttaaatggactcgttattatggacaccaaaaaattgtttgttgatttttcttacaatttgcagagaccccacctccaataccttatggacatagaacttttaccaaattcctgagataatcgagatcaaattgtttaagaaacttctccaaaagttatggagacgtggagagagagagagagaggcgctacaaatcatggagagagagagagagagattttatttattttgggtaaggatcgtggaagaggaataacaaaaaagagaaattaagaattaaaaacataaatattgaattgagggtaaaaaagtctttaaaaaaaaagaattaatagaaaaagtgtctatttcctataaactgcctcaaacggaaaaacattctctaaaagtgcttaatagtggaacattaatcgcatgacaatataataagacgtaaaatttttggtcttatcatatgcaaatacttattaataaggaaattttggtcttataatattgcaaaaactgatttttctttgtttactattcatccctatcacaattcacaacattaacaaaaactttctaatggatttttcttcaactctagaacattgcaattccttttcaactctagaatatcaaataccgtttaaaagacaaaactatcagttaatgatgtcacaaattactcaaaaaattaacactctcttaataagaagaagacttgtattttaataataagaagacctcgtgtgaaacgagatcaattacaactttatgtattagactttttgacaaattcacaacggtcatcaaatggaaacaaacaaaacgaaggctcctcttcaggctctcaacggtcacttgcttagaagctgcgactacgacaagcaaaaatactcatccaatgaaaacgacgacgtatagaacctaacggtcgttttaaattctttaagattctatttttcatttaatttaaaaaggagaagaaaaaaaaagtgagtcatcaatgaaacacttctttaacacagatacgttacccacatgcccaattattagcattcgtttccttttagacgtgtttttgacttcatttgaaatgtctgttttaacctcacagagcaaacccaataaatcgcttacttcatcgttttagctattttagactgtgaatgaccgttttaccctccaacattctcttttgtactatctgctgtgttttattgaattttattctacgttacaaagggcctttcttcttatttgcaatactcctctttttgtttatgatagttctagtctactagacataatttgtttttattattaaattgacataaagttaccaaaaattgaatgattcttattttggttatgaaaaaatattggaataaaaaatctcatggatatatacatttttcattattaagaaaaaatgatattttcctttattttgccaacaaaaaaaaactggtcaacaagagtaggattcaagctaattttgttttcctcaaaataatatccattttgtagaaagtaaaaggacaacataaataaaggaaatgaaagttgtaagggcataaatgttatttacaaagtcaaagagactgaaaaactttgaataaagctcgataaacacggactctaattcattcaatattcattaccttcttctttcctttatatttaaaaaccttcttcttctctctctgtacatcgtcacaacaaaaaaaaaacagaaggagaagaaacaaaaacaataatctcagcaaaaacaaatctctactcatcgaaatcgaaatcaaaatatagaaacgatg

SEQ ID NO: 25808 - DNA, 3003 bp, Unknown; identical to SEQ ID NO: 25807
  misc_feature (1)..( 3003): 2750-1469P.txt file - cDNA_ID_2708406; gDNA_ID_2214533; Annot_ID_185010

SEQ ID NO: 25809 - DNA, 3003 bp, Unknown
  misc_feature (1)..( 3003): 2750-1469P.txt file - cDNA_ID_2708417; gDNA_ID_2214516; Annot_ID_133951
catttgtgagagttaagacagagttaggtctgctttctgatttcacatgaacttatcgtgagagtttcttactaaacaattcacacactttatatgtatgcgtgttaaattttggtgagaaaaatgttagaagaaaagcaagattacgcttttatttaaccatcccctgattatcaaattctcgttatcaaaaaaatagttgccgataatatcttcacttgtctatacacatttaaataaaattatttaatttgaacagtcattattgtcagttggatgaggaaccctaaagataagaattattgccatttaagtattgataaagatatttaattaattgtaacttcagtgaaatttcatagaaagaaaaatatatattcatttgtttggttcttatcataatggtcccaagaattgctgcaccaaatggttgtatctcgaggcatcgatgccattacggtaaaagcaaatggtaaagtagctcataaagctacactccacaacatcaataccaatttaacattttcagatattctaattttttagctaacgtctgaattaacatattctaatttataatatgaagaaacgtaaatatttgaacatttatatccttaataactgcttagatataggagctctaaacataatctacactaattttcgcatgtgattatgcaaatatcaatactttgatgataaactattagtttgattaaagaatggcagtgtagtgatagataagttatctctaaacatagaaagagttggaccaaagtctcattctatcgctttcttttttcccatctatttgaatatttgactattcaggtggatattattctcgtataagaagttaaatatataattaactaaaattgggttcaaatatcttttattaattaagattatagtgaaacatgattttttttgtcataataaatctatagtgtcaagttcaatgtaaaatattttaagtcaaagtgaaatcatattaagacaaccgaacaaccacacaaaaaaatacataaaccattttgttttcatttctttatattcaaactaatcatcaccaaaataaaacctaacaaataaaggaagtgaaccttgtaatttaaaccttacttaacccctttatcagaataaggttttaattttaatgaaatctcacaaataattttttttctttctttcaccttaaattgactccaaacaaaaacggaaaccatgatgagccaaactaactgacatattcattactatatcttatttgttttgaattttaaaattaatagaaacctaaaagtaactctagtttttatgaacttatctctatttaacataataataactggtgtaatagttagtctttcgtataagtatggactgacatttgtttcttacccaattctagaatcacaatttaaaaacgtaggtttgcttcttcacttgaacaaacttgaaaaaaaatttcatcatttaactaagctcacttttaccaatcaacatatcctgcatactatttttcaccattacgatatatttatgtcgactaaaggaatctccaaggctaaacactattttggtgttcaaattacaccatttttagcactaaaacttctgttctatccaaccataacaccaaaaatcacactaaaaaaagaatctattattatataatttatttaaaagattttttttgttatttaatagttttgattagtatttattattagtataggattacataacattataaacatagtatattaaaatatatatttaaaaatacataaaattgtaattattttaagtattttcatacataataatataaaaatatcataattaaataaactatttcaagagatataatatattaatgtatccattcatttttatattttatatctattaatcatttgtaattttatatttattaattgaatttttattgatataataagtgaatagtgtttagagttatgaatagtatcacaccaaatttgatgtaacactgtagcattacactaaaatggtgtgaattttagagttccattggaaagcttttagtgcaaaaattacactaaaatggtgttttagagtcccattggagttggcctaagtagaaccactgaaccaatgcaacaaagttagacatatattataataatagacctctatctatgctatatatatgtaattttgcattaaataggccagtgtttgtggataactatcacgattaaatagtgctaatcatgtttaaatagtggtaaatttacccatcaaaaacaaaacaaaaaagattaaatagttctaaataacaaatattacagcccatcattagttgtcttgttacaaaggtagatgatgtagcaatagactaatagtacccattatatcgaagataaattactattcaactatacaaaactatacaattatatattatcacctttttttgttaggtttcttttgctgtttaattattattattcaaaaataaactctcaaaacattatcttatttaatcaacgcaacaaatatcgtaagcaaacatgctaaaattaaccactgtaaaacatatatttgtttctgtcgaacattttaataaaatattcttacaagactatttcaaaaaataacaaaaatataaaagtgtttgtcaacgaaaaataatttttaattaaataaggaaataatataataaaaaggtataaagtaaacttgaaatcggaaaaaaactaaaaaaggagaaagaacaaagcaataaatgaaaacctgcaaagtttcgtctttgcaccaaaaaacacatcaccactctcttcctctctttcctcacttcgctctttcttcttctcctcctacttcccaacttctctcctctctcttcacattattatattctctctgtttcttccaatccaatccaatctctctctctctctctctctcagaaactaaactgaaatattgcagagttttgaatacacggccatg

SEQ ID NO: 25810 - DNA, 3003 bp, Unknown; identical to SEQ ID NO: 25809
  misc_feature (1)..( 3003): 2750-1469P.txt file - cDNA_ID_2708417; gDNA_ID_2214516; Annot_ID_184443

SEQ ID NO: 25811 - DNA, 3000 bp, Unknown; identical to SEQ ID NO: 11773
  misc_feature (1)..( 3000): 2750-1469P.txt file - cDNA_ID_2708428; gDNA_ID_2214516; Annot_ID_133952

SEQ ID NO: 25812 - DNA, 3000 bp, Unknown; identical to SEQ ID NO: 11773
  misc_feature (1)..( 3000): 2750-1469P.txt file - cDNA_ID_2708428; gDNA_ID_2214516; Annot_ID_184444

SEQ ID NO: 25813 - DNA, 3000 bp, Unknown; identical to SEQ ID NO: 12152
  misc_feature (1)..( 3000): 2750-1469P.txt file - cDNA_ID_2708443; gDNA_ID_2214534; Annot_ID_134349

SEQ ID NO: 25814 - DNA, 3000 bp, Unknown; identical to SEQ ID NO: 12152
  misc_feature (1)..( 3000): 2750-1469P.txt file - cDNA_ID_2708443; gDNA_ID_2214534; Annot_ID_185036

SEQ ID NO: 25815 - DNA, 3000 bp, Unknown; identical to SEQ ID NO: 12157
  misc_feature (1)..( 3000): 2750-1469P.txt file - cDNA_ID_2708446; gDNA_ID_2214534; Annot_ID_134341

SEQ ID NO: 25816 - DNA, 3000 bp, Unknown; identical to SEQ ID NO: 12157
  misc_feature (1)..( 3000): 2750-1469P.txt file - cDNA_ID_2708446; gDNA_ID_2214534; Annot_ID_185028

SEQ ID NO: 25817 - DNA, 3003 bp, Unknown
  misc_feature (1)..( 3003): 2750-1469P.txt file - cDNA_ID_2708454; gDNA_ID_2214534; Annot_ID_134343
acgtaataggttgttttctttatgttaaatttagtatttgggacgaggaattgcgggaatccaaggacctacatatgcaggttcaggatgcttccacactagaagagttatgtacggtctatcaatagatgatttagaagatgatggaagtctttcttcacttgcaacaagtaagtactacaggcgaaaacaaaaatgcatatatcattaaaccaatattttagtattgaaaattctatttctcttttttttttttcaatttattctaacacttaaatctatgttctgttattcttctaacatgcaatgtatagtacttttgtgattcatcgttatataatacgttcagtaattttattattcaaataaatcattttaatggtattgttgttatttcattaagggaagtatttggctgaagagaatttagctagagaatttgggaactctaacgagatggtgacatcggtggtcgaggcattacaaagaaaaccaaatccgcaaaatacccttgcaaactccctcgaagcggctcaagaagtgggacattgtcattttgagtaccaaactagctggggcaaaactgtaattagatttaaactatatcacagtagactattaatctaaactcaaattttcttcttattcatagtaatgtcatttgtaatgcataaaatcctgcagattggttggttatacgaatcaacagcggaagatgcaaacacgagtatcggaatccattcgagagggtggactagctcatatatatctccgaaaccaccagcgtttcttggggctatgccaccgggaggtccggaagcgatgctccagcagcggcgatgggccacaggactgctcgaagtccttttcaacaaacaaagtccgttgatcggaatgttttgtaggaaaataagatttcgacaaagcttggcttatttatacattttcacttggggtctaaggtcaatccctgagcttatttattgtctcttgcctgcttattgcctactccacaacgctgccttatttcccaaggtgactctctcttagttctttctgtctcttcaacttcaacaaattaccgaaactcaatttggattatgacatggtgactgaactagcacaaccactaaattcttaatttgtatcattttctcattagtatagtttctatttatttcatataattgattaaaagggaaatgtctaatgttttattttgtttgtggctctagggagtttatttaggtatagtcgtcacacttgtgggaatgcattgtctttactctctatgggaatttatgagccttggtttctcagtacaatcgtggtttgcctcccaatcattttggaggataaaaaccacttgcagttggttatttagcatccctgatatcatactcaagctacttggaatctcgaaaactgttttcatagtcactaaaaagactatgcccaagacaatgtcaggatctggatccgaaaaatctcaacgagaagttgattgtccaaaccaagattccggtaaatttgaatttgatggctcgctttatttcttgcctggcacatttatccttttagtgaatctagccgctctagccggttgttcggtgggtctacaacgtcacagaggaggtggttcgggtttagcagaagcttgtggatgtattttggtggttatattgtttcttccatttctaaagggtatgtttgagaagggaaaatatggtatcccatggtctactctttctaaagctgcctttttagcagttttatttgttgttttctctgtgggaaactagtatactgatatggctttaatttgtagctaaaaactgctaatatgaaaataattattctctaatatacctctggctaaattttagtttctttgatacaaaataaatctaggactataaattcgtaaatagttgatgtacattctgaagtagtgagtagcgtattacttccaaaacaactgcatcgcctcttctacggctttgtctcgttctcacaattattagcttatatccatataagacactatttatttgactgatcaaaaaaaaaatacactatttatctttgtgggttttaaaactatgacaggacctgattgattttgtttttgtaagattcgtggtttttcgatttcatgaaaatgactcaatgatttcatcctttctacttttggggtttgaagtcaactgtttatgtggacgttatttttttgaaaatttaagagataaaatagggcatacgaagccaatatctagataagtgatttaggaacaaaaaccaataacaaaatgaagaaacattacttgacttcattttgtgtgtgacgagtggcgactagtcatcattcaccacaaagcgcaaacttgaatcaggagtaagaagacatactttatcgttatcctaatttgaatcggaccacacaataacccaccacaaatagacaaagatacatatattattgacaatcttttattatataagataacgttctatataattgaattgttttattaataacgaaaaaaaaacgacttcgatatgagtaattaattcgttgaaaaaagtttcttcgggtctagtttttttaaacttctaatatgatattaaaaaccaacatgatagctttcacttgatggtaacttaggatcagtatagtggtggtatctatctacaagtttaattccagtttacgtgaagttcataaattttattggtcatatcaatgtgtacaataaatatacgttttataaataaataatatttgcattttttattcatgtatctaaataacaaactagtccaatttcacttgactatgacctctttgttcttttttttgttaatagttttcacaaaaaaagcttactcaattttatatcttctcatcactcctttttattataagtgtatacaaattatatatatattttttacttaattcttagaaacatatccaaaaacctcaagaaatctccttccatg

SEQ ID NO: 25818 - DNA, 3003 bp, Unknown
  misc_feature (1)..( 3003): 2750-1469P.txt file - cDNA_ID_2708458; gDNA_ID_2214534; Annot_ID_134342
aattaacagaagcgcggatatctttgatagcacctggccaatcaaggccatccattagatgctgtgcctctgcagtatccaaaccaacctttcctcgatacaagctacaaaatataatattgtgagacgatactcaatgaaccataatttacaaaactgaatcttgcagttaaagaagcactcactcaggtataagggctttgaatccaggctcaagttgtgagattttaatagcatggttcttgatctcaaagtcaacaccccaccattcttgaatcaccacaatcccaggcgcatcatctttaccgaccacataggcatcaaatgtctaaccaacagaccacagtgtataagttttctttagagtaaaatcaagattatagaagaatcatacacaaaaaaatagctaaatcaaatgcatttttcacaatcctaataatcaagaaactccaatgttcaagagaaaccagtctatccatggagagagttacaagcaaagcataacatcgccgaaaactctgaccaaaacaatacctaaactgtttatcactatactgatcatttgtgaactgaaacctaaactcacaatcttccttcttaaatcaaccagttctataaccaaacctgataaggactatgattatacggagatcttcagaagtagctaagcaataataacatctcttactctcattcccagtttctctaccacagaacaacactacacaatcctgaagcagaaacgccattgaaatgataaatcaaatataatccatacatcatacacaacagattccgagatttgggggatatcaaaagaaatgatgattttcattcaacggaaaggataaccaaaatttttttttacttcaaaatcaggcactacggatacagtcgaagcttatgatacaccaaacacaaccataaaaatggcactaagtagaaaaaaaactcagggagagacaaaaaagagaagctcttacagtgtcatctctttggatctgaattttcctgaaagctgaatccgccattgatcgcactgataagcgagaaaacgaaggaatcgaggatctatagagcgaagaagtttttccgattgaagaagagaagaatctggatgaggatgacactagtgtacttaacattgtttttgtgtcttgtgaggaaagaaattcttcagagtcaaccccaaacgacacaaaaacgacgacgtatctgtgagtgtgaatctgggcccggtatatttttaaaaatatatgggccattaggcccaaataatcaagtccttttttgtatttgtatttgtatttgcgacgacgataatacgtaaatagtagtttggtaatatccaaaaagccagcatcgcctctgctacggcgttgtctcttttctcccaattattagcttatatcaatataagaaattattttttttgtggattttgtaaccatgacaggaccagcttgattttgtttttgtaagattcgtggtttctcgatttcatgaaaatgactcaatgatttcgtcctttctatagtattttgggttttaaagtcaactagttgacttcaaaacccaaacttaacgtccatatatatacacatacacagtactgtattatgtgtatatatatggacgttaagtttttgaaaataagagatatatagggcttacgaagccaatatctagataagtgatatcggaacaaaaatcaatcacaaaatatctaccaagagatgtcatatgtgatacgtattaactttatatacatatgattagttccatgaatttgaatttaaaaggtatagtgcatgtatcaaagggcatatatagccacatctcaattgggataaatgaaagagttcatcacgtttcttttcaattcccaaaatggcgatgcgaggaaataaaggcaagttattgatttcgctttctataataattttaaatttttgttgtataacaatgataaagaaacgttcttcaacaacaacaaaaaaatgttacgtacgtgactttaatttgcgtgacgactactcatcattcaccacaagagcaaacggaataaaaagacaaactttatcgttatcctaatttgaaccaaaccacaaaatagccaccacaaatagacaaagatatacatacagcgagacacatcatgcaaaaatgtatatatgtagcttagtggatcattaataatgtttagagaaacgatcgaatttaatgagacttattttcgttgaaaaagttttgatagggtgtaacttaatatatagtatcagtctagtgctaaacatctataagttcaaattccaatttctgtgtatattttggcctccattctacaaatctatatttatttaccacaatgtataatctagacatacaatacgttttacaaaaaaataatatgtagtacatacaccatttgtgaagtcatgtatctatttgacaaactagtccaatggaatttgactatgactaatttattattgtcctttctcttgtgtatctttttttttcttcctaactaaacactactacacattatgggttgattggtatccaataccgctgtagtatggagtatattgctttgataataatcaatcaaaggatgctactaaaaacgatattttaagttttatgatttttttttctttcgtaccgctactttatatcgtttttaaactatttttgtatctcttaccgttttttctacttgctaaaaaacttatacgattttgtgtggccaatcggtcctatattttatatatacaagcattcatagacgtgacgacgcattattttacttaaccctatataaacatatccaaaaaccgcaagaaagctcacaagaaatctcctcccatggcagattcaagttcttctctccctcctctttgcgagaagatctcatacaaaaactattttctaagagttgtggatctcacgattctaggctttctcttttctcttctcttgtaccgaattctacttatg

SEQ ID NO: 25819 - DNA, 3000 bp, Unknown; identical to SEQ ID NO: 12171
  misc_feature (1)..( 3000): 2750-1469P.txt file - cDNA_ID_2708481; gDNA_ID_2214535; Annot_ID_134364

SEQ ID NO: 25820 - DNA, 3000 bp, Unknown; identical to SEQ ID NO: 12171
  misc_feature (1)..( 3000): 2750-1469P.txt file - cDNA_ID_2708481; gDNA_ID_2214535; Annot_ID_185064

SEQ ID NO: 25821 - DNA, 3000 bp, Unknown; identical to SEQ ID NO: 12170
  misc_feature (1)..( 3000): 2750-1469P.txt file - cDNA_ID_2708489; gDNA_ID_2214535; Annot_ID_134366

SEQ ID NO: 25822 - DNA, 3000 bp, Unknown; identical to SEQ ID NO: 12170
  misc_feature (1)..( 3000): 2750-1469P.txt file - cDNA_ID_2708489; gDNA_ID_2214535; Annot_ID_185066

SEQ ID NO: 25823 - DNA, 3000 bp, Unknown; identical to SEQ ID NO: 12193
  misc_feature (1)..( 3000): 2750-1469P.txt file - cDNA_ID_2708511; gDNA_ID_2214536; Annot_ID_134392

SEQ ID NO: 25824 - DNA, 3000 bp, Unknown; identical to SEQ ID NO: 12193
  misc_feature (1)..( 3000): 2750-1469P.txt file - cDNA_ID_2708511; gDNA_ID_2214536; Annot_ID_185103

SEQ ID NO: 25825 - DNA, 3000 bp, Unknown
  misc_feature (1)..( 3000): 2750-1469P.txt file - cDNA_ID_2708519; gDNA_ID_2214536; Annot_ID_134385
caaagcagcgtcttacaagaacgtattctactatttgtcctacaaggacaaggatttgtcagtaccaaactccgatcagacaaacacctgcggtttgtggaaatggaaaagctttgcgcggtggtggagaggcgttgacatcggtaatgtcgaatgcgagggttggcgcgtttttcttgataaagaatcttgatacagggaaagagtttatagtgaatgagtatgatgaagatggaatgtggaataggcttagtgatctgcaaacagggaagcaattaactttggaggagtttgagaaatgtgttggttattcacctgtggttaaagagcttatgcgtagagagaatgtgaataggattaactacgaaccgttaatggatcttcgcaagtttaattcgtatctttccaagagtgtgaggttaagtaagagaagaggagctgcattgttgaagaacattaaaggtgtagctcattccatgagtttacgcgttgcggataaagatgtaagcgatggaagcactgatagtccgaaaaaggggaaagatcataaacatggtaaagctaatgagtgggtgaaagttagaccaacagggaaatcttacaaggagttaagtgctttacatatgtgtcaagagattcaagctcatgagggtgcggtttggactatcaagtttagtcaagatgctcattatctagcgagcggaggagcggatagagtcattcatgtgtgggaggttcaagaatgtgaactaatgtctatgaatgaaggaagtctcactcctattcatccttcactttgtgactcttctggaaatgagataactgtggtagagaagaaaaagaaaggaaagggatcatccgggagacgacacaatcatattccggattacgtacatgttcctgaaacagtcttctcgttttctgataagcctgtttgctctttgaaaggtcatctggatgctattttggatctttcatggtccaaatctcagcttcttctttcatcttctatggacaaaacagtcaggttatgggatatagaaaccaaaacatgtctcaaactgtttgcccataatgactatggtaagacaaatcttttgtatcctatcttcacatctagctattaattttctgcatgcacttttgactatattgtctcattgattcaacagtgacatgtattcagttcagtccagtggatgaaaattatttcttaagtggttcacttgacgctaaaataaggatatggagcatacaagatcgacatgttgtggaatggagtgatcttcatgaaatggttactgctgcttgctacacaccagacggtcaggtatttgctctgtttttttgctctgttttttgctctgtttcttggagtagtctacaaaatccatccattatggtgtttttataatgatggaagttttggttttttcggttgaagggtgcacttatcgggtcacataaaggaatttgtcgtgcttacgatacagaaggttcttcctaagctctttctgtatcaaacatcatgtttaccagttgaatacttcttttcattgcgacgcgcttttttcttctgtagaacagattgtaagctgagccaaactaatcagattgatgttcagagcaacaagaaatcacaagcgaaaaggaagatcactagttttcaggttcctttctttaaaagccaaaatccttcttaagactttagtaaactaaaatgttaacaagttgttgatgccattatatagttttccccggtgaatccatctgaagttcttgtcacatccgctgattcacggattcgaatactagacggttctgaagttattcacaaattcaaaggtaaattctctacaagcactagagccaagatgaacaaaaacaaaaactgatactttttgttgacaggctttagaaacacatgtagccaactctctgcttcgtatagccaagatgggaaatacataatatgtgcgagtgaagactctcaagtttacttatggaagaatgactttcaccgaacaagatcaacactcacgacacaatctcacgaacattttcattgcaaagatgtctcagccgctgttccttggcatggtcatgttagaggtgagccaccaccagttcagattcactctaaacgccactcaaagcgcatatctacttcaagccagccttcatccaccataagctcaccaacaaaagaagaaacctcggcgactggaccaactacatctaaccggaataaaaaatcagggttacctccaatgcctaagaaagccgctacaaagagtcagattcaaccagaggaagaggcaggaccggagctgggaagcagtgagtcgtttcggtcgagtatgaactcttcggagcagcattcatcgaggtttggggaatctccatcgataaacacatcgtcaaggttatcttcttggtcatggttcgacagtggagggcatggtccgcaaactatacagccaacggcttgggggatggtgattgtgacggctacagttcatggtgagatccgatcttatcaaaactttggtttaccgagaagaatcggtcgccaaactactctgttttgattttaaaaaggaaggaaccggtgttttatttttcttgatttgtatctttgttgcttgtagagtacgtaaagaaaccttcttatacagaaacaaccgtcttatagtgttgagaaacctctctcgacgttcaaaatattgagttgtatacacagagaaaaatttgtgtagttctccaaatataaatcaaacagtaaaactatgttacttcaattaattagatgttcttcgatcattcgtgggagataggccatggcccattttaaaatcaggcccgtttaaagcgtaattagaatgaaacaaaaagacaaatataattcaaaagataaggtgacgtggcgaaaatcggaaattttgcgatatttctcactctctcgtcttcttcgtctgagctatcaaactccagtcaatg

SEQ ID NO: 25826 - DNA, 3000 bp, Unknown; identical to SEQ ID NO: 12186
  misc_feature (1)..( 3000): 2750-1469P.txt file - cDNA_ID_2708530; gDNA_ID_2214536; Annot_ID_134374

SEQ ID NO: 25827 - DNA, 3000 bp, Unknown; identical to SEQ ID NO: 12213
  misc_feature (1)..( 3000): 2750-1469P.txt file - cDNA_ID_2708536; gDNA_ID_2214537; Annot_ID_134409

SEQ ID NO: 25828 - DNA, 3003 bp, Unknown
  misc_feature (1)..( 3003): 2750-1469P.txt file - cDNA_ID_2708540; gDNA_ID_2214537; Annot_ID_134412
gaaaaaactaacccaatttaggaaatctctctcgaagtaactcctccagaactcgttggtcaacctggggaaagtaaaatgttttatgatgagattactagtcggccataaaggataggaaaatactgtaacaaaaagattactattttacctgggactcgagcatctcttctgaataataatcatggaagtagtcatcaatgattcctgtaagcgaccttaaaatccgaagtaatatttagttaacttacatgtttgttaagaagagatttgaggaatgggctaacagtagttaatattcaaccaaaagaaaaggaagtcatagatacacgaacttcacacagaaccaaagagttggattttcattgacaaacaataatacaatattaggagttagagagtagtttccgaacataccaaaaagcattctcttcgggcatcagaagtaataaaagtgcagcgaagaaattcattgcctgcacatgatttattgatacaagataacaaataactgagatgttcatttttgtgagcatgtaaccatactaggatacagaagtgacagtattaaataaccgaatacctgacagtatccaacagagggattatgcctggcataagcagttagcaatcgcctcagagcatttctgaaatcatcatctagggcaggatgacctggaaatgtccggggtaaatcctgtaattgaaataagcaacagctgagaaaaatgaccaagatcaacaggagtccagtactgcaccattagttagaaaatgctggatgccaagtaatgtacagttgctaaccttttctatctgacctttccatttttccacaacagagagggggtctgtacttgaacctttctcatctgtatgctgcatgagctcctgctctatgtcgtttcctagactatctgcagctaatagattttggtaataattcttgacccgacgtttcttgactcccgcaaatgcttgccagagctgaatatttgtatatatattttcagattattgagcagaaaataaggataataagaactaactatcaatagcaggagaatgctagaaaagagaatgacaggatttattacctcacccctcagagccataggtgcaccgccatgaataagaacttcaagttcgtctttccaggggcatgcagatactagggaagctgcatcagcagcagcagacatgctggagacacttgtgccatctgaagaaccatcctgaattggatctgatctctccgcatcatagaactcgtcttcggaatcattctcacatactccctttgaagactcggtctcatcagttgaggctaaggaattcaatttctgagcttcttgctcgccatttgtggaatcccccttcattttgacacggacactcatcaagtcctcaattgcttgaagagatggcctgatctcagcccataactgaactttgtgcacattcttctctctattgggaacttcatcttcctctctcgcattcccaggagttaaatcagaacctggcttgtcagcattcagatcttttctttcagcacccttgtttaattccttttcttttttcttgtcactttcacttggattgacatgagtattttcagacgatccattcgtaggtgacacgccagattctgcatgaaattccaggaaattgctccaccttgccgacctctccacttcttcctcctgcagtttatcagtaaaaaacagcattagaatgttaaggtgaaacatcgagtgacagtgactgcgtcaaccatataagaaccaaaaaatgacttatgatatatgaagcctttcgatattgattaaaccaagaccactaagtaaacttctaagttaagtccacttctgaaatctttcacacagctgtaacaaagctactttaatggatcaccaaattttagacaaaccttccttttttcctaagaatgccagtgtgcactcaatcatgtaaaagaattttccgagtagaaaataaaagttatggagatagaaagaaccttgtagatattaacatattctcggtatctttgcacatgctgaggcctcacagaaaatccatatgcatccctgttcataaaaccaacctcattaacttccctaagtactaagaatatagatgaaatcaagatcaatgatcactagattctcaactagtgatctaaaaagacaacattttgctcagcaaatcgagagcagagagattaactgagaaaccgcaatttcaaaaaacaaattccatcaaatgtagtaaattagaaacaaaaacacaacgagataagcaatgtagcaatggagaagctcgaaaggcgataccttttgtggtcagacttagaaacggcgtcggcgatcataattccttagttggagaacgagatctctccgaatagaggcggtgatagttgaaagagatggctgagcgcagaagaagaagatccggtggagcaagaagcaatactactaattgaacatcattacaacacgcgactgaagttgaaaaaaaagatgaaaagttactacagtgtcggagagagagacgaagaaaaaggtccgagattgtagaggacgttattgcatcctttaattaatttatatacttatcatcaaatactcgaaacctttgtccttcttttgaaataaacttatactggaaattaataattttgggcctaaatcaactagagcccatttgtttcatgtttgattaaaagggatttatataccctattgagtccacgtcacaccgtcgtcgttaatcgtggattaatttgttttgggcctaactgaactataaatccacttgtttagtttttacggtaaagtcacttttgccctttagaatccaccaaagtcgccactgtctttcccaatttctttgaacttttcaggtacccttaaacttcatcttcttcgatttttaccatttttttcaatttgcaatcagaaatcgaagcgatccaaattagtaagctcgcccatg

SEQ ID NO: 25829 - DNA, 3003 bp, Unknown; identical to SEQ ID NO: 25828
  misc_feature (1)..( 3003): 2750-1469P.txt file - cDNA_ID_2708540; gDNA_ID_2214537; Annot_ID_185137

SEQ ID NO: 25830 - DNA, 3000 bp, Unknown; identical to SEQ ID NO: 12230
  misc_feature (1)..( 3000): 2750-1469P.txt file - cDNA_ID_2708542; gDNA_ID_2214537; Annot_ID_134414

SEQ ID NO: 25831 - DNA, 3000 bp, Unknown; identical to SEQ ID NO: 12228
  misc_feature (1)..( 3000): 2750-1469P.txt file - cDNA_ID_2708542; gDNA_ID_2214537; Annot_ID_185139

SEQ ID NO: 25832 - DNA, 3000 bp, Unknown; identical to SEQ ID NO: 12226
  misc_feature (1)..( 3000): 2750-1469P.txt file - cDNA_ID_2708545; gDNA_ID_2214537; Annot_ID_134416

SEQ ID NO: 25833 - DNA, 3000 bp, Unknown; identical to SEQ ID NO: 12226
  misc_feature (1)..( 3000): 2750-1469P.txt file - cDNA_ID_2708545; gDNA_ID_2214537; Annot_ID_185141

SEQ ID NO: 25834 - DNA, 3000 bp, Unknown; identical to SEQ ID NO: 12210
  misc_feature (1)..( 3000): 2750-1469P.txt file - cDNA_ID_2708550; gDNA_ID_2214537; Annot_ID_134405

SEQ ID NO: 25835 - DNA, 3000 bp, Unknown; identical to SEQ ID NO: 12222
  misc_feature (1)..( 3000): 2750-1469P.txt file - cDNA_ID_2708550; gDNA_ID_2214537; Annot_ID_185130

SEQ ID NO: 25836 - DNA, 3003 bp, Unknown
  misc_feature (1)..( 3003): 2750-1469P.txt file - cDNA_ID_2708558; gDNA_ID_2214537; Annot_ID_134410
aaacaatgcatctgacataagcaattgaaaactaaaagaaaaaagttgacgcaatacagaactagatagtcaagactcttctaggaaaattaaatgctttctgaatgccacttgcaaactacacattttcccatatctttgtttgttatgaacataaatagaagctgacctcagatcaggcaagcactcgtaaaatgtcttggtgtcttcgtcgtcccaaataggttccgggacagatgtatcttttacagtaccagagggtgaagcttcgtcccctgctgtgagcctagttgtaccatcctctggcataacaggaggttgcatatcaagtgcttcggccaaactgcaacaggacacaaaaattgcataattaatgaattagatgagaatattgttactgtagatattcctgtgccagatatccattccagccaaagatgtgggaagaaaggagaaacgccatatatctaaaatcacttccaaacttcagttcataaatattatagggttccagtgaatcggtaaacacatgtcacaatcatcataaaactattgcaaatgaactgatgcatgaccaagatctaagcaatgaaactatatgtataaactacaatgacagcaacttcaggaacatattaagaaagaattgagagctcaataatagtatgtgttataggtattttagttaatggccagtgagaagaaagctacgacgctaccaatatcctcattgatgaaacgtttcctttgtgcaattaactccacaacagctagacccaacaagaacaggaaaacctatgttgagttataggaatggtcaacttacgatgagatatttcgatagagatggtcgtatgatttcctcagcttttcataagaagatgcactgtcttcactaagctctcctttagcatttaccagctttgcattttctttctccatttggagaagtaactgtagaaaaaaactattacgaagatactacagaaagggaaaactagcaaaatgaaaagaaaagaaaagggagaggaaatgtttcatttttcaggcaagaaaaatcaaaattcctgcacataagctcatgggtaaacaattaaggatctaaccttgtgctcagactgaaggagatctgcaagagcatcataatatgtgttgaaagctttcttaaaactctttttctgatctgcagtgacgtcgagacccttgaaaaactagagaaaaccttagtcacatttagctacgtaccggaaaatatggggaaggcacagacaagagctcatcaaatatggaagtaaaacttcagttgatcttgaaacctacttacatcttcgtcttgtccagagataggaagccccagaaaaattcttccttgccgagcaaaactggtgagaagtgtcagatttgtttgggtcgtatctctgtctttcagttgttcaacactggtaagatccttaataatattgataaagatgttactatcttctattactccaacatagtagagctccagaagaagttttagggtactgcgctttttcatggcctttgagtttttatcagcttctaaatcttcggcagattttccaggaaagaagactttcaagagcccttgtgttagactggcagaaaattctttatacctctgatgaagtagcgagcaaatctgtcaaaatacatggatatcagcatagaaacaaattctgaacagagagtattgtcgtatgctactttctatgccccataagaaatacaaacagaaaagagacccaaatatcatctaaactaagaggaaaagatatcgttcaacagaaacctaaactgtggtagaggatttgccataccaagtggtggaaagcattaagaaactatctaaatataaagataacaactactgaaaatctcaatgtgacaagttgatgacgagagtcgcatgaaaaaacataagaaacaaggtgtaaatacagatacaaaagaacaaaacagggaaacataacctgaacagctgcttgtatatctgagcttttgagcttagcctcacaaatggcagtaacagcttcactaacgaatttgctaaggttaacacctcgcagatcatccatcaacccttctcgctgctcttcattgatctgctttaacttcttaataactgctgtattccgcttgatactagaatctagagtcctaagatatgctgaatctgtaacgtggaaggactcactatcagtaacaactcaaaactacacattctaaactagaaaagaattattgtaaaatcgtgtgctctcaagtcctgaatggctattataggtactcgattactaacagaagcattgtggaaatcctacatactcaattccatgaaaacaaaaactaaccaggtcgttcaggattgagattgttttgacgaagagtcagtttagcttcaattgacttcttaatctcttcaagacgagcaagagcttcctgcgataaccagagaaaacaattttcgaattgaagaatgagatcatagtttcaatttcatcgagtaagacaaatccgtaatctcgaaatcaaacctcgtcgtcttgtttctcgctgtgggattcatcttctggatgatccattagggttcagggagataaagtcgtgtgatttcgagtcaagtgatcgctttttcgatcggacttaggtttagtgtgttcccggagaaagagatgatagaacccggccaaggaatttttcaattaacacaaaaagagaattgagggaaaaagcccaaacgggtcaaaaagacccaataccaacgggttttacccggcaggactaagcagttaccaaaataattaccaaaccggaaccgaaaaaaaaacccatcgtgttggtaaaggaacctatgtctgaataggtaaagccatggaagcaaagagagggacagtgacataaaagacatgacacgtgttcctcacgagcctactaaaacaatcattatttcttcttcttcaccgtgttcttctctccatg

SEQ ID NO: 25837 - DNA, 3003 bp, Unknown; identical to SEQ ID NO: 25836
  misc_feature (1)..( 3003): 2750-1469P.txt file - cDNA_ID_2708558; gDNA_ID_2214537; Annot_ID_185135

SEQ ID NO: 25838 - DNA, 3003 bp, Unknown
  misc_feature (1)..( 3003): 2750-1469P.txt file - cDNA_ID_2708572; gDNA_ID_2214538; Annot_ID_134423
taatagtttagatacttatagaccgacattctgatcttcttctagcagctctcatataacccattgtcagtacattgtaaagaaaattttcggtttaccctcttagatttttgagagcgcacatcttcctggtgaaattcaagatataattgttatttcatgctcactaaaactttgaacacttatatgccatcatttcccattagagattgataattttatgttgtctctttgctgtgctttcgtttgatgtcaaaattccatactgaactggtgtttgcattgcagcaagcgggccagggagatgcacaatcaacaatggaggttgttggcatgaagagcgagatggacatgcgttctctgcttgtgtggttagtggtgtcttctgcgcttaagtgtataatctcacagtttagtaagatacttctgtctcaacttgtaatgccttcaggacaaggacagtgttaagtgcgagtgtcctccaggatttaaaggagatggtactaagaagtgtgaaggttagaccctctgaaaaaacttgaattacagtactactttgttctagttctaatcatcttataaggattttcgtgcttcctgcaccagacattaatgagtgcaaagagaagaaagcatgccagtgcccagagtgtagctgcaagaacacatggggaagctatgagtgctcttgtagcggggaccttctctacatcagagatcatgacacttgcatcagtgagtatttttttttgaatatggaagtctaaagtttgattattcaaatagtgtttctcccacctgttttccaattgttattggttctatttgtcgaaatctaggcaagacgggtgcacaagtgagatcagcatgggcggccgtttggcttataatgttatcattgggacttgcagctgctggtgcatacctcgtttacaaatataggctaagggtaagcttttttaatctcttctgctcttttgttttctgttgtgttaatagcgaagattaatcttgtatttgccatatccgttacttggggaaaattgttttaacattcctatgcccctggttttacagcaatacatggactcagagatcagagccataatggcacagtacatgccattggacagccaacccgagatcccgaaccacgtgaatgatgaacgcgcctgagaaagcaaaacagtccatctatttattccccgggaaggacccaaggtgacacgttcttttaactgatgtggcccttaacgacgatgttttctcgcctctgtatctttgtaactcttttttttttttttaccattacagtgtatttgcatacaaaagaggttcgagtgactttgtgcttttttttctcacttgtgtccatgggacttctgtaataggaaaactctgatgtaagtagcttcggctaacaagacaagagagagttacttgttttagagttcatgttgttaattgtttcctttttttttttttgtcgactaattgtttccttttatcttggaaaagtgtgattctcatttcatttatccctaaacaaaagaaggtccgattctttgtgtaagtcatcttctttttagttattaaagtaagaattatatttttgacttttgaaaatgtacttatacgttttatattcctaactttacaagtttaaattaatataataaattatgcaaaaacaaatttcaaaaaacaatatattggataaatatattgcatatatatttagttaatatttattgaataatttggtattaatataataaattatgcaatactatgtaactaaatatatattgattaaattttttacaaagatttttgttttaatatttataaattctagtttcatagatcgcgcatttcgcttatatcacagtttttttattaataggctatgttttttaaagtactttaatgttgtaatcttagtcactatttatttataagcataaaactataatttctatgtttttgtcgcctttaaaaaatcaatattaatactaaaatttaaactacatttaagtttgaatctctaaagcttgtgttaatggatagcttggaaagcttatctttccggagaacattattattgtacaatctattagctcttgattcttgaatttagttagtgcatctcctgattatgttccactttcattttcttctaattttaggaatctggatgcaaatccaggttaagtacatttagcttaatagaaagatgatttgactcggactgatgaaaatggtgccaagaccaaaactctaccactcggacgagtcaggtcaaaaacaactcaaattgactattgaaccatttttctaatctagaccagacaccaaaactctaccacagctctccgacattggtgggcctaataaattcccacaaatatttttttctgttttctttttctataaacggttggaattacatcttttgaacccatatttttttttgtactaaaatgattaaactcgagccaaaaaaatatcaatttattaggcaatcactacttgtataatgcaatttatggcgtgattagttccacaactgcatatagactatcgaatacttacacttttatgtttttaggaatgtgagtttggagtttgttaccgaaaaaccaatcaagttcaagcttaaagccttaaaccaatcaaaccatatcactttctatttttaggaatgtggatgcaaatcaacattaaatacatttagtttctaaaaccaatgttaccggttttgataattcccacaaataataagatgttcataaaaacgtggccaacaaccatttatgttcaccaacctaatcgcccctctctcaaaaaaaaaaaaatccaattttccaattttatttaacggtcacattttcctcattgcctaattaaaaacattcagacacaaatttagtttcttcttcttttggttctgtctgaatccaattttcttatattttatttcctccaccaccgtgagatatg

SEQ ID NO: 25839 - DNA, 3003 bp, Unknown; identical to SEQ ID NO: 25838
  misc_feature (1)..( 3003): 2750-1469P.txt file - cDNA_ID_2708572; gDNA_ID_2214538; Annot_ID_185154

SEQ ID NO: 25840 - DNA, 3003 bp, Unknown
  misc_feature (1)..( 3003): 2750-1469P.txt file - cDNA_ID_2708576; gDNA_ID_2214538; Annot_ID_134422
atgattcatttgatttgagtgtttagatcttcattatttagggtttaatagaaattgttgaaattagggtttcgtgaattgtggttttatgattgataattagggcttttatatgtaaacgaaattagggttttgtgttcacataatcagtcgttattacttttgatttttgccttttagattgatatgaatttgatttggtttgtgtatgaattgaaacataaacactcgtctattgcaatacgtggatttaattatttcagttgtgttcttgaatgaaatgagtttggttttatgaaatgagtttggactttagttattacgactaatgagtttggtctttaagaaatgagtttgtactttagttattactttgtgtttctgcttatgagtttgctctttatgaaatcagtttggactttagttattactttgtgtttcggataatgagtttggactttatcaaatgagtttggactttagttattactttcttttccggctaatagtttggactttagttattgctttgtgtttcggctaataagtttggtctttatgataggttgtattatatactttaagtgttttagttttgatcatgaatgaaatgagttttgagtttgtgtgttatataatttaagtgtttcagttgtgttctatgctttaagttctctaacttgtggttggtcttatcaaatgagttttgagttgcaggatcctgaagatttgagtggtgccgacatcacttgtacaagaagacaccacaagcaacaatttgtattgtgcgacagatgcggttgacaaatacctccggattggtgaaaacactttgatgtcttgtatgatacattcggttgaagcaatcatatatttgttcgggaaagagtatctaagaagacctacgcgacaagatcttaaacgactactgcgtattggagagctccgtggatttctcgggatgacaggaagcatcgattgtatgcattgggagtgaaagaattgcccgaccgcttggaaagaacaatatacacgtggatctggaaaaccaacaatcgaactacaggctgttgcttcccaaaatctttggatatggcacatatgttttggacctctaggtaccttaaatgatatcaatatacttaatctctcactagtttttgatgatataatataaggccgagctccaaaagtgaaatacgtcatcaacggaaacgactaaatcatttggcttactagctcacatatggtatttatcctaaatgacctacattatccaatctatttcacttcctcaaggtgacaaagattctttatttgctacaaatcaagaagtttgtcgtaaagatgtagagcgtgcttttggagttttgcaagctcggtttgccattgtcacaaatccaactcttatttgagataaagaaaaggtaggaatgatcatgcgagcatgtataatactttacaatatgatagttgaggatgaacgagatgagtatacttattttgatgcatccgaattcacacaaccggaatcaaccgcttcttcacaagtggatttcaactattttacagatatggcttcaaatctcggtaatattatggcgtctggagcctggttcgtgctcggactatgcatcaacaattgaaaaataatttaattgagcatttatggcacaaatttggcgggaatcaagctaaccactaatcgttattttggttttcaatatttatatcatgtatgtttaatatttaagtatttacattaataattaaattttatgaaataaaatatttgtaatttttaatttaataataatattttattttttaagaaacccgcttaaagacctaccattggacaaacaaaaaattaaagaaccaaaaaaatctcttaaacttttaaatttcaaaattatgattaaaaaaatatgaagagcccctaatggtctcttaccattggtgttgctctgagattgcatgtttatgtatctatgtttaggatatgcaaagttgattatgaacttgcttttgggataattgtcttctttttttatgcattaacaattttaaaatttttaggataacaactctattcaaagtcttttaacaaaaatactccattcaagctcaattgttactaaaatccaaaactttcgccaaaacttattttctcaattggttataattttcattgggtaggtttcaaaacaacatgttttgaaactatatttttttttacttttttttaaaattagatatctatattctaatctttaatctcctttgacaacattctaattataaattcacagaaaaattaactaatgctaaaattttcaataacatattttattattaataattaaattaattgttttgtcacatggaaagaggcaaaaagaaaagtatatatcatcacaataagatcttcatttcgatcctcacatgcattccatgaatgtgtattacatcaatttacaccttttttaaaaaacattatttcagaacagtattaaaacaaatttcgtggataattctaaagtattacatactctagaattaaatatatttccgtatttaaaaaactaagaatatatttttagaacaaaaacttaaaaataacaaagtaaatcgatagattgataaatatatcttctctttgctctttttcaatctgtaaccaaaatattaaaattcctcatgtatttatttctgatatcaactaattgttaaaaaatttttttactggttttaaatttaacccgtgcaacacgtggcttgatagcgttatataaaatattttgtttgacttgaatgggtcatctatagtcttcccagtcacacccaaaccgctcaacaagaaaaaccagatttattttctctggaaaacactcttcaagtcttttaccttccgagaatatatttcaaattctatcatatcatctttgatcattttccttgtccttcgaatttgttctttgttgtggcggagtcttgaagatg

SEQ ID NO: 25841 - DNA, 3003 bp, Unknown
  misc_feature (1)..( 3003): 2750-1469P.txt file - cDNA_ID_2708596; gDNA_ID_2214539; Annot_ID_134439
tatcttttcctcgcccattagtattttgaaaagttgctacaaaatgtcaaagaggaaacggaacagaaaatctcagaagctgcgagcaaggcaataagccagagactgcagaagctgcaaaccaggtttgacagatgtgtcaaagagaagcaatttcttgaagatgtgagtctctatctagctttcgttttaaaagtttttcttgatggcatatttacatctacttacatttctgtagagtattattgacttgttgttttctcatgtgtagttgaacgaaaatcttgtgaaaaataaggacgtatggagcaccaagattacagaaatgaaagaaaggtattatctatctagcaaatctcgtcatgggaaattgtgcatattcgctagcttgtgagaccatgctccatttctcattgatctttgatttagggagaagaaggcagttcgggcaaaggatgaaaagattcagggcttagaagaacaggtaaagaaacatctatagacaatacaaccccctgctttgttggttatataataaaacacctactaaatcggttattcacactctcagcttggaaacctaatggcccaaatggatggtgagagtgaagtctcagagacgaaagaggtccaggacgccactgtctcgaccaccaatacctcttcttctggggcagggaatgttatacatgcaaataaaaagaagagtaacagaagaaagggttagatcaagattcaaactctaccaaatctcgcttagactagtcgactaaagttcaagcaatctaactgcttagaatgtctagatctaacaattcattcgtgttataatgtgtgctatgatgagaatctgagagaaacgtttggtagttgttgtatcaaacctgatagaactatagccgttaccctcttggtgtatataatacaattggttgatatcaatattaaaaatcgtagttacttgacggtaatgccatcactatgcataccgttggaggtttcataagactttaccccatcttatggctttatcttctaatttcctcttttcgtttataatcaaattcaattatttttcatgtcactagaccggttagttatagttttacatttgaagcactaatttcaagagtcaatgatacttatgataaacaaattctatgggtttgaaagttaatccaagttaaatgactgaaacccatattgtaccaatttggaattagaagtccattatctctttcagatggtgtctactaacacacaagatcacaagaagaaggtgcaagctataaagagagtagacaccatctgaaagaaagacataattggactctcacataaaacacttggcttgaagcgaaaaatgcttttgttttccattcgttgttctatttgtcattggtggtgctatgttatgttcgtgttgatctacgcatccgggggccacatgaccatgggcctcgtttgctaccacgttgcttcattgccacttgtaagtcgtaagtattatcatgcggtacaacccttcaactatgtcctttttttttttttttttttttttctcttctaacaacaacctttcaaatatgtcatgtagaattattgggtatccgtattatgttcatgcaatttttaataatttgtaactacgattaaaaaatatatattttatgattatgcaatcacataattatgcgctatttttttatttaaaagcaaaataaaataaaattatcctatgttacatattttcacgctttgtgttggattactctacgcattaaactcttaaactaattatttgtgcatgaacaaaaaaattgtgttcttaaactaagttaaaggaaacatatatgagagggtccttttaatacatctgtaccacctcccctggaggataaggcttgtaagtggaatgcacttcatcgtcacatagttggggcaaagatatccagggaataaacgcattgagtaagttttggtccatgtctcttcttgtgtatcaatgtccatatggctaatttccaatcagaaagttcagcactgccactaaccatggctagaagatcttcaaggttgactagcggccaggtgtaggtaatgcgcgcggtcttgggacacatcatggaactgttcagtgtgaagatccaaagatagaatcttgtaaccattaagtacttcgaaccagtagatggaaccattcacaaagaccgaatgatgtctggcttcgacatagtaaggaggcggactcggcattgtccgccattcaccaatgtttaaatcgagaagttgtgcttgatctcggtttagttggatgagccacgaatgctaggcaatgcgtagggcattgaatatcatttggagtgaaggttttgaatccctcaggcagcttgtgaaagagcttccgtttagcgaagttatataaccaagacattcatgttgcttttcctttatgggctatgtatatcacggtttttccagtttcccggtttttcaaaatcgttatcattgcatctcgacaccgataagattcatagcttaaagttttgtcgatgcactgaagtttgagttgtttttgctttcatgtttactttggacctttaaaactggttttgcaatctgtaaaatctgtaaacgtacactgattaatgatatttacattcttagaaaagaaaaatgaatcatcagcccatgtgaacatatcgaacaatgtagcactttctcaaagccaacacaaccgcccgcttagcttacattagatagatcaggcagcctttcatatgtaaagataagtggcggagaaaccagccatcaactattgattagtcaacatcttatcttctatcattagctatttacgatttaatatctacttgacatgtaaaagactaactcttcaccagttcactataaatagaggttgatattgtgcttatatcttcacactacacacaaatacatacaaacatacattaattggaaactgaaagtaatataatcatg

SEQ ID NO: 25842 - DNA, 3003 bp, Unknown; identical to SEQ ID NO: 25841
  misc_feature (1)..( 3003): 2750-1469P.txt file - cDNA_ID_2708596; gDNA_ID_2214539; Annot_ID_185186

SEQ ID NO: 25843 - DNA, 3003 bp, Unknown
  misc_feature (1)..( 3003): 2750-1469P.txt file - cDNA_ID_2708603; gDNA_ID_2214539; Annot_ID_134452
ccttaagtacctgaaaatgcacaataaagacagccaaccaacggttcaaaattcatcccattgctgtattacaagtcactgtgcaaaacctgagctgtctagtacataatttgaagttacctttgacatgtgagactccaaaatctggcgtcgaccttccacgtctgggttaggtacaacaatatgacgatcaaacctcccaggtctaaccagggccttatccaaagactctgggaaatttgttgctgcgaccacaataattccttcattctgtttaaacccatccaactcaacgagcatctggttcaatgtcatcttcatgtattgctggtccttgggattgcgacttcctccaatagcatctatttcatcgataaatataatacacggggagcacttctttgcagcactaaaaagatctctcactcttctggctccaactccaacaaacatctcttcaaactcactaccactgcaggagaagaaaggcactccagcttctccagcaatagctctagcaagcatagtttttcctgtcccaggaggaccgacaagcaacacacccttaggaagctttcctcccagacgagtgaacctctatagtaaagatcaaaagatgaaagagtgaggcctaagaacaaaacagtactaactctagaaaaacctggcacagataattcagaggataaaggtctatatgataacttcacatgatttatgcttttgaatttacatcactagacagattttatacttaactagaaaaacactctagcactgtgaatttactttggggtcgcgaagataatgcacaatttcctctagctcagcctttgcttcatcaacaccctttacatcagaaaatttggtgctcgaatccatactaggttgcacttcttcgtgcaaaccaagtcctaacatgtattaagcataaattaatgagcacaaagtcattcaatacagctattggatcactgaagaaaacacaaccaaactctacctttgccaattcctctgtcctcgataagagctccaataccagaaatgagtaaaaaaccaactccaatagttcggattgtactccatagctgttctttaaagtgagtcctttctgtggatatcgtatggatcggtgcactagcagttccaaggacaccatcttttgttggttttcctacgtttctaaatgccccaagacctccaaaagtctcttcctcccttgcaacaccagcaatacctaaaagaaaaacagcaaaacatttcccaatattatatagagaaatggctcagaagctgctaatacaaatatgaaagcaaggacacaatccaagtatccattcagattcaaacaaacagtctctccctccttacccacctctttgcaatgttcgaaccagctcactttgatcgagcctatcaactttaaccaatgccttaatgtattccgataacgcagaggcattcgcatgcaaagaaggttggctttcaaacattctgataacagcctcaggatcatttcttcgaataagttctctcagatgtgcaacctcattaacttcttctctatcacggactctgcgagcaaagctaccaacataactcgattgaaacctcgttcgcggtaaagaagctccaccaccacccacagctatagataaaataaaaccaatttacatcaaaaacacttctaaaacaacaagaacaactcataaacggaatcagaatttacctccagtaactcccactctaggaaaagaggagtaagctctaacaagtaagcttcttaaactgctcaattccctttcatgactcgaaacctgtcatcggtgaagagaatcaatacagatgaagttaattactaatcccaaactcaaaatgacactagacaacacatgaaaacattttgataaaagtgaatacttttacccattttgaatcaaaaaaattgaaactttttataccaatttcaaaattaggtgacttgggtagtcaaataaatcaaatgacaatatcacagagacaatctagaatcctaaaagacaacattttgagggcagagaagaatttgagcttctagggtttgaaaaatatcatctttagcttatgaatcacaaagatcttgataaaacccatcagaaattattatctaattagatcaaatccactacagtatcaaaccaaagtcgaaacctttttcgtattaaaaattggataaaggggaaaagagaaaaatgaaacaaaaaccttggtgatgatgcgcctccaagccatcaatcaaatctctccttcacgatatcttaaaaattggtgttaatgtctgataaatcgaagttcctcgatctatatcggaaacaaaagacttcttcgttgtgtttggggaagaaccgttctaatcttattccctaaagtcttaaaaacactaaattacacgtgagagacctgtttggttatcgggtgagagaaaaattgtgcagcaggtggagacacgcacgagatatgtaggtcgcctcttaagtacataaatacccttggacatacccaataattcattttagtaggctttttctggcggcccacattaaaaagaaggacctagaacataaattggcatcgttagaaatgggcttaagtaaaggcccatatgatatatatataaaaaaagagattctagattagtaacgaagtttctggaacattgtcttgtcttgtcgccacgtgctcacataaatgtcaaagaagcttcaatacagtgaaatgatcttgtcttgtctctagaaccttctcttctctccccttataatttcatttctctctcctccacgcctcaatctctcaactcaaaactcaacattttctgaagaaagtcgcaaactttacccaaaacccagtttctaattttagcaacaaaatcaaaaatatctacttttgtttctcgaaagttacgaaattcatacaatctagcttatctctgagcttatggatttgagataaacaacgaaaatg

SEQ ID NO: 25844 - DNA, 3003 bp, Unknown; identical to SEQ ID NO: 25843
  misc_feature (1)..( 3003): 2750-1469P.txt file - cDNA_ID_2708603; gDNA_ID_2214539; Annot_ID_185199

SEQ ID NO: 25845 - DNA, 3003 bp, Unknown
  misc_feature (1)..( 3003): 2750-1469P.txt file - cDNA_ID_2708610; gDNA_ID_2214540; Annot_ID_134465
aatgattgaggccaaactatctcccggaccttctatttacaatatacgccgacatggtgatagtagtcgtttgcatgaaacaggcgttagggtcgatactggtaacttctttgcagcaaaggtgagtttttcactttgttgatatgttaggttggatgtagattcttgtcatgttcgatctaattaattgtcatggcagagaagaggtgttgttgatggtgttgattttggagcaactggtttagtgaagaagatagatgtagatcgaatccgtgagaggcttgatagtggttctgtagttttattgaggaacttgggccattccagcaccggagaagtcttaaattgcaagtatgctctctttattggtaataatttacttgctaaatcttgacgacattaggtttttgtcaccctgatattgggacattacttctacactgcagtacctatgaggttgctacagcatgtgctttagctataggagcagataagcttatttgcataatggatggtccagttcttgatgagaatggacatcttgttcggttcttgactcttcaggaagcagatacattagtcagaaaacgggcacagcaaagcgagatcgctgccaattacgtgaaggctgttggggatggaggcataagtagttttcctgaacctcttggttacaatggtatggtgacgactcccaacaatcatattgggagaccgatttgggaaaaactcagtccgacctttcagaatggtgttggatttgacaacggaaatgggttgtggtctggggagcaaggttttgctattggcggtgaggagagaattagccgtttgaatggatatctctctgaactggctgcagcagcgttcgtttgcagagtgagtccttgagctaacccttgtgcctcttttttacatccagctctgattcgttgatttgttgaagggtggtgtcaaaagagttcacttattggatggtactataagtggagtgctattgttggagcttttcaaaagagatggaatggggactatggtggcaaggtatacacaactgttttcactttcgaatcatgcaaagttttgatttttcttacaaaactatggaccattcttgtcacagtgatgtatatgaaggaaaccgggaggcgaaagtggaagatcttgctggaataagacaaataatcaaacccctggaagaatctggggctttagttcgtagaactgatgaggaggtttgccttttagccatatcactagcttagattctacttctttttgtttaggtgttagcatcaaaggataattggtttttggtattcagcttctgcgagctttggattcgtttgtggttgtggaaagggaaggacatattatcgcttgcgcggctttgttccctttctttgaagaaaaatgtggagaagttgcagctatcgcagttgcatcagattgccgtggacaaggccagggagataaattgctcggtataatcacaaaacttttgagcattgtgtttcgaatctactggtaagaaaaaccccggtttcttgactgtgaaattttgcagattacattgagaagaaagcgtcagctcttggacttgagatgctatttctgctgacaacgagaaccgcggactggtttgtgagacgcgggtttcaggaatgtccaatcgagatgataccagaggcaagacgggaaagaatcaatctttcgaggagatcaaagtattacatgaagaagctgttgccagacaggagtggaatttctgttgttcgaacatttcagtatgattcttgagagtgtccagaagcagaaaattcaaacatagagcaaataaaatgtaattgacacagaaacatttagctgaatctctaagattctgctgagttttgaatcaatattttcaggaacagtgaacgagacaaatgtctttccaacgctatagtggcatctatcgatcgctttgagcttctccacgaacgattcctttgcttccgtcttctcctatgttgtcttgatctcgtgcagagaccgtcgtctactctttgtattgaatacactttgccttcaactgctttgtcttctgtttggttcaacttatataaatgcgaacctataaaatgaaaacaattctgtgtgatattgtgaagaagaaatagtttgatcagaatcctcaaagccgacaagaatccgtcgaaatcgcggtttgacttcccggagaattttccagataacaagaaagaaagtacactttcctggaaagaaaaacaaaatcataaacataacttttgagctcgttcaaattgaatcagttcacaaaacaaacccacattcacttgaaactcaccaagtgattgacgcaagcttggttttaatttcttctttcgtcagtttacaatccgatgcagctaatattgcagcagtagaatattaatatacaatcaaatttatcacttatactgtatatgatcccaattctaaatgtgatcagcaaagctctattattggtagtatatatgtgtatattcattagtggagactggagagtgggtgagtaaaataaacgatatgactagtacctcgcaaaacatgacgaaacctctattattacaaagatccttgtttcctatatgaggactttaatttttgatttattaaggtattaattcatccaaagttattttaaagatcctcaattttttttttttttttttttggtagttagatcctcaatatataacctactccttttcttttgtcgaaaatataacctactcctacatttgacgtcaggaaacctctattattgataatatatggtcctacatatgactatagtacaataaaacgccatcaaacgtctattattggtaattaattaagtaattaacttcttttttttgggataaaaattaaagatccttgtttcctaagatgactcgatctttagaaactaagagagaatgaaactaacactaaaattcctacaaaaaaaaaatg

SEQ ID NO: 25846 - DNA, 3003 bp, Unknown; identical to SEQ ID NO: 25845
  misc_feature (1)..( 3003): 2750-1469P.txt file - cDNA_ID_2708610; gDNA_ID_2214540; Annot_ID_185223

SEQ ID NO: 25847 - DNA, 3000 bp, Unknown; identical to SEQ ID NO: 12270
  misc_feature (1)..( 3000): 2750-1469P.txt file - cDNA_ID_2708623; gDNA_ID_2214540; Annot_ID_134456

SEQ ID NO: 25848 - DNA, 3000 bp, Unknown; identical to SEQ ID NO: 12270
  misc_feature (1)..( 3000): 2750-1469P.txt file - cDNA_ID_2708623; gDNA_ID_2214540; Annot_ID_185213

SEQ ID NO: 25849 - DNA, 3000 bp, Unknown; identical to SEQ ID NO: 12269
  misc_feature (1)..( 3000): 2750-1469P.txt file - cDNA_ID_2708633; gDNA_ID_2214540; Annot_ID_134453

SEQ ID NO: 25850 - DNA, 3000 bp, Unknown; identical to SEQ ID NO: 12269
  misc_feature (1)..( 3000): 2750-1469P.txt file - cDNA_ID_2708633; gDNA_ID_2214540; Annot_ID_185206

SEQ ID NO: 25851 - DNA, 3000 bp, Unknown
  misc_feature (1)..( 3000): 2750-1469P.txt file - cDNA_ID_2708652; gDNA_ID_2214542; Annot_ID_134497
tgtgatttgtgagaagcagtttagctctggtaaggcttatggtggtcacgtgaggatccactccattgagtacaataacaagggaaagatgaagaagatgaagaagatgaagttgaagaagaagaagaagagaaagattggtttggtgaagaaagagaaggagaaagagatagatctggctaggactgacgtggaaggtaagattaggtgttgtctttgtggaaaagagtttcaaacaatgcactctttgtttggtcatatgaggagacatcctgaccggacttggaaagggatacgacctcctccaccatcggagaagttcaatctaagctacttggatgatgatgtcgatgatgaagatgaggatgatgatgatgtgatgagtagatccatgatgatgagtgatgtacccgaggatgttcagggagctgcttgcattctaatgatgctctcttacgcttcaagaaattactgggctgggatagaggaatcaccaaaatccgaggtaagaagttcgagtttctacaaagatgatgaaggaaaagataaagtattaggagatagtaggatggatgaaaagaagggtttgattgtagatatgaagataaagatggaaatggaagtgaaggtgaatagtcctcgagatgaagctaagaggtcattagggtttgatctcaatcagcctccttaccatgaagatcatccttaattccagttggaactagttcaattggtttcgcagttcgatttcaatggaatggagtagattaaagttttaacatgtttctcaatgaatttacatcctcctacctagcttttgtacataatgaaatccttgtttggttctagtcatatttcattgctgttttttccttctagtccttttcttctgtgccaatttctcttgaatattttctttaatgttttgtgactttggtgtgactagaataaagttgttatgcttttatctactgaatattttcattcacaaggattgagatttctcaagttgtgagaattttcgtaaatcgagtagttcatatgcatcaaccatatgatacggatattccataggtgtatcaacttttcacatacaaaaaatgtataatttaggtgcatacttagagatagtaactaaatatattattgttaagatgtcaaaaatataattttagttattttaccaatataagttcaaacacaaccacatatttgcaagaaatgccatcgtaaccaaatacaaaatctttttaaaaatcttaacttattcaaaatgaaaacatatttctatatacaatgaacaaaatcttctcaaatatctaagggtctcaccggtgcaacatttagaagaaaaaaatttctgtcaaattcttctaaactcacaaggagagagtaattatctttttcatttttttttctatcaaagacaagtatttttttagaacaaaagcttctacttcaaaatggtggaagaaaacatattacttttcctttgtggaaatctaaagaattcaattgaaaagattttcttctaaatattgcactatcataccttaagttcatccacataaaaactttttaattaaaaataatacatttattcacattcaaggccgtctccacgaaaatgaaaggtaagtaaatgttatgggtctataatcaattttttgataagattaagtgtcatatgataaaaacgaataagatttatttccttatcataggaaagacaaaaaacataaatataactatatagaccctccacaaaaaggatattacgggtctgattggttgtcctacttagcgcaagagttgaaaaaaatacaagaagtgtaaaaagaccgaaagctaaaataaaagtaaaaactacaataaaaacgaacatcgaaaaaacacaagcgaaaaactcaacaaacaaagattcaagaagaaacactgattgcgaactacgaagcacaaaaatttgcatgatttttcaactccaaagagtttgagtcctcatcgttgttgcaacgaacaatcccaaacctaggccagtcttcaaatcgatatgatagagacgcttacagcttctctaaaggttaaagcaaaaattgggacaaataaagtggacttaatcatgcaatgcaatatagaagataagaaacatttttgaataataacaagaaaatgcatcatttttagtaattcatacaaatgaaggttaaccaagatatcttccaaatcctcacactttatgatttcctaaaatcttaccattgaccaatatgaattttaagggcaactttctcaagtgatttatgggatacaagtagtcttgtttgaaatgaacgtccttcataagaggatagtcttttatcaaaaatgattacacatttctgaaaattaaattttatgttcagagacttctgcatattgcatgaaaacctttagcaatgtatggacattcttacacttgagtgttgcagtgaagaagagtatcaacggtagatttcaataaaaatccactcaactttatcaaaagctttgctaatatcttaatttaaatgccacagaagattgggtagcttttttagtatgctctgaatgcaccaatttgcgatatcaacatactattagtaatcaatctacaaaaatagaaacagactgaagtttatgaaattatacaaatgagcttagaaataagcttatacgcagcgttgcataagcttatcatcctataatctataaccccaattgaagcatcagtttggagattaataagagaaagagattaggccaaattggtaaaggatagttattgtagttgactaattgaattgtctacctaaagtgcccaaatgtcatagagatgaaaaaatgtgctattgggccaatttctctatacaaaaacattttgattttttgttagaattgggctgattcttataaaaaaaaaaaaaataggtgacatatcagatcaaagagaaaaaaataaggtaggaagaaacaacaacaatg

SEQ ID NO: 25852 - DNA, 3000 bp, Unknown; identical to SEQ ID NO: 25851
  misc_feature (1)..( 3000): 2750-1469P.txt file - cDNA_ID_2708652; gDNA_ID_2214542; Annot_ID_185277

SEQ ID NO: 25853 - DNA, 3003 bp, Unknown
  misc_feature (1)..( 3003): 2750-1469P.txt file - cDNA_ID_2708654; gDNA_ID_2214542; Annot_ID_134487
atggaccatgtcaaccacatcaaataaaagcaatctagtctagcatatgctgtcacaaataaactatcttaacagaaattgctatagtacatacatatgtagttattgaaaatcttgatttttccaggaagaaaatgatgaaaggctaagggaagaagaaagggtgattgaatctaaaaaccgtgctgaagcagaactagcagagatgcaacagaatttactaatggaaaaggagaagttacaaatggaggaggcgaaaaacaaacagttgattgcacaagcggtaaattcatattctttaacaaacaatctaatgtattacgatatcacgaacaaactatcctttttaagttgctatagtacatagatttttattattgaaatactcatttccccaggaagcaaatgaaaagcttatggaacaagaaagggccaaaaaccgtgctgaaaccgaactagctgcagtaatggtggagaagttacaaatggaagaggagaaaaacaagcagttgattgcacaggcggtaaattcatattctttaaccttgtatacttgtacttaattgcattcaaatagaaattgatctcttgtacgttttgcctttagacaatgattttaaatgttagaaatccttcgtttgctaggaagaggagaaaaggctcaaggaacatcaaacgaatgagcttaagaaggttgtggtcatcagattcgatcaaatatgcctcctactttgtgtttgattttttttggtcatatatatatatatatgtatcatgtttcgtggactgaggtcggttatttatggacagaatcgcatgatctgcgcaagggatcttaacatcgaatggtctcatagcgaagagcattggaaatgggtaaatctggatcacaacatatcaaggtaaggatttatatatatttcctacaaacagttataatgggacaagtggtgggaccgtgttattgtctgatcttgtttaaccgatccaaaccaaaccgtaccgaaaaatctgaatcaaacgaacacatgatatgctttcatcatccctttaggcagaaagaaatgcttcaatttacaaatacatgatcaaatataacttttaaaaacaaataacttcatagaaaagagttaagttggcttatggccgaatcatgtatgtctcaaaaagccatgtagttaaccctcacttaaataagacttgttgattttaccagcaatacattcgtcgaagttgctgagcttctaggagtttattggtttgacgtaagtggaagtttggacacgacggaaatggcaccatggacacattacgaggttctgttcgttgttaatttaaaagactcagcttttaaatggaatgcagcggtgaaaatgaacctgttttacatcaacagtaggccaggaggtccaggaacgcaagagcgagctgttgacatgaggcagcatattgggaaaggatgggtaactatacacgccggtgaattcattacgacaccggagaatgtcggactgattgggttccgcatgtctgaggtcgactccggcgataacaggggagggctcattgtcaaaggtgttttaattcgtcctataaactaatgcatgtatcagtaattcagtatagtgtatgtctgacttctatcattcttagctgatgcatgcatgcttcgttgtttatcagttgatcacttattcaataataacgtgaaacataaataatcgcatctaaatttcgtggtaacgattacttaattctttcattaattattttcagtttgcatgatttgttttccagtatttaaaaagcttaaaattcaagttttgatatgcaacattgcaactcaattcgaataaatcgtcacttgtggttttaggcattggagtcagtggcggacccataattttttatcggggtcaaaatataattgaaaaatacaattaaaatcttgaaaacaataatgtaaaaacaaaaatacaatgcaagattgatacaagataaaggtgaaattaacttacttgaagctgattggagacagtagagctcaagaacatgagaaccaaacgtaaacttcgtcaactgataactgcatccgacaaagacaaaacaaacatgtataaggagaaaaccaaaagcagacacttgatctaagtttaaaaaccaaataaaacaaacatttgtttgtgtaacaaaattactcatcgttgatgaagaaagactccaagcagactatctcttcttcttcttcttcaacaattgcttctctacctttatcactttcactgcccatctttgactacagtatacagtcagaatcagatatttcagatcccaagcttcgaagtgtgttccaacaaatcaaattcggaaataacaacacatcagctaagggaatcgacgaagaaaggtattgattaacaaataccacctctttgttactttgttagagaggtgcgcttgttgatcaactgcggcggttccgtcaacttcgaaaagtaattagatttttagagcagaccatttcggttttctgatttgaaccggtttgagagagaaaaataaataaaaagaaatttgcacctataagttataaccaaacaaaattacaagtcaaatattttattttcgtcaaaaagattttattgatagaatgtgggatcgatttctaatgactgttatttttgtttctaggttctgataaaaatattttttagttaaaatcagtattgctttctgactttctcagacatcacaatctcataatacatcgtgagagatagattcaaacatccctaattccaaacttgtacggtatgtgttaaattaaaaacttaaaacgactgatccctaatatcaaaatgccgacataaaatataaatggaagcgttgaattagggaaaaaaaacagaatcaaaattaattgagatctgattacaaaaaaaaaaaaagagaatctttatttgtatttgcagaagaagaagagaaaaagtttgaaagaaaatg

SEQ ID NO: 25854 - DNA, 3003 bp, Unknown; identical to SEQ ID NO: 25853
  misc_feature (1)..( 3003): 2750-1469P.txt file - cDNA_ID_2708654; gDNA_ID_2214542; Annot_ID_185266

SEQ ID NO: 25855 - DNA, 3000 bp, Unknown; identical to SEQ ID NO: 12309
  misc_feature (1)..( 3000): 2750-1469P.txt file - cDNA_ID_2708662; gDNA_ID_2214542; Annot_ID_134493

SEQ ID NO: 25856 - DNA, 3000 bp, Unknown; identical to SEQ ID NO: 12294
  misc_feature (1)..( 3000): 2750-1469P.txt file - cDNA_ID_2708666; gDNA_ID_2214542; Annot_ID_134494

SEQ ID NO: 25857 - DNA, 3003 bp, Unknown
  misc_feature (1)..( 3003): 2750-1469P.txt file - cDNA_ID_2708670; gDNA_ID_2214542; Annot_ID_134495
tattcactatggttcataccacagaaattctatatttgaaaactgtgctgcaaaaacatatttattgatgttggaaaagtcaatcaagatgtagaaatatgctgaaaatatggtctatttccaccaaatgatttgcctctatttttactgtgaaaatagctttattagttagataaactcataaaatcaagacaatcacatgatgaagtattgatttaacacattttgaaacactacacgttaatttattcgactgaacaaatacaaagttttcattaaatgtgagtgctgagttctgtgacagtttgtttgaattttctggataatgattagcaccatgccccagccaagaaacccccatactttgtttgtaaccattaatattaatattttggttggcgacagacaaatctttggccgacgaagctgattttcactctttcactgccaaattttgtatgtttcatcgacatttttacatttgaaaatcttatgtttttggttttgttgggggatatgcataaatttcttaagagataaataataagtagaatcgtcgagagatgtataatctagtttatgtttcttggcctctactctacttttctttctttgcattctctttaaattcccattcttcgtttatttaaagatgcatgttcgaatcttctctacttctacaaactaaatggaatgacataaggttatgtctctctatgaatattgttggatataaacaagttgaactacaatgattcaacgcaggttgttcaacactcactctctcagctttggcatcttaagacacttttacgatatatccactcctagtttttaggaaaagaacaagactgtcacatctttcaaaagtcatcaacccgcaaccaaacttttatttcatttgtctcgttagattagatgcttgatgaattgagtctcaatacctcctaaagtgaagaaaggtctcgggaggaaacaaaatgaccttaagatattagatttttggttggaaatttggaatgttaaattttattcaacaaaaaattatctacatagtttgaaaggagattacaacaagagaggaccaatgaaataaaagcattaatagaatgctagcttaaaattcaaagaaatagatcagctatgatcggccatgaaaccaaagagaatggatccgatggctagtcatcaatctcttaatgttaacaaagagtagatctgattttgatcaaaacaggccagacccgtacttcgtcatcgtatatcattattttttattttctgtttcttgaaaacaaaaagaaaaaactatttgtaatcacataacaatttgttgaaagacaaaaaaaaagagagagagagactaatatctacttgtatactgttatttttttttaccatttctattaattattttgttattattcgttaaaaactttatctatcttttatgaccaataatgatgcataatttattctaaccaataaccactaaacatgttagaattgacttcatacttccattaatacatgagttgaaaattctaatcctaaaatgaaaatgatagaaccagaccagaccaaattgactcaaaagattccagctcatcttgatatttctagattacaagtcactctaaatacatgtttgaaatgttcgaaaaaaaacattgctataattaattaaaaaacagtagaaggaaaaattcggtgagaagaaagtagaatgttgctagaatcaataaattaatcaaaataggtacagtatataatagactagtatccctctaatctaacggtccatttatacctgtccccattacacatgtcaaagataataatacaaaacaagtatgtaaattgtaggtatttattagttgtgagaatgactattttattctactctttttcttttggaaaaatctaacgtggacatccgataatcgacttggctcagatcgattttgagtaaattgttttaaggggtttagaattcatatagaaccaaaaaacatgcggttcggatcggtagttattttacggtttgactatgttcggttatctctcagttcggaccgacatataaccaaattttattgggttcggtttgaattaaatatttgtacataaactatgtggaaaaaagaactaaataatttgttcaatctaatgaattagtttgcaaaaaatatttactctagacacatataagtatgtacattcatatattttagttattttgagcctaatcataactaaattttctggtttataaatatagttttgaatatttggattatctcaaacataaatataattaacattttctgatttttatgacattgactaatattttctgatattaagatattgatctccttaaattgtttttatcattctttaaagttcattatcttgtttggttccaatttcttgtacataaaccataaatttgaaatttcaattagaaaaataatttccttttatgagatacaatcatacaattgtatttcaagtagttcgaatactcattccgttttcggtttagttccaagttgttataaaagatgaactacactatttggatgtttatgattatctggttcggttcggtatctcttaattcggttatttcggttttagtaatccacataaaacagactataatctcttgcattatatccacatagacctaaataataaacaatttgtttcttcccgctaagtgattattaatgagcctcccttcttctcaactgttatttcactttaacgtacaaaaaaaaacacacacagagagaaagagagagagaaaagtttccgcattaatggtggcttcacctaccagttgtctagtggtgagagattaatgtgacgacgacgacgacacagaacaagagatagagggagaacaaaccaaaaccaaatctacactgcaatctcttccctcatcttctccaattatcatctctctctgattctgttgcgccgccgcggagaatg

SEQ ID NO: 25858 - DNA, 3003 bp, Unknown; identical to SEQ ID NO: 25857
  misc_feature (1)..( 3003): 2750-1469P.txt file - cDNA_ID_2708670; gDNA_ID_2214542; Annot_ID_185275

SEQ ID NO: 25859 - DNA, 3000 bp, Unknown; identical to SEQ ID NO: 12316
  misc_feature (1)..( 3000): 2750-1469P.txt file - cDNA_ID_2708688; gDNA_ID_2214543; Annot_ID_134509

SEQ ID NO: 25860 - DNA, 3000 bp, Unknown; identical to SEQ ID NO: 12316
  misc_feature (1)..( 3000): 2750-1469P.txt file - cDNA_ID_2708688; gDNA_ID_2214543; Annot_ID_185293

SEQ ID NO: 25861 - DNA, 3003 bp, Unknown
  misc_feature (1)..( 3003): 2750-1469P.txt file - cDNA_ID_2708699; gDNA_ID_2214543; Annot_ID_134519
gccatacaaaaatctataggtggtgtccgtcattccactaagtaggattttttgtttgaatcatttctatatagtaaattacattccatatagttgtagaaaaccctttatttactttgtatttccagtattttaagtttctcttttatagagcatagtttcagagaaatttcgttttctttcgactatatttccagagacatttaggtcattcaccggtttatgtttttctttttgaattttggattttggggatatttaatttttccatctgtttatgtaattttaaaatatatttttctatgtttttatatataaaattagatgacaaaaaagaatataaaatcttcgaaaacgattgcatcgtcattttgattatctgtttcccattatataaattatggttatattatggtttaggctgttttgatttcttgcattctttaatattttcagaatttattcgaataggtttaattagttccgtacaaccaacatagaaagatattattagtttttgttctattcaattttgatggaatgtctactcctaccaacaggtttgaacaaggattttgcatagttatagtattaaaaagtgactaaaaagtagaaagttagagagtgggtagtgttgctaaacactttattctttctcgtaccaaactgatgtgatatctaaaatgactttgaactgaaaagagagcatagcactcgacaataaaaagggttttgatagatcccactgattatctctgaagcgaaaaacccctttttttctctcaacttgacgattagggtttcttcttctccttgccgccgttggtgtggcctctcgcccaccggcgagaatcttcctctttctccctcctctcccttttttctatggctttagtgatgcttgctcgggctcctgctccacctttgctcctcccttctccgaatccgccgccgtgtgctctaccgcaagatttgaccagtttggtctctccttctgaacctcccgaccctccagacccaccagactatctcgttggagcttccaactcctttctctcgattttgctgttgaggtcttcagatctaggatcagatcttgttcagactttgagccctctagatctgggttttgctttacgatctattactgctgtgtgcagttcgtggtaccaagtatttcctctcgcttgtttggagctttggttctctattccacacctctctcatcctctagtcactctatcaaaaggttttgtctctctgaaaggtagtaatttctttgaatttttaccttcctttggaacatgccttcgtttatacttcagttccctcaccatgaggatgtgatgatttctactagttttaggctggttttacctcaatatgaggctgttatgatcttgcttaagctcaagctgttcttacctcattatgaggattgttgttttcgattggacttcgaattcagcttcttttacctcagtatgaggttggtttgattctgtataagcttaggcttctcttacctcattatgaggatgttatttaaaaactttggttaagagcaattcatgttattgtttctttggtttggtttcttgaaatttcacgcaggataaaggaaaagacatatgacgtcttaacaagaaatgatcttgggtcttggactccagatttgttcatcaagaagtggtggttttcgcaaccccacacctctccgaagttgaggtttttctcacatctcgtaagctcaagaagttggtgctttgtcgcctatgctattgtagccgtatttcatgatgcgttttatccactagaggatgttgcatctccggacagcagatcaccaagtgtgctctcttatttccgaaagctcatctcatgttgcagcactattggtgtctcgaactttagttgcttaactgttatgtatgcttctatttttttctttcgtgctttctgtatgtcatttgtagcagtggtttttttggcctttgtagcctctttgatgtacttgttgaaccatttctccattgttggagagtagaatcatttataaaaagctagtttgaccaaaaaaaaaagatcccactgattttgccaataccaaattttactattcccaattaactgtaccaagcaatatctttttggtttgtaacataattttggcaaagtttcgacatgtatcaaactatcaatcaaatttgcgatactgatttctatatatagtttcaattttatttggatatcacaaataaaaactaaaagtgggttgaagaatttacgaaataattaacataattttggtcggcgctgaccataataattaataaattgcgtcttttagctcttaagtatagtcaaacgttaattttttttagtaaagcaaaagacgtgtcaaagtcaaactaactaaaattagatgttctcatatactgatatacaatcatatttttaattatgaaactatattgcgtcgttgacaaaaaaaaaaacttagattgcatcaataatggttattcttacaaaaaaaaacccgttaataaatgatataaaacaaatgaaaaattaaaaaattcgatatcataaattcatgatattctcttttactcttttagtaattagatctccgaataataaataatcgtttactaaaaacgtcctccacaaaattcggcaagtaaaagaccaaaaccaaatctcttcagggtcaatttcgtaacttcacactaattccataaccatacataaaaacaaacaaaaaaacaaatcctgcgagaaaaatcccaaaaaatcaataatttaaatcactttccatagtttacagacaacacagagcttgcttacgtgttctccaaattttgtatacattattttcacaaaaccagttcctcaacaactagatccatcatctctagcgttcttaaagtttccaacttttttttttattaatttgggccaactttttttggtttgagaattgggcgagggagaaagatg

SEQ ID NO: 25862 - DNA, 3003 bp, Unknown; identical to SEQ ID NO: 25861
  misc_feature (1)..( 3003): 2750-1469P.txt file - cDNA_ID_2708699; gDNA_ID_2214543; Annot_ID_185306

SEQ ID NO: 25863 - DNA, 3003 bp, Unknown
  misc_feature (1)..( 3003): 2750-1469P.txt file - cDNA_ID_2708706; gDNA_ID_2214543; Annot_ID_134502
tcctcaatcttccctttcaaaaccgttataactgccaacaaaacaaacacaaacacttgtttcagccaactaccatcagatcataaaccatttgaataacactctaaacacatacataccatctgagaatccattcgacttaacaatctcctttgctgtgtcagccatttgagaacactcaacctaagaatcattagtcaaatcagatcaataagagccaaactttgattaacggagaagataaagagacatactgcgtaaacgtgagctgctcctgctttagcacagaagagagacaagattccagttccagctccaacatcaagaacaattttgtccttgataagaaacttgttcttgtaaataacatcttgataactctttgtcctcactacatcctttaacatttcctaataataataacatcaccatagaaaaactgttatacacattgcctaggtttcagaacaaaggattcaaaacaaaacaaaaaagcaggagactttacttacttcatgaatacctgcaaaaatcaatcaattggaaacagagtaagcactttgcagagaataagataacatgaagaaagcaacattatataatgaaagttcaagggtttataccgaaatgagagtaagaatcgaagtagtaatcggcgctggtaatgtcatcagcaacatcggcattgttgtcatctccatcgtgcattgattcatcagcatcctcgaagtgtaacttcgtcgtctgagtttcatcagagccgttgttgttgttctccgtactagtcattttttgcggcaaagagagaggttttggatggctaacagattcgaataagcaaaaagatttagggttttaggatggatacgaactttatgttatgtgtatgattctatttcagccgccggttcaattgtttttgacagataaaccggtttggtttataccgatccggttcggttattgtcgtaattataaggcagtgtagatgaaatttggaggaaaagattctgacgctggtagtggtgagtggtgagcacggccaaaaggtatggcttgcttacgatcaccgattcattcttcttttatttcgtttaagattctgatattttggtctaaaattcttcttcgctcttttggattttggtttttaggggtttaaagtttgtttttttatgtgtttgagtctcagatctaatttgaaatctcttcactgcgataatgctttttaggttttgaattgcttaatttttccataattcggattcgttcgatttgttagtctggaattgaggactagggttttagtgatttagcttgatatgtgtgaaaagccttatgcttttggatgccttgcttctgaaattacattttttcagtttcctgttttagttattgaattctatcgtggaggtgtataatgaaccatgctattgtatatgatgagctaatctttcttgtttaggcttagtttctgagactcaattggtaaatgctaaacttggtttctatgattttgtaggattttggtattgaaaaatggcatcaaaattggttcaacttcaatcaaaggcatgtcaggcttcaaagtttgtggccaagcatgggaattcgtactacaagcaattgttggagcagaacaagcaatacatccaagagcctgcaactatagagaagtgcagtgaattgtctaaacaattgctctacactcgtcttgctaggtcattaccattttcttctctctttatctcatggacatattttcaatggccatgctcaaactatcttttatgtatacttttgaaacattaatctttagagaatgctgatgaaatgtgcaagttgaatttgcattactcgcgagtaggtagccttttttgcctgaaaaaaatatgcttgagaatttgttatcctctagtagtttttgtcctcgatggaattgagcttgtaaatatcctttgattaggataatatatgtgcctgtcttgtttttcctgtctagataacacattataagcaccacattgtgttttgctatcagttgaagagttcggctttctgtgatacgcaatcttgcgtctatagctaatactcttcttactaactacagcattcccgggcgctacgaaacatttaggaaagaagtagactacgcaaagaacttattgaagaacagagcgaatctgaaggtggaagatgcaggaatcgctgcattgtttggcttagaatgctttgcttggttttgcgcaggtgaaatcgtcggcagaggattcactttcaccggctactacccttgaaattgagacaacaaacaaccaggtcgccggaatattcttcctgacgcttgtaactccctccatatgattcctcacttgaactatatatacttcctcgaatccatttatattttcagttttttcctgaaacagaagtgttggagctaagggaaaaaaaaacattttggtaaagctcttaataagttgagaaaaatgcatttgatacaagattcttctttagatatttattttatccacaaagtttaatatctgttcacaatatttaaaacatcagagaattattttttttaatatattaagtgattgttaattgtcgaataacttcaaaaatagaggaatatttgaaaaaaatgttattttgaagaatttatgatattcacaagaaaatgatttttgagtaaaaaactgttatttttattttgtttgagaaactgatatcatagttgaagtaaaaatttaattttgcagctgataaattcaaaaatagaaatatataatacatttatttgagtggacttaagataaaatattgaattaacttcaaatctcagcgagagaatattcaaaaaaataataataaaattttggtatgtgcgagaaagcaggaagaccaatgggatcttaaggagacccaattggaatctttagccacaatttcgaaaccttagcgaagaagacaacaacgatttacgagacgacgacgatg

SEQ ID NO: 25864 - DNA, 3000 bp, Unknown; identical to SEQ ID NO: 10350
  misc_feature (1)..( 3000): 2750-1469P.txt file - cDNA_ID_2708714; gDNA_ID_2213644; Annot_ID_132336

SEQ ID NO: 25865 - DNA, 3000 bp, Unknown
  misc_feature (1)..( 3000): 2750-1469P.txt file - cDNA_ID_2708714; gDNA_ID_1591721; Annot_ID_151437
cgactacagctccatgagacattctgatggaccttacggcgagaatatcgccgcgggatgggtccaacctaaggaccaaatgagcggtccgatagcggcaaagtattggttgacggagaagccaaactacgatcatgcgaccaacaaatgcaaagatgtttgcggacactacactcagatggtggccaatcaatcgttaagtctcggatgtggctcgttcaggtgtcatgagaatgagttgatttatattgtatgtaactattatcctatgccagtgggtgatgagaatacccgtccttattgattatattgatgcaaagaaatgatccatatggtaatgtgatttgacaattattaatatgttaagttactgatcaatatatatgtataagaatataaaaccaagtttatgatatacattggtttgtataagttgctgctgtgaaatgattcagaataaaatgtgatgttcaattggttaaacaaattgtgattacatatatttgatataataatatatgaactttttgttatagatgatttataatattttcgtaaattatattcggagttattttcctttgtatttagtccgttggtatctagagcaattgtgaaaatgagtagctaagacatgaaaaattgtgcatttagataatgatggtttatgtttctttttgaagagcatgcccaatcaatatacaaatagacacagctctactgctctagcagaaaatatggagcaaatttctgtcttggggagctttatgctgcggttaaagcggctatgagactctaagcatcctagtagagtagataacgaattctatagactatatagcgtgtggacatcaacatgtctttaactttaaaatgattaaaagttgtctaatgggtcggtttaatagcttatcatcttccttattttaacttctaagtactagagttaaaggaatcaaatgatgcgtatgctttaacttttcaagaaacacaatgatgcatagttttaagacactgtaactgtaagtgcaaatgaaccaaaaatgatgctttaacacgacgttgagttttggggaatcatttcatctgacatatatgggaggacatgttttgtttgtatatcgaaattcggaaaatgtatggctaagtgggaatattggatatcacataacttattagaatcagaagagattgcaaatttgtccaagaagcatatatcaagacactgtaagcgcaactctgaaaatttcattgttgatcaaaaatacaatatagtatgtggcaactggcaagtcatacaatcacatttgatcgtactagtgagcagagccatgccaaggttaatggttgacggaggcggtcaaaattttttttccccaactaaaaaaaacgatgcttataataatagaagtaaaaatgtctacaaagataaattgtcatatgacgaaaatacgaaaaaaaacaaaacataaaaatagttctaaagcgtaattcttcttcctttcttcccaacaaaatcattagccaaacgttcaaagtcaacttctctaaccaatgctctttcgatagataagatcgccaagtcacttaaccttttttgtgacatactcgaacgaagataagattttatcaatttcagctttgaaaaacttctttccgcagatgcaaccgaaactggaattgtcaacaatacttgataagcaatccatgaattaggataacaaccttcaactttttgcaagaagtctaacacttcaataggcctcctaacttccttgggtaaagcttctcttagaatttttagttcataaaagagatcactagcaagaatatctgaatgtgttccatgagttaaagcatctttaaggttggtacaagatgccatcaaactatcatcactcgccgactgcaactttttcaaatcaaacaaaaacccaaatatttgttcatacctttggaattgttcgaatcttgtctcaagcgagtaaagagcttgatccatgatttggatgaagtagtcaattctgtaaatttcgaacataagtgttacaaaatttctgattctaatttgggggaaaactacaacatgtataattaagaattacatcaaaccataggatagaacaaggataaataaagtatcaaacttactctaacgagtcaatgttaatacgttcaaggctcaagagtaacaggattagaaaaagtcttgtggaaagagacggcgattaaaaaataaaggaagaggattctctaacctaacttaataatgctttgttctgtttgtttccttattctttggatttttttttatttttattttattttcttattatttagataaatgcaaatgatctgtaatattggtctattaaactaagagtatcttatagaaaaatatgcttctaagttttttttcaaaaattttggacgtaagcgaaggtttctttcttatgccttgaggcacggctctgctagtgagttatagtttcaatgaccaaggagttccatgcgatacacaatgcaccaaatttggtgtgaagaagtaaacgtaacttatcaattgttcgaatttctgtggattttatgcaatcagtattcgtaaagtaacttggttttataagtctgttctcaatttccatggcatcaaaagaaaacgtttagtctgtttacttcgttatctcataatccaaattcaacggccacgatcagctagactactgtaaatcaggtggtcgtgacagcacaagatcaacgatctgagttcttccttcttcgctcatatgctaaattctgattgaaacatctgmcgaattcgttcttcccctttctaatttgattctccttggaacaaacaagctctgttacagagatcagagtcgaatccgtaacaccattgttgattctctaaagcatctactgatttcaatcgtgaaattagccggtggtgcatggaagctcctttagcggagagttagtttcaattttgattcatcaatg

SEQ ID NO: 25866 - DNA, 3000 bp, Unknown; identical to SEQ ID NO: 12338
  misc_feature (1)..( 3000): 2750-1469P.txt file - cDNA_ID_2708721; gDNA_ID_2214544; Annot_ID_134550

SEQ ID NO: 25867 - DNA, 3000 bp, Unknown; identical to SEQ ID NO: 12338
  misc_feature (1)..( 3000): 2750-1469P.txt file - cDNA_ID_2708721; gDNA_ID_2214544; Annot_ID_185350

SEQ ID NO: 25868 - DNA, 3003 bp, Unknown
  misc_feature (1)..( 3003): 2750-1469P.txt file - cDNA_ID_2708735; gDNA_ID_2214544; Annot_ID_134538
aatcaggtacatatatatactacattcatgtaactaataatgtaattgttctggctatgtatgtgattgtaggagctgcacaaatgtatgagaacggtgtgttagcgtacgtagatgttgaatttgtagcggatgttcacattcgagcattcgaggatacttcggcttgtggtagatacttttgcttcaaccaaattgtgaacacggaagaagaagctctcaagcttgtacaaactctatctcctttaatacctatgccaccaaggtaattattattactattattgttattatcattactactatataatttattattttatagttataatatatgatttaggcatgagaaagaaatgcaaggaagtgaagtttatgaagagagattgagaaacaagaaactaaacaagctggtggaagctggatttgcttgttaattacatgaagagagatgttataaattaaagggcaagaaaataacaaagaaattttatagtaagagttgtttgtttacttatttttttaattattgtactctcaattcagtattttatatatctatattttattttattttgaaatgaaaggaaaatatgtgttactcatagaaaagtgagtattttttttttggttttaatgtgagaaaagtgagtatttattacttgtatgtcattatttatggaatatatgatgaggctaggtagcaacaaataataagaaaatgagaaaagcattatacagttttgtactaaactacacatttgcaagctaagaaggaaataaattttgacatgtgcttgatgtaatttatgagttgtcaactttaaagtatatagctaactgttgatgaatgatttatcattaacatttttaaaaaaaattagatacaatttgaaacgtgtaataaatgatgagcatatatccatacattttgtttgtaatgggtttctgatttatccacacttcagtttctgcaagctgtgatgttagacatgataaaatcacacaaacaattcagagacatacaaaatcaggattgtgaagcaggatttaaagtatatagcttagttttttttgtatttttttttaacagcaaaatcaatattcacgttttagacatcagaaaatgaagcaggatttgcaagtttgagagttaaaagtcagtcattaacaaaatcaaaatctcaaatgcatccacgatttattaatacaacataaataatgcaatacgatccaaaagaaactacaaaaataaaatttaaggttcggtcttctcaaaaaagatcaaggttttgtcttcttggtatgtccatcatgaagtttcttctatgggacgttctttaaatttgcatgatatagatcaagatgggttgttgccatatgcgaggatgatgttgaattgcctctgctggaccaacgtttcaaggacactaaaattttaatgtctttggcaggaccggctataaaattttggggtcaaaactcaaacaaaataatttaagattattaaaaaaaaaagtggagccaattatcgtaaaataaaagtattattaacagtatattgaaattttaaagtcttgaaccacacttttgatcatatgagataatatgttttggtggtgttttaagagcaaaactaaaggagatgggaaactcgatatttggtcgatgtgggatgagtgtagacaacttcaaggctgtgaagatcccaacaccggctcttactccatttcttttcaaaactagtcgatacattctcatacacaacttattattaataggtttcagtgttttacatcaaccaattttatattaatcgtttatttatatttattttgttgtcgatgaatcggtattagaaattgagagcttgtggcatggtatatctgtacattcaagtattacagtggagaaatttttattttggactgatatattgttgttatcccgagctaaatttgtaaataggaaacacaaattgaaacttataaagtaaatcgcgagaaaaatcaattgattattagagaaatactaaacaatctgaaatgcaaatcgttcgctcaaagtaagctcacgattacacaacgatcaacatagactgctattgctacatcaccagagtatttctttgtctctctctcaacaatctagaaaagcataaagcttatgagatgtaaaggtagaaaaatttagagaaatatttatcatttttcaattaaaaatataataagagaaaaatgataatgcattatgtttaaataatatatatatataaagaaaaaaatttaaccttgtgaaatttataattttgttagtctaaatatagtatatgtagataaaatataaaattagtgagtataatagatgtgtcaccacttaccacttattacctaaattaaattcattataatgcatattggtggcagaaaaattgtatatgtaatgctgaaaaacaaaatggtatatgtaatatcattcgatagaaacaattcgaacaattggccgcattagaactacaatgacataaaaatgtcttcgtcattttaatttttttcttatcatttttgatgttgtggtgaaattttagtgtaacttttaaaatttatcgattggtgaaatcaaaaatatttgatcaattggttagacgctaaatatttgatcaattggttagaccacaacaaaaatatttaattaattggttagacgattgtaagatattacatcagattaatagcgtctagagaatacacttcgacgaaaaaggaaaatcacttaaaaaaaaaaaaaaaaatacacttcgacgaaacatgtcaatagtcatatgagttgggccttatagtttattgggcctgagtagattattgggcttaaaggagtagtaaaaaacaagaagacgctaacactagacttccaaaaatcaaaactttagggtttcagagcaaactctgtcttcttcaagccgagagcgaaaaccctaagctcaattccgattttgcaactatg

SEQ ID NO: 25869 - DNA, 3003 bp, Unknown; identical to SEQ ID NO: 25868
  misc_feature (1)..( 3003): 2750-1469P.txt file - cDNA_ID_2708735; gDNA_ID_2214544; Annot_ID_185336

SEQ ID NO: 25870 - DNA, 3003 bp, Unknown
  misc_feature (1)..( 3003): 2750-1469P.txt file - cDNA_ID_2708739; gDNA_ID_2214544; Annot_ID_134536
agcttgctccaaaggcagccgacggtggagtgcaactcattgttccaccaggaaaatggctaaccggaagtttcaacctcaccagccattttactttgttcatccaaaaaggtgcaactattcttgcttctcaggtatgaatgatttccatttttgcattatataaaactgaaattagataaatatattttgtgtaaggaattagtcatttatttacatgttttttattttgtggtttttcaaaaaataggatgaatctgaatatccagtggttgcacctttgccatcatacggacaaggaagagatgcagcaggaccaacatttgctagtctaatctctggcacaaacctaactgatgttgttatcaccggtaaggttaaccaaattaataatacaacaatttaatgaattagtagcaacagtttggtgctttaacgaccaagaatcaatgatataagatcttaagaatgtattttacgtataaagactagaattaatggaatttatttggttaggtaacaacggaacgatcaacgggcaaggaaagtactggtgggtgaagtatcgcagtggtggatttaaggggatcacaagaccttacacaatcgagatcatcttctctcaaaacgttcagatctcgaacatcacaatcatcgattcgcctgcatggaatattcatcctgtatattgcaacaatgtcatcgtcaaaggcgttaccattcttgctcctatcgattctcctaataccgatggaatcaaccctggtaagtccatatcccacgccacattatatcaaaacgctctgattttttgtttgtgtttctaatcatcatattggctttatattttcacatggcattgtcattttgttttgacacacttttttcttctttattagattcatgcaccaacacattgatagaagactgttacgtagtctcgggagacgattgcatcgccgtgaagagcggttgggatcagtttggtatcaaagtcggcatgccaactcaacaattgtctatccgacggctcacatgcatctctcccgacagcgctggaatagcactcggaagtgaaatgtccggtggaatcaaagacgttagaatcgaagacattacattacttcagacacaatccgctatccgaatcaaaaccgcggttggtcgtggtggttatgttaaggatattttcgccaggaggttcacaatgaaaacaatgaaatacgttttctggatgagcggtgcttataaccaacaccccgcttccggttttgatcccaaggctatgcccgtgattacgaatatcaactaccgtgacatgaccgcggataatgtcacgcaacctgcgaggctcgatgggttcaagaacgatcctttcacaaagatatgtatgtcgaatataaagattgatttggctgctgagccgaagaagttgttgtggaattgtacaagcatctctggagtttcgagcaaggttacacctaaaccgtgtagtttgttgccggagaaaggagcaccggtggactgtgcttttccggttgataagattcctattgaatctgttgtcctgaacaaatgctctgcttagagattgtgaacggagataatactaatttcctcataaatatatatacattgtctttttgcaatgtatattaattcccttagaagaaaatgtcccagctgttattttataaagctgatgggtacatgcaatggttttagaatacgcatacgaaattatacaatcagtttcgtggaattaaattaaagtttgaaacgacgattataagcatatgtatcgaattagagattaagctttcctagttttgtctaggattgaattcttatgcgagagatgaaaatgtgatctaagcatcgctagaccctaaacattaatggataacaaaaggatgtgtgttatatctacatggaatttttatgtcacatatcaaattttatgtatagtttaaaatgtaattaagtccttatcaaaacatatatgtttggttagtgttatactgtaattgatgttttttttacaaatatgttaaatagcgcattgcatggtttatcacattaaccaatgtttttgtgcttgatggctcgatttatgcgatgtgctaagttgtcttagaagacggatcctcggtatatattcttgtgacctaaagatatcccacgggcgacatcgcaactaattgatatgcagaatagactaatagtacaaaatttgtccgtatcacatattttttatgtcactagttactataaaaaataattaaaatacaagtcaacacataacaaaaagaattataaactaataaaatgattaaagtcgttgattagtttaaaatctgcaactaaaaatgataatatttgcaataatatttttcatttttatattccctttgttctactcgttttatctaattatgtttggttggcacaacatatatattcattttgataattctacctatctttcttttaagaacacttgtcagaattcagaacgtaagataaagctaactcacaatgtcatcgtaaatcatcttcacaccacaatcgctacctactaacttctagctactttgttgtcaacttctcatattaaccttctcttttttcactatagtatttgaatccaaattactaatttatttaaatataaactttagaaatattaaaataataatagtttaaaaataactaatactacaaaacattaaaaaaaaagaattacgtttttcaatcaattatttattattctgtttttttttccaccggtcaatggattaaccaacaacacaaagccatatagtaaaacaagaagatgagtaggttgggagcgtgcaacaatgaaatagttcacccacctttctcctatttattactacttccttctcctcacgtctctcctctacatagtaagacccaactaaatatcttcttttctctccatacactttttccagatatttctaatcaacaaaactgatg

SEQ ID NO: 25871 - DNA, 3003 bp, Unknown
  misc_feature (1)..( 3003): 2750-1469P.txt file - cDNA_ID_2708742; gDNA_ID_2214544; Annot_ID_134535
taccgtgatataatcatatgatctgatgatttggttgattgcaacatttcttttattaccatttttcaggcgtgtcttatagcagacatggtgcaatattttgttgacgccaaacttgagtttgatgcctctaacatctacaatgatgtcaatcgtgctattcaacatgtccatagaagtggattggttcatagaggaattcttgctgatcccaacagatatttgctaaaaaatgcaagtgaaagtccttcaaattatcttcacttgttatattacctttgattggtatattactgaaacagcaatttgcttctcagggtcagcttctacgtttcctgagaatgctaaaagataaaggaaagaagctttttttgctgaccaactctccgtataattttgttgatggcggaatgcgctttctaatggaggtaattcacattattgaatagatctaaaactcttttattttctcgttggaatatcactagggacaatcatttcaacactttttttattttaattagttgtccataatcttcttacggccagttccatatttttttttttttaagtggttcatgacctttattgggttgtgcttattgttcgttaggaatcttttggcttcggagattcctggcgagaactctttgatgttgtgattgctaaagcaaataaaccagaattttacacatctgagcaccctttccggttagttgtcattacgatataaccagaaacactatgttcttgtgtaaaacataatattttcttgtggaattgatcgcttaactcttttattgctattaatccttgtagttgttatgattcggagagggataatttggcatttacaaaagtggatgcatttgacccaaagaaagtttattatcatggttgtcttaaatccttccttgaaatcacaaagtggcatggccctgaggtactctttacaacaagctgatatattccattctgtaacttcatgcttttgaatgcatttaaagacagactaccacatgttttattcataggtgatttatttcggagatcacttatttagtgatctaagagggccttcaaaagctggttggcgaactgctgccataattcatgagctcgaggttagtttaccatacttgatgtctatatagctttttagttgattgtatcctcaaaagtgtttgtacatcatttaaagcccaaccttgtacactgagttctctttatgatgttatttttttggttcagcgagagatacagatacaaaatgatgatagctaccggtttgagcaggtatagtcacaccatcctcttttacttcccaagaatggctttttgcttatacgattttaacattcatgaccgtgatcgtagacatatagtagtttgagatactctaaataaagcaaagacgtatgtgttactaagtttgataagacaatttattgtgcttatattcaggccaagttccatattatccaagagttactcggtagatttcacgcgactgtatcaaacaatcagagaagtgaagcatgccaatcacttttggatgagctgaacaatgcgaggcagagagcaagagacacgatgaaacaaatgttcaacagatcgtttggagctacatttgtcacagacactggtcaagaatcagcattctcttatcacatccaccaatacgcagacgtttataccagtaaacctgagaactttctgttataccgacctgaagcctggcttcacgttccttacgatatcaagatcatgccacatcatgtcaaggtatataaacctgtgaccttaaaagagccggacattttgagttttattgattgatttgacttttgaattttggaattaaggagcttaacgaaaactcttttctacttttcttttcaggttgcttcaacccttttcaaaacctgagatagctttcattcccctaagaactgaacagatgatttcgctagacgagaaacttttcttgtatcgatgacgaatcagacgacaagaaggcttgcaattcaatctcagattcttgctgctgctgatgattcttttgcataacttaaagtggctaacacttgaaaacaaaggatgtaacaattagagattttttgttggttttagttagggattatggtgctactttgaagtttgatttctaaaaacatgaaatatctttgtagattatggtgcaagtttaataaaggcttaaaatgttttaagttgagccgtttattcataagttgcgaattcaattatgaaaaaaaaaaaaaaaaaaaaaacactacaattggagcaaagaagtagatgtatagggaatctagagcattagaatagtttagtcccaataagtaaaaaaattgctagtctcataaatattttacttataatataatatctcttaaaacggataaaatctcaatcccaaataataaatttaccccttcaacattacatgccaatttgaaaactaattaagagatttgtttttattataggtaactcaagatcttaatgatcttcttatagcccttataggaaggtccggatatttcattccaattgacatacaaattttcttcagtcaatttacctaatttaagatctataacttcagaagttggattattttctactaaaacgggaattgtttgtcttaacagaaataaataacaagattggtacataattgcaccttttttagctctacttatttttggtaaatcaattcaaggcttagatttagataaagtttaagcatgtttttctctattttgttcttctataaattactctgttttaagccaaataaaaaaacaaacacaaataccaaaaacaagtcataagaatcaaatggagttctctatcaatccttcaactctaaaggtaacgttattttaaacaatgtcatcctcctaaacatgttttgaaagtgagtttaatttgtgagaacattcaaaatatggtttaattttttcttctattcaacagatg

SEQ ID NO: 25872 - DNA, 3003 bp, Unknown; identical to SEQ ID NO: 25871
  misc_feature (1)..( 3003): 2750-1469P.txt file - cDNA_ID_2708742; gDNA_ID_2214544; Annot_ID_185333

SEQ ID NO: 25873 - DNA, 3003 bp, Unknown
  misc_feature (1)..( 3003): 2750-1469P.txt file - cDNA_ID_2708746; gDNA_ID_2214544; Annot_ID_134551
ttgcacccggacgcatcccaagatttctctctgcctcagaatggatttcattgattttcttcgctttcacctgccattgaataagtacaacaacacgtaagcacggataaagaactaaagactgttattaaaagatttgagatggaatgataaaatcttacctcctcacgccttggtacccatttattagctcgaagatcaacaacgttttggaccataaatctgagacgcagctctagctgagggtgccttgctagctccttcaaccgaccaaagtacgtgtcattaatacctcgagatcgtgggctgtcatcaagttgcttcccaatggttataaaaaattggcagagagcttcaacatctccctctgctgggcaagctttagtatcgtctcctaaaagctcctgaacaatatgatgaactatcttctcaggcaccatcttttgcttgagaagttcaccaatcagacggatatttccaagtgtccggagctttgccattttctccttatccattctttccatttcttggtctggattagtcatctgtctgatctcttccttcaatttgccagcaccttcaaatgcctcttggcaattattcaaaagcactcttttaaaggttatttctttcccaccgggttcctcagagggaaacgaaggtagctgtccgttaatatcaaaacacagaagagcatacatctcgcagaatgtgggctgcagtatagcattctcaaaaattagctgtatcacttcctgcaatcaaaggtaagagcaaatcaataccatgaaagagagaactacaacaatagagatcaggaattgaaacaaacctttaggatatctgcggaagtgatgccagcgtcaatcaattgacctttaagaagctcgtacttctccggagtaagcttgtttagaatactgcataaaattgtaaagaatcagtcagaatatacatcacatcaaccttcaaacacaaaagctgaaaagaatagtattagttgttgacaataccctttcacgctcttaacgactcgatctttatctgaaagagctcctcttttagctgaccacggaacctccgctttaatcagcacaggggtaggaccagactgtttcacaagatgatcatgttagcaagaagagaaaactagtaatgatatgccaacacataacaagtgacgaaaacttaccccttgccatgtacttttggcttcacgagggtcgtcccttaaccattctttaccagaggttggaatctgagaacgactatgccagtcacggttatcagtctcggtatgacgatgctgagtatgatttgttatctaataagaccaaaaccaagaatgaaagtttaaaagacagattccaaaacaggaggattacacacacacacacagacacacacttactttactctcggctgcatgattcccccaactctgctcttcgccaaaaagctcaactgcgatttccttacagcgtctaagaatttcatcagagacttgaacagactgcgatcaagaaaacacaaaggtgaatgatttggttcacaaagtcaaaaacagaatcagagaattaagttaaatacctctctgtgctgaagtatctcttctcgggaaaacctcacacgttcaccagaattttctctctacaaaaacataaaatgtcaagagcttaggattcaattacataacataaagtatcaatctttgtccatattcaaattcaacaaccctaaaaattcaaactttgtacaaaattcgattcaaaatcatggaaacgaatccaatcctcgtttaaactcgaattgcgaaaccaaattgaagagaaacagaggatttttcaatgtatttaccttgacgggaaaaggggtttcttcggagccgccattggtaagatcaaaagaggaagaggagctaaagcgagggacgaaaagcctgcttttgccgccgccaccgccgggtctcaaactcaaaaccgatggttcaccttgttgttgcattactcgattctcttgttttttcgcaattagaaggattcaataaaaaaaagttttgcagatagatagaggtatatagtgtatatatatgtgtctgtattgacggtggagaagataaaatcacttcgattccctttttttttttggctgaagctgtgttctgtggtttgccctaatttccttttcttcttctcacgtgtaaatgttattgttaattacgaaaatattctgtatatcaaaataattttatttattgaaaaagaattgatggaaaaatcttacgaaataaagacttaatattgtttttaatgcatcattatcaaaatacaagtctactttcacagaattaattaccaaagtatcctctgtctataatctccaacacaaaataattaatttttgggaaaaataattgatggaaaatcttatgaaatgaagacataattattttgtatttattgcatcactataaaaataaaaatctttgttgcatcattaaaagtgttgttggcatggctcttgcatgagttaagttagttaattcaaagattacctctatctataagttatttatttttgtttcctaaaattatgaatttttaagtaaatttgacaaatatacatatgtataataataaatatagttggtttattagattataatttcttaaaaaataaaaaaataactttatatgcatagattcctttgcaaattataactttattttactccctttaaaattaggaacatgatattcctcaaatttctcccatgttcaatgtgattatgctggttttagtttagatgttaaaataaaaatcctaaaaactaaaaagtaattgggccctttgttttaaagcccataagcccattaataaaaacattgacgtttagcttccaaacattggaaacgacgtagtttcattctccgttgcgttttattcttctggataagagcttcgtgatggtttgaaacctctgagtgaagaagaagcgccatg

SEQ ID NO: 25874 - DNA, 3003 bp, Unknown; identical to SEQ ID NO: 25873
  misc_feature (1)..( 3003): 2750-1469P.txt file - cDNA_ID_2708746; gDNA_ID_2214544; Annot_ID_185351

SEQ ID NO: 25875 - DNA, 3003 bp, Unknown
  misc_feature (1)..( 3003): 2750-1469P.txt file - cDNA_ID_2708750; gDNA_ID_2214544; Annot_ID_134532
tttaccaacaatcaataattccccatcaaaacaaggttttattatatcttagactggttagtaaaccaatagcaactatgagaaataatacctttgggaccttaagtaacttcatgtgtgcttcgtctgctgtcttctgtcctttccttgagttgcatcttgaacatgcagctacctatgtttcatgaaaccaattgaagaaaacaatttaacccatcttcaatattcttggctacaacatatatgctacttcgatatcaatcacatactaggttttgccaagtccattctccacctcgagaaaccggcataacatgatcaatggtcaaattttctcgcgaagaacaatatctatatcccaaataattaaagttctgtcagcaacaatagtttgattccgcaaaaacagagagatatgattgcgagtagagatagaaaaccactcactgacaagtataatcgtctcgtagtaaaatatttttacggctaagtgagtttttcactcttcttcttttaacaacctgaagcaaatgtggaacctgaagcaagacaatgaagtaagcttcaaactggcaacaagagataaaaactggctaactaaactcatattctacatacccttaatacagctggtatgtagaacgaacccgtaggagaactaacagtctgatcataatactccaaaacgtcggcctagacaatgcacaaaacctgaattaaagatcattatacaaataagcaactatatacctactttttacataatacaaatcctgcgtttttgttgattgggaaatttcttgcataatcgtattagaaaacgtcattatgtcattatgcgtgttaccaatcagaccctaagtatcaacatgagttaaaagtcttttggcctgaccttatccatgtactcgaggcagattgcgcgcttccagcaaaccacattgaccggcctacagtgacacaacatgcttgaacttgaataaagagagaactaatgcttcaatcaactatataactacatatattcgtaacacaaacgaagaatttccatatatctcttttaatatatcctgttctaagatcaatgaatacattgtaactaaaaataataaactaaaatgtaataatacaaaaaaaattgttgacctgtatgaaatatcaagaaccaagcctctgaagcaagaaagatgatcatcagtctctaaaccatcatcgtctccatcaaaatcccactcatcgttgtcttcgtcaatatcaagatttttctcggtgttatcgagatccctaattttctttctcttataaggaaaagagtaagatgagaagattctagcacaaaactttagtcggctcatgcgtattggaaccaaaggagatccaccaccggccatgtaaaggctctgccgaaattggtctctcgaatctacaccaaaagataatccatcgttgcttgagagaagcttaagtctagcagagaaatgtgccatttgattgaaacgaaacgaagaagttagggtgatccaaagtcttggaaaattattaggaagagaaattgtttacacaatttggacttgagcagagccgttaaccacaaactgatttctatagaaaaaatatcatgctctataaaatgacgaatatggcctcttatctttctaccaagaaattagaaaaaaaaaaaaaaaaaatcatattcgacgctgccgacaaatcacaaattttcgcgctaagctaagtatcgatttttagtttaaaatttggaataattgttactcgttatataaatttggaatttaataaaatgaaattaaaaatatgtatagtttgatagatcccaaaaagtattcaaatttacataaaaatagaatataattttgatactttttgttaaattttttctattaatataaaaatttgaattgtttaatagaaatttcagatatgttaattttcaatgataaaaataatatttcagatatgtgaagaaaaaaaattcagcatttcattacatttatataaaacacacaaagaatttttgtgtgtttgaaacagtacaaactatagttacaagttacaacgtatagcacctcatgaagaggcaaaagccaaaaagttgcagaacctgtgaaatagtgtttgatatttccatgtatgatgtattgtcttaagacctcatagtttcgaggttatgcggcttaaagttgcttctatagatccgtgaggttcattggtttggcaggtacacatcatctttaaactgcaaatgcaattcattggaaacgattcatatcctaaaattattggcttttatgcaagtttttttttgttgtctgattttaagtttataactatgtactactgctgctacttttctacttatcattttcgtttacgtttcgtggtttcatcataaagacaacatcaaatagaggttcttaccttcaccattgaagggttttgcttggttgaaagtgtatatttggcagttttaggtgaatcgatgatacatcaacgaacctgatcatgttaataagaacctttatcatggtaagaatcacataatcacacaaacagcaaaataaatatatactgatatgatgataccttttcagtacggcgcttcccatgaggaagagagtgcgttggacagaagagctgtacacaccagtttctggtggaccaaagaaagtatccattaggactttctttacgtctatgaacttctcgctgaaatagagtccctttgttgggatgcttgcaactgactcaaacgagtatgtcatcgtgaacgtgtatgtcggttctaagaatcaattacagataagaatgtagcattactaattaactcatacctacaagatattcgacagatacgttattgtctgccttaattaaaggcttaccttaaaggtaaaacaaagttttgggaatcattaaatagttgtgattagctcgtgtttctaaggcttctcgtgttttttttttgttttttttgaggttatg

SEQ ID NO: 25876 - DNA, 3000 bp, Unknown; identical to SEQ ID NO: 12343
  misc_feature (1)..( 3000): 2750-1469P.txt file - cDNA_ID_2708754; gDNA_ID_2214544; Annot_ID_134531

SEQ ID NO: 25877 - DNA, 3003 bp, Unknown
  misc_feature (1)..( 3003): 2750-1469P.txt file - cDNA_ID_2708758; gDNA_ID_2214544; Annot_ID_134530
ctcgttccttctttcactcgttctcatatccgatttacttactccgccgccggtgcttcttctcctaatcgagctattcactgcatggcttccgattcccctcaatccggagatggttccgtctcttctcctcctaatgtcgcggctgttccctcttcttcttcttcttcgtccgcttcttccgccattgatttcctctctctctgtactcgtctcaaggtaagctttgattgatccgccttacattttcgctaagatccggtggttttgtgtgattatacaacgcaatgttggttagatgatgcgattgttcttgttgatggattgtgtggaaatctgatttcgttagggaaatgaaacgatttcaagctatgtagttacttttgatgttcttgttgatggattgtattggaatctgtaaattcgtttgtgcaatgaaacgatttcaagctttgttgttactgtgtagatgtgaagtttttatgtgaatctggttagttttcgcggtggtttctgtcaatgaactatttctactcgtaacttttgtctatggaacctagaatttgatacagatgttggtttgaaacctctaacgcattgtttagatttatgtggatgttttttaccaatgtaagattggatctgtgttaagaatggagattattctggtgatggattgtagaaactcaatgcattgtaactgtttatataagatcatttgttttttagatttgtgtggatgtttgttatcaatgttatgatggatctgtgtggagatagcttgaaacgtttcgtgcttaatggattgtattggaatgtatagtggattgttacggaaatgaaacattgtcaagcttggctgcatctgttgacggattgtagaattcgtttaggggaatgaaatgatttcaagtttatgtgattaatggtctgtgattactaaatccttgaagatgtgaagtttgtcatgtgttttacttttttgtgaatcaagtgagtttttgtttgctgatttaacgatagagtttgtgtgctgtatcgtttggtaaaccatctttttatatcaaatagacaactccaagagctggatggattaagagagatgtgaaagatccagaatctatagcggatcacatgtatcggatgggtcttatggctctaatttcttcagatatccccggtgttaacagagacaagtaagtttcttgcttgcttctctcttttcaagtttcaactgctgtgaaaaaactcttcttatatacatacttttctttctatagatgcatgaaaatggcgattgttcatgatattgcagaaggttagttctttcacttttagagatttttaatcatcgattttcttaatcacgagttatttagtcgagttgttgttgagcagccattgtaggagacattacaccttcttgtgggatatctaaagaagagaaaaaccgaagagaaagcgaagcacttgagcacatgtgcaaactcttgggtggaggcgaaagaggtctgtttctcttctattgttgaaataccttatgtatcttcgttcgaccttcttatgctcatttgtataacacttatcatcacttctaaaaatgtatatatcgtaattgcagcaaaagaaatcgctgagctttggagagaatacgaagagaactcttcacctgaagccaaagttgttaaagatttcgataaagttgagctgatactacaagctttggaatatgaacaaggtaatgaatgaccaataaaagaaactctctttcgataagagatttagcagaaactaatactcatattgttttttgtttgctatttaacgcagatcaagggaaagatctagaagagtttttccaatcaacagcaggtaatttttgttgtatgtcattatactctaaatagataatctgaatatggttgaaggctttaagcttgttactgtttgattcagggaagttccagactaatataggcaaggcttgggcgtcggagattgtttcaagaagacgaaagcaacattagttctcacttgactctttctttttgtttcttaacgtctagctcagtggagttcaaatactcgtacgtttcaaatttaatcatcttaaggtttttctaataatcttcgtagctgtctttacttgttttgttactatcactaataaaagatagctagctagtgactatcttatagatagctaatgaagatcaaaaaacttaatcaagctcttaaattttattttaagaaagtatcattggttcctcaatataaattttcggatcgttaatagaggtcaaatgatttttctttgttttgttttgtttcaagattttgcacgggttaaaagttgaataagaataacgaatagagtatagacacttcataaagtgtagtttccctgccacacttagatctcctactaacctcacttagattagatttctctctagtctaaaagtctttaaaccttttaccattgggtttcacaaaattaacattagtagttatgtcttttctttttaaaaacatattttagaataaaccatatctccaaccgaaaactccaaactctctccgacgcttatccgcatagttcttttgtcgattttgagcttcttttatcttaacctttaagattttgattttttccgatgttcatgttattaaccacaagtctacaattaaattattatatttttttaaaaatgattcttgcgcgagaagctacttagtggactcggaaggagaagggaaattggtagaggttttaatttgcaaaacttataataatataatagtagtagtcgtaacaaatggtttagctgattattcaacatggaacttttcaaagaatgtttcagttttagttgaacagacaatttttacccttgtcgtaacaagacaaataacgatttttccgactctcttcattcgatctctctccctctccctctctcgatcggaaaagtttgaatctccggcgatcttctcaagatg

SEQ ID NO: 25878 - DNA, 3003 bp, Unknown
  misc_feature (1)..( 3003): 2750-1469P.txt file - cDNA_ID_2708769; gDNA_ID_2214564; Annot_ID_134916
gatgagacgggtttccagttaccaaatggacatttctaaaagagcattatagaagactctgttacctttagtattctgctaaaaagatggtcaagatctcaggtacaagttctagatgataagcggccaacaaaaagacgagtgttcctatagctatcatcataccgaggcattttcaaactacaaagttaaaaagggacaaaaagaaacacaaattttgatcataacccgtaagaaactatacaacaagaaaataacacttctctaactcaagacataagaaaaggccccaaaggaaagtaaaacttcaatcaaacgccactcagctaattcagagacaaggaagcaattaatcggaaaaaccgaaggtccgaagctaaggaaaccatcaccggagatacatcaaaccaatttaaaatcatgaatcctagctcggaaggcactaaatttcaatctaaattatcaaattcaaaagatttttgatacctaagaaggtgagcactgcgaaatcggaagccctaattttgaaacaaaatggggaagaagataagacgacaacgattgtttttaaaataaaaatctgtacaaataaataaattaatttgaaaatattaaatgggtgtaggagtactaatcggctcaacaaaagtttattctccttgactaatgggccagtgacttaccaattttaacatctactatcttaataagaaaatgtgttggaaatggtccagaacctctaggacttatactttttgtagattactacatctattttttttttaagttgattatgaaattttaattattaaaaatatattcatatgtcaaatctattttggttataaagcaaatgaaaggtgataggattacttatattttgaataaaatggcatgagcttgcatatttgttagagagcttgaattatgggtcacttaagtaaattttaatttataaactgtagttttgtatagaaagtttaaactgtttaaaatttaatattctttcacaaatatacacatttctattataagtttataactattagacttctaaaactgttaaaattatttgttatcagcaaaatcaaactatttatataaataaaacattaataaatgatgcaaaaatcgttaaatctttaaataaccaaaatttctattcaaaaattaaaactaatcaaacaaaaataaaagtatgtactaaagtaattttaagaacaaaataaaaatttccaatgaaatgttactacattatggctctgattggtgatgacaaaaagaacaataggaatatgaatgaaaaagaacaaaaaggaacaaaaaaaaggaaaatagtcataagtaggaaccaagaggaacataagaattgaacaaaatgattatggtaaatggtaaccaaaaaggtgaactaatatttaacataagaattactaaaaaaatcatttattgaattttgtttattaatttcatttaaaattaaagttctgtatgaatttaaaataaattaaattataaatttctcttcaaaacatttatttattttatagtaaaaatttaaattatattacaaatttaaaataaatttcactttaaaacatttatttatactaatttaaaataaattcataacattcattaaattgaaagtttgataaaaaagtatatatatatatatatatcaatatatactaaagatatagaaaatattatatatagaaatataaatattatcataaagctattttaaattgatttaataaataaaacgaattttatttttttgctcctcttggttcctgtacaattttggggtggaacaattttgttctatcattcctttttttttgaaaaatgatgatgaaaaatgtaggacccacatgtctgaaaatggaacaaaaatacgttgtaaatggtaaaaaaactaaggaacaaagaagaacaccactttcctactcattcttttcctcaaaagtggttatcaatcggaacctatgatatatatgtttttatataattcactaacaaaaaaaacaatcttaactaaaactttttgcaaacactattatttttacattaccttccacacatcttatatttttaaatataatgataagtgacaagtttatgatatatatatatatatatatatatactataatttaattcactaacacaaaaaaacatatacaaactttaataaaaaaccatacgataatacttacaacccgcataatatgcggtacacaacattagctattgtgtcataaataacactatacatttttctatgtacattataatttatacactacaatatatatatcactaaaaattattctaatatgtttattagaatataaaatctccaagtacgtgcgggtcagaatctagtttgttatataaaaataaaaaaccaaaatgtaataaaaaaatttataataaactctcataaaaacgaattaaaaaacattactacgttaaaataatcttaaacttcaacagtcaaattataataatgtttataaatatatatgatgatattcttagaatcaaatctcgattttggtagatttcgattcggttggattctcaacatttctttcaaattatctatgattttttttctttctttctttttttaaacatatctgaactctagaacaagcgaccgtgagtcataaataaaaggaaagagatccaaaaatataaatgcaactacttgaaatcgactaaatatatcgaaatcacgtgacaaatcagcattttatttattctattaactttatagttggttccacatcctttcactctattcgatgtattgtacacatctggcacaaatctgcatctctgtcttcttcttcgatcctcgatttcatccacaatatacaatagccaaatttccgattttctcctcactgaatctctagaatccatcgttgattcaaactcattttccgatcaaacggcatatttttccctctcgagagagcgataatg

SEQ ID NO: 25879 - DNA, 3003 bp, Unknown
  misc_feature (1)..( 3003): 2750-1469P.txt file - cDNA_ID_2708773; gDNA_ID_2214545; Annot_ID_134565
gtgaagcccaaattcaacgtgagggaattgaagccaatcatgttgcacccgaaatagttggaggcgatggagttgcaaagcgtggagttgcagaagatggagatataggtgatggagttgtagaggagatagtaaatgaggagggagaaggatatgatctcatgattctagtgttgatgaagatgattgtccggttattgtcgaagataatagcgggtacagagaggcagaacaatgtttggctgaaaatttagaggaagaagaagatgaatttgttgatgttgaaatctgcaataacttagaagaccattttgggtttgatgcgtgttaagatgatgctgttaataaatctgatgaaagcggagatgatgtttgggacagcgagaagattccagatccattatcagatgatgatgacaaatatgaagctgagaggccattcactcatggagaccattccgatgaaccgctagccttgaataatacaatcaacaatgcagacgaattcaagtatgcactcctcaggtattctctaaagactgaatacgatatcaaaatgtttaagtcatcatcgaataggcttggggcaaagtgtacacaacacatcaaagaaaagtgtccttggatagtgtattgttcttttgagaagaggaaaaacaagcttttgataaggagattctataataagcatatttgtgtaagatccggttaaacaaagtttttgaaaagtggaactattgcacaactttgggaagaaaggcttcgattgaatcctaaaattaaatctcaggagatggtagttgaaattaagagggagtttaatatgattgtgactgtgcatcagtgtaggagagcaaaacaattgctaagaaataaaagaaaggctagtcatgaatcacattttgcttgcaatgattctataggttatatgtttgttttgatgcattgaaaacagcttggaagaagtcttgttggcctattattcgtttagatgatgcatttatgaaatgggatatcaaagggaaaatgttagttgcagttggtaaagatggggataacagaatatttccaattacttgggcagtggtagaggtggaggatattgataattagatgtgttttgtgcaactgttgaaaaaagacttgagtcttggagatggagctgacattacaatgatatttgataaacatcatgtaagatttttggttctcgtaagttaaatgcaagattttatgatttcttgtgttggatattgatattatttacttgtggtgacaagatttattaaatgcagttcgtgatgagcttccccaagctgaacacagaatgtgtgcaagacacattttggaaaattggaagaagacaaacaaggatattgaatttgagcgtctgttttggaaaatagcaaggtgttacacatcacaatcctttgcaatatagataaattttgatgactttaattttgactataaaaataatattataaatgacaaatttaattacaatttattatattcatatttcataaaaaaaattatattatttatttactatcttcaaaaaaataaacatttaagatagtacttatttagttattgaatgtagcagatttatagttggaatatgtaaactgcaatattttacatgcatgccatttcaatatgtgtaaaacattttgacagacgatgcatgacacatatctctctcacaaatttccaaagtccttttaaatttttccacaacttctatttatatatatttgattatttattctgaagaatacttttagaattttatttatcttcatatttatggataattttggtatatttaaaaaatgagaaatgaaaaaatatttaacaatgtggataaagatcttctagaggttctaggtttaacagaaaaaaaaacaaaatcgtggcagttagctcaaattgagttccatgttgataattaaggttttcttaaaccagataaaaaagtttgggttagaaagatctcacataataatatatttatttaggattttggtgctttgtggacggatcacagagagaaaacaataagttttcaggaacagtgtggttctatacatcatcaaatacagagttgccaactatatgacgcgaatctctgtagaagtctatctctactccatacctaagtcgaaggtctactctggacgataaagtgtatgatttgtcccgaaaactaagatttagcctttttacggacagttcaaacctggtgaatatggtgtctttcccaaccgaatggtcggcgtttcaacatatttggaggattttcaaagcgacaaagaagaattcataagcttctttttattattaatctctcacaatgcaaatgtaaaagttgataattcggtatgaaaagttcgaaccgtttcgtatcatttatgtaaacaatattcctcaaaattggatcttttgaactctaaataaaaagataattaaaaaaatgttcatctatgatgagctacatatattatattgtattagcaacaaacctcatgatacgttcaacgtcgaaaatacacattctaagtaatagaaaaataactattaatattcccatccatgttgaagaaaatataagaaaagctaagaaactcaaaaagaagaaataaaaacaccatagaaaccggaagtgtctaaaattccaccacaaatctctaagtgactttctcaaaaataaagacttcgtcaacacaaactttcttttgatagaccacaaaaatttcttatgttgtctattcttggtatgctttgatagagacctctcctcttcaacactcgctctctctctttctttcctttttttcctctatcatttcatccatctcagattatcttcgtttttcttcatctccagagactctccttccatctacccttagagggcgcgcctcccgtgcgccttcttaactggttatggaatccaaatgtctcatgttcgtttccattgtatctgtcttcttcatg

SEQ ID NO: 25880 - DNA, 3000 bp, Unknown; identical to SEQ ID NO: 12380
  misc_feature (1)..( 3000): 2750-1469P.txt file - cDNA_ID_2708783; gDNA_ID_2214546; Annot_ID_134593

SEQ ID NO: 25881 - DNA, 3000 bp, Unknown; identical to SEQ ID NO: 12380
  misc_feature (1)..( 3000): 2750-1469P.txt file - cDNA_ID_2708783; gDNA_ID_2214546; Annot_ID_185432

SEQ ID NO: 25882 - DNA, 3003 bp, Unknown
  misc_feature (1)..( 3003): 2750-1469P.txt file - cDNA_ID_2708799; gDNA_ID_2214546; Annot_ID_134583
agacatatcaatccatccacggaagcggaaagaagcttgttgggcttgttaggaacaaagtgtacctataattaagaacagagttgacatctataaactaacaacaaactagttcctttcccgcttgagcagaaagaatgagagagcaacaaacctgagtgacgtcgtccatgtgggattcctctaaacaagcaacttgctttgagtttctccagtcccacaaaagaacctgcaccatcgcttcagattgtaacaagctgaaacatagaaaatgctcaaaactagccttttttctttctcaaagtgtactcctttttaaacatttagagaaacaaaaaaaaaaacacgattccacaggattgagatgcctaacctgctctttgcatccaccagccagaagattatctgcagcacctccataggagaagctgaaaatctcctgatcattcccagtatcaatacgcgaaacctgaaacacccatgatcaacttaaattcaatgagttccgaaaatggaatcacatttacgacagaatttatataaaaaaaaaaaaactcacctgttggaaacttcgagtgtcccaagatctaatggtaccatcggaggaacaagagtgcaaaacgtgaggagacgccgccgagtcggaggaaaacgcaatctgattgacggtatcggagtggcctttacattcgccgtagtactgaccagtcaccggcgagtaaagcttgacggtgttggttgataaggaaaccgcgattgctgtccaatcgattctgtcacaaaaccagagttgggttcactttcagtaaactaattagtatggttatcgaaaagagagaacagaaagcttttactttgggacaatctggaagacgtagtcagagccgaagttggtctgaatagagttcttgagcccaaatttcttcacgttttgagccggagaagaatccgaaagctgacgattttgaacctccacttccatctccgacgacacttcttccatttgccgtttcagcgaaattgataagggttttaacggtctagggtttgttcgttgatcaaaacgaaacgaggattagcacttacctctctaagtcatagagaaggttataactctataggtcaaaatttaggcctgttttaaccttttcggcccatttaacgcacggtccaatacgattattagcccaaggaaacaacaaccaactcgctcgctcaccgtgcgcttcttctaaacatgtccatagaaacataaacatactaaaatgtgaaaagattaaattaaaaaacggatagaaacatatagaaagccacgtgatggtagcaaacagatttagtggttacaaccagatatcatttgatattgagatttatgaaaatgtcctttttcaatggctccgatcggtcagtgatcggatctaatattataaaggtgtgttgacccataacataatattattactaatacaagtaacatgcggtaattaactctatgtcgatcttttttctctgcatatatatcttttagtcggttttttcgttcttgctaatcgttatattcctctacacatggcaatggaaaagaaacgagtaacaacaacaagtagcctgcaaataattaagtgcgataagacaactctgctctgattggaaactgatattccggcccgtcccccttttattacgtaggagtaataaaattgggaacgtcaacttatattaatcatgacgacgttttctcaagggagcaaattgtacgttacgtctcatattatcaccacttttttgcagcaacacagttttatttcacacaatacaacaacactttatattatatatgagagtgatagaattttatcattccatatttccatgatataaagggttccaataattggtccaatttttctaataagacttttcttattctcatagactcttcttattcatctttcttaatcaattcgaccaactcagtggaagacaaatctcacacgaccctttccactttttggtaactttattattaatttattagtatggtgtagttcctttctttcttctgctgatcttgtcaacaaaatactaaatttttcctaagcggctgtttatatattattaacaaaggtttccgcgtgtctcttgtttaactagtagactaaaaacaaatcgtaaactcgattttctcaaccaaatttagaagatactacggcatgtaattagctaatgataaaagattcgaattttcgttccaatggatttgtcttttcttttgcccaaaaccaagaatttgtcttctcttggcagtatttagctagacaacgcatatagctatatattttgtgtacactggtcaaggtcgtggatacgtcattaataatattatttccaataagtcctattaaaacattaaacaactttgagttttaaaacaaacttagtgtaaagaaaataaaaatagcagacagtttacgggtaagactagatgaccatatatgattgagtgcataaaacatcttttttctttctttttttgaaaaagcgaaactaaaagattattagttgttggaaatcagcttagcgtaatcttcgagaaaatgactctaatgctaaaatactgatttaatcaattttctaatggtttgacccaacagacttttttttttttctatcctctaataatatataatcatatagtagtaattatttagtagataatatgattaacacgtgaatagcaaagtttctatcatttttattcaaaaaaagattcataagtaataaaatgatagtcaacttttctttttctttttgtgtttggccttttgttgcagcgtcattgttgtacaccaccagtcacactattgtgggatgtgataatcggtaccttttaatgtcaggagcttctttcttacattttccacttcaaacaaaccgataattcagaggaattttctcttcctctctctctctcttttttatattttttcactgggaaaaatg

SEQ ID NO: 25883 - DNA, 3000 bp, Unknown; identical to SEQ ID NO: 12370
  misc_feature (1)..( 3000): 2750-1469P.txt file - cDNA_ID_2708814; gDNA_ID_2214546; Annot_ID_134569

SEQ ID NO: 25884 - DNA, 3003 bp, Unknown
  misc_feature (1)..( 3003): 2750-1469P.txt file - cDNA_ID_2708822; gDNA_ID_2214546; Annot_ID_134601
tttgtttcttagtagaaaataatttggctcctttgtagaagaagaaaaaaactaaacggctttaacatatggactacgccgtttgtatcttgttgttacaaaccattaaacgttactgtttgatcaatatgttaattcagaactgtttggtttaaagcataagtattgaagtcgtcaaatgaacaacttgcaatcttttgctttgtatgagatacaaataaaatcgtggtccgtttataaaatagctttctccaaacaatttcaattcccttttaactaacacaacaaacgacccggcccgtcaaaagaagaccaacagacgatgaaataaaaggaaaaactcaattttctaaactatttttgggggtcgtaaataagtgaaaagcctgccgacgaaaaaagaagaagtgaaaaaagaagtgaaaagcccttgtcttatttgtcttttactatttttctgatttaaaataaagaaacaaacatttacagtatttgtttataacgggggctaagtagagaatcatgagaagattaaaatccctaaaagttttgggggaaagaagaaagaaggaagacgatgatgatgctcagaatccgaagcagagatggactggagagagtcacagcggagggagctcatatcactgtttcccagctcaaaaccttgatcgcggatcagcttcagatccctctccataagcagaccttatccaccaatcgtgatctcctcctcgccaaaactcccgctgatctactcgccttcaccgacctcacggacccaaacctccccctctcctctctcaacctcggccatggctctatgctctacctcgcctacgatggcgagcgctccattcctggagctcctcccgttactcctgccggatccttcgggaggaagatgaccgtcgatgacttgatcgcccgccagatgcgcgtcactcgtcaggagacgtctcactgcgactccgtctccttcgatcgcgatgccgccaacgctttccagcactacgtcaatgagtctctagcttttgccgtcaagcgcggcggctttatgtacggcaccgtcaccgaggaaggacaggtggaagttgatttcatttacgagccgccccagcaaggcacggaggctaatcttattctgatgagagatgctgatgaagagaagcgcgtggacgcaatcgccatgggcttggggatgaggagggtcggtttcatttttaaccagaccgtggtgcaggacaagactgaatacactctgtccaacgccgaggtgctacaggcggcggagcttcacgccgagagcgagctgaaggagtgggtcacggcggtggtgaagcttgaggtgaatgaggatggtggcgccgatgtccatttcgaggcgtttcaaatgagtgatatgtgcatcaggctgttcaaggaagagtggttcgagacggagattatgccggacgatgatccaaagctctctaagatgaagaaggaggtggttgttggtgtgaaggatcttaaggaggtagataacgatttcttcctcgttctcgtcaggatcttggatcaccaggttcgtgtttttctctctacccttcctttgcatcaatcatcattgttctttgtactaatgctctgcttgggcaaataaagtaattgaatctggagcttttaagtcttaggttaatgaagcttgtcagtgtttgctttccatgagataattgaaaattagcatttcgtcaatggtccctgtgttttaacattaggctgctgtgatcaggggcctctgtcatcaacattcccaatagagaaccggagcagtcgagcaacgatgcgggctctaaaaacacatctggaccgggcaaagagcttgccgttggtgaagaagatgtcagattttcatctgcttctctttgtggctcagtttctggacgtgtcatcggacgtccctgctttagccgagtgtgtgcgtctgcagtcgcctgtcccagagggctatgcgttgctcatcgaatcaatggccaacacttgttaatttttgtgtcattgttttttggttcttgatacagtatatcatgttcgttttatggtccagaaaatcttttttactagttgacaaatgaaaaatctctagtgtactcgtgatgtatttgattcaagtttgggggttaatttaagttatcaacaacttgtagaaacaaagttaattcacagagtaataaatcattctaataggtatgctcaggggcaaattggcaaaacataaaaataaaaagagagctactaaagttttcgagcgaaagcgaaaatgaaaattttataattcgagcgaaatgttaaaaagctgaaaattgggggaagaagagagaagagtttcatcgtcactggaatcaatagagtcaattggcgggagaggttagtctcgaaaagaagtggaagccctagggggaaactttctcgctcactcgctcgtctgcaaacaccatggaagacagtcctcaaggccttgtgagtctctctttgcttgtttgattttgtttgggaattttggattactcttaagtttttctgctgggcgtgtagaaaaggagtagagatccggatcaggatcaggatgacgacagcggcgaggctggcaaggccgacggaagcggcggagagaatcaggagcgcagcagcgaccagattgagctcgatgacgacgatttccaggaaacccgtcccaagcccaagcgtagtcgcacccatcctcctcaacagaatctcattggtacaattcatattcctaaatcgctccaagctttgtgccaattgattgtttcctaaattgattgattgtttttcttagagagcttcatcttgtttgtttgggtagatctttcagctttcatattttttttgctaacagaggttgtcaaaggcaacggggatcttatttctaaagccgtcaagatttgggttgaaagatatgaagactctcccagccttgctaccactgagctcttgtcaatg

SEQ ID NO: 25885 - DNA, 3003 bp, Unknown
  misc_feature (1)..( 3003): 2750-1469P.txt file - cDNA_ID_2708826; gDNA_ID_2214546; Annot_ID_134588
agcaacatatatagcgtgagtacctttggtgtcctgttttcagtccggcattgacaatcattgtcgagacaacaaggccagctagaggatctaaaaaattaactccgagaatagaacctcctgcacacaagtcatatttcacgatttatgagaacttcatgtctccctttatcagtagttccgtacaatagctggaccgatgagagagacttggtaaaagtaaataaatggaattcagagatctacattgtctccagttctttagtagtagccatatgcgtgaccaggtctgggatattgaaacaaaggatatagttgatttacatatgtactgattggaaagaaaagcttaccaactccaacaagtgcaactagagaagaaatagcatctgatcgatgatgccaagcatttgccatcatcaaaccactcccttgtttttcacctgctcgttttgtgatccaataaagcctgagaaacataagattcagggatgaaggatcaaaataagtgaagagaatagggatgaaggatcaaaagaaaaggggcggtaggttctgagaagcaagtctaactaaagtgaaaatttgcaattgtctagtaagaagcgacggtagagcaaaagctgtagacgtaaagcaatggggtatgataaacttgattggattgaaaagagtgataaataaagtgatgtttgtacccttctttgatagaaatggaagcaatagtaacagtcaaagcgagaatgggatgattcatatcaatgccgtgatgatgtccactatgaattacctcaggagctgcggacagtgcaatctgcaaatgagaaaggaagggagaagaactctgtaaattgaatttattatatcccaaataaaacaaacaatggaggatcgataaaagataaacatgaagtgcaatatattctcatacaatgaagcaaggttgtggaggtggagatgagtaattaaaaaagaaagagaaaggagagagtggtggtcatacagataaaaggtctaaagcatgccaggcaataccagagccagtagccaaaagcatggcagagatgccaagtgctccaagcgtttcaaatttaccatgacctgcccttgtatgcatggggaaattcagttcattgttattataatgtatttacatcaaaggaaagagaagagaaaaggtaaccataaggatgttctttgtccttgggaacatttgcagctctgtaagacactagagcaacaccacttagaacctgagatataatgatgatgatcatgtgagaaacaaaaccaaaggaaggatcatctctcgtcctcagcaaatgagaattttcattaccacatcggaaacggaatgagcagcatcggcgataatggcggtgctgccgcagagataaccggtgagagcttttgcgacagataaacctatatctgcggtgagacctagccggaatatcttctccccttcttctccaggcttttgatattgctggtgatgatcagggtgaccaaaatgccaccttctggagaaatcgaaactaggtttttgcgatgaagaagaagatactcggagtggtgatgatgatgatgatgatgatggcagataacggcaagacatataatatatagtagacctacaaatcctcgtcggattcaggatttgaaatctgataatacccattttgatttcagctgagaaaccctctctccctcttttctccgatcagtttcccaaattgacttctcattcattgcgcggtaagatagacggcgctcatttttttaccgtttacttagttaccttttcaccgacgattgtaaaattatactcagtcaatgatagcttcattaaaggccccccatactgttctttcatattgggccaaatcaaatgttgggagtataacaaaaaatattttttttaaaacggtaatggttaattaacaacactgattgatttggtctctcttataaaccagaaataaccgattctagaatcgaaaacccgaacactgagtgaggtagatattggccggaattagagttgtctaccggcggcatcagcgacaaatggaatgtatggagttttgccgagtaaggagctgacgactccatacacaaaacacataaagctgaagacgaaaacccccgtgtgcccccacatcatcgccttcattccaaacccgcctccttgacccggatccagtattcgggtcagcagcaccggaaccgccaggagcacatccagcgtcaccgcctgcatcgcgttgaacctcacgtacctactgaaactcgtgttcctcaccactcccaggtacagcccgaagaatgccacgaagctcgcgtacggcaccgatctgtacaggttcaggattgggaagattggctcgaacagcaatcccagccttgggtactgcgcgaacaggaaccgcccgtactgcagagaattgaagaacggcagcgcgtacgacgctatcgaaatcacgcgctcagtcgccggcgtcggggtgtaggaggcgcgggtcgtcaaggcggttgcgcgtctgctagaggggcggatcgagaaggttgaggatccggggaaggagaggctgagtggtctgcatctgggagccgacaggggattagttagggtttggtggagagaaaggcacagagacgccattcttttatttttttgtttgggattttcgctgtttagtcggcagtgtcgatttgttgacaagaagagcaaaaaaaagtaacagctcaaacgctgccgttttcgaatctaaaatttggcccgcgcacactaacaacataattgggccgacttagctatataaatgggcctatatatggtactagagggcttcgtgaacaacagaaggtttttgtggcgccgacaaatgggaagcggaaacgaagaaatgtgatggcattgattgaaggcgagtcgagtcgagtcagactcggtcagagcgagttgagagagcagttaagaaacagtagcaggtagaaatg

SEQ ID NO: 25886 - DNA, 3003 bp, Unknown
  misc_feature (1)..( 3003): 2750-1469P.txt file - cDNA_ID_2708847; gDNA_ID_2214547; Annot_ID_134612
catcattgttttagagagggagaaagaaaaagagctcagctttctgatggagaggagtattcaaggacaaaacaagctctgtgtaatgtatcttatctcaatttggaacgttactagtttttatctttcttgtaatcttttctttcaactattgattcaaagatgtggacttgcatttactccttccaaaagagtccacaatggttgcattcaatgctatatgtgtttgttataccaaaaacaccaacaaatctgctctcaactgtttccctctctttgaaacattccatttttcattctaattttgtttcgctagactgacccactaaccaaaacccacactagtctacccaaatttaatatctctcttctcaatctcactttctcttcttactcacttggtaggtaactccttcccctgttttttcttttgttgcagtgtttggaccaaaaagtgaatgtgagaagaagcctacaagttcaagaaactgtagaggatcatcaaagctttgcccttgaagaggaagaacaacaactctcaactccgagcttgctgcaagacacaacaataccatttctacaaatgctgcaacaaagtgaagacccttcaccgtttttgtcattcaaagacccaagctttctagcactactatctctccagacacttgaaaagccttgggaactcgaaaactacctcccacatgaagttccagagtttcattcaccgatccattctgaaaccaaccactactatcataatccatctttggaaggagtcaatgaagccatctcaaaccaagaacttccattcaacccactagagaatgcgcgttcaagacgcaagcggaaaaacaacaacttggcatcattgatgacaagagaaaagcgaaagagaagaagaactaaaccaacaaagaacatagaagagatagagagtcaaagaatgacacacattgcggttgaacgaaaccgcagacgccaaatgaacgttcatctgaactcactccgctccatcattccatcttcatacatccagagggtataataaacaaaacccacaaatcaaagttccaacctttatcaaatgtcgaattttcttaactaatatctctcgtagggagaccaagcgtcaatagtaggaggagcaatagacttcgtaaagatcctagagcaacagttgcaatcccttgaagcacaaaagagaagtcaacagagtgatgataacaaagagcaaattccagaagataacagtctcaggaacatttcgtcgaacaagttgcgtgcgagtaataaagaagaacaaagtagcaaactcaaaatcgaagccacagtgatagagagtcacgtcaacctaaaaattcaatgtacgaggaaacaaggacaacttctcagatcaatcatattgctggagaaacttcgattcactgttcttcatctcaacatcacatctccgaccaatacatctgtctcttattccttcaacctcaaggtacttacttatataacaaaaaacccattattcaaaatcatcgacaatggtgaaaaaattcaatcttttttgtttgttgctcagatggaagatgaatgtaatttgggatcagcggatgagataacggcggcgattcgtcagattttcgacagctgattgactaatccaagtaaaaagtaaaataaaaaaagaaacgtttactttggtaacttcgttttcatgattaaattctttatttggtcgtatgtgattggagtcttctcggcatggaacttgactttggttttagggtactagtctctacagaagctgtggtccttctttggatagatttataatgaaagtttgacccctctctctttttttattgtctttttgttttgcttttgcctctctctcggggttttgacttttgtatcataaaactagaatataaaagtttacaaattatatttatctataaaatatttttattttatactttacgattgttattaagtaacgtcctcttaaattcgtcccgccaatctgtcccgtaaaaaaaactcactgattttatttatgatatgtttatgaatcattgtctaaatattttttaattttgtagtaattaaatgctatctaatatctctgcgatttgatgattataatcgaattattatagtcatgtagaaaaacaatatcaaaaatgataattttgtagtaattaaatgatattaaatatttcagaagttttattttagtaactaatcgtgtagttaatgtggagagattttgggaagattatcaaatatttaattcaaagattttctttctaattatcaaaaacaattattaaatgccagtggcagccactgtaaataaatctcaactctaggatttatttcacaaagtggctgcaaaaatgtatatataaatatctaatctttacttagatggcatgggtttgaaaagttctgagtaactgataggcccaatgactaaaagcccatatgtgtttctcatcataatggaaggcctacaagtagaagaattcgctcgtgtttatgaattatgatcttgattgtaatcttattatcaaaaaccaaccgtaaaagtatatgaattgcgtatttgtaaattgtaattattatatagtattgagattgtgattaaaagtaataatgaatttgttgaattattattatagactatagtatagtagcaagagtgaaattttgttttcaagaattgagtcctaattttataaaaggagccaaaaaacccaattctatctaatccaatgaaaactccaagatcgtctctacgtccgccacgtcagcactatcctgatcgggaaacccaaaacgagtggtcgaatagtttccgactggtaacagagaaagcatctccacaatccccaaaattctttcaacacttgctctccattaatcttttagataataaacctaattgtttctgttttgtttttgtttctgtgagattcttccgaggcttgaagctcaatagctatg

SEQ ID NO: 25887 - DNA, 3003 bp, Unknown; identical to SEQ ID NO: 25886
  misc_feature (1)..( 3003): 2750-1469P.txt file - cDNA_ID_2708847; gDNA_ID_2214547; Annot_ID_185470

SEQ ID NO: 25888 - DNA, 3000 bp, Unknown
  misc_feature (1)..( 3000): 2750-1469P.txt file - cDNA_ID_2708857; gDNA_ID_2214548; Annot_ID_134616
gacttctcctcttcatactaaattgtcgaaatgccatgagctcacttgcccttgcactgcagcttaacccagttaaggccaaagaacttacaaacattcgctctgctgggaaagacgaaaatgtgaagctatctccacctcgtcttgtatgtaccctttcctcttttaacatgacataagaaaactgttttcttgatcagaaaattttcttgccctttgtggtttaacttttgaattcttgtctattcagatgacacttgaggaagctataggatacgttgcctcagatgagcttatagaggtacattgttcatcaccaattccaaatctagctaatcatattatccatgacgaacattttgtttccggcttcctatgcatttactgttcttggtttaatgttgtactgttattggtttaatgtggtcaggtgacaccaaagacgattcggttgaggaaaagatgtctagacgttaacaagcgtaaatcccagagcaaacgagccaaagactaaaaagttatcttccacacttgactctctggtacaatttttatggaagctggtttagttcttgtcacaatcctagaaaaagaaaattattgaatatgtacgagaaacattcagattatatactagattcgtaacttatacgcaagaagatgcattcttgtattgataacaataagaagatagatcgatcccgatgctgtattatcattgtggaccaccggatttatcatcgttataaagaaagttttgttggtggccttggggtctatttaacgacccacatgacccaagttatatttttaatttataactgattccttttgttccaatcgtcgttctaattttatctcatcaaaagcatgtgtctccatttatgttaaataacatggtagtagaaactttaaaaagttaataactaatgttcagttcgagtatcatgaaaatatccaccgcacagtagtcgccagtttggttatgtcactccagaccaagcttaagccactccagacacaaggacttgaggccgcattgtaaggaagtgttgcaatcgttgcatcatctactggaagaacctcaagaggatcctctaaaggcttaggactaggagtaggtttttgattagaagaggatgggttgttaggttgaataatgggtgtattattctctagaaaaaactacaaaccaaagtctcaaacgtacgtaagaagttaaactaaaagaaaaaagacaaaacgtgtgtaaatatatcaaactaagatgagcaaagaaagtaaaggaaggaagcagagtccaatccaaacattagagtttgaagctgcactatgtggagctggtgatggtcccatctgatactgtactggagcatgattaaccggtgactcagccaacggagactgtgaaggagacgaaaaagagcttggtggtcggacgggtccaggaaccggagcagcgacaggtcccaatgaggctggtaatacatggatttgaagcttttgtcccatgtcacagtgaccaggaaatccgcatatgaagtgttggagtcccggtttggttagaatgacgatatcagacccggtctcgtatcttgctagcggtttggacggttcacacatctcgtaatcattgtgagtgacttcggtgacgtcgtggaagtctttgttgtatttgaagaccaaagagtctccaacttgaaaagttattgtagatgcccatgtctcgtagttgacgctcataatcgtccatccgtcggagtcaccaactttgtgaacggttcctccaacggaaattccaaaaagtgctacaagaataagcaaagaagtaaagaaggcgttgcttttgatcaaagccatgatcgattgttgtttgaaacgagagaattaagcagcaaagaaagaagaaaacaactatgtaagagatattataaagttttgagtttgtgttggtgagaagttgagagagcactacgttgtttatatagacccgaggtctcgtttaaggtaacccttttctctttaagaatttgacgattttatatgtttttctaaatcaaaaatatattatattttgataattcctagtgataattgttaaggtcattttttccctttttgttaaatatatccagaaatttattaattcttaaaggtattaatttattgagagattataataattttgtaattatttttaaaaaattatctcataagaagtttttttttgtaattaatatctttataaaattatattacttattaaattttaaaaacacacaaactttctcgatgtaataaaatattagaaatgaactatttcgaaaattaatacaaatttaagaaaaatatcatatttaatttttaccaattgtttatttcaccaattgttagagtcatatttagggtctaatttatactccctccgtcccatgaagatggattttttagaaatttcacattctttaaaaaataatatataatgacaattttaatctcttaatactatttaaaaataattattaccatttatttaattatttaataagggtaaaataggtaaacagttctaaaaattacattggaaatataaaaaattatttttgtgggacaaatttttttcctaaaaaatttatttttgtgggacggaaggagtattctttaacacacatacaacgattaggatttatatacaaaagatattatcttcttttaattaattaattaatttatttttatttatttatttattttttaattattgtaagttaagattccattttcgcatctttttttttccgaatttccttttttgtaacattttctcaaatttttaatgaaatgtttgtttttttggtgggaatatttaatgaaaatatcacgaagtccaaaattgccacaagctgagatttttattttattttgcatcatcatcatcaatatcattcatcatcatcagacatcaggtgcgtcataagctccacaaaaaactcatccatg

SEQ ID NO: 25889 - DNA, 3000 bp, Unknown; identical to SEQ ID NO: 25888
  misc_feature (1)..( 3000): 2750-1469P.txt file - cDNA_ID_2708857; gDNA_ID_2214548; Annot_ID_185482

SEQ ID NO: 25890 - DNA, 3000 bp, Unknown
  misc_feature (1)..( 3000): 2750-1469P.txt file - cDNA_ID_2708871; gDNA_ID_2214549; Annot_ID_134644
gaacaacatataaggatggatagaccaaataataactgaacaagtgaatggttcgacaattcaaaacgtaaagagtgctgacacaaagttaaatttagtaacagcagacaatccattgacatgaacaatatgcaaattcagatcaacttcagcaaatacagacatggaaagtcattaatatatgagatctattttcaaaagatcacttgctatttctttaccttttcttcaatctcaactcgaagtcgaaggcattgataagcctttgcaaactcagttcttcaatcttctcttgaatctctatccattctcgataaaccatatgctttgattgattggagactgaccagaacaaacagctcaaaccctggaactatctgcaaatttgtagacttgctctgcctccaattctctctactgcttcaagtgttactgatgtttgtgtttgaaaataaacatccaagtttttttacataaaaatttggttcattattcaactaaaaatttacatttttacattattgtaaaataataaacataggttattaggttaagatgattcttatgcatgaagctaaaagaaaaattcagaactatcttttaaccatatgtttggaccaaagaaaacgaatctatatatagattagtcaaaaagaattcagacacaaatacaacaataacaaagcatttgagctctctctctctctatctccctcgtttcctctgcagcctctgttttttacaagtcagattagcttacttacttgggacagaagttacatggagagaccaagccttgttaattgtttatataatccggattggtctttttgtcatctctttgtttcgttttctgataatttgtctctaagatctttaagagcatcaacgacttcagaatcaagattgtgtttaagcaatctcccttggaaagatgttgaccttgtttcttgcatcattttctcaacctccttatgcatcgatttaatctacaatatcatgtttcacaaaatcaaaatcacaaacaaaaaaaaaagaagcaaattgctttggtgatgatcttcatacctcagaaaccaatgccttgctactccaaatataagctccctgtcaagaatcagtcaccaaaatcaaaaacaagatatgaacataacgagtttataacatcgatatgatgccccaataccgctccatgtgctgcttgttgttgacagacatcagatgttacaacccaaaccttggggcatccatcttctctcaatgcaaccacctatcaatatcagaaatgaagaaacatcaacaattattctcgtaaagccgtctatttgaacaggctttgggggtaaagagatcatttttccttgcctccttttcaatccaagcgtcagcacaagtttctcctgagaaaatcacatcaacactggccaaaaaggataaaactttttgagttgtcaaagtaaataaggatatcgaaaacagacagaaaagggccaaatgactgtaccctgcaaagtcttccttgtgagtaggaagaccagacatgagagcatcaaacacaaccactaccttaacctctacaacaatttcaaatcaaattgtctcattactcattagccatagatgaaatcaaatgtagattcgtccaaagtttgtacctttaaccatactgaaggacacaagttcatcaactaacttctgccgagcaacgtcaagccttcctttcatgaaatgtttctttaacttcatccaatatccacacacattataaccatcaacaagcaaaaccggaactgcgtcatccaatagaccttggttcgtgctgtaaaacccctttcagggaatcacaaacattccttaaactttcaaacctcaaaatacattctaaaaacaatatgaagatagtaaaaatagagtgtaattactagtaaagcgtatttgtaggatcccggtagagctcgctatcatccggtaactcgtctttctctactttcttcttcctgtaactagtcgctggcttagccatgccagatcctctgctctgaaactcctacaatatatatcatacaattccaaagattgtaacttagacaaattcttgaacactaataatgtttagacttagacacagtagtaatgaaacaaaaagatcacactactactacatgccttccataacttgagaagctgcaagttatgcttaacattggatttgattctcggtggttctggctctgactcctgccatcaaaaaccaaaatcaagtgaatggtttgcaaaatgctcaatgaacaattcatcatatccgtaactccgatactagagatctaaaaggaaccaaacagagaagaatttcagaattcaattattcaattcaaatcagtaaaccaattgatcataaaccaagaagaaaagactggcaaatccatttcagaatcaattcaaaacaatgaatgttatgatggattagttgatcacaaacccccgcttcgaattctcaactattttggattaaaaagagacttttagttctcaaagaagaaacctttacataaatgtgcatctatgtgtggaccttaaaagaagaagattgatgaggcttcttgctttttcctcccatcttcaccaccaaaactctacagctatcgtaagaacaagatgatgaagaccagttaaagtatacggcggaggaggaagaggaaccacctctctgcggcggcgctccggcggtcttcatctatttgactactgaagaattgaaaattctctcctttttttgaaaagtctataaaactagtggataatatcatgtcaacgttacgcttttgtatcaacgcattatatctttaagagagaaaaaaaaatccattttttacgtgtaagaaaaaaacaaaggatccttttttactggaaagatgttttttttttcttatcttctgagataaattgcgatagagagagagaacaaaaaaattctcagtgagcgcttattgatcaacaatg

SEQ ID NO: 25891 - DNA, 3000 bp, Unknown; identical to SEQ ID NO: 25890
  misc_feature (1)..( 3000): 2750-1469P.txt file - cDNA_ID_2708871; gDNA_ID_2214549; Annot_ID_185522

SEQ ID NO: 25892 - DNA, 3003 bp, Unknown
  misc_feature (1)..( 3003): 2750-1469P.txt file - cDNA_ID_2708879; gDNA_ID_2214549; Annot_ID_134642
tcaacagagatcatctgtcatcgccatcgctggagactacacgaaagaaaatgttcaatcgaaataaaatatcaagggacatattttttcttctctttcctctcaactaatagcaacttgccacgtaggggtccttagttgtcgacaaaatccctaaacatagaaacgtccctctctaataaactgattaatgatttaattttttgctatattactcaagagatcaaccctcaagagcccattaggaactgccgttgagcttggtctaagatttccggttcagtttgatagtattaaaattaaaccgagtgtatttggattaccaaaataacatttaacgttcacatttttaaaattttacattagcattgtactattgggttttaatatatggatttttgttttcaacatattattacataaaaagcattctaaactcaaatcaaaagctaaaacaaaaacaattgaaagacccaaatctgtcatggccattaggcatgactcgacgaagagaactacaagctttgtctagaacatcgttgatagcctaaagagttttaccataaataaaaggttgaattgccttcataaatgaaggggaaaaaaacacttttctaaagaaacttcaacatatttgagcgttcgaccaaagttggtcacaacttaatccttctgagtcatcagagagaagctacgctaatgtattgatcaatcccaccttctcatgactaagcttcacgcattcaaacaaattttaatcagcttatcaagacatcgtattgttgctcggatctcatctttagaggtattacaagaaaaaaaatatcatatcacactatttctataacaagttgttaataatacatgtcgaagtttaacatacagtgtttcagatagaatctctagtctcctttagttcctttcaaaatatgttcatacatggagaaatatatgtcttcaaagcgtttgcatcttgactatcatgaacaaatgatgaaccggacaatgctacatcctgatcaaaactagatgaatcatgagtttctatgatcacctccatgtccataaccaaaagaatcatgggcgtcaaagaaaagaaaaaaaaaaacactttatttcatatgatttgtagatttggttcttataatatactctttaaccaaattacagcggcaaaatttatatttttgtagaatttacactctaaaaaaatacaattttctaacattgatagaacatttagttttagtataatgaatattcaaacaaatttggaacatggagcaaagcgtagaatgcatgttccaaatattttaaaattttgatattcagacttctaaaaactttagaaacgaaaacttgtataaaattcgtagaacatgtacaaaaatataaaatacatactctatttttcgtagaactctagaaaatgtgttctgataaaattagacgaaacattttctatcaaaaaatcaattgcatctaatcttcaatgatttcaaaaacttttccattcaaattctctatgtaaatcaatcatatttttctgattattgttttaaaagtctgattaaaattagaacaattcttgggtttaccccctaaagggtgaatccattcattcacccccttttaattgatcaattagaattttacatgtaatctatttaaagaataaataaattaaatcacaaaatctaaatcttaactacaattttatcaacccaaaccaaaatatatttcgtttaatcacaaaatttaaactttaaccactattttatcaacccaaaccgaaatataatttcgttttaatcacaaaatctaaaccctaaccactattttgtcaacccaaaccgaaatataatttttttttaatcacaaaatctaaaccctaaccactattttatcaaccaaaaccgaaatataattttgtttaatcacaaaatctaaaccctaactactattttatcaacccaaaccaaaatataatttcgtttaatcacaaaatataaaccctaaccactattttataaacccaaaccaataattttcttaataaaaattctacagaatttgtttccttaatttgttttgttttactaattttaatttttatttattctttaaatagatgacatgttgatttctaatcagtcatcaggctatcaacaatggttttttcattcaacaccctccacgtcatcttcttttttccacatcatttcttctctcttccacataataattcaatacccacttaaattttatactctactatggtttgcttaataaaattcaacactctacccactatttttatttcatttttctttcttttatgttttaaatggataattagtaaaaatagatgtatttttttgtatccaaatcaaataaaacaagtctttatttatagagtttgaaatatggtgaattttaatataaaaaaaaattaaaacaaatatatattttataagataattgatctataataactcagaggaaaagtaaatatcagaaatttcagtaacaaataaaagaataacacatgtcctatctatatttaactcttctctcacaatttctgtctccaattatttaatgacaaatagcagtaaggggttcatttttaacaattcaaaattgttgaatccgttcaacaccgttgaatccacataagattcatttctttatttaatattccactgtaagcattcaattattgaattaattttttcaatagcccattgtatatagtcttaaaaaggggtgagtgaatgtgaatgaatggattgtattttcttaaaataatgtgtaagtcatacgtgacaatttcacaacaaaaatatttatatggacaaaagaaatttggtagacatatttgatattcccattaaaaaattgcatgagaaaaagaatatatatgaaatggtttggtttcctttctaaacaagaaaaaaaaaagtaatctccgaagaagaacaaattccttgctgaatcatg

SEQ ID NO: 25893 - DNA, 3003 bp, Unknown
  misc_feature (1)..( 3003): 2750-1469P.txt file - cDNA_ID_2708904; gDNA_ID_2214550; Annot_ID_134653
catccttttggtaagaactgcatcttttgaatgctattcttgaaaacttgtttggacttctagatgaaaagaaaattcgtttgaaaatgactcaatcattcggtgtttgttatgcttgacttgcaggcaggactatttttctatgatatcttctgggttttctttactccagttatggttagtgttgccaaatccttcgatgctccaattaaggttagtaaaaatgcctcaaaagtacacaccataccaaattgattctgatttgttcttagtcaatttttcagtaatctcattgttacatatttctttcagctcttattccctacgggtgatgctctaagaccctattctatgcttggtcttggtgacattgtcattccgggtatgttctctaatgcttaacccaatagctatattcagcttatggttatgcattcttgaatcatatttttggatatgatatgaatataagatattaatttttgttttcctttaggtattttcgttgcactagctctaagatttgatgtgtcaagacgtagacaaccacaatacttcacaagtgcatttatcggatacgctgttggtgtgatcctcacgattgtagtcatgaactggtttcaagcagcacaggtcagtttttgtgtcttaattgttgtcatctatttattgcaaccttattttgggatttctctctgataggtttttgtttttgttttgcctttgtttcagcctgctttgttatacattgtcccagccgtaattgggttcttggcttctcactgcatttggaacggtgacatcaaaccggtttgttttctagtccttctagatttcgatgtatctattgttgtaaacgcaattatgcaacccaaacagaagaaccttcctgttaccttctgtttgcttatcgtgtttttggttgtagattaagatgtaaaggattagtgagcttatggtcttcttcttcttctttgttttgttgctgttgcagttgttggcgtttgatgaatcaaagacagaggaagcaacgactgatgaatcaaagactagtgaggaggttaataaagctcatgatgaatgaggaaaaatcgagaaagaagggcagaggagaaatatatacacataaatgtgtcttaatatatggaacaagaaggaaaacaattttgtttccaaatgatcatcaatcagtcccttctaaccccttttttgtttttttagattttcaaactttcttttggccaagacttgtgtaagttactataagttacaacaaattttctttgacttttctttctgttttatgttaaattcgttaggagactggaagttatatatcatttcgaacagaattcgaaatatgagctttttagctattgtagacaacgtggtaaggatatgaacagtgagaggcaaagaatagcacatgatgatgataaagttatgaacataatctgtgctgagaaagggacatttttgcttggggagctatttggagacaaaaaaaagctagatagaaactctacacttaatgttttttttttttttttttctgacatctagtacaattattgcttggagagcaagttgtgtgtttaataatatataacgtatatgtaagttgaataaaaatgtagagaaaaatcttaatgttaaaaaaaaagagagtaggtttggggtttaagtttgtgattaggtctagagctaaagccaaggaacaagcacgtatcaaagatcaaacaaaatgagagtactgagggacggccaaagtggtggtggtgccaatgagggagctaaagcggagaagactgtgtttgaggttaaacttgagtctttcgaggcacgtgcgaaaatcaagatcattaaggaggtaaggagaatcattggtgtgggtcttaaggaagctatgaaattggtggtgaaggctcctacggttttgaaaacaggactttcaaaagaagaaggagaggaggtcgttgagaagttgaatgcacttggtgctgaagctgttttacagactagagtgagtgatattccaagtctgttttggaacagtttgttccatctaataagctgatggatgatgataccgttaataagagcttattagctcaattaggctttctcattgctaatgttttttttttataaagagattaactaaaccaatgtatctttgcttgtttaacatgtatcgcaagtccttcttcttggcataataataatcgataaatttgggaactttgttgttattccatggctttaatgatctccagtgagagttctcttactttgctcatttatttggcctgactccacagcacaactaatttgtgttgatatcaagatcttgcaagatatgcaagattagaaactgaaaaaatgtagcaaacacagaaaaatgtcattgtacctaaacacaaaggttacaaaactagggacataccaaaaaaaacaaacctccaacactttgtttgcgtgttgaaagttaaaagacatataacaatagattttaccaagaagtgaaatattctcacttggagatgtcaatatttacatctccgaacttaggcctaggaggatccgttgccatatccacatgacccgaccaattagtttactaaaacagtgtgattgttcatttccttctaccatctttggttgctatctcaagtcaaatcttgaacttttatttcccatcaaaaatattcagcttctctgtttcaagcacttacactaatgggctatatgagcccatttaaagttggtacatttgacaatgtgcgtgtccttttctttttttttgtttaacaatgtgcgtgtcctatttaacatcgttgtttactcccaacaaaaattaaaaaactctacaatgttggaatcgagtgtattcttcttcacaaacaaacttattatcttcaacaaattcggaagattcacaattgcttgttcctctcttatgtctacttcccagaaaaatttctgcttttgaaattcaagatg

SEQ ID NO: 25894 - DNA, 3000 bp, Unknown; identical to SEQ ID NO: 12428
  misc_feature (1)..( 3000): 2750-1469P.txt file - cDNA_ID_2708920; gDNA_ID_2214550; Annot_ID_134661

SEQ ID NO: 25895 - DNA, 3000 bp, Unknown; identical to SEQ ID NO: 12428
  misc_feature (1)..( 3000): 2750-1469P.txt file - cDNA_ID_2708920; gDNA_ID_2214550; Annot_ID_185546

SEQ ID NO: 25896 - DNA, 3003 bp, Unknown
  misc_feature (1)..( 3003): 2750-1469P.txt file - cDNA_ID_2708937; gDNA_ID_2214551; Annot_ID_134670
atgagttgctatgtcagtcagatcaatggaggctaagtgtttttagaaatgtacatacctaacatcaccaggctgtcgtttaccaagattgagcaagatgattgaaaatccagtccctagtatctgaaaccccccgtgataacaaagaaagccatcaaaggagattaaacagaaacgacttgttagagacactacctctctatacaaaatgtctcatattcaatggcattgcaaaaacgttgggcattttcaggaatccagacattgaagataaagatgacttacaaatatagggcccagatcccaccgatgtgcaataggcgccaagataaaccacaaggtgataataacccacatctttagacttaaagagaaaagtcccataagaatgatatctagaagatcatcacacaaccacagatcaataaactatttgtttcataagttcttggacattgcagatgatgcacatatcaaagattaaagagttctcacctggcagcttcaacttgttacgcagaaagtagtataacttcctcttccaccggcttgctgacggtgggagtttaaacttctgcaatgccaaaagagattttataaggacagaaactaaaaaaccattctttaccagttaagaaaccattctttaccaaatcatcatcatcatcatcatcaaatgactcaactccagctggtggatttggtattacagcaacaataaaggaatctacacaataaaatcaagacttgtgcataacctaaagacgcatttaacaaacacagataagcattgatgcttataacattttcagcagaacctgtttaccttggtccttgagcgtaacgtataaatcatctccatcttcttcgtcttgcaatgcctttccacgaagaatcatccttaaagttgaaacgggaaatttacccttttccgcaattgcatttctcaaatcacgaatctaaaatcagcccaaggatcaatcaatcattcccttcgtacaaaggaattcacttagagagataaagaagaagaaaattctttactttgatatgagacgccactcgaatttgagacggccgagctgggccgatggttttgtacgtgatctcgacggtgccattgttggttgaatctgagctcagctcttcggttgaattcatcatctcaccacgaattgtatgcaatcaatgagaaattgaggattagggtttcgaatttgggaattgaaaaaaacagagtttgttttctcacttgctacttctccgatgacggagagtcgacttgagttttcaatattttcatatctgtccttacatatgtttttaattccacttttaaccccaaaggtttcagagagtataaaaaactccaaaacattggaaaagcaattgtaagagcttctgcgtcaaaaagaaggtttgggttacacttttcatacacaccatatgcataggatgaggccttcaatttctgccttacatatcaaaagatagaacacacacacaaataaagcaaagaaacagaatatctttgagatctcctctttatttggagaagacaaaacacagaacaagaattagaaagaagggagagaaagcaaaaatggcactaagaatgtgggcttcttctacagcaaacgctctcaagctttcttcttctgtttccaagtctcatctctctcctttctccttctctagatgcttctccacaggtgtttgtaattgtgtatgtagttgtgtgtgcatagctttatctgaaactgttgatgaatgtctctgttatttttttagttttggagggtttgaagtatgcaaattcacatgagtgggttaaacatgaaggctctgttgccaccattggcatcactgcccatgctcaggttcttatttttgtaatctaagtgttaaaatagctcagaaactagatagatgtctctttggacttttggagaatggttataaagataatgatagttttgtaagattattggctgaaatgggaggagaaatgacattgatgttgcaggaccatttaggtgaagtggtgtttgttgaactgccagaggacaatacttcagtgagcaaagagaaaagctttggagcagtggagagtgtgaaggcaacaagtgagatcttatcaccaatctcaggtgaaatcattgaggttaacaagaagctcacagaatcacctggcttggtacagttttaaagtcttaaggaaattaagtaagttaccactcatgtgacaacatataagcaatgatttggcaattgtgtgttgtttagatcaactcaagcccctatgaagatggttggatgatcaaagtgaaaccaagtagccccgcggagttggaatctttgatgggtccaaaggaatacaccaagttctgcgaggaggaagatgctgctcactaggagggtttctctctgtcttttatgttccaagttctatcaattctcatgcttgttttctaaatttgcatacactctatgaccaacttcacaaaataagagttcaagaagatgaaacagagacctaacaaacacattaagattttttctttcatatatcttgttatcctcaaaatgcatttaccatcaccccaaaagccagtccaataaaaaaggtgatcctaatcaaaaattattaataaaaatttggtaaccttaaagatataaccattactttaaaataaataattggtcataagaaaagaaactggtcgtccaaatattacaatctgctccattatattgaaatcacgtattcaagctcataaggcaagttaggtccctattggtcaatttggttgtatctaccgttgacaaaactgtaacatccattgtggtaaaaattgggcatgaaaacaaacataacgacatatgataacatacaaggaacataatattaacgaagcacacacatgacacgtatatatatattcatatgcacacaaacacagatagagatgaacagaaacacatgacataactttccaaatg

SEQ ID NO: 25897 - DNA, 3003 bp, Unknown; identical to SEQ ID NO: 25896
  misc_feature (1)..( 3003): 2750-1469P.txt file - cDNA_ID_2708937; gDNA_ID_2214551; Annot_ID_185560

SEQ ID NO: 25898 - DNA, 3000 bp, Unknown; identical to SEQ ID NO: 12437
  misc_feature (1)..( 3000): 2750-1469P.txt file - cDNA_ID_2708951; gDNA_ID_2214551; Annot_ID_134679

SEQ ID NO: 25899 - DNA, 3000 bp, Unknown; identical to SEQ ID NO: 12437
  misc_feature (1)..( 3000): 2750-1469P.txt file - cDNA_ID_2708951; gDNA_ID_2214551; Annot_ID_185566

SEQ ID NO: 25900 - DNA, 3003 bp, Unknown
  misc_feature (1)..( 3003): 2750-1469P.txt file - cDNA_ID_2708953; gDNA_ID_2214551; Annot_ID_134682
tactaccaaagaatacagagccaagcatagacaaggcgaaaagagtattacaatcaacccgtcttaaaccacatgttaacacgcagactcctcagaaccgtgaggttgataggaacttgttcatgtccttgaggaactttcggtccaaataccccattgcttcgatgatgatgatcaaacctccaagatccacgggaactactactcagtacaggccttacagtgttggtgaatccagtctgattaaaccaatttatgctagaggcgggttcaacagcgtcatcaggaaggacattttgcagtggatggtgcagaagagataaagccgccaaaattcatcaaaggcccttctgtttcttagattacaacatactcagaaggaaacacttgtctcaaccgtatcactttgtatgagtttttaataaccggtggattgataggaaaatctcctggacaactaaaaattgtgactagtattacttacttgactaacacgtctatctgttcttcttcttcttctaattacaaccaggaatgtcttctgagagattttgggttctataatcaataacaaaacaatcaggtttacttttcgggttttcactctcgattggatccaattggcctatagactgactcgttgtctcatatcagtcctccaattttgctgaatcattctttttagttttttactactgaccgaaactgaacttatctaatttcgtgacagacaaatgagtacataattaaaatttaagattaggcccaataatctgcattcagcattattctgaagatgtctctactgtagtggttacggtttttacatgaagcctgctatatatatactttatcaaatatttcagagctcaagcagagagcttccttctctggcaagcacgaaaaggccaccatctcctctagaaatcctgagatccttgtcgagataagtggtcaagagccaagagctgcctcggtttcctggaaacggaagcttgagaggtggctgaccagagagtgcccgtgaaatgtttgctgccacatcttgtaaggggttcaaagactgctttaacaacgaaaggctaatctgctgcccaaagacgcccacactctctgggagatctacacttgatttgatcaccgggggttttagcgtgccttctttgaaagaaacctgacatttaccaaacattaagacaaccagatggtgataccaatacaaattcaatctacaaagaaacctttttaacatagctttgttttaatggtaaggtttgattgactggaatgtaatcaaaagtacaaactgttaatgcttcagtgaccttaatactcaaactggtgtttgtaagtttagttacctcaattcttgaagggcttcgaacttcaaatgaagcagtagcactgaaggagaagtctgcaaaagggctggagagtgtagtggagttgtcgataatgagattgtttgtgtctattgactgacttatgcttttaactttcaacaaaggtgtcgaacccgcagctagtagaggaatcaactcagagaaagcagtgtacctatttcataacccaagaaaatacacaaaattggaacaacagtaacaattcctggattattatcattcttcatcaaagatttcacaatgtctcattctcaattcacagtgttgaaattctcagcgacaactaaaggttcctacatcatcgaaacaagatcatttaacttacagcaaaacccagttgccgtcgagaagttctggattctctaacggagccggagtaggattcagagcttccagttgattcacaagctccaaaacctccgctcggacttctgacccagctttgaaacctaattcagttccgtacaccgaatccgccaaacaccttttcagctcccaagtcgggtcagacaccgcacttccatttccagcgtcggcttcagtttctcctccaatttctcctccccactcgtcttcgttccttggaggatccgattccataaaccgggtcccggattcctcaagttcgggtccggatttctcgccccattcgtccgtaatcacattcacggtcacattatctggctgagagtcgggctcatttgcatctccaggtttctcaccccattcatctgtaactgcagacgcatctaggtcggattccgattcagattccgagggcagagaagatcggattttagaaaaccggagtggcttgggacgataaccaaaagagaaagagagagagttaagttttagggagatagaaggagagaaggtcttgcttggatttatggaggaaacatagaggagtgaagaaggacgagcgacggtgaagagcgtagccatggccgatctttgtgttcgagcttggtgagaaaatttcggaaaacaagattactcaagtcttagaaaatcacacgaaatttagatgaccccagaaaaaacgcaattttaaaacttcaaaaaaaaaaaaactttaaactaatgggcctgacccaggcccattataacgatttgtattcgtctctttcccttatccccgtagtgatactttgtctgagtgagtgagtttgaaatcaatcatcaatggctgcttttgcttctggtttggctataatcttcaactctccttcactaaaccctgtcacaactcaagcgaccttcctttcttcgaatcggattcgttcctctcctcgcgttttcagtggatttcacagcctccgacgtcgcggcttccggcgattctctcaaaatgttatccccgaccggtttaatagcttctcatgtaattgcttatccgccgtatccaccagcactatcgattacgaggtgaattttcgtattcacgtctatactagtgttgctggtctatcagtctgagtgataaaatggagaattgcgtataaatggctggttccaaggtctatgtatatataccatgatcatgtagttgttgtacattagttagataaaaattgaatcgttttcatatatgatg

SEQ ID NO: 25901 - DNA, 3000 bp, Unknown; identical to SEQ ID NO: 12449
  misc_feature (1)..( 3000): 2750-1469P.txt file - cDNA_ID_2708977; gDNA_ID_2214552; Annot_ID_134696

SEQ ID NO: 25902 - DNA, 2046 bp, Unknown; identical to SEQ ID NO: 12244
  misc_feature (1)..( 2046): 2750-1469P.txt file - cDNA_ID_2708993; gDNA_ID_2214539; Annot_ID_134432

SEQ ID NO: 25903 - DNA, 3000 bp, Unknown; identical to SEQ ID NO: 12245
  misc_feature (1)..( 3000): 2750-1469P.txt file - cDNA_ID_2708997; gDNA_ID_2214539; Annot_ID_134433

SEQ ID NO: 25904 - DNA, 3000 bp, Unknown; identical to SEQ ID NO: 12245
  misc_feature (1)..( 3000): 2750-1469P.txt file - cDNA_ID_2708997; gDNA_ID_2214539; Annot_ID_185178

SEQ ID NO: 25905 - DNA, 3000 bp, Unknown
  misc_feature (1)..( 3000): 2750-1469P.txt file - cDNA_ID_2709003; gDNA_ID_2214554; Annot_ID_134737
tatgagtactattgtttaggtttcaatttttgaagtattgatatgaaaacacatatttttttaagtaatgatgtatggtggattttaaaattttgaatattttatctgcagtataccgtgggtcgattttttatagctaaattttttaagtttcaagttatattcgttttgttaatattatatggttttttgtgtttacggttgtataattgtattttaattgtaaattttaagaattcatccgtgatatacctttctttattgatatcgatcaaaacccgtcatcccatataaactcgtctatattatctcgttagctaaatattagtattataaaatccaagaaaataaattatttttgttataaatacaataattttaggatctcacccgtgttataccgtttcttgaatgattttaaatttctactactaatatagattttaaatttatcatagaaagtatatgatttcaattttttgtatttttttttatttaaataaagcaacggcttaaatgatgatatatataattctttttctgtatgtgtatatgattttttatgtgaatattttcattattataaattagtatttttattgctatgcaaaatgttaatataaatatttgctataaatcgaatttatgcatatttgtggagtaaaattcacggaattttgtttttgaaaatatatgaaaagattgtgtagagatttttagaaacaaattaagcaagatatcgtttggttaatatcttttaaaattttgtaaaactaaataataaatgtgagtggcagccattgtaaataagtctcaactccaggatttatttcacaaaatggctgcaaaaatgtatatgtagatttacaaacaaaaacaatactgaagggaagatgttgggagcattaagaaacaattttaaaagtataaataataattatatgaattacttatgatttgatttagggaaaaaagtagtagagtaacttagaacatagtagtgggcatttaaggtactattttagtaaaataattattaattagaattatacatagttacaattttatttttaaaattttaactatacggttaaccgtacaattaaccgtactgttaaccaacggttttgatatggttacggttaattaaccgttactgttaatatacttttttaaccgtaactgaactattttcacggttaatggttacggttacagttaataaacggtacgaaatacggttacggttagattttggtgatacctaattgttaattcgtttcttctttgattagttttttatttctaatccgagaattcttggctatgtcttcagtcttcaccggtccataaacccaaaattgaaatgataggaattaaagataccgacacgtcttatctacacccaaccaagagagaaatttggccatcattatttttcattgttttcagaagattcatttgccaatattagaactttctgtcaggtaattgattctcatatagttttaagaatatatatatatatatatatatatatatatacttgttttgtaaaattaaacaaaattttgaacaaatacgttttatttatataaataattaataatagatagaagacttaattcttttttttacggagttaaaaacaattattaaagccatgttagtattatttttttccgtctaaagtcatgttagtatttgtaacaaaattgaatagtttcgttgatggaatcaatttgcccactgaatgcgaacacgaaagttacttaggtcctgtttgtttctccatccaaatggatcatctagatggaaatgaaaaatgatgtttgtttttgacaatttaacataccatttgtatgaatcacttggataatcaatctaaatgactttataagtttaggcaaatttttaaaactcatttaaatggacttggttgaaccatttggccggagatagtttagtcaaaaagaataaatgacaaatataacatttgtaataataatatttttttataaattttttatttaatatttttttaaatgacatattgcaccaaaaaaataaaaattgggaaatcacggactattattttacgtcaaaattatattcattttcccgccaaaaccgcaaaaatcatatttttccgccaacaccataaaatcatgttttcctccaaaaccgccaaatcatttttttcctccaaaaccgcaaaatcatatttttccgttaaaaccgtaaaatcatgtttcccgccaaaatcgtaaaatcatgttttcccgccaaaaaccgtaaaatcattttttcccgccaaaactgcaaaatcatgttttctcgccaaaactgcaaattcatgttttctcgctaaaaatcgcaaaatcatgttttcctgccaaaaaccgtaaaatcatgtttttccgccaaaacttcaaaatcatgtttttttgccaaaatcgtactatcatattttcctattcaaacgcatcatttaaattaaatatcaaatgatgaaacaaacactacaaatatcattcaaatgcatcattcaaattaatcatttatatgattaatttgaatgaaaatgctaaatgatgaaacaaacatggccttaaattttttaaagttgcaaattgatcatttcgattgtttttttttgtaagagttaaaatcttaaaagtttaaagccgaagtggttgctatccagttttgttaaaaaaaaattaatttcatgcacaaaggattgaccactgaaccggacatggaattacaaaaccgggctcgtaccgaccacaataaccggtcaccactaataagccgtgttcgttgacgatgttgttgtattcatcgtttttgtcacgttccggattgttttgtggctgacgataaaacagagcacaaaagaagaaaaatctagggtttgtttgagactaagaggaagagaaagaagaagaagagaaaattcgtacaattccgccattaaagcttcaacctttaatg

SEQ ID NO: 25906 - DNA, 3000 bp, Unknown; identical to SEQ ID NO: 25905
  misc_feature (1)..( 3000): 2750-1469P.txt file - cDNA_ID_2709003; gDNA_ID_2214554; Annot_ID_185657

SEQ ID NO: 25907 - DNA, 3000 bp, Unknown; identical to SEQ ID NO: 12506
  misc_feature (1)..( 3000): 2750-1469P.txt file - cDNA_ID_2709020; gDNA_ID_2214555; Annot_ID_134752

SEQ ID NO: 25908 - DNA, 3000 bp, Unknown; identical to SEQ ID NO: 12506
  misc_feature (1)..( 3000): 2750-1469P.txt file - cDNA_ID_2709020; gDNA_ID_2214555; Annot_ID_185679

SEQ ID NO: 25909 - DNA, 3000 bp, Unknown; identical to SEQ ID NO: 10381
  misc_feature (1)..( 3000): 2750-1469P.txt file - cDNA_ID_2709024; gDNA_ID_2213646; Annot_ID_132382

SEQ ID NO: 25910 - DNA, 3000 bp, Unknown
  misc_feature (1)..( 3000): 2750-1469P.txt file - cDNA_ID_2709028; gDNA_ID_2214555; Annot_ID_134767
ctaaattcgtgtcagataccattttgttctcttctgtgagctgggagtgctccaagttcactggagagtcactaggctgagatttaatttccacttgttcctttacagcctctttctctgcactggcgcaactatttttcaaggagtcaagcttgtcttgaatgcttgagagctctgtggccaaagctttcctgaactctcttatactaggatgcaatccctggaagataaacatcagtataggaaactgtcagcaaaaatcctacacagcagtacatactgagataaactatctcggccaaccaatgaaattagtctttcatgcattacctcgacagcatccaatttcaaaagaaggttcatcaccagttctccattaacaacaatctccttctcttcaatgtgctgatcagtagaagcttctagcgcctcaatacgctttttaacatctcccatctgctcacggacagtggctatctccttcaatttcttaattggctcccatcttctcacgtcatatccacggtacatagattggataattctagcagcttcctcttctgtaaagctcttctttgcaggctgttctctattctccttagcttcacaaggtttaataatctcaccgtttgattcttcttgaagattagaattgctctcaactgatcctttttctgttcttaatgcgtttaggcttccctcagccatcttcatttctgcgtttgcgtcttcacattttacattacaagcctcaggaacagtccttgattcagccttcttggaggacagtggagccgcgatcttagtctccttagatttttccatccgtttaggatgacttactgatttggaaccaccatttctctctttcggtaatgggtcaacacgcagacaaaccggaggcaacttggatgcttctgatgatgacgaagactgctctttttttgtgctcttaactggctcattctttgcaatccttttggttggctccgttggtttaggcagatggttttctgatagtttcactggaatatttcttggttcctgtagatggttcgccactgggatatttattacagagctcttctcctccgcatctgaaagtacattgcactcaaaattcccttctttgccttttgcttgagttatctgcccttcatttctgtggagatcagaggggcaagactccaagttacgcccttcattactactctccttactctcagaagcttcaacatctttccgtttcccataagatggtatccaaaaaataggatacggaacctgtccaggctcttccttgttcttctggttctgcgcttccttcacatcttgaccctggattaaggattttatcatgctgatatcaaacgggtattccaccgttttcccattctgcatctttttcctgtcttcattactactctcagaagcttcaacatcatctcgtttccgacgagatggaacccaagaagtaggatacgtaagctgtcccagctcttccttgttcttctggatttgcgcttccttcatgtcttgaccttgcaataaggatttgaatttgctgatatcaaacggggcttccacggttttcccattctgcgcctttttactgtcttgattctgtaccaacgacttcatgctgctctcatcaaatggaaaacaaccacgccaagattcaggaaaacttttctgaatcgtcatattgtcaggagctctaacttcagcaggaggctggttatgcttccctaacccaagagagcttctatattcctgattcctagcattctcatgaggaatccatataattgggtaagggcagttagtagaacgaactggaagtacagcttctcctttctcaatctcaggctcatgctcttcaatcacaacgcctctgtctttcttcaaatcacacatctgggaagaacatttcccgcagtgatgcttcccaggcacatccttctcaacatcaaaccaaggttgataaccaactggaaatggtggatgaacgtaacaagacggagcgtaagacgcgtgaggaggatggaaagcggaacgattcatgcagcattgatggtacggtacttgtgggggataacaaggaggccagtaagcaggaaagttgccgtgaacgcagcttccatgacacggtggtggagcatccattgccatatgctgagagttattaccaaatccttgataatagtattcctgtggtctcatttgacatggttgtgatggatccatgtacacaggcatcatctttaatcaagatcacttaaccaattccagtaaaactgcagcaaatacccaaatccatatatcattagaaaaatacaatgtgaatttggttcattcagaattatttcgttaccacaatcaccaaaatctgccaaactaaatcaatcgcatcttcattaaactaagagcaatgaactcaagattctcaaagctattcattaaactaagaagggaaaatgacggagcttacacgaaacagaaacgatccgtaaattccgatgactcagttcctgcgaagctctctcactctctccaccaattaaaaaaagcagatttcttcttcgaattactttctgattcagatgattgcagctttttctatgggtagtgaacaatccaaagacatttcttgatttatagaaagacgaacaacaacgttcagagggaaaagatatttcttctgctctccagatcattctcgcatcactttgaaaaatctggaattttctcttcgtttcttaacctttactaacacgtgatttaagaaactcgcttcgcttatgggccatataaattaggcccatttattttattattgggcttataattaggctgtatattgagcgttagtctccgtctctgatacccaattcgaaaaccacttctcagcctccgccgattcagacctcgcatattcagcttcccagtctttctctctgcgtcgttctagggtttttgttactctttgcttcgaagatg

SEQ ID NO: 25911 - DNA, 1853 bp, Unknown; identical to SEQ ID NO: 10379
  misc_feature (1)..( 1853): 2750-1469P.txt file - cDNA_ID_2709039; gDNA_ID_2213646; Annot_ID_132380

SEQ ID NO: 25912 - DNA, 1853 bp, Unknown; identical to SEQ ID NO: 10379
  misc_feature (1)..( 1853): 2750-1469P.txt file - cDNA_ID_2709039; gDNA_ID_2213646; Annot_ID_181438

SEQ ID NO: 25913 - DNA, 3003 bp, Unknown
  misc_feature (1)..( 3003): 2750-1469P.txt file - cDNA_ID_2709073; gDNA_ID_2214557; Annot_ID_134798
tttcctatggtcaaacaagttttaagtttaaagttcgtatttgtcctccaggtgtagcaaatgcaatagaccttgcagatcgtttccttccaaaattgaagtctcttaattgtaagaatttctccatcactgtgtggtgccatttgaacactcttctttcttcaccatatgtacctaagctttgatgaagattaaaagttgagtatacttctgtaacttatacttccatccaatgcaggcaaacctttggttgtcactttccgtgcctattctaaagatcagatccttaggattctgcaggagaggcttgtggtaagtcttaaaagatgcctttaatgagagaggaatggctgattaatggtattcaaggaattatgaagaaaaaatgcatagtagattaacatgtcaataacaatttttgacccatttaaggaccttgaaactatatgatgatatatctaatctaaacttatggtacttctatgttgatcttaaattattattttcactatttgtaacaggcacttccatttgttgcatttcagtccaatgccttggaaatatgtgcaagagtaagaaaatatatgtcatttttttatttctctcaaccttgttttcattttgatattctttaattgatattcataatgtttgcattgttccagaaagtatcagctgcatcaggagacatgagaaaggctctatgtgtctgcaggtgaaatctcttacgaatttcgtttcctttgagtttgttcttgtattgcatatgatgaatgagatagaaatgggctttatactgtaaattcactcttaaaatcattacattaaagatgacaatctcagttaactcacattttttttcaatttccaggagcgctctagaaatcttagaaatagaagttagaggatcaatagatcaagaaccaaaaggtccagttccagagtgtcaagtggttagtattttactctctactttactcagttcacttactgacgatgcaaatatccatagaaaccgttgtcttatcccataattgtttttatcgaatctataggtcaagatggatcatatgatagctgcattgtccaagacgtttaaatctccaatagttgacaccatccagtctctacctcaacaccaacaagtaagttacacatcaaaacacacacacttattgatatctggttcttctcgtttttaactattaagtaactgttaggatatgcttacaacatgatcttacctagaattagcaaaatcgtagtattaagagaacaaacttgaagtcacaaagaaactaaagacccgtgttggttctctgacttagtggctaataagacctactctgaaagtatgtaatggactgaaataacatgcttctattgaaaacttgcagatcatagtctgttctgctgcaaaggcttttcgagggagcaaaaaggatagaaccattgcagaggtaaatcttcattgaatgagcaatacacaaacacaactcatgaatttatagacattgtacataatattcatctctgtcttcacactttgatgcagttaaataagctatacttggaaatctgtaaatcttcgatgataactccagctggaattactgagttcagtaatatgtgtacagtgctaaatgatcaggtacttatctaatcctataagattaactctcatgtttgtgtatggtttatgcattatataatagacatttgattgaaatgtcattgttttgtttggcacaggggattctaaaacttagtcttgctcgagacgataaactaaagagagtgagccttagagtagatgaagcagacatcacatttgctcttaaggtatatacattacactctttgtttattattccgaaaatgcagtttcttaagttaacaccttctcttttcattgcaccacaggagattcgattcttccgcaactgtcttctatgatgaagttactgagttatagtcttatagatgggttggttccttcattctttacagaatacaaagagttatatatatataaaaaaatcagtacacataaattgtttattctgtcatgtaaatgcaggaacataaacaaaatataatctttattagtttttactggttagcgcaaaagctgaactcatattatgtaattcttctctttttgtactattagtcatgctctcaatgaaattaatgccatcaagtgattgtccttgactccttgattcctgagtgttcgtctgatgcattgtggctattaattccgttcaaaatcttggaggtctcagctttagtctaaggcattttacagccactatgcgccgtggttcacaaaagccctcatatactgaagactcttttccatttgccatattcttattcattataatataaacaatctattaatctttttaccaactttgtcatgaacgaattcaccccaacggaaagttagaagtgtttaaaacatctccaaggtgctctggtgcaccattggttaaaataacatgtgcatcaagtatattacaactttttgttgatttgctatgattgaaaatgtttttcttcgtattttttaattttaaaatctctatgaaattattaaaatatccatgaaattattaaaatctatagcttaaatttcaaaatcatggattaaatattttaaattattgattgaatagcacataatttcaacttggaaattgaaaattaccaaaaattctgattaaattttaaaattaacacagatcatgaatccagcaaacccctaaggaataaatgttggttataaaactatgcttgactgttttttggcaataaaatccagatatgctttcgtttgcggtcccattcggtccgatcgccggtccggtttagaaaacattgctttatgggctttgtatttgtagtactgtagtgtatatattcttctcccagtccacacttaaaaaggtttaaactggtatcgaaagacttaaaatcaacgagctcacggggatg

SEQ ID NO: 25914 - DNA, 3003 bp, Unknown; identical to SEQ ID NO: 25913
  misc_feature (1)..( 3003): 2750-1469P.txt file - cDNA_ID_2709073; gDNA_ID_2214557; Annot_ID_185758

SEQ ID NO: 25915 - DNA, 3000 bp, Unknown
  misc_feature (1)..( 3000): 2750-1469P.txt file - cDNA_ID_2709077; gDNA_ID_2214557; Annot_ID_134801
tgctatgttttgcctatctatagttacttacccaaacttcagattttctttgcgatgtttttttaattgataaagtgttcctttggtgtgttgttctaagatattacaataaaaacaaagattgattcaataataataaaaatcaaatctcagcaaaattcattcgtagctctttcaaaaacaagttttagtacaaagtaacaaggttatagcttattggacaagaaaaggctagggcttaattcctatcacgtcatatatgaatttctcaattgcggcaaacgaagatccaccattcttcgtagctctctggatcatctgcgagatatccatcactcgtttcctcacaacattattatccgtgtccattacataacgaatagcggtctctatctcgtttgcgtttactatctcatcactatgtaccctgtaatcaagcttcagctccacagctagcttcagttccttcaccatcagaaacgcattgagttgttgctctgcatacattggccatgtcacaattggcacgccaaaccacaaactctctactattgagttccatccacagtgagaaacaaagcctcccactgccttatgggccagtatttctacctgaggagaccaaccacatatcattccacgtccatcgacacggtcaaggaacccctctggcaaatcatcctttgtcacctcttctttacggagtgaccagaggaatctatattgacatagctcaagtccatgagctatttccttcactagagaacctcttaaccttgccatactcccaaaacaaaggaatacaaccgatgcctcgggttgatcatcaagccatttcatcaactcgtcacgacgggttaggtcctgctctggatgaggctgggctttcaagtcaaatatggggccaacagcataaacagaaggataattctgttcttgaagaaaatgattcacagagtaaggctcaatatcaaaggagctattcactaggattccattggcctttgtaaacaatatggccagcttaacgtaagcatcataaccatcttcaacaaacagagctgacggcagaacattggctgggacagggtttacaaatccaggtatcgacaacatttcttccgagtttcttacaaaaaccgatgtatctctactatgtcgatctgctagatactgcatcatagctaagaacccggaatttgtagtcaagaacacatagaaagggagacttatatctttagcaacgtcaatcatagggagacagaaaaagtcaacaactaatcccttgaccttaactccatccaatgcaagagaagttaaaatatccatgactatattcctcacaagagggatatttctctcaataacatcatacacataagcttccacagattgtgtactaccaagtgtaggtttctcctctaactcagggacatcaatgaatctaacaaacggttgagaggaggcaattgatttaacataagtgtctagatgagactgaccttgtagtttcatcaagaggattgtgatacggatcctatcatcttgctcaatgagacgcctagcaaattcaagaaacggaacaagatgaccaacggttggtgtggggatgaagatgagctctacattccgcatctctaacaacaagagatagcttttgattttctcttcctcaatctacattcaaagaagagaattagctaccttaatgttgacttttgtcacatgtgatgattactgatgtgttgcttctacctaatgttgaggtggcccttagcaagcacgagagggaagataatggccggcagataaagatggtagagtgggatccacaaccaaagaaagcttctaattatttattagagagttatttgaacatgttatcagagaatctccattttatacaagattttcagttaacatgtttttggctgagtcactttatatatttcaatccattagacatttctatctttaatttttaatctattagacatctcctgatgattgaaactgaatattaccaaggactcaaattgtgacttagataatcagcaagttttatataaaaatgtcaaatgcaactatggaatgaaggagatccatttgaattatcataactcaattacattaattatttaaatagtgatagagtcttactcgaagactcttaactctgagtgaactaaaaagccgacacaccaatccagtgaggctcaacaccaacacacaatgaagtaagatcttaacgaaagttgctgcaagctgaaattcactagagatcatggagatgggccaaaccaccacatgaatcccacatctttcctacttttatattcaatcaactaactttaaaatccatgattgattaacactccttcatgaattgaaattgaattctctagattttacaattcgatattattgtgtggatttcaaaatctatacaattaccttgggtttttattctaataatttacttatgaaactttatgagatttcatttcaaatgacttcatatacacatatttcaaaagtaatttagttttgaataacattggattttaatgaagtatttaaattttaaaatatattaagcacaattaacaaatataagattttgaataacagtgctatttaacacttgtagaaatgggtaagtcgaaacttctaagatttcaaagtcaaaagacaacattgttagttattgacatttcttttcaaactgaaattggagttgacgccataaaagaccaataggccaaaaattaaagggcatatacactttttctgagttataaatttgtagcctcaactcttaaggacccaacattgactcatatgctaaatctaaatatccccaagatacttttcaacgacaactattgatgttcaaaaataaaataaggtctatataagtttaggcaattttgtgactacaatttaatattgattatagaaaagtgaatccacttgacctcctcttggaacgcggctatg

SEQ ID NO: 25916 - DNA, 3000 bp, Unknown; identical to SEQ ID NO: 12549
  misc_feature (1)..( 3000): 2750-1469P.txt file - cDNA_ID_2709126; gDNA_ID_2214558; Annot_ID_134843

SEQ ID NO: 25917 - DNA, 3000 bp, Unknown; identical to SEQ ID NO: 12549
  misc_feature (1)..( 3000): 2750-1469P.txt file - cDNA_ID_2709126; gDNA_ID_2214558; Annot_ID_185815

SEQ ID NO: 25918 - DNA, 3003 bp, Unknown
  misc_feature (1)..( 3003): 2750-1469P.txt file - cDNA_ID_2709140; gDNA_ID_2214558; Annot_ID_134828
tggaggcgttgtgcagggttgctggagaagctgatgactatgagagagagtcagtaaatgctagtgatcctttacgtgttgctgtctcagtggaatcactgatgtttgagaaattgggtcgctcaactggagctcagaagcttaagtacagatctataatgttcaacctgagggatagtaacaacccggacttaagaaggagggttctcactggggagatttcaccagagaaactcataacattgtctgccgaagatatggcaagtgacaagaggaaacaagagaacaaccagatcaaagagaaagccctgtttgattgtgagcgtggtcttgctgcaaaagcatctaccgaccagttcaagtgcgggcggtgtggtcagcgcaaatgcacctactatcagatgcaaacaagaagtgctgatgagccaatgacgacttatgttacatgtgttaactgtgacaaccactggaagttctgttgaggagatctctgtgtcttttatttcatgagaccatgttaagacatagaggctctgattgattaatcaggagcttcgtgtccatttgctagcagcattcctagaatgctctggctccgatgtttgtttaaggatatcattcaatgtcttagagattagtaagtaggggtatttactaatttaggtgtttgtagttcttatttcttttgcttctcttcttccaaactgtcaactcaactttcttgcagattttaccaaattttgaagtttttttttttagttttagaattgctatttgtgtcctccatttaatcatcttgtacggctgaagcttcacagcctaatgtatgtgatattggtcgataagtatcattacttgaaactgattctgactcaactgcaacacaagagaacatatacagcttaaagttcccatcgcattgcgaacaagtcctgtttctttctgtttcattttcactatcaaatacagccgaagatatatgtcaagatgaatggcaacaaatggatgtatcacttctagcggaatatgtcccattcttcatcatccaaatctctcttttttcggttggatcgattgtttctccttcgccgtcttctatcagatgaactttcaagatcttcaacatcagggtattcactatcaaactgagcatcccagagtccctgtaattaaaagtctttcttcaatcatccatttgaaaagtgatgaaaatcccaaggcatgccattacaagacatatatataccttagtcaacctctgttttctagaagctgcatcttcttgaaccacaactatatcttgtaagacctcgattatatcctcgacatctaatctgtatgtactcacctgcattatcacataccaggtaggtaatcataacattatgctattccaagattaaatgcttgtgcttgtatctcacataaaccatttcaactttattagaaaaaagggaattaagttacccaccaggcttgatggtataatagttaccccgaaggaatcgagctcaagcgattcaactattcccgagttaatgttgaatgagtaacctcgaacctaaaaccaaccatgtgcattcagctaatagcaagatataagcaaagagacagatatcattaccgaagaagatctttattaacacacctttccaatgtttctccctcctggtgtaactactctgtaacctacctaaacaaaagatgagaattcaatcttagacttgcttaaaggccagtgattcacaagacatcacataaaaagagactatataccagtgtttcaagtccaaccatcttgaattcagtatccaagacagtctcattatcaacaaggacaacatcacccacctacagagatcttaatataaactaagatgtaagtaaacacatttccaaatgaaacaactttcaacgtagcagaaaccaaacatagtagtacccggacaatgtctgtgagcagaaatctctcagattctccagatagcaagcttggtttaacatcaaccaccaaaaccaaccactgaaatttcagaatgatagagctcattgcacttacttaaacagtcacaaatttggtaaaagagcagactttagactcgctaaggtgattggattcaagaaggaacttacagaagtagtgtcaacccaaagctgagagataaatcctaaactcaaagctgattgtatactaacaacttgcttagcaacaagattcgatcttgtcgtcgactgcttgaatcctcgcgaacccgtaatgctcagatcattatcacctactagtcgaaccaaatcactttctccaggtaattctacactatcactccccacagtttgatgcactacatcttcttcattagatagtgaagaactcaagcaacagatgaaattgtctctcggtttctctataaaactgaattgcccgagaaagggagagtttttcgaatcaatccaaaagcaattgaggattgaatgctgaatccgtttgagcctccatcgacaagtttctgaattgggtttcaccaatcgagcattgagaactggaagagaacagaagaaggaagatgagcaattgcacatttctaaagaaccctacaaattcaactctacgtggacaaggaaaagatggttttttttgttctttctaaactcttattaaattgagagagaagccaaaaaaaaaaaaaaactcttaataaaattgttcgctccgactaaaagaaaggactttaacatttcccgttcggcgaccactttctcgtttgtcctttctccgttttcccgttcggcgctaaggtttcgatttcgtgtcgtattatcactcgccttcatcgcaaagtaagcttaagaatcacgcatttctcttcttcgtcctcctattgttcaaatcattcagatctgacttcgttgagataaagtttggattttgatgagataaagtttggatttttgttttggggtttgaatcgataactgatacgttgggaagctggatcaggtatg

SEQ ID NO: 25919 - DNA, 3003 bp, Unknown
  misc_feature (1)..( 3003): 2750-1469P.txt file - cDNA_ID_2709148; gDNA_ID_2214558; Annot_ID_134830
tgatctctaatcttccaagggttttgatagaggagattttttttagggttcctttgaaatctttgagagcagtgagattaacttgcaaaagttggaacactctatccaaaagtaggagctttaggaagttgtacattagtaaaagagcaacaagagaagaggagtccatgatgatcgctatgatgaatttcgatctttattcaatgagggtcgtagttgacgacgacgttgatccatctaaagcgtttaaaaaaaaaaggaataaaaaatctatagcgtttaaacgtcaacctattttccttgatgaacaagtcaagatatctcaagtttttcactgtgaaggtttattgttatgcttcttaaaagaagacgatacaagggttgtcgtttggaatccgtattgcggacaaacaaggtggatccaactcagatattctcaccgtccacacaaagacaggttcatttacgctctaggatacaaggataaggaatctcgtggtagcttccaattattgaggtttgtagattatttcctaggagcacccaaaaatcaatatttttggtatgaaatttacgattttaactctgattcatggacaactcttgatgtcactccacactggtgtatatactgttgtgaccgtggtgtttctctcaacggaaacacttactggtgtgctaaagaaaggaaagcagaagacgatattgtcgatcacatcatatcttttgattttacaaacgagagatttgggccgcttttgcctttgccgtctaaggttatggaacatgaatatgaaattgtaactttatcttatgttaaagaagagaagcttgcagctttatttcagcattacgaagcagattggaatgagtttgatatatggattacgactaagattgatgctgaagtggtgtcgtggagcatgttcttgagaatggatacgggacctaggatagaggttccacatatatgtgaaggtttcttcattgatgaggagaagaaagtcgccatgggttttgaagaagacttcgatcgcaaaacatttatcatcattggagaagctggatacgtaagaaaattggatatcaaagcacatgtagacagaaaatgtcggccaactgtgtgttcttatgttccaagtttggtccaaatcaagaaacctgcacgaggcaaaaggaaaagacaaagcagcttagaaaagcgtctatttgatcaaaacatgttgagacttgaagcatttaaaaagctaggcggctacttctagaagcaatatgcaggaggagttagaagtgaaagggatgacttgtctcaatatataatttattatgttacaaaacttctatttattttctcaattactttattttggcatgtacgtcaatagatttttgaaccagaatctgccccacatgtgataattttctccaaatattttcttaatggtttagttttgataattataatatatatatatatatataaatatatatatacaggtttaaactccaaatctatttctaaaatatgaaaatctaaattttattaattatgaatctataattcgatatgtctaatatatattgtttgattttatttaaatatttaactcgtctaaaacaccacgattagatctctaagagttgggttgccgcccctccaacaacgaacaaatataaagcacaaagcattttcttcaacattgtctcacacaatattttttttggtaaagagatagaagaagaaagtgttgcgagtggcattcaaatctatgaaaattcaaagggacaggagaacatgaaaaaaaatatctaaaggagtgttaatgagatgagctaattggttagtgtgcttaatgggaatgttttagacttttagctgaattattctttttaagtttttaatgattaaaccaaagcaactcttaacggaattgccactttagtatatcgttgacaactcttagtttccattagactactacgtacgtgtcatccacttttctgttgacaaaaactaataacaatcccattccttgtcagcatccaatccataaatgtagttggtcggtccattttttgttggtttgacacatttgtgcacaatcccattaatttcttgataattagcaataaggcaatcctagttagctaagaaactatacgattatatttttggtttgtctactatataacatgtactgtgggagacacttacacatgtaactagtttaaccaaactagatgatcgttcaaaacagcatccagcttatctctcgagtgaaatcctaaaacttgggtagaatagtaccatggaaattgctttaagtgggtttatatcataaacatagaaatttatattatacgtgaggaaaaaactagtgagatcatccacttagtgttgttatatactaactaaaagatatcatatgcgccacttagtaaatgcaatgatgtattattagagatagtagaggattaacgtgaatgtgtttggaatacatatagtggcgatagatgtgtgttagtgaatatgttcggtgctggttttgaccccatatcataatttttaatgtaataaattcttttgcttacttcataattattaagttaattggtcgtaaaaatggtgctacttagtggatgaaacctcatccagaatcttctaccgaaccaaaactctttaaatactaatctataacacggctacattactattaagctgatccgatccaccaccacatcataggtattattactctgatcttcccttttcaagcattactactttctcctcttagttttcttgtttcaccaaccaagctctctttcttgatctctatctttatgtcaactctatgctctcttgtattgtgttcttttccttttcaacaaattttgttcactagtcactagtatttcctaacactttgtactcatgatgatctctacctatctttgcataaaaccctcacgggtacttaggaagaatattcaagagcaatg

SEQ ID NO: 25920 - DNA, 3003 bp, Unknown; identical to SEQ ID NO: 25919
  misc_feature (1)..( 3003): 2750-1469P.txt file - cDNA_ID_2709148; gDNA_ID_2214558; Annot_ID_185800

SEQ ID NO: 25921 - DNA, 3000 bp, Unknown; identical to SEQ ID NO: 12553
  misc_feature (1)..( 3000): 2750-1469P.txt file - cDNA_ID_2709152; gDNA_ID_2214558; Annot_ID_134834

SEQ ID NO: 25922 - DNA, 3000 bp, Unknown; identical to SEQ ID NO: 12553
  misc_feature (1)..( 3000): 2750-1469P.txt file - cDNA_ID_2709152; gDNA_ID_2214558; Annot_ID_185804

SEQ ID NO: 25923 - DNA, 3000 bp, Unknown; identical to SEQ ID NO: 12563
  misc_feature (1)..( 3000): 2750-1469P.txt file - cDNA_ID_2709156; gDNA_ID_2214558; Annot_ID_134835

SEQ ID NO: 25924 - DNA, 3000 bp, Unknown; identical to SEQ ID NO: 12565
  misc_feature (1)..( 3000): 2750-1469P.txt file - cDNA_ID_2709160; gDNA_ID_2214558; Annot_ID_134838

SEQ ID NO: 25925 - DNA, 450 bp, Unknown; identical to SEQ ID NO: 12545
  misc_feature (1)..( 450): 2750-1469P.txt file - cDNA_ID_2709173; gDNA_ID_2214558; Annot_ID_134847

SEQ ID NO: 25926 - DNA, 3003 bp, Unknown
  misc_feature (1)..( 3003): 2750-1469P.txt file - cDNA_ID_2709189; gDNA_ID_2214559; Annot_ID_134857
gaccaccttcccgaggatgaacagccatccgataaggcagatcagagccaaccacaagcctacccagctgaaaataagtatccgatctagttataggaaatacaaaaccttgcaaatgcataagatctgctcctatacactcatataagaacagaatataaaacctttcctacttacaggttgttccgagagagaattggtgtttagatcaacacggcatattaatatgacattagagattccacttcgtccctctccgcctccgccggacaaaacgatgcagctccgggaagaagaagaagaagaagacgactcatcatcatcttcagatttctccggatccattatgattttggatctgacatctacctccggaatccagtcggcggcgtaaatcggtacaccgtaagtctgcatattcgacggttgattcgtctctgtactctgattcgccatcctccgtgtctgtctctcgagctcaatgccaagtccccactgattcgtaaaaatactaaatacaaaaaaaaatattaatgggctaacttaaggcccattacagtatttataggcccatcataatatttcatttatcgctgaattccggtaaagtgatagcggttggacccggttcacgggatagagacgggaaagagtacggcggtacggaggtcaaactcggcgagaaagagtacgtataccggatcctttaatttttataatattttcatttatcaccccaatactattgatttgatctaaaaacaccctatagttgtgtaaaattcttaaatcgatgtgttggtgatttttgacgtaggtatcatctgtttcgggacgaggacatccttggtacattgcacgagtaaaatgcaaaggaagtctctgagtcagctagtgggtttcttggtggaataataatttttcagtgactcgtttcgatacatgttgttgaaatttgaaagttttgttatttctcatcattttgttcctccttaaatttggcccttttataactgtctttatcttatgtctaatcgttttctgtgatttatatctttgtatttagtgtgctacttatataagttaaaactctacacgaataaaactcaagtagtgagatttcgaagatcaaatagtttgtaaactacgacgaaaattacaaaaattgcaacttgcaagtgtcactaactataaatcacgacattcttccctttcgaaaaatcttcatttctcgacaaaaaatttaggtttccaatgatgaccacaaaaagtggaaaaaaacgattctcgtttctgaaacgtttcgcttccgcgttttcattactgtttctatgctagagagtattagtgccttgttgtcatggtcatatatctcaattgaaaatctcctaaaactatatataaaatgacatatagtattttactaaatttaggaatcttttcatttatatagtaaaaaaataaaatagtgtcgctgttgccaaccactctctatccatctcagtttgcacatgcaacacaaccacatgctaattgctagtgaaactctcatactgtttaattaactccctaaatatttatcaaacaaatgatatctacgttttttaaaaaaaaaacatatctttagattatagagttatacaataatttccacatacataagcttccacgtatccaaatttaaataaatattttttgtgtataaaatgtaatccaaagatggagatctaaatctactaattaactcacaagtcaacatttaaatatgcttagaaaaataattgttttcgatctatgaaattatgtggctgcattatagtattaacaagcaatcatgcttagaaaattataatattgttatcaatacaattacaccctaattccttaccaaaaatacgtgccgtttcaagattagctaaatagagcatggaatcaacattgcttgtcgtgttggctttctcttcggagttgttaatttttaatttaatatttttactattttcatcacattattgaatacgaataataattgtattaaacaatcattattggaataagacttagatgataaagatattctaatcatttataaaatacgtagatgttgactttttttttttggcaactatttgaaatatatttgtttccaacgattattattttataaaaaataatcataaaatttgtgacctgcaatatgacattaatagttaaaaaaaatttcgtcaaaaggaataattcacaattttaaatagataaaaattgtaaccagaagatataccatcatatatatttacaaattgtattattatctattcataatacaaaacatgacaaaagaaattggttgagttcttgtcgggtattttccatatctcacacaaataaatcaaaaattgaaaaagattacaagacacaaacaatccaaaaaattaagtatcaaaaggcaaattttttatttttatctttagtttctcgtagtgcaaatattaaagcggttaatttgatacgtaaaattcgtgttcaaccgcaacatattatttacgtaaacaacatttttcaaaaattgcattaattaattttggataataaaaaaaaaggtatatactactaaaatatggagattaactaaaactgttcatcaagaatcttcaatatatatctttaaagagatttatttcgaattttattaaagaaaaaaatttgaaatctaaagggcaaccaaaaaaaaaaaaaaaagacaagaggagaaagaaaagcaaaggaagggcatgtgactgatcacggctttgcctccaccgcataaagctcccttcacagatacatacactctctttctctctcttccggcgtttattcttcttatttcgccaccgtcctccgccgccgtggtggacttatatctctgcgtttcacgacctgccgccaccgccggcgataggtttcaatgatgaattaaggcgttggccagagagagaagagagattgagatctgtcgatatg

SEQ ID NO: 25927 - DNA, 3000 bp, Unknown; identical to SEQ ID NO: 12572
  misc_feature (1)..( 3000): 2750-1469P.txt file - cDNA_ID_2709197; gDNA_ID_2214559; Annot_ID_134851

SEQ ID NO: 25928 - DNA, 3000 bp, Unknown; identical to SEQ ID NO: 12572
  misc_feature (1)..( 3000): 2750-1469P.txt file - cDNA_ID_2709197; gDNA_ID_2214559; Annot_ID_185834

SEQ ID NO: 25929 - DNA, 3003 bp, Unknown
  misc_feature (1)..( 3003): 2750-1469P.txt file - cDNA_ID_2709205; gDNA_ID_2214545; Annot_ID_134555
tgtttgttcttttgatgattgtgcaggtaaaaggagtattccacccatacttgagtctcaccctgctgatgttccgcacttctttggtcaacctcacacaccaactgcctataagccacctcggatgatgagacgtctttcaaagaagcatttactgccaccttttgatccacctgatataaaaaatccaggaaagtcaagctattgagtctaaagaagcgtttagtgggaggcaacccacttgtatgattttctttttcttttctttttcgttttttttttctcgcttactccggatttgaatgccacttgggacagtgacgtttaagtctggtggaggcgcttactaactacgttttctttttgagtgttattcttatacatatttttctttttcagtcgttttattgagtcaaaattttgttaggaattatgatctctattctttagattatatcgtggttgattaatgctgcaggttcgactcaatccgactattgtaaaatttagatggcaaaccaacaaacttgaggatatcctagtttccaatacaaccactaaggttagagctaatctcactgctctttcttttacctcatcaatcggttagtattcatagatattgactccttatcatacctgatattgagaccaatgtgataaagaaaagtattcctctccccttataaaaataaaataaaatgaatgatgaataagagattgataggactttcagatagtgtataggggtaggaatgtttcctatgaccccattattatacattatttggaatgatcaattacaaaggttggaaaaatgcctagggtgtcgatccagtatgcgagttcccctttgtttactctctaaaaagaataattctggggagagaaagaacaccaaaaaaagaatataaagaacggtcgatttatcatggtatagtacaggattgaatctagacggatcttgaatgttagcttgtttgatgagacccagcgatgaaagcctaggggatatagttgtggaacttatgtatggaatctagaatgttgtgtaagcttgcagagaagtacatgttggttaggatttgattagaactgctagacatatggatttggttaggatgatcaaggcaataagctagagaatgttgggagttcctgtgttttcaaacctcttccatgggttcggcttttgtgttttgcttgagggcaagcaaaagctaagtctcggggagttgatataaccctatttttactgcttttagctatgatttaggtataggttttagagtccttttgtgatatgatcatggatagcattaacgatatggagcatgaaccggagcttgaacgtgagcttgtagccgaggaaggagctaagcttgtagctgaggatgagcttgtagctgaggagaacttgtagcggaggatattcttgtcacaccggccgtcccaatgacttgttctagagctaagctattcgaccaagccattgccgggatgcttaaccacatttgggaccgaccaaatgacttgagccaagtcactacctctttggttttgattcaagctcaaggacctcatcaagatggataagtgattcatgagtgctctttttccctgcctttggttttgtcccactgggttttccaaaggaaggtttttaatgaggcttatgttttcacttcatataatccattttgatgattcaaggcccaaacccactaaaataaagagacaatttcgtggccttagtagttgaagagtttattttgattttcaaaaattgtttttaatttctgttgttttctaggcagccttggagcatgttccaagacttgcctcttcatcttctcttctccttctctttatatactcttgtatttacttttgagaacttatctttcttttaatcaaaaaccttttctaagaagatcatcttgttggtgtgtatatccagcaaaatccttagtctcttttagtgcgcatatccaaaggatctaagtctcgatatcttgaagcccttccgcaagcttctgtgatatccatcgattcatttaaatctatccatcatcacggcatcacagccacctctatccatttctcaacctaagagtgccgagtccttgggaggatctcatcatgtggtatcagagcacactctgaaagttgagttttccatcgttatcattttgtatattttcatctttagatctgtgtccgtctgtcaccttgatttaattttcataattatttggtgcatgctaaaattgcgaaattaactgtcacgggtttgaaaaatactctagtattttttaaaattgtttctggaatttttgggaacgttatgataatatttagcatccgaacaagtgaaactgtcgtaattagggttctagggcatctgaagggttatttcgtgtttgtttaaaaagaactagttactggtgttgttttgttgtctctattgcagaaagaatggctgaatctgaggaggaagagactagccacaatcgaaacaacaaacttttggtggaagcctttgagaaaatgatggataccaaactgaatgcttttcgccaagagtttcatgagaaactagagttggggcagactcgtcctcgagaatgaaggagagttaatgagccgcttgagcaaagagatgaagctacagatcagtactatgggcataggagcacttcatctcacaatagtcaaaggagacaccatagacgtgctagagaaggtagagatcttttgcaagacaatcttggaggtcttaagcttaaaattccaccattccatggaaagaatgatccagatgcttatttggaatgagaaaagaagattgaattggttttcaaccttcaacactacaccgagatcaatagggtaagagttgctgctactgaattttatgactatgctttgagttggtgggatcagctagttacttcacggagacgtaatcaagagcttccattggaatcttggtccgaaatg

SEQ ID NO: 25930 - DNA, 3000 bp, Unknown
  misc_feature (1)..( 3000): 2750-1469P.txt file - cDNA_ID_2709221; gDNA_ID_2214561; Annot_ID_134876
tttgatggtaaaactaagttcgtatttcgctttaagaatatagaatgatgaaaaaccttttgtgtttcaaaatactgattaggtaggattttagacagacgattaacttttaatatttttaagacaggcgattaaaagttaatcttcctttttggattttatttgattattttagttgagagattcgatctgtttagcttttggtatccaaaatatatgtcattgaaaacagaatgtgtcggttttgagtatcatgggttggttttgtcttatgtttatctgtgatttcgcatttgcagcagaaatggggatatgccccgtataattaaagaccttgattgtctcttgattagatagaaagtaaaattcattggaaaataattgtttggatcggtcagtataatgtcaaaatgtgtaacaaacgaccagctcaataaaaaaaggttgaggtaattttgaaatatttctgtaatgtcattagaatattctcggatgtataaaatcaatgacaaacattaaatatatgacgttaagatggagaaaaccgagaaagattttgtaggtttattatttgtttcaattataaacgaatcgcctcaaccttttttatattatgacgttaaaacccccgtaaatattatcataaaagccctcaatatgatcaaagtacatgcacttcaattttaagagacatggatgatggatcttacggtgttatagctagagttggcttatattcttaaatagaactatacatcgtttttttttgtttcttcaacagtaaatgataaaataggtacccaacatgacaattggctagccaaaactgagtaatattatacatgtcagatactcggttttaggatataacaagcaaagaactttaaaagaaaagagatgagagtttatctaccaacatcaagaacgaaggccattcctacataaacctcgtctaagaaactatatatgaacaaattgtatttaaatcgtaggaagaaactatatggctctagatatttgactatcccaaatttagagattttactcatgagtgcaaaaacgagacatctactaagattgggcaaatttacttgttacctggcttttacctccttttcggctcgtatccgaattgaaactcaagtacccggtacaaaatatgtcaagataaaacaataaattaatatgtgaataagagtgtgttaaataaagttatggttatgagtgggtcgaataaaattgtggttgtaaaatatcttaaaaaatactataagttatattttctaagctttgtactgtaaatgcctaagcttagtgttagaaccaagttaagtgaataagaaagaatttgaaagagtctatgagtgtgactggtttgtataccatgtaaaagaaaagaaaaaaaagagaagaaacgagaagaaaaaagtagaagaaaattgtataccatgtatttatgagaggaaatttttagttgtttttactgaaagtaaaaaaaattgagaagaatattgttggtgaacaaattattcttgattggaaaaatgacaaagagtaattgagaagatttattttttcccaattttttccctcttctattttttttttttttttttttgaagtagcttataagcccattaaaaatgttagcttgtggcccaacatatttaagggccgtcctgaacataatgcacataatttgattgtagctaagcagtaaaagattttaacaaaattgttttagaataaaattataagtttaaaaggtattgtttgacttgaactgtaccggaatttataccggaaatgtcgtaccgtcctgaacataatgcacataatttgactgtagctaagctgtaaaagattttaacaaaattgttttagaataaaattataagtttaaaaggtatggtttgacttgaactgtaccggaatttataccggaaatatcgtaccgttctgaacataatgcacataatttgactgtagctaagcagtaaaagattttaacaaaattgttttagaataaaattataagtttaaaaggtatggtttgacttgaactgtaccggaatttataccggaaatgtcgtaccgtcctgaacataatgcatataatttgattgtagctaagctgtaaaagattttaacaaaattgttttagaataaaattataagtttaaaaggtatggtttgacttgaactgtaccggaatttataccggaaatgtcgtaccgtcctgaacataatgcacataatttgactgtagctaagctgtaaaagattttaacaaaattgttttagaataaaattataagtttaaaaggtatggtttgacttaaactgtaccggaatttataccggaaatatcgtaccgttctgaacataatgcacataatttgactgtagctaagcagtaaaagattttaacaaaattgttttagaataaaattataagtttaaaaggtatggtttgacttgaactgtaccggaatttataccggaaatgtcgtaccgtcctgaacataatgcacataatttgactgtagctaagctgtaaaagattttaacaaaattgttttagaataaaattataagtttaaaaggtatggtttgacttgaactgtactggaatttataccggaaatatcgtaccgttctgaacataatgcacataatttgactgtagttaagcagtaaaagattttaacaaaattgttttaaaataaaattataagtttaaaaggtatggtttgacttgaactgtaccggaatttataccggaaatgtcgtaccgtcttccacacttcggagaaacgacagataagctctctctgttctcttgccacacttcccaatacatggatccattttgacgtcatctttatcactatctctctattatataaatctcttcgtacccttttaccgattcttcaccgtgatcgcttaatcagacctcaatttcgttgttaaagaacaaagctttaagcagccatg

SEQ ID NO: 25931 - DNA, 3000 bp, Unknown; identical to SEQ ID NO: 25930
  misc_feature (1)..( 3000): 2750-1469P.txt file - cDNA_ID_2709221; gDNA_ID_2214561; Annot_ID_185880

SEQ ID NO: 25932 - DNA, 3000 bp, Unknown; identical to SEQ ID NO: 12608
  misc_feature (1)..( 3000): 2750-1469P.txt file - cDNA_ID_2709225; gDNA_ID_2214562; Annot_ID_134892

SEQ ID NO: 25933 - DNA, 3000 bp, Unknown; identical to SEQ ID NO: 12608
  misc_feature (1)..( 3000): 2750-1469P.txt file - cDNA_ID_2709225; gDNA_ID_2214562; Annot_ID_185903

SEQ ID NO: 25934 - DNA, 3000 bp, Unknown; identical to SEQ ID NO: 12601
  misc_feature (1)..( 3000): 2750-1469P.txt file - cDNA_ID_2709235; gDNA_ID_2214562; Annot_ID_134881

SEQ ID NO: 25935 - DNA, 3000 bp, Unknown; identical to SEQ ID NO: 12605
  misc_feature (1)..( 3000): 2750-1469P.txt file - cDNA_ID_2709247; gDNA_ID_2214562; Annot_ID_134885

SEQ ID NO: 25936 - DNA, 3000 bp, Unknown; identical to SEQ ID NO: 12605
  misc_feature (1)..( 3000): 2750-1469P.txt file - cDNA_ID_2709247; gDNA_ID_2214562; Annot_ID_185895

SEQ ID NO: 25937 - DNA, 3000 bp, Unknown; identical to SEQ ID NO: 12603
  misc_feature (1)..( 3000): 2750-1469P.txt file - cDNA_ID_2709251; gDNA_ID_2214562; Annot_ID_134883

SEQ ID NO: 25938 - DNA, 3000 bp, Unknown; identical to SEQ ID NO: 12603
  misc_feature (1)..( 3000): 2750-1469P.txt file - cDNA_ID_2709251; gDNA_ID_2214562; Annot_ID_185893

SEQ ID NO: 25939 - DNA, 3000 bp, Unknown; identical to SEQ ID NO: 12622
  misc_feature (1)..( 3000): 2750-1469P.txt file - cDNA_ID_2709259; gDNA_ID_2214563; Annot_ID_134900

SEQ ID NO: 25940 - DNA, 3000 bp, Unknown; identical to SEQ ID NO: 12622
  misc_feature (1)..( 3000): 2750-1469P.txt file - cDNA_ID_2709259; gDNA_ID_2214563; Annot_ID_185919

SEQ ID NO: 25941 - DNA, 3000 bp, Unknown; identical to SEQ ID NO: 12623
  misc_feature (1)..( 3000): 2750-1469P.txt file - cDNA_ID_2709263; gDNA_ID_2214563; Annot_ID_134901

SEQ ID NO: 25942 - DNA, 3000 bp, Unknown; identical to SEQ ID NO: 12623
  misc_feature (1)..( 3000): 2750-1469P.txt file - cDNA_ID_2709263; gDNA_ID_2214563; Annot_ID_185920

SEQ ID NO: 25943 - DNA, 3003 bp, Unknown
  misc_feature (1)..( 3003): 2750-1469P.txt file - cDNA_ID_2709265; gDNA_ID_2214563; Annot_ID_134902
aacatggctaaggaaaatgttttgttccacaaaattttatggctttggtttatttcatgagctttttggtcgatttcatcatttcgtatggaaaaacgaacaaaataagatttggtttagtgtttctttggatagacaatgagtcctttatacgtatgtgtctatgtggtataataagacatcacgatgttaaagaagattagaaaaagtcttatggataaggaaacataaatccataattggacccattttggagaattttgagttaacgttcaaaaacgacgtttcttctcaagtttttctttatccaaccttttccagtaaaactaacagttaagtattaaatagatttcgaagcatatgatttattcataatgtttacttacttagaaagttcatttggtaaaataagaataagaagaacatccaagggttcaaaaaggatcactcgggaaatagatgaaacgtcttaaacgccagtaatgaagatctctctgaactcgagtgtctaacgtagtaacgttcgatacccatttttaaaaagtaataacgttttctaatcattatgctagcctcttctcttgcttagataatggtttggttaggttattttatcagaaatgttgaatttggtctaagtagtgctatttcagttctatctcctataccggtcggttcatggtttctgtttctaatccctttttgctttcttttctttcatttagatcaattttagtgatattaccaaaagaaggaggagggtttgaattggtattgtgcgattgtttttggaatgtatagaagttaacattatcatttcgaacgatgggtttgaagtccattggagacgtgtaagaaccgtaggttagtagagagcatggcatttacacgtggaaccacagagaatagtttagctgttgaagcatacgatgcttgatatggctttcaacgttcaactcttattttatgggtttggacgcaaaaaaaaaagtaaaaaatattgaaaataactcgagcctttaccagctgattaaactacccatatgattcaattttgatgttgtcaacttatcgctaaccctgtcattactttaatacattaaaattaaacaggtatttcaaatttgatatatgaaatatttcactcgattgaaaatttcagtttgaaaaaggatataattttgttttttttcttatttttattttttggcttatttctactggtttgtaatatacttcctctattctttaataattgattttctaaaaaaacacacatatcaaaaaatatattaaagctcattataaatatattactttttgtgatttatattttttataattttaaactaataatattagttatttattttaaaatttgatattcatcaattataactaattaatattgtataaaaatctaaaatattaatatttttgaaacaatttttttcaaagaaaatcaattaataagaaacagaaatattattttgatcccagaagttacagaggatagtgattaaatttttagttggtgcagtattttagattattaaaatataatattattagcgtggaacatatatatccatgagtactgctagttgacaaaactgtatccgttgaaattgtgatattaatttcatttgttcactagtgactagtgagtaaccaaagagatatgtatgatggtattgtatttgcatctaggtcttttgacaaggcacaatctaactttcctctgatgatatttactttttttagcaaaaagtaataatatttggtttagctagttttttattttagttattatatacttttttgacgacaattgtgagtatataataacagtcaagtattagtataaaaatactgactcctcttgtaagcaatttaacaaagtaaacgtttttttaacgtttccgttcatcataatactaaatagctcagatctgattgtgttacttgcaaatataatacgtttttgctttcagagctacagtatgttgtccacaacttcgcaaacatacttttaaataagagtctagaaacgcttgcaatttgttaaagagcgacctaattaataaataaacgtgagtttctagtaattactgatgtaattaaaatgatgcgtaattataaaaatatacacctgtttttctctagcattctcgaacggtatttaattttgccgatttgcatcgttcaattaactatatacaacaaagttgtttcctaattagactccatatataattggattatcaaacaaattcctcaattccaaaatgctttcaaaatttgtattcgaaaaataaatttacaaaatggtatcgatgttaaaattatgaattttgaatagaagctacaccattaaacaattttcatcaatggtttctcattgaaaaactgttcaatataaaaataaaatataatcaaaaaatatgaaaaagaatataattagtttctcaagtgagaaactttaaaaaacgcataaaaatacttgtatatcatctattgatcaaatattattttattattaaactttaattatataactaatatttattaaaatactaatattttttttttttgagaaaccatgaaggtattttactgatagagatgtttttagctaaagctttaacttctttttttgaaaaaacaaaagctcgaattaggcgaaaaaaaactagaaaagataaaaaagatttcaaagaattaaagattctatataatctttctcaatcaatttatgagacttctcgatcatatctattagcatggattatagtgatcttttgatatgattttctttacattttatatatgtgtatatatatatatatccccttaaataaatatgtcattaactcattatcttccctcactcgacatagttgactggtttcttgtcgccaagttttgctgcccaactataaatatgtgctgtgctcatgcactcttcaatataagtgttttgtgtaactaaaacaaaatatg

SEQ ID NO: 25944 - DNA, 3003 bp, Unknown; identical to SEQ ID NO: 25943
  misc_feature (1)..( 3003): 2750-1469P.txt file - cDNA_ID_2709265; gDNA_ID_2214563; Annot_ID_185921

SEQ ID NO: 25945 - DNA, 3000 bp, Unknown; identical to SEQ ID NO: 12626
  misc_feature (1)..( 3000): 2750-1469P.txt file - cDNA_ID_2709268; gDNA_ID_2214563; Annot_ID_134904

SEQ ID NO: 25946 - DNA, 3000 bp, Unknown; identical to SEQ ID NO: 12626
  misc_feature (1)..( 3000): 2750-1469P.txt file - cDNA_ID_2709268; gDNA_ID_2214563; Annot_ID_185923

SEQ ID NO: 25947 - DNA, 3000 bp, Unknown; identical to SEQ ID NO: 12627
  misc_feature (1)..( 3000): 2750-1469P.txt file - cDNA_ID_2709272; gDNA_ID_2214563; Annot_ID_134905

SEQ ID NO: 25948 - DNA, 3003 bp, Unknown
  misc_feature (1)..( 3003): 2750-1469P.txt file - cDNA_ID_2709280; gDNA_ID_2214563; Annot_ID_134908
tgatatgtgaatttggactatattcgtccatttgatgagttacattcctagagtctagagattcagctgattttagttgagaatcattcaaatagcttaaaaatgttacaagactaattgtaggacgagttatgtcagaaacttgtttcaaatttgacatgaagaaattataagcaaatagtaagtaaagatttcacttcctttttctgttggtaaaagcaaaaaagtacatacatattgaaatattctaaacaaatttagcgcgttggcttctttctttacggataagttaccaagatttccttctttttatacataaaagaaactaaaataacttcttttgcccatcttgcttttgtttatgatgatgatgatattttctttatttattccagttattaaaaggcaaagtaccaaaggaatcttcaatgagtgttccttgtgcgattcagcttcatgtttattctcatataacagaaagtatcagtgcacagcacaatttctctaacagtaaacttatatccaacttttactttgtatgtgtcgtcgggatttgaatgtgtggtatgatattttattttagtcttctataacaattaagtttctataaggttggatattaatttgctctgtttttattaccctagaaaaattatattagtgggagtcattggctagttcacgtttggaagttatgcaatttttgaggatcttgacagtttactttctttgatttcagttataattacttttctgaaattaagctctaaaaataaggatcaaatggatacttaccttagttatcaaatcaaagcaaattcgatatggacgaatcaacatcacaatcgtcttctttagtgttttcaccatcttccacctctaacttacttagacagctcctttccacctgtttcttctctctctgtctttcttttttctctttcttcttttatattctccgacaaaagaaaaagtacaagatacccagaaaaagagtgtagaaactacatttgttcttcttctctgttctgcttcgaaattatgggttcctctgtttctaaaaccgcttcctctgcttctgcttcttctataacatcgattttgaattcacctccggagacggaattcaacatcccttcttcatcggtacctaaagctttcacatttccgatgccgtcgattcatcatccacctgctaaaaaaggcgacacacaccactttgtctctcttacatcgaccacttacggttctcttgttctcgacgacagacaaacattgcctcacatctccgtttccgggaagagtaacaagaagatgcctgaaacagaggaggctcgcgactcgttctctcctgactcagtgatcaacacatgggagctcatgaacgacctcgacgacgaattcgattccgcgaattccgatacaagtaagagtaattccgtcgtaaatttggattccttttctaaacccatcacgaatcgagacgtggttattaatgggtctgcgtatggatcttacgaagatgaggaagattggagattattgccttttaaacctaagcaacctctgtggaaacatatgtctgaagaatcatttctctctgatttagatcctaacattatctcatcttacaaaagagcactgtcctccaaacagctaggcaagaacagtagcaatggccactcaaatcattcggttttagtcagtttaccagaatatgtatcttctagtccattgagttctcagacttcggaaaaagaccaagagaaaccaagattgcttgaaaaagaagataacgagaacaagatagtagtatacttcactagcctcagaggaattcgaaagacgtatgaagattgttgttgcgttagagcgatattgagagggtttcaggttgcggtagaggagcgtgacatctcaatggactccaaatacaggaaagagcttcagaatgcactcggcgaagagaaaccggtttgtttgcctcaggtgtttataagaggcgtccgcattggtggaattgaggagatcaagatactcaacgatggaggtgaactggcagagatgttaaaagattttcctgcttgcgaatccattggagcctgcgatagctgcggagatgcaaggtttgtgccgtgtactaattgtggcggtagtactaaagtgtttgaggaacaagaagatgggtttaagagatgcaatggatgcaatgagaatggattggtacgttgtaacaagtgttgtctttagtaattggattcgtttgagtgatgttgttgtgaaaatgtgaagagaagaaaaagaatctaaagatataacttttgacttaagatatgtttggttggttgtgttctttgaatgatttgtttgttttcatgctgtatattataagaagtggcctaaagctcaaacctagaatgtcaagcctcaattgtttcttcacgttgatctttgtaatttacatgttataaaatgatttttttttccaaacaaatacaaacaggatgaaaatatttatgtaaacctagaactattttatttctttgaaaataatagctaaacctttttttaatatggatatgcaaactgaaaaattagagtttgctgttttggccttttggtcttgtacaaatttgtttttgttacattttacagatgacctgttacggcagtagcggtaacgaaaatgttactaggcattccacagtaattgtctcttaacgtcatctactatcttatctcttctagctattttagtatggcttaccatttttccaaaaaccagtgtcactaaagttacagaacaatcgcctttgactacatcacctgcttgatcattggctaccatccaagtctgtttgtaaacttcatccgctgtcacggtaaaaacgtcacgggtaaactgattattgaaaacgacaacgggtcttatcatcttcaaacccctcacattactcaagctttgcttccttccccgagaccgagagagagagagagacgatg

SEQ ID NO: 25949 - DNA, 3003 bp, Unknown; identical to SEQ ID NO: 25948
  misc_feature (1)..( 3003): 2750-1469P.txt file - cDNA_ID_2709280; gDNA_ID_2214563; Annot_ID_185930

SEQ ID NO: 25950 - DNA, 3000 bp, Unknown; identical to SEQ ID NO: 12630
  misc_feature (1)..( 3000): 2750-1469P.txt file - cDNA_ID_2709291; gDNA_ID_2214563; Annot_ID_134911

SEQ ID NO: 25951 - DNA, 3000 bp, Unknown; identical to SEQ ID NO: 12630
  misc_feature (1)..( 3000): 2750-1469P.txt file - cDNA_ID_2709291; gDNA_ID_2214563; Annot_ID_185934

SEQ ID NO: 25952 - DNA, 3003 bp, Unknown
  misc_feature (1)..( 3003): 2750-1469P.txt file - cDNA_ID_2709295; gDNA_ID_2214563; Annot_ID_134912
caaactgttatggtaaacatgaatgcatagatagatgattttaagtatgcgattaaaattttgttgggatgcaaaatgaaatatgtatgacaagacaagacaatggtgtgtgttattgcatgtgaagagatgtgatggtgacttcaatgacttgacctctcaatctcctcctctctctgtctctctgctggtcctctcttaaatttgttttcttatttttttctttttcttataactaattcgattttttttaatgaagctaagctaccaaaaaaccatctcctttctaattttcgctatagtaattaaatgatcaaaacgcaccaaaaccaacacccatatgtttacatgcatagaatttaaatgtaattcatattatatactaattagcttctttttttttgcaactttttgttttcttatatagcacataaatttttgtaccattgcctcttcacttctatagcttgccgaaattaatataaatattattattggctatttattttgttgtcaatacttttcttgtaggtaataataattacatgaactttttatctatcacatgagactatgagaggtcccttcctagttatacggttatgcgaaaatagcggctttcaaaaataacggtacggccgaggcgtttactttaaacgggctccgtttacttcaagtctgtcacaacgttcgtcacgtgtcattgaacacactatcacctgactagcttaccacaccccagaccaataattattgctctgttactaaacattagccacgtaaaagtcttgagtttaagaaaattgtatagtaataagacaaacttttacttatagttcaataattttttttatgtaattccatatatatatatatatatattatcacatggtatagtatttaattatgtgatggtctccatctacaccagattttctttgcaatgacctaacaaaccaagaccaactttaaccatgtgttgaaagcacttgaaaccgtctatgttcacaggttagctactcaattataactaaagttagctaacgtaatagtatatgaatgatttagttggaatgcgaataataatttttgttgtaggagcactgacttccacatgccatgagtaggcctagagcttaagtctcagtctcattttcatgcgtctctctcactcaatgttccactagttccagtagtattaaatgaataatagagcctttgcatataaccagagagagtgagagacctttgggccaaaagctctaacaaaaattccttttgtttcagagaatagagagaaagagagagagctagagagagaaaatgacaattgaaaaaacttgggagttggagttaagagatacctgaaactttctgtttctgtgatgactgtgaccactggactttgcttttctctatcatctctgctctcaggggctttcttgtctattcatcatcttatatatatcattttcagttaactctacttatcaaaatttacactgtattattgcataaaataagatctggattagactaaaatcttgtattgacactaatcaaacatctcagtgttttctctttgtattttcctcggtcaaacatctcaagatttttttttttaattattttttttcattttacaaatttcgtatctttacattatttgtttgacaagacatatacttctctgatttgaaagcataacaagaaaacgtacttgtgtgattgatacctcagtaacagtttttttttccgctcttcatattatctaccatatggaaaagacattcttatagatcaatatgttttttaaatgaaactatggtctaagacaaaatagctagacacaatggccatgatattttctgtatatataaaaacgaaaaaaaaaaatattgatcaaccagtatatgaaatttaagatcatgtaaataacaaataaagacatttagtagcaaaaaaagaaggatagatcgcgtaataagatacatttatcatcgaacaaatcacatattcatatgccgacccacaaaaaatcacatattcatattacagtcataattcataacaacattcgtcttatttatttgagttgcagacccccaatttatatagtacgtatgtatagtagacgggtttaaggtctacaacaattattcgattttgataactttgaaccatatggttcacgtggacaagagtggtgttttttattccacatatcatatatggtgttgagtgtcgatcaaattagaatccaaggaaaaaagaaactccataattaaatttattattctttaattatacagactatatatagtaatgttgcatttgtggacaagactaattaatatgttttcgataggtaaaatcgaataaaagagtcaatggtgaaacaagttggcgataattaacctttttctaatcgaggggccaaagaaaggtaaaataataatggcccgacaaatgaaattcgatatgatttaatgaggatttaccattaaatttggttgtcactttcatagacttttttcaccaatttccagatctcccactttaccattccatcatttttgggaatttcattattctaaattcaagtatcagtctaattaattaactaatactcctatctttccgtagctattattttataacagttacaaaaatacgtggcaagaaaaagagtgtatttccattttccagcgttcaagattaatgggccatttgattttctaaatattgggccaaagagagaatccatagaagcccattttaaactatcatatcttcccgcgaaaaagatagtgtaaccactttctttaacagcgaatatgaccttcccgtgatagtcactcttttggattccattcaccacctttgatcaattcaagtttgacacgcttctctcgaatccttctaacatataatagatccatcggatcctccaaaaccacaagttaaaaaaattattcaagaaacacgagaacaaaaacaatg

SEQ ID NO: 25953 - DNA, 3003 bp, Unknown; identical to SEQ ID NO: 25952
  misc_feature (1)..( 3003): 2750-1469P.txt file - cDNA_ID_2709295; gDNA_ID_2214563; Annot_ID_185936

SEQ ID NO: 25954 - DNA, 3003 bp, Unknown
  misc_feature (1)..( 3003): 2750-1469P.txt file - cDNA_ID_2709320; gDNA_ID_2214564; Annot_ID_134924
ctcaacatggatcgcttggataatgaagtgtatctctacagtcagcttttcggttctaatcaatggttctccacatggtcacatcaaccccactcgtggaatccgacaaggcgatccattatctccctatatattcatactttgtgctgaagttctctctcacatgatgaaccaagccgagatcaacaagcagcttaaagggataaaactatccacaagaggtccatctatctctcatcttctctttgctgatgattctctattttttactatggcaaatcataggtcatgccatgccattaaaacggttctacgtacttacgaggaagcttcgggtcaagcagtcaatttgcgaaaatcaactattacctttggcaaaaatgttagcaatgacataaagcgaagaatgagaaatctcctcggaatacacaatgagggaggtggcggaaaatacttggggctaccggaacagtttgataagaagaaatctgagatgtttcggtatattgttgagaaagttaaagaaaaaactcaaggttggagcaagaaatatctgtcacaagctggaaaagaggtactactcaaagcagtgctttagctatgccaatctactccatgaatgtgtacaagcgaacaaaagagatttgcaatgagattagtggagtactagcaaaattctggtgcggttcagacgctgaaaatcacggtatgcactggtttgcttgggatcgtcttgctttgccaaaacaggagggtggtcttggttttagggatcttgaaagttttaatttagcattacttggcaagcaaacgtggcgaatgcttcaatatccagagagtctaatggcaaaacttcttaaagggcgatatttccatgattcaaatatcctaaatgcagtccaagggaagaaggcctcttttatttggaaatccatcctacatggtagagatttagtcaggaaagggcttcgattctgtataggtgatggcacaatcgtcgacgcttggctggacccatggttaccaatgcatccccctagaccaagtgactccaccacctagaaacgttctcttgaaacaaagactatggaaattaagaactgctccgaaaatcaaacacttcttctggcggcttctatctacttctcttcctactggtgcaactttgaggtatcgacatattactaatgatgctaaacgtgtgagatgttgcagagaggacgaaacggtcaatcatctcttcttccgctgccattacgctcaagtcatatgaagaggctcgagaatcccaaatcccatctttctcgaccaaactgctccatgggacgataaaattcgcgccatctttaatatcaacacctcagcacgaacatctcatatgagacagttgcccttatggatcatgtggcgattatggaaaagtcgaaacacacttatgttccaacaacaaagtatacactggcggaaaagtctaagattagcgaagcaagatgcatgcgaatggcaagatgcagaagattatgttcaaaaaagctcaagcgggactcagattctaccctcaacggttaatattcaaaaaaattggacactcccacctagcggctggacaaaatgcaactatgatggtactttcaacagagacttgccaagtaaagctgcttggattatcagaaatgacagaggaacgttcttaggagcaggacaagcggtggggataacaacaacaaactctcttgagagcgagttacaagctctggtcatggcaatgcaaaattgttggagcaaaggccataagaaggtttattttgagggagataacaaagaggtagccgatacaatcaatgacaggaatccaaactttgcggtttttaattggctaagagaggttgtggcttggaaaacaagatttgaggattgtcgcttcacatgggttcgacgaaattccaacatggcagcagacacattagctaaacatgcactaccttcacatacttcttatcatttttctagttttactcctcatgtaattacagacatactccatcgagactttgtctctgcagttcaataataagattgatgttgatgaaaaaaaaagaaagtaaacttagtaaccgaaatatccgataaccgaaccgaatacccggaaacccaggattagctatagttaacaaaattaaatggataaaacaaaacgtacggttactacaaaatatccggcccataaaaggcccagtgatctctgaaaacatgcttcatgtcagatagataaaaaaaaaaaatagttattacggtcaaactttttttcctcttctgtgtttaaatttccaaatctcagtgtaccccacaaaacaaaattcgaaaaacctcgcaacgagcgcgagattcaaaaatcaaaatcaacaacacgcgaatcaaaagaaactgactcacacgcgcctctctcctcgaactccgtctcttttctctgctaaaacaaaaatcatctctcttctcgctctctgcttttgaatctctcttttttctctccaccacctgagattttcccatcactttcccggaaaaagcagcgattatcttcatggcttctcactcaccactatcccactgatgcttcagagtatgtttcgctactctctcttccccttaatttttcactttctctgcatttttctgtgttgttctttggaattagagtaatgcgcgatgaagaaaatggttgaatcgttactttagagtaattcgctgttgttttttggttattatcatcgtcttctatccaattttagagcgaattaagtagagattcgattttgtttagagtagagaaaatttcgaattcgctgttgttttttggttattatcatcttcttctttccaattatagagcgaattagggagagatttgaatttgcttcttcgattcaccagatccttgagctacatgtctcagactcaattctaattccttgttgcagttattggatttgaggaaggattatg

SEQ ID NO: 25955 - DNA, 3003 bp, Unknown
  misc_feature (1)..( 3003): 2750-1469P.txt file - cDNA_ID_2709350; gDNA_ID_2214565; Annot_ID_134930
tactataatctagtaatcagaacaagacgatgattagtagtataatacttttttttccaaaacctaccactaaatgtttgtaagaagttcagattagtaatcacacagttcaaaaatttcttcaccttaatcaccatagaaaaaaacccttctaaatccgttcacaacacaagagatcctaagattaatcactacagagtcaacactacttcaaaatgatttgattcatctgatgaatctgcagctatcacaaacaagttcgatctctagagatctaaacgcagagagacgtgaaacttggatcgatgaatatttcaaaatcatacaaattagagaattcagtaactaagaagaagacgaagcggcacccaacaaaactttctaataacccatttttctgaaaatgaacttaaaggatctgaatcaatttgtggtcggttagaaatcccgaaaaaagagttaagaagatcaaatgatagaaacagaccatgaatttgaaagtgcttaccaagtggagctgatgaatctgagattggtactctgttttacttttccttgtttagattattcagctgggaaaaacgcagaaagagtagatgatgatgacgaaagaaatgcaaattgggtgtgtgtgagagagagaaggagaatcttttagggtttataaagtggagagtgagtgtggggtcgtttcgtatttttgaaagccaaatctggcggacgagaagaccgtcgcattttgtttttatttcccgttttgccctttgttttctctcattataatttttagtacccctaaatgtgatgtggcacaaattgatcattagcttccattaattatcaaaatgttacaaatgtaattgttttattttaaaaaataaaagaactagaggtaatatgtgtggtgtgtatattgacatttgacactaaacaatgataacaatagtgctgtaaaaaaagacaatgataagaactatctttatatatagtaaaagagagaagtgagaagatccaatgtttgttaaattactgtacacatcatatttttaaaaagtttttagttttcttctatactatttcttatatacaattaatctaatgaggttataaaataaaaaataaaaaaaatctttatatttagaaaatttagaataattagttttttgaaaggtgtgtttcacatttgtgataaaacttaatatgtcatatgtaaaccataaaacatatttagtttgcatgttataatgtatacctaaagttacttttaaagaagaaagtgatcaataacacatctaaatagtgatttatgcctaacatgtaattgaaatcatggattaacaagaaataatcatggattaacatgatttcttactaaaaataataattatgcattacctcagtaaaaatagcatattttactcaattaaaaaaaaagtgaaaacatctaatacaaaaatgacattgaattgcattagatacatatgttatatttaatgattcataattttttgtaaggagttgaccaaaaaagtatgtagaatgaataaaagggcagattagtcatttgggaagaacagaagaagaacaaaaagagaggcggtggctgaacggctggctggtcgaaaaaagcgagtaagaaggcccacaccaccaatggagccaccgaccgaccaaaccgtcctcaccatgaaatctaatattatttccttcttttagatttgacccctcagcttttatttcctatttaatttcccctaatatgaatagagacgctttcactttatttatttcatttgttatggtatcaaaatccacatcacgttgattattttttctatttaaagatttgtttcatttccaagttgtgcaattgaaaatgtatcgtcaccgtcctgaaatcgtcactacaactttttcaataagactacaaaatgacaagtttagttatctacacagtcaatatcacaaaatgtttggttcgacttttatgttcggtggctataaatgggttttacaaagttacatgaacaataataattatggtttacatgttaaatgtatgactttgtttatatatgagcttaaggaagtatttaaaattcaaaagtggtcaagttagccaaattggcggctattgaaacgtccacattgggtcaaagttcaaagaaacgcagccaatgctcttccggacttttcatcgtactttttttgttattaagaagaaaaactaagaaagtcacaagagagaaattcaaacaaaatttttatattagaagtcccaaaacataattcaaattaactaaactacgtcgtactatatgaaattcttattaaaatatctttttgaataatacttctgttgaataatatgtagaagaaaaagagaataaaaagaaccggttcaatctttgtcaaaaaaaataaaaagatttaagattaagccaactcaacctcaactatttttcaaagtgggcgtttttcaaattttctcaaacatagatctttttccaaatgaatacaaaaatataagggtcgacttgctattataaaaagttcctaaattctctcccgtgctcattttgaaaacctccctctttcgctgcaagcagagaaaaagacgacggagaaattttaaatctgaggttcttttagtcctcgcgaagccagatgctactctctattgcacgtctgtgacagaagagctcgattagggaactgaagacaaagacacggagaaattttgaactcgagaggtttgattttgaacctttgaatctctgggtttctgatttcttcgagatttaactaggtagttgaattgaatcctgataccaccttgaagcgtttttgttgtgctttctcagattatccatgatcatgtgatgcactaatttcgtagtattcaattgctgggattctgaaattagcaaaccttaaaatggttgatttgtggaaatttgtctaaccggttaatcggttaacagagttggaactagtgttatg

SEQ ID NO: 25956 - DNA, 3003 bp, Unknown
  misc_feature (1)..( 3003): 2750-1469P.txt file - cDNA_ID_2709354; gDNA_ID_2214565; Annot_ID_134932
ttattatttagagtgattctcactaaatcttaggcggttagcaaccgccatagttttcaaaatctcattctatcgggattaaatctgtttttggtgactatatataaacattggtcgaatttttaggtaagtaaaatcagagttatattgaaaagaatcatgaaattaaattacaaaccaaagtagaacccatgttttgcttttttctttaatttgactttaccaacgtcgagtttcagagaaacttaaagaaacaaatgcagaagcaaaaacttaaacggcaaaattgtaagaccccaaattacttattagaaaaagaatatgtatatgttaccttcaccagtgcaactcatatcactagacaactaagaccccgacgaaagaaaaagtttttaatatcaagattcattttcttacagtaatatcaagactttttcatcttttagactacaactttgaatacattgaagaaaactacaataagattgagaaaaattatgtttctctaagaaataaaaaagtaagatatatattaaggttaatttggaactgtattattttgaatcaaaaagaaactcaaaaagtgtgaaactcaaaattaagtctcctcatataatttgaaactcaaaatgaactaaaagtaaaccattaaatgatgtatgtatcctcaaacaatttttgaaacaatttaaaatttatctacgttactataaggatagaagagtacatatacttacttaaaagtgttatatttaaaatttataaatgtgctaaaaggaagaaagatagagcatccctatatataactgcaacatttatggactatcttttatgaaaacttaggctcaccacacttctttgtatacaaattgtatcatttatacatttatgaaaaattaatttggatgtattcatgtatagattgtcaaattaatttgtacacccacattttaaatatatgctaatattaggataagtattctgcattttaaatatctaatggcaatacaaagtttagttagtaaagtcaaaatagttaattatttttttctataacataataatttgaaaaatgtattatgtaatttgataatttgtacattaattttattagtataaagacaaataagttagattaaatacttatagaatttgttgacaaaaaaattaacaatattaaacgaaaatgacaggataatctgtatccagaaagatgatgtgtatacataactgcgtcaagacggatattgtatgaatatatgtaatagaacattaagaatcaaataaaaagatgtaagcatatgaagatgtaaaaaatgagtcatagtatcgacatatttagagtttgacttgatatgtttaagcttcattaccattatttttctctagctaagagaggagtcaacttgtgtgctacataggtccgtacattttatgtcgacattctttcgccattctttttgaaaaaagaaaaaggaaatattctttgtcttatatcttttcatcttttcgatttcttaattatttaaaaatagtatcgtaaaccagggtactcgtgacgacgtgtctgaatcagtctagtttgaattaatataatgaaaaactaatcactatgaagcaaacgatattaatttactctcttttttttcataatagtcgctctcgactacgtttacgatgcccacattttcctttgagaacatatattaatttgtagtcactatgaaaattaatactgttacatagaagacatatagaattccactttaacttgagttccacaagagcaaaaaataatatttctcctttttacaagatttaatttttctatgagactatattttcaacataattttgtgatatatgacttaaataaattaattttgatttcatatactaattatatgaactggataaacattttaattacgtcataatatcatatgtcatgcttccagttaatcgttatcggaggcttcggcccatgttgtctgaaaacccaagccatatcaatcatttcttcatacaaactaaaattccttcaattggagaagggatatgaaaataagagaacaatccaacaaacaaacacttacaaaaagatttagagacatttcctccagatcaatactcaattactcaccaaaattttgaacgatatatacttctgaactaaacatgttatacgcatctctcactcattaaaagctttcccaatatcatattaatcccgggatactttgaccatttattcatgtcgcatggacaactagttaagagtacatcgagacattgtatgagaatatcagtgtccccaaatctctgccaactccaccctggagaagggacatcacgtcggcaagattaaacgattactggtcgtacacagattcaaccttacctaacgcatgaacaaaccctccagtgagaaaaagacgcatcaccccatttacaattatcctcgcgcggactaatcccaagtcgaggacgcaactaaagctctgagactcatgatgagtttcctatttcatacccaaacgatatagtaatatcaaattattgctatattaattaaattaaacaattcgttcaagttgactttcattagatatgatcagatttgtctcttatgaatcgtaactaataatgcgcattattatataaaacaagtttaaatacatggtatacttcctaaaaaattacgtattgagtttgaattaattttaccatcaagatctcgtgaagataaaagggcaaaacgagatacaaaatcattagttgaatattttagtttttgttagtttaagaagttcaatatcttattaacgaatgaccaaacgaacaaaattaatactaccacacatttttatatgatattaatatacgtatatatacattcagtacttccattaccataccaagcttttctcttcttttcatcatcaagaatccaacctatccggttcataaaagccctaattttaaaataagatagagattatg

SEQ ID NO: 25957 - DNA, 3003 bp, Unknown; identical to SEQ ID NO: 25956
  misc_feature (1)..( 3003): 2750-1469P.txt file - cDNA_ID_2709354; gDNA_ID_2214565; Annot_ID_185975

SEQ ID NO: 25958 - DNA, 3003 bp, Unknown
  misc_feature (1)..( 3003): 2750-1469P.txt file - cDNA_ID_2709371; gDNA_ID_2214565; Annot_ID_134939
ccgaatacttgctttgtgatgtgttgcatatgtatgtagaaatctaagagctttcaattggtaacttgaatcgttatgaagattagtaagttctttttgttgagtgttttaattggtgtgcatgtatgtttttgcattgtaaatttcagttgactgaaatcttgtaaatttatttagtcttgtgtcgctgcatcttgcatgttaaggttacaaaatcaattttattagttggaaatgtaaaagtcagatgttctcttgtctctataggtcaggtttaatgtatatatcgtatgtgtgatacttttgttgaatttattcagttggaagaaactgtaaagcatgatgagaatggaaagcctgtaaaacgattgaggagaagagaaactttagtgcattcagaaaatgttgctggaagaagcttttggaatgagcactcctctcttcataaagatcttggacattttgcaaaagacattggcaaaattgaaccagattatgttaagtcgtttcagtttgagagtagattattacctttaacttgggttgtggttaggattgatggctgccattttcacaggtaatatgctttttagtctttgtttattttcattgttagacaatgtgtcttgcatggaagccttagacttgttaaaaaatatacatatgttccctacgatttccttaagctataatgctatattacaagtttatacacttctgaatgctatggtcggtctattcttacattgcgattgcttttgtgctctgctttaaattgtgatttattaggcaatgcttctactttttggaacttagaaaacatataagaacagtagttgacagctttgacaaacaaacgcctgcctattgcttgaatgattactatcgttatattgtaagtgaaactcatagagcttgctttggattttgatagattttctgaagttcatgaatttgagaagccaaatgatgagcaagctctgaaacttatgaattcatgtgcagtggctgttcttgaggagtttcaggatattgcctttgcctacggcgttagtgatgagttcaggtatgtaactctcagcccctttaaaccaagtttacatttctagatactaatcgagttcatctttggtttgcagctttgttcttaagaataaatctgagctttacaaaagacagtccaggtcagactagttttctatgcccttaagttttcttgttgcaggataaacttatctgtcttctcctaggttttcttgttcttttcagtctttataactttaatttctatatcttgttacagtaagataatatctgcagtagtatccttcttcacatcgacttacatgatgagatggggagattttttccctcacaaaaaattgaagtaccctccatcattcgatggacgagctgtttgctatccaacatcagatattctcctggattatctagcttggagacaagtcgactgtgagtatacttgtcttataaatgattcacttgtcttgtgagattgttgcttgatatcaaatagactcgtagtttgagttggatgctcctttcagcaattttgttttgtcttgcaggccatatcaacaatcagtataatacatgtttctggatgcttgttaagtctggaaaaagcaaaattcaagcccaggattacttaaaggtgctttgttcgagtagccaatgctccctcttagttcaatgaataaatggcttgtcacttacatttggctctgtttcagggtacccagacacgagaaaaaaacgagttacttagccagcaatttggaattgagtacaattcattacctgtaatcttccgcatgggttcttccgttttccgcctaaaggtgctacttttattatcatactccaaaatccttctagtgtttcatagcagattcttattattgtgaagaaaagaagggtcctttcaagagaaaccttttaaggcattcttgtttttacaagtggtctgaaatagttttaaacaagtggtctgaaataagtggtctgaaatagtttttacatttagacgcaggaaggtgttacagaggagaatggagaagtttcaggaaagcaagtggaagcagaagtgggcgtagactattcaaacattatcgaccaatgtttctggcaacaacatcctcacattcttagcttctcctaagacaggtattcattgctaccaaaaaaaaattccaaaccgaaaaccgaatgagattcagctcttattttgataaaccgaagctaaagtacaaaacaatcgaaccgaatggtttacttttttctttcactattttttgtttttttccattattttaaattaacctttttcaatttggtagttaattttttccttcaatgagagatttgggttgttaattttcctttgactggtaggataagcaatattagtgcttttcttttttttggtaaagtaagattcgtaaaatgtattgactaaaatgataaaagaggaagaaaatctcatccaaattttttgactaatatgttcatctaaggtaagttgacccaaagtgagatacattgtgttcttgcctaatgattactatagtagaatctcattccaagcacaacaatatttttaaattaatttcaaggggaattccctaattttcaattaatttgtatttataacacctaggtagatttttctctattaattgaaagaaagttccattactaattaattaattagagatttttaacttcaatcataggtgctaataacacaattaataatattttatttctttcattcctttttcaccattttaaaaaagtttattaattaaataaaaaaataagcgttacctccttcgacgatcagacgattctgccattgtcatacatttggcttagctcgtaacgtttcctctctctctctctctcgttccacaccactacattctccgtccgtcagaatcttcgaatttacctgttccgccaatcactcctcgcgtaatg
